(12) United States Patent
Coffin

(10) Patent No.: US 10,167,482 B2
(45) Date of Patent: Jan. 1, 2019

(54) GENES AND USES FOR PLANT ENHANCEMENT

(71) Applicant: Monsanto Technology LLC, St. Louis, MO (US)

(72) Inventor: Marie Coffin, Cary, NC (US)

(73) Assignee: Monsanto Technology LLC, St. Louis, MO (US)

(*) Notice: Subject to any disclaimer, the term of this patent is extended or adjusted under 35 U.S.C. 154(b) by 266 days.

(21) Appl. No.: 14/757,273

(22) Filed: Dec. 10, 2015

(65) Prior Publication Data

US 2016/0244777 A1    Aug. 25, 2016

Related U.S. Application Data

(63) Continuation of application No. 13/385,376, filed on Feb. 16, 2012, which is a continuation of application No. 12/157,153, filed on Jun. 5, 2008.

(60) Provisional application No. 60/933,428, filed on Jun. 6, 2007.

(51) Int. Cl.
    *C12N 15/82*    (2006.01)
    *C12Q 1/6895*   (2018.01)

(52) U.S. Cl.
    CPC ..... *C12N 15/8261* (2013.01); *C12N 15/8247* (2013.01); *C12N 15/8251* (2013.01); *C12N 15/8262* (2013.01); *C12N 15/8267* (2013.01); *C12N 15/8271* (2013.01); *C12N 15/8273* (2013.01); *C12N 15/8274* (2013.01); *C12N 15/8275* (2013.01); *C12Q 1/6895* (2013.01); *Y02A 40/146* (2018.01)

(58) Field of Classification Search
    None
    See application file for complete search history.

(56) References Cited

U.S. PATENT DOCUMENTS

| | | |
|---|---|---|
| 6,096,953 A | 8/2000 | Hoffbeck |
| 2003/0140380 A1 | 7/2003 | Henkes et al. |
| 2003/0233067 A1 | 12/2003 | Yongwei et al. |
| 2003/0233675 A1 | 12/2003 | Cao et al. |
| 2004/0123343 A1 | 6/2004 | La Rosa et al. |
| 2004/0216190 A1 | 10/2004 | Kovalic |
| 2006/0048240 A1 | 3/2006 | Alexandrov et al. |
| 2006/0150283 A1 | 7/2006 | Alexandrov et al. |
| 2011/0214199 A1 | 9/2011 | Coffin |
| 2013/0305398 A1 | 11/2013 | Coffin |

FOREIGN PATENT DOCUMENTS

| | | |
|---|---|---|
| WO | WO-2006076423 A2 | 7/2006 |
| WO | WO-2007044043 A2 | 4/2007 |
| WO | WO-2008153927 A2 | 12/2008 |
| WO | WO-2008153927 A3 | 12/2008 |
| WO | WO-2009091518 A2 | 7/2009 |
| WO | WO-2009134339 A2 | 11/2009 |

OTHER PUBLICATIONS

Weigel et al 2000 (Plant Physiology 122: p. 1003-1013).*
Theologis et al 2000 (Nature 408: p. 816-820).*
"European Application Serial No. 14181041.6, Communication Pursuant to Article 94(3) EPC dated Feb. 13, 2017", 3 pgs.
"European Application Serial No. 14181041.6, Office Action dated Mar. 2, 2015", 2 pgs.
"European Application Serial No. 14181041.6, Response filed Aug. 25, 2015 to Office Action dated Mar. 2, 2015", 10 pgs.
"U.S. Appl. No. 12/157,153, Non Final Office Action dated Oct. 17, 2011", 17 pgs.
"U.S. Appl. No. 12/157,153, Response filed Aug. 22, 2011 to Restriction Requirement dated Jun. 21, 2011", 11 pgs.
"U.S. Appl. No. 12/157,153, Restriction Requirement dated Jun. 21, 2011", 11 pgs.
"U.S. Appl. No. 13/385,376, Final Office Action dated Sep. 10, 2015", 17 pgs.
"U.S. Appl. No. 13/385,376, Non Final Office Action dated Feb. 27, 2015", 18 pgs.
"U.S. Appl. No. 13/385,376, Preliminary Amendment filed Feb. 16, 2012", 7 pgs.
"U.S. Appl. No. 13/385,376, Response filed Feb. 13, 2015 to Restriction Requirement dated Dec. 16, 2014", 8 pgs.
"U.S. Appl. No. 13/385,376, Response filed Jun. 26, 2015 to Non Final Office Action dated Feb. 27, 2015", 8 pgs.
"U.S. Appl. No. 13/385,376, Restriction Requirement dated Dec. 16, 2014", 6 pgs.
"European Application Application Serial No. 08768181.3, Communication dated Sep. 9, 2010", 1 pg.
"European Application Application Serial No. 08768181.3, Response filed Mar. 16, 2011 to Communication dated Sep. 9, 2010", 8 pgs.
"European Application Serial No. 08768181.3, Communication dated Jan. 19, 2010", 2 pgs.
"European Application Serial No. 08768181.3, Communication noting loss of rights dated Sep. 11, 2012", 1 pg.
"European Application Serial No. 08768181.3, Extended European Search Report dated Aug. 23, 2010", 6 pgs.
"European Application Serial No. 08768181.3, Office Action dated Jan. 26, 2012", 4 pgs.
"European Application Serial No. 08768181.3, Response filed Feb. 16, 2010 to Communication dated Jan. 19, 2010", 10 pgs.
"European Application Serial No. 12179231, Communication noting of loss of rights dated Aug. 19, 2013", 1 pg.

(Continued)

*Primary Examiner* — Matthew R Keogh
(74) *Attorney, Agent, or Firm* — Schwegman Lundberg & Woessner, P.A.

(57) ABSTRACT

Transgenic seed for crops with enhanced agronomic traits are provided by trait-improving recombinant DNA in the nucleus of cells of the seed where plants grown from such transgenic seed exhibit one or more enhanced traits as compared to a control plant. Of particular interest are transgenic plants that have increased yield. The present invention also provides recombinant DNA molecules for expression of a protein, and recombinant DNA molecules for suppression of a protein.

13 Claims, 7 Drawing Sheets

Specification includes a Sequence Listing.

(56) References Cited

OTHER PUBLICATIONS

"European Application Serial No. 12179231, European Search Report dated Dec. 10, 2012", 6 pgs.
"European Application Serial No. 12179231, Invitation to Remedy Deficiencies dated Aug. 16, 2012", 1 pg.
"European Application Serial No. 12179231, Reply filed Oct. 19, 2012 to Invitation to Remedy Deficiencies dated Aug. 16, 2012", 4 pgs.
"European Application Serial No. 13174081.3, European Search Report dated Jan. 17, 2014", 6 pgs.
"European Application Serial No. 13174081.3, Invitation to Remedy Deficiencies dated Jul. 17, 2013", 1 pg.
"European Application Serial No. 13174081.3, Reply filed Sep. 25, 2013 to Invitation to Remedy Deficiencies dated Jul. 17, 2013", 5 pgs.
"European Application Serial No. 14181041.6, Extended European Search Report dated Jan. 26, 2015", 7 pgs.
"International Application Serial No. PCT/US2008/007105, International Preliminary Report on Patentability dated Dec. 17, 2009", 10 pgs.
"International Application Serial No. PCT/US2008/007105, International Search Report dated Jan. 30, 2009", 5 pgs.
"International Application Serial No. PCT/US2008/007105, International Written Opinion dated Jan. 30, 2009", 6 pgs.
"RNA Recognition Motif-Containing Protein (*Arabidopsis thaliana*) (AEE75400)", http://www.ncbi.nlm.nih.gov (submitted Feb. 18, 2011), (Feb. 18, 2011), 2 pgs.
"RNA Recognition Motif-Containing Protein (*Arabidopsis thaliana*) (NP_187983)", http://www.ncbi.nlm.nih.gov (submitted Feb. 18, 2011), (Feb. 18, 2011), 2 pgs.
"RNA Recognition Motif-Containing Protein (B3H4P0_ARATH)", http://www.uniprot.org (last modified Jul. 22, 2008), (Jul. 22, 2008), 2 pgs.
"RNA-Binding Protein, Putative (IPI00523019.1)", http://www.ebi.ac.uk (created Jan. 5, 2005), (Jan. 5, 2005), 1 pg.
"Subname: Full=Transducin/WD40 domaining-containing protein; Subname: Full-WD40-repeat protein", Retrieved from EBI Accession No. UNIPROT:Q9LFE2 [online]. [retrieved on Nov. 26, 2012]. Retrieved from the Internet: <URL: http://www.uniprot.org/uniprot/Q9LFE2.txt>, 2 pgs.
Bork, P., et al., "Go hunting in sequence databases but watch out for the traps", TIG, vol. 12, No. 10, (1996), 425-427.
Clinton, R, et al., "Alternative oxidases in *Arabidopsis*: A comparative analysis of differential expression in the gene family provides new insights into function of non-phosphorylating bypasses", Biochim Biophys Acta., 1757(7), (Jul. 2006), 730-741.
De Angeli, et al., "", Nature 442:24, (2006), 939-942.
Doerks, Tobias, et al., "Protein Annotation: detective work for function prediction", Trends in Genetics, vol. 14, No. 6, (1998), 248-250.
Frame, et al., "", Plant Physiology 129, (2002), 13-22.
Geelen, et al., "", Genbank Accession # AF044313, (1998).
Geelen, et al., "", The Plant Journal 21:3, (2000), 259-267.
Guo, H. H., et al., "Protein tolerance to random amino acid change", Proc. Natl. Acad. Sci. USA, 101, (2004), 9205-9210.
Hechenberger, "A family of putative chloride channels from *Arabidopsis* and functional complementation of a yeast strain with a CLC gene disruption", Journal of Biological Chemistry, vol. 271, No. 52 (Dec. 1, 1996), 33632-33638.
Keskin, O., et al., "A new, structurally nonredundant, diverse data set of protein-protein interfaces and its implications", Protein Science, 13, (2004), 1043-1055.
Lorkovic, Z. J., et al., "Genome analysis: RNA recognition motif (RRM) and K homology (KH) domain RNA-binding proteins from the flowering plant *Arabidopsis thaliana*", Nucleic Acids Research, 30, (2002), 623-635.
Mitchell, R A, et al., "A novel bioinformatics approach identifies candidate genes for the synthesis and feruloylation of arabinoxylan", Plant Physiol., 144(1), (May 2007), 43-53.
Mitchell, Rowan A, et al., "A Novel Bioinformatics Approach Identifies Candidate Genes for the Synthesis and Feruloylation of Arabinoxylan", Plant Physiology, 144(1), (2007), 43-53.
Ngo, J. Thomas, et al., "In the Protein Folding Problem and Tertiary Structure Prediction", Merz, et al., (ed.), Birkhauser, Boston, MA, (1994), 492-495.
Nishimura, A., et al., "Over-expression of tobacco knotted1-type class1 homeobox genes alters various leaf morphology", Plant Cell Physiol., 41(5), (2000), 583-590.
Saisho, D, et al., "Characterization of the gene family for alternative oxidase from *Arabidopsis thaiana*", Plant Mol Biol., 35(5), (Nov. 1997), 585-96.
Salanoubat, et al., "NCBI", GenBank Accession No. NP_187983, (Aug. 13, 2001), 1-2.
Sivasankar, et al., "", Plant Physiology 114, (1997), 583-589.
Smith, Temple F, et al., "The Challenges of Genome Sequence Annotation or "The Devil is in the Details"", Nature Biotechnology, 15(12), (Nov. 1997), 1222-1223.
Sonnhammer, E. L, et al., "Pfam: a comprehensive database of protein domain families based on seed alignments.", Proteins, 28(3), (Jul. 1997), 405-420.
Thornton, J. M., et al., "From structure to function: Approaches and limitations", Nature Structural Biology—Structural Genomics Supplement, (Nov. 2000), 991-994.
Wells, J. A., "Additivity of Mutational Effects in Proteins", Biochemistry, 29(37), (1990), 8509-8517.
Zhou, et al., "", Biotechnology Letters 31, (2009), 1811-1815.
"European Application Serial No. 14181041.6, Communication Pursuant to Article 94(3) EPC dated Oct. 2, 2017", 4 pgs.
"European Application Serial No. 14181041.6, Response filed Jun. 23, 2017 to Communication Pursuant to Article 94(3) EPC dated Feb. 13, 2017", 14 pgs.
"European Application Serial No. 14181041.6, Response filed Feb. 7, 2018 to Communication Pursuant to Article 94(3) EPC dated Oct. 2, 2017", 18 pgs.

\* cited by examiner

SEQ ID NO

```
4038        ------------------------------------------------------------
3777        ------------------------------------------------------------
27198       ------------------------------------------------------------
7302        ------------------------------------------------------------
44992       ------------------------------------------------------------
66893       ------------------------------------------------------------
768         ------------------------------------------------------------
15584       ------------------------------------------------------------
42579       ------------------------------------------------------------
45333       MSYSNSNPENYSAATSSPELKLYQAFIFSVPICFTFIILFLFYLIYLRRSSSDLSSLGMR
19299       ------------------------------------------------------------
21692       ------------------------------------------------------------
57173       ------------------------------------------------------------
57659       ------------------------------------------------------------
4374        -------------------------MARNPTRTVYIGNLDEKVTERILYEILIQPGR
55005       ------------------------------------------------------------
42612       ------------------------------------------------------------
67783       ------------------------------------------------------------
consensus ------------------------------------------------------------
            ------------------------------------------------------------
            ------------------------------------------------------------
            ------------------------------------------------------------
            ------------------------------------------------------------
            ------------------------------------------------------------
            ------------------------------------------------------------
            ------------------------------------------------------------
            ------------------------------------------------------------
            ------------------------------------------------------------
            TTFIPGNSLSTIELGLSKELREMLPIVVFKESFTVMDSQCSVCLGDYQPNDKLQQIPVCK
            ------------------------------------------------------------
            ------------------------------------------------------------
            ------------------------------------------------------------
            ------------------------------------------------------------
            VVDLCIPRDKETSCPKGYAFAEYETEEIAQYAVQLFSGLVRLYGKTLKFAISGQDKPSSN
            ------------------------------------------------------------
            ------------------------------------------------------------
            ------------------------------------------------------------

---------------MNQDLAKVQTEEDDFLIEISGEAPLTYSTLEGCVPPTFRSMTVGPI
            ------------------------------------------------------------
            ------------------------------------------------------------
            ------------------------------------------------------------
            -------------------------------MSTVPREFAGLDPRSADFHPALTRCPV
            ------------------------------------------------------------
            ------------------------------------------------------------
            ------------------------------------------------------------
            ------------------------------------------------------------
            HTFHMDCIDLWLTSHTTCPLCRLALIPSRSRQSQDDPVPSLVSPDEEVSSQPESEPVNHR
            ------------------------------------------------------------
```

FIG. 4A

```
------------------------------------------------------------------
------------------------------------------------------------------
------------------------------------------------------------------
GNNPVMPKLNPVPLPKQPQFVHHSDMHVLHTPADPMHYQLDPCIATEGSAMVWRLCFECC
------------------------------------------------------------------
------------------------------------------------------------------
------------------------------------------------------------------
------------------------------------------------------------------

YQVFDMGGNAVSVQRHGNFASVGILTLVSTRAK---PLEVEIAKE---------------
-MVFDMGGNAVSVQRHGNFASVGILTLVSTRAK---PLEVEIAKE---------------
----------MNSRRS------RSVKLVSTRAK---PLEVEIAKE---------------
----------MNSRRS------RSVKLVSARANGDGALEVDVPEEEG--------------
TCGFCCAGRLIRRAPWMNSRRSRSVKLVSARANGDGALEVDVPEEEG--------------
-----------------------------------MGLIKN-------------------
-----------------------------------MGLIKN-------------------
-----------------------------------MGLIKN-------------------
----------------------------------MG-SIQN------------------
VVSTQPESEPVNHSGVSSQPESQPVVNHRGVSSQPESQPVN-HINDGHEQQCDQDVEGFK
-----------------------------------MGS---------------------
-------------------------------------------------------------
----------------------------------MDSIQN-------------------
-------------------------MKMESPGVQPAAAGEEEGGG--------------
WPWSSEATNVVSVLLGTKEGNLPREEAMKMESPGVQPAAAGEEEGGG--------------
-------------------------MEVEADGIQEATAGAGDGGGX--------------
-------------------------MEVEADGIQEATAGAGDGGG---------------
----------xxxxxx------xxxxxxxxxxxxxxxxxxxxxxx---------------

-----------DERMSSSADNTVYCCIAKGR----KIIYCYNSKDGDPHME---TTAALC
-----------DERMSSSADNTVYCCIAKGR----KIIYCYNSKDGDPHME---TTAALC
-----------DERMSSSADNTVYCCIAKGR----KIIYCYNSKDGDPHME---TTAALC
-----------DERMSSSADNTVYCCIAKGR----KIIYCYNSKDGDPHME---TTAALC
-----------DARMSSSAANXVYWCIGRGR----SVIYRYSSKGGDPQAE---ATAALC
-------------------TVHYCCVSRDN----QILYSYNGG--DQTNE---SLAALC
-------------------TVHYCCVSRDN----QILYSYNGG--DQTNE---SLAALC
-------------------TVHYCCVSRDN----QILYAYNGG--DQSNE---SLAGLC
-------------------TVHYCCVSRDN----QIMYAYNNAGDHRNNE---SLAALC
EMEEDERNNIGTSSACCSCRTVHYCCVSRDN----QIMYAYNNAGDHRNNE---SLAALC
-------------------TVHYCCVSRGN----QILYGYNNGGDHHRNE---SLAALC
-----------------------WCVSRGT----HILYGYNCGRHPPRNE---SLSALC
-------------------KVYYCCVSKGN----NVLYVYGGG--DQEVE---KVAALC
-------------------GVFFCVAVTSRGRTDRLSYFQAEGDGDDAEEVARATAALC
-------------------GVFFCVAVTSRGRTDRLSYFQAEGDGDDAEEVARATAALC
-------------------GTHVFFCVAATSRGNKNSISYFHTNAVGEDAES-ALALAALC
-------------------VDDVFFCVAATSRGNKNSISYFHTNAGGEDAES-ALALAALC
----------xxxxxxxxxxxxxyccxxxxx----xixYxyxxxxxxxxxe---xxaaLC LENAPLYHRHYIHTAG-SRSYGYLMADG-HTFFAIIDPSVGNVGALQFLERVREVFRTVN
LENAPSYHRHYIHTAG-SRSYGYLMADG-HTFFAIIDPSVGNVGALQFLERVREVFRTVN
LENAPSYHRHYIHTAG-SRSYGYLMADG-HTFFAIIDPSVGNVGALQFLERVREVFRTVN
LENAPSYHRHYIHTAG-SRSYGYLMADG-HTFFAIIDPSVGNVGALQFLERVREVFRTVN
LDRSPPHHRHYVHTSG-RRSYGYLTADG-HTFFAIIDPSVGSAGALQFLERVRDAFRSSA
LEKSPPFHTWYFETIG-KRRFGFLIGDG-FVYFAIVDEVLKRSSVLKFLEHLRDEFKKAA
LEKSPPFHTWYFETIG-KRRFGFLIGDG-FVYFAIVDEVLKRSSVLKFLEHLRDEFKKAA
LEKTPPFHAWYFESIG-KRRFGFLTGDG-FVYFAIVDEVLGKVSVLKFLEHLR-------
```

FIG. 4B

```
LEKTPPFHKWYFETRG-KKTFGFLMKDD-FVYFAIVDDVFKKSSVLDFLEKLRDELKEAN
LEKTPPFHKWYFETRG-KKTFGFLMKDD-FVYFAIVDDVFKKSSVLDFLEKLRDELKEAN
LEKTPPFHKWYFETIS-KWTFGFLIEEDGLVYFAIVDEVFKRSSVLXFLENLRDELKKAA
LKNTPPFHVWYFEPIC-KRTFGFLIEKDALVYLPFVDEVFERSRVLEFLETLRDELENAH
LERAPPFHRWYFETIG-KRTFGFFMEDG-YVYFTIVDKGLGNPVVLQFLEHVRDEFKKLA
LDHAPEHHHWHHHTVVGRRTFAFLAGDDGRTYFAVADPTPGSAETVRFLQRVRDAFGSCG
LDHAPEHHHWHHHTVVGRRTFAFLAGDDGRTYFAVADPTPGSAETVRFLQRVRDAFGSCG
LDHAPDHHRWHHHTVAGAKTFAFLSADDGRTYFAAADPSPGAAEVVRFLERVRDACD---
LDHAPDHDRWHHHTVARTKTFTFLSADDGRTYFAAADPSPGAAEVVRFLERVRDACD---
LxxxPxxhxwyxxtxx-xrxfgflxxdxxxxyfaixDxxxxxxxxlxFLexxRdxxxxxx RSG------------FHDSLVPAVQRLVASLEKMPRATFD-----------LEESVEKG
RSG------------FHDSLVPAVQRLVASLEKMPHATFD-----------LEESVEKG
RSG------------FHDSLVPAVQRLVASLEKMPHATFD-----------LEESVEKG
RSG------------FHDSLVPAVQRLVASLEKMPHATFD-----------LEESVEKG
GVGGR----------QPHESLVPAVQRLVASLEKMPHAAFV-----------LDG-AGAG
RENSRGSFTAMIGSINVEDQLVPVVTRLIASLERVAESSS------------NNELKSSN
RENSRGSFTAMIGSINVEDQLVPVVTRLIASLERVAESSS------------NNELKSSN
------------------------------------------------------------
KKNSRGSFSGSISFSNVQDQIV---RRLIASLE-FDHTCL------------PLSSPSID
KKNSRGSFSGSISFSNVQDQIV---RRLIASLE-FDHTCL------------PLSSPSID
EKNSRGSFS---------------------------------------------------
ENISRGLFSGSIFFNCVQDPLV---RTLISSLERVAESTN-----------PLTCLPI-
RKGSRGILP-NMNSIYIQEKLVPVIRGLITSLESVSHGSSNWRDETSLSFQVDLSPSPSN
GGGGGGATRRR---NQRDDAVDAVVWQFVRALR-ASAGRGT---------------AAL
GGGGGGATRRR---NQRDDAVDAVVWQFVRALR-ASAGRGT---------------AAL
------AAPRK---RLRDEAVAPVARQFARTLRAAAAGPSS---------------GAE
------AAPRK---RLRDEAVAPVARQFARTLRAAAAGPSS---------------GAE
xxxxxxxxxxxxxxxxxxxxxxxxxxxxxxxxlxxxxxxxxx-----------xxxxxxx EPSDSSSCTSSKVPLLGRSGSRKDKKKAKEKAASAA------VCEDEQHGTR----GVRI
EPSDSSSCTSSKVPLLGRSGSRKDKKKAKEKAASAA------VCEDEQHGTR----GVRI
EPSDSSSCTSSKVPLLGRSGSRKDKKKAKEKAASAA------VCEDEQHGTR----GVRI
EPSDSSSCTSSKVPLLGRSGSRKDKKKAKEKAASAAG-----LXEDEQHGTR----GVRX
AGDGDGCTSSSKAPLLGKSGSRKEKRRSRDKLSSSAAGAGAGGCEDEHHGTR----AVRI
LGEQSEGSNSTKAPLLGRL-SKQEKKKGKDHV-----IELEEHRKSNDRGN---------
LGEQSEGSNSTKAPLLGRL-SKQEKKKGKDHV-----IELEEHRKSNDRGN---------
------------------------------------------------------------
GAEQSYASNS-KAPLLGRS-NKQDKKKGRDHAHSLRGIEIEEHRKSNDRGN---------
GAEQSYASNS-KAPLLGRS-NKQDKKKGRDHAHSLRGIEIEEHRKSNDRGN---------
------------------------------------------------------------
LNGQIEGASSTKAPLLGKS-NKPDKKKVKDHVIAMRDVELEEHQKSTDRGARVDSCNLDG
FPGDDSRGGGDASSADGDKDDEEEEDDR--------------------------------
FPGDDSRGGGDASSADGDKDDEEEEDDR--------------------------------
LPEASLQAKEPSTPLAPVCEKDEEERQR--------------------------------
LPEASLQAKEPSTPLAPVCEKDEEERQR--------------------------------
xxxxxxxxxxxxxplxgxxxxxxxxxxxxxxxxxx-xxxxxxxxxxxxx----xxxx DVPP-EQVGGMSLERSASQSRLRRQHSSRSLWVRHVK---------------IIIVV
DVPP-EEVGGMSLERSASQSRLRRQHSSRSLWVRHVK---------------IIIVV
DVPP-EEVGGMSLERSASQSRLRRQHSSRSLWVRHVK---------------IIIVV
DVPP-EEVGGMSLERSASQSRLRRQHSSRSLWVRHVK---------------IIIVV
DVMPAEDVGGMSLERSGSQSRLRRQQSSRSLWMRHVK---------------VIVAV
```

FIG. 4C

```
ITDDSAGAGTSLEKECVSSSGRSVTQSFEWKWRRPINRLRETNLPKEKNQQNQNKATVSL
ITDDSAGAGTSLEKECVSSSGRSVTQSFEWKWRRLV------------------QIVLAI
------------------------------------------------------------
VTECSN-ASSESATYVPRRGRSGGSQSIERKWRRQV------------------KIVLAI
VTECSN-ASSESATYVPRRGRSGGSQSIERKWRRQV------------------KIVLAI
------------------------------------------------------------
VSQGGAGASVSLQKDMGSMRMRSAPQNIRKKWWRQVR-----------------IVLAI
--------GGE---AMAVAADGARRRT-RRSWWRYSK-----------------VVIGV
--------GGE---AMAVAADGARRRT-RRSWWRYSK-----------------VVIGV
--------AGERRRAFLQPEESASALPGWRPWWRHAS-----------------VVIVV
--------AGERRRAFLQPEESASALPGWRPWWRHAS-----------------VVIVV
xxxxxxxxxxxxxxxxxxxxxxxxxxxxxwxIxxx-------------------xxxxx DAIICIL--------------------LFAAWLAVCKGFQCVSS----------------
DAIICIL--------------------LFAAWLAVCKGFQCVSS----------------
DAIICIL--------------------LFAAWLAVCKGFQCVSS----------------
DAIICIL--------------------LFAAWLAVCKGFQCVSS----------------
DAVVCLV--------------------LLAAWLAVCKGFQCVSG----------------
SLSLSLTSSPPFSPLKPDQKPSFIRALLGQQMFTSGNVTARVFERQIRTPPPGASVNRAR
DAAICLT--------------------LFGIWLAICR----------------GIECTRS-
------------------------------------------------------------
DIAICLT--------------------LLGVWLAICHGIECTRS----------------
DIAICLT--------------------LLGVWLAICHGIECTRS----------------
------------------------------------------------------------
DAAVCIL--------------------LFIIWLVICHGISCIR-----------------
ELVLFLV--------------------LFVVWMIVCKGFNCVQR----------------
ELVLFLV--------------------LFVVWMIVCKGFNCVQR----------------
DVVLCLV--------------------LFAVWMGVCKGFGCLR-----------------
DVVLCLV--------------------LFAVWMGVCKGF--------------------
xxxxxxx--------------------lxxxwxxxcxgxxxxxx----------------

------------------------------------------------------------
------------------------------------------------------------
------------------------------------------------------------
------------------------------------------------------------
HFYENLVPSYTLYDVESPDHCFRKFTEDGLFLISFSRNHQELIVYRPSWLTYSTTDDSTT
------------------------------------------------------------
```

FIG. 4D

GENES AND USES FOR PLANT ENHANCEMENT

RELATED APPLICATIONS

This application is a continuation of U.S. patent application Ser. No. 13/385,375, filed on Feb. 16, 2012, which application is a continuation of U.S. patent application of U.S. patent application Ser. No. 12/157,153, filed on Jun. 5, 2008, which application the benefits of priority to U.S. Provisional Application Ser. No. 60/933,428, filed Jun. 6, 2007, the contents of which are incorporated herein by reference in their entireties.

INCORPORATION OF SEQUENCE LISTING

Two copies of the sequence listing (Copy 1 and Copy 2) and a computer readable form (CRF) of the sequence listing, all on CD-Rs, each containing the file named "38-21(54866)A_seqListing.txt", which is 239,913,045 bytes (measured in MS-WINDOWS) and was created on Jun. 5, 2008, are incorporated herein by reference in their entirety.

INCOPORATION OF TABLES

Two copies of Table 16 on CD-ROMs, each containing the file named "38-21(54866)A_table16.txt", which is 646,705 bytes when measured in MS-WINDOWS ® operating system, was created on Jun. 5, 2008, and comprises 150 pages when viewed in MS Word ® program, are incorporated herein by reference in their entirety.

FIELD OF THE INVENTION

Disclosed herein are recombinant DNA useful for providing enhanced traits to transgenic plants, seeds, pollen, plant cells and plant nuclei of such transgenic plants, methods of making and using such recombinant DNA, plants, seeds, pollen, plant cells and plant nuclei. Also disclosed are methods of producing hybrid seed comprising such recombinant DNA.

SUMMARY OF THE INVENTION

This invention provides recombinant DNA constructs comprising polynucleotides characterized by SEQ ID NO: 1-759 and the cognate amino acid sequences of SEQ ID NO: 760-1518. The recombinant DNA is useful for providing enhanced traits when stably integrated into the chromosomes and expressed in the nuclei of transgenic plants cells. In some aspects the recombinant DNA encodes a protein; in other aspects the recombinant DNA is transcribed to RNA that suppresses the expression of a native gene.

Such recombinant DNA in a plant cell nucleus of this invention is provided in as a construct comprising a promoter that is functional in plant cells and that is operably linked to DNA that encodes a protein or to DNA that results in gene suppression. Such DNA in the construct is sometimes defined by protein domains of an encoded protein targeted for production or suppression., e.g. a "Pfam domain module." (as defined herein below) from the group of Pfam domain modules identified in Table 17. Alternatively, e.g. where a Pfam domain module is not available, such DNA in the construct is defined a consensus amino acid sequence of an encoded protein that is targeted for production e.g. a protein having amino acid sequence with at least 90% identity to a consensus amino acid sequence in the group of SEQ ID NO: 67782 through SEQ ID NO: 67894. In a particular aspect of the invention the recombinant DNA is characterized by its cognate amino acid sequence that has at least 70% identity to any of SEQ ID NO: 760-1518.

This invention also provides transgenic plant cell nuclei comprising the recombinant DNA of the invention, transgenic plant cells comprising such nuclei, transgenic plants comprising a plurality of such transgenic plant cells, and transgenic seeds and transgenic pollen of such plants. Such transgenic plants are selected from a population of transgenic plants regenerated from plant cells transformed with recombinant DNA by screening transgenic plants for an enhanced trait as compared to control plants. The enhanced trait is one or more of enhanced water use efficiency, enhanced cold tolerance, increased yield, enhanced nitrogen use efficiency, enhanced heat tolerance, enhanced shade tolerance, enhanced high salinity tolerance, enhanced seed protein and enhanced seed oil. Such recombinant DNA in a plant cell nucleus of this invention is provided in as a construct comprising a promoter that is functional in plant cells and that is operably linked to DNA that encodes a protein or to DNA that results in gene suppression. Such DNA in the construct is sometimes defined by protein domains of an encoded protein targeted for production or suppression., e.g. a "Pfam domain module" (as defined herein below) from the group of Pfam domain modules identified in Table 17. Alternatively, e.g. where a Pfam domain module is not available, such DNA in the construct is defined a consensus amino acid sequence of an encoded protein that is targeted for production e.g. a protein having amino acid sequence with at least 90% identity to a consensus amino acid sequence in the group of SEQ ID NO: 67782 through SEQ ID NO: 67894.

In another aspect of the invention the plant cell nuclei, cells, plants, seeds, and pollen further comprise DNA expressing a protein that provides tolerance from exposure to an herbicide applied at levels that are lethal to a wild type plant cell.

This invention also provides methods for manufacturing non-natural, transgenic seed that can be used to produce a crop of transgenic plants with an enhanced trait resulting from expression of stably-integrated, recombinant DNA in the nucleus of the plant cells. More specifically the method comprises (a) screening a population of plants for an enhanced trait and recombinant DNA, where individual plants in the population can exhibit the trait at a level less

---

LENGTHY TABLES

The patent contains a lengthy table section. A copy of the table is available in electronic form from the USPTO web site (http://seqdata.uspto.gov/?pageRequest=docDetail&DocID=US10167482B2). An electronic copy of the table will also be available from the USPTO upon request and payment of the fee set forth in 37 CFR 1.19(b)(3).

than, essentially the same as or greater than the level that the trait is exhibited in control plants which do not express the recombinant DNA; (b) selecting from the population one or more plants that exhibit the trait at a level greater than the level that said trait is exhibited in control plants and (c) collecting seed from a selected plant. Such method further comprises steps (a) verifying that the recombinant DNA is stably integrated in said selected plants; and (b) analyzing tissue of a selected plant to determine the production of a protein having the function of a protein encoded by a recombinant DNA with a sequence of one of SEQ ID NO: 1-759; In one aspect of the invention the plants in the population further comprise DNA expressing a protein that provides tolerance to exposure to an herbicide applied at levels that are lethal to wild type plant cells and where the selecting is effected by treating the population with the herbicide, e.g. a glyphosate, dicamba, or glufosinate compound. In another aspect of the invention the plants are selected by identifying plants with the enhanced trait. The methods are especially useful for manufacturing corn, soybean, cotton, canola, alfalfa, wheat or rice seed selected as having one of the enhanced traits described above.

Another aspect of the invention provides a method of producing hybrid corn seed comprising acquiring hybrid corn seed from a herbicide tolerant corn plant which also has a nucleus of this invention with stably-integrated, recombinant DNA The method further comprises producing corn plants from said hybrid corn seed, where a fraction of the plants produced from said hybrid corn seed is homozygous for said recombinant DNA, a fraction of the plants produced from said hybrid corn seed is hemizygous for said recombinant DNA, and a fraction of the plants produced from said hybrid corn seed has none of said recombinant DNA; selecting corn plants which are homozygous and hemizygous for said recombinant DNA by treating with an herbicide; collecting seed from herbicide-treated-surviving corn plants and planting said seed to produce further progeny corn plants; repeating the selecting and collecting steps at least once to produce an inbred corn line; and crossing the inbred corn line with a second corn line to produce hybrid seed.

Still other aspects of this invention relate to transgenic plants with enhanced water use efficiency or enhanced nitrogen use efficiency. For instance, this invention provides methods of growing a corn, cotton, soybean, or canola crop without irrigation water comprising planting seed having plant cells of the invention which are selected for enhanced water use efficiency. Alternatively methods comprise applying reduced irrigation water, e.g. providing up to 300 millimeters of ground water during the production of a corn crop. This invention also provides methods of growing a corn, cotton, soybean or canola crop without added nitrogen fertilizer comprising planting seed having plant cells of the invention which are selected for enhanced nitrogen use efficiency.

In another aspect of the invention transgenic plants comprise recombinant DNA constructs which affect the expression of two or more proteins disclosed herein.

BRIEF DESCRIPTION OF THE DRAWINGS

FIGS. 4A-4D illustrates a consensus amino acid sequence of SEQ ID NO: 768 and its homologs.

DETAILED DESCRIPTION OF THE INVENTION

Figure 1:
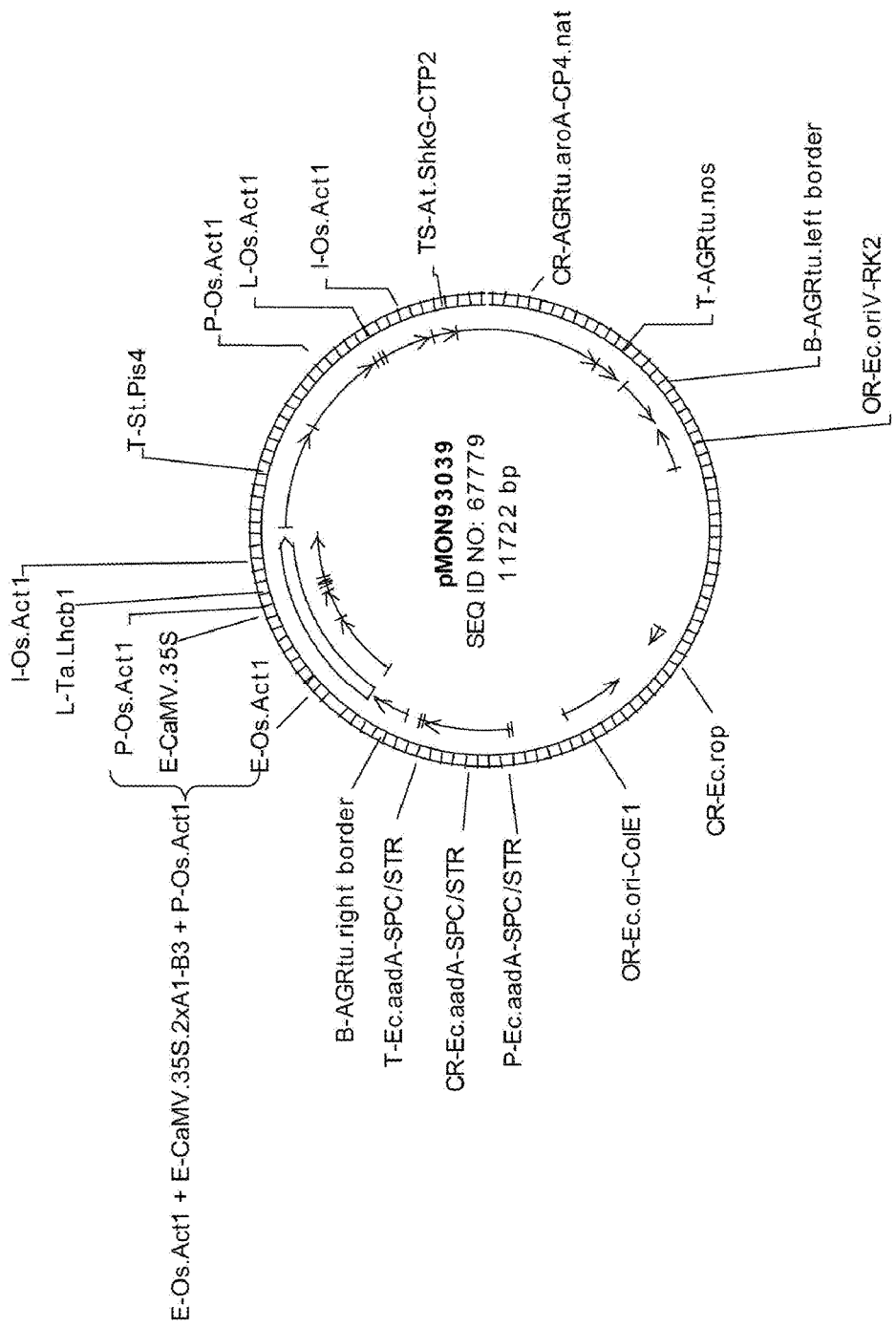
FIGS. 1, 2 and 3 illustrate plasmid maps.

In the attached sequence listing:
SEQ ID NO: 1-759 are nucleotide sequences of the protein coding strand of DNA" used in the recombinant DNA for imparting an enhanced trait in plant cells;

SEQ ID NO: 760-1518 are amino acid sequences of the cognate protein of the nucleotide sequences of SEQ ID NO: 1-759;

SEQ ID NO: 1519- 67778 are amino acid sequences of homologous proteins; SEQ ID NO: 67779 is a nucleotide sequence of a plasmid base vector useful for corn transformation; and SEQ ID NO: 67780 is a DNA sequence of a plasmid base vector useful for soybean transformation.

SEQ ID NO: 67781 is a DNA sequence of a plasmid base vector useful for cotton transformation.

SEQ ID NO: 67782-67894 are consensus sequences.

Table 1 lists the protein SEQ ID NOs and their corresponding consensus SEQ ID NOs.

TABLE 1

| Gene ID | SEQ ID NO | Consensus SEQ ID NO |
|---|---|---|
| CGPG1083 | 767 | 67782 |
| CGPG1088 | 768 | 67783 |
| CGPG1092 | 769 | 67784 |
| CGPG1108 | 770 | 67785 |
| CGPG1140 | 772 | 67786 |
| CGPG1143 | 773 | 67787 |
| CGPG1170 | 775 | 67788 |
| CGPG1192 | 778 | 67789 |
| CGPG1311 | 786 | 67790 |
| CGPG1391 | 792 | 67791 |
| CGPG1633 | 809 | 67792 |
| CGPG1715 | 814 | 67793 |
| CGPG1895 | 822 | 67794 |
| CGPG2035 | 836 | 67795 |
| CGPG2068 | 840 | 67796 |
| CGPG2118 | 844 | 67797 |
| CGPG2191 | 848 | 67798 |
| CGPG2313 | 855 | 67799 |
| CGPG2426 | 864 | 67800 |
| CGPG2437 | 866 | 67801 |
| CGPG2452 | 867 | 67802 |
| CGPG2855 | 882 | 67803 |
| CGPG3004 | 887 | 67804 |
| CGPG3084 | 892 | 67805 |
| CGPG3269 | 905 | 67806 |
| CGPG3270 | 906 | 67807 |
| CGPG3410 | 913 | 67808 |
| CGPG3605 | 922 | 67809 |
| CGPG3612 | 923 | 67810 |
| CGPG3616 | 924 | 67811 |
| CGPG3631 | 925 | 67812 |
| CGPG375 | 933 | 67813 |
| CGPG3931 | 940 | 67814 |
| CGPG3975 | 944 | 67815 |
| CGPG4346 | 974 | 67816 |
| CGPG4383 | 977 | 67817 |
| CGPG4437 | 983 | 67818 |
| CGPG4660 | 995 | 67819 |
| CGPG4772 | 1007 | 67820 |
| CGPG5196 | 1043 | 67821 |
| CGPG5212 | 1046 | 67822 |
| CGPG5304 | 1057 | 67823 |
| CGPG5510 | 1072 | 67824 |
| CGPG5732 | 1100 | 67825 |
| CGPG5889 | 1116 | 67826 |
| CGPG5921 | 1120 | 67827 |
| CGPG5925 | 1121 | 67828 |
| CGPG5926 | 1122 | 67829 |
| CGPG6049 | 1135 | 67830 |
| CGPG6120 | 1142 | 67831 |
| CGPG6201 | 1151 | 67832 |
| CGPG6311 | 1169 | 67833 |
| CGPG6353 | 1176 | 67834 |
| CGPG6636 | 1214 | 67835 |
| CGPG691 | 1235 | 67836 |
| CGPG6930 | 1238 | 67837 |
| / | / | / |
| CGPG6934 | 1239 | 67838 |
| CGPG7056 | 1249 | 67839 |

TABLE 1-continued

| Gene ID | SEQ ID NO | Consensus SEQ ID NO |
|---|---|---|
| CGPG7071 | 1250 | 67840 |
| CGPG7243 | 1270 | 67841 |
| CGPG7258 | 1271 | 67842 |
| CGPG7324 | 1277 | 67843 |
| CGPG7338 | 1279 | 67844 |
| CGPG7352 | 1282 | 67845 |
| CGPG7362 | 1285 | 67846 |
| CGPG7430 | 1295 | 67847 |
| CGPG7438 | 1296 | 67848 |
| CGPG7450 | 1299 | 67849 |
| CGPG7452 | 1300 | 67850 |
| CGPG7480 | 1302 | 67851 |
| CGPG7510 | 1308 | 67852 |
| CGPG7517 | 1310 | 67853 |
| CGPG7523 | 1311 | 67854 |
| CGPG7532 | 1314 | 67855 |
| CGPG7548 | 1316 | 67856 |
| CGPG7599 | 1320 | 67857 |
| CGPG7616 | 1324 | 67858 |
| CGPG7793 | 1333 | 67859 |
| CGPG7816 | 1338 | 67860 |
| CGPG7826 | 1339 | 67861 |
| CGPG7861 | 1340 | 67862 |
| CGPG8054 | 1362 | 67863 |
| CGPG8059 | 1363 | 67864 |
| CGPG8084 | 1367 | 67865 |
| CGPG8093 | 1368 | 67866 |
| CGPG8097 | 1371 | 67867 |
| CGPG8112 | 1372 | 67868 |
| CGPG8120 | 1373 | 67869 |
| CGPG8157 | 1376 | 67870 |
| CGPG8158 | 1377 | 67871 |
| CGPG8212 | 1382 | 67872 |
| CGPG8375 | 1403 | 67873 |
| CGPG8383 | 1405 | 67874 |
| CGPG8544 | 1422 | 67875 |
| CGPG8546 | 1423 | 67876 |
| CGPG8549 | 1424 | 67877 |
| CGPG8588 | 1429 | 67878 |
| CGPG8597 | 1430 | 67879 |
| CGPG8629 | 1433 | 67880 |
| CGPG8636 | 1437 | 67881 |
| CGPG8646 | 1440 | 67882 |
| CGPG8677 | 1442 | 67883 |
| CGPG8716 | 1446 | 67884 |
| CGPG8754 | 1447 | 67885 |
| CGPG9001 | 1471 | 67886 |
| CGPG9069 | 1476 | 67887 |
| CGPG9097 | 1480 | 67888 |
| CGPG9106 | 1481 | 67889 |
| CGPG9143 | 1487 | 67890 |
| CGPG9188 | 1498 | 67891 |
| CGPG9248 | 1505 | 67892 |
| CGPG9285 | 1509 | 67893 |
| CGPG9315 | 1513 | 67894 |

The nuclei of this invention are identified by screening transgenic plants for one or more traits including enhanced drought stress tolerance, enhanced heat stress tolerance, enhanced cold stress tolerance, enhanced high salinity stress tolerance, enhanced low nitrogen availability stress tolerance, enhanced shade stress tolerance, enhanced plant growth and development at the stages of seed imbibition through early vegetative phase, and enhanced plant growth and development at the stages of leaf development, flower production and seed maturity.

As used herein a "plant cell" means a plant cell that is transformed with stably-integrated, non-natural, recombinant DNA, e.g. by Agrobacterium-mediated transformation or by bombardment using microparticles coated with recombinant DNA or other means. A plant cell of this invention can be an originally-transformed plant cell that exists as a microorganism or as a progeny plant cell that is regenerated into differentiated tissue, e.g. into a transgenic plant with stably-integrated, non-natural recombinant DNA, or seed or pollen derived from a progeny transgenic plant.

As used herein a "transgenic plant" means a plant whose genome has been altered by the stable integration of recombinant DNA. A transgenic plant includes a plant regenerated from an originally-transformed plant cell and progeny transgenic plants from later generations or crosses of a transformed plant.

As used herein "recombinant DNA" means DNA which has been a genetically engineered and constructed outside of a cell including DNA containing naturally occurring DNA or cDNA or synthetic DNA.

As used herein a "homolog" means a protein in a group of proteins that perform the same biological function, e.g. proteins that belong to the same Pfam protein family and that provide a common enhanced trait in transgenic plants of this invention. Homologs are expressed by homologous genes. Homologous genes include naturally occurring alleles and to artificially-created variants. Degeneracy of the genetic code provides the possibility to substitute at least one base of the protein encoding sequence of a gene with a different base without causing the amino acid sequence of the polypeptide produced from the gene to be changed. Hence, a polynucleotide useful in the present invention may have any base sequence that has been changed from SEQ ID NO: 1 through SEQ ID NO: 803 through substitution in accordance with degeneracy of the genetic code. Homologs are proteins that, when optimally aligned, have at least 60% identity, more preferably about 70% or higher, more preferably at least 80% and even more preferably at least 90% identity over the full length of a protein identified as being associated with imparting an enhanced trait when expressed in plant cells. Homologs include proteins with an amino acid sequence that has at least 90% identity to a consensus amino acid sequence of proteins and homologs disclosed herein.

Homologs are identified by comparison of amino acid sequence, e.g. manually or by use of a computer-based tool using known homology-based search algorithms such as those commonly known and referred to as BLAST, FASTA, and Smith-Waterman. A local sequence alignment program, e.g. BLAST, can be used to search a database of sequences to find similar sequences, and the summary Expectation value (E-value) used to measure the sequence base similarity. As a protein hit with the best E-value for a particular organism may not necessarily be an ortholog or the only ortholog, a reciprocal query is used in the present invention to filter hit sequences with significant E-values for ortholog identification. The reciprocal query entails search of the significant hits against a database of amino acid sequences from the base organism that are similar to the sequence of the query protein. A hit can be identified as an ortholog, when the reciprocal query's best hit is the query protein itself or a protein encoded by a duplicated gene after speciation. A further aspect of the homologs encoded by DNA useful in the transgenic plants of the invention are those proteins that differ from a disclosed protein as the result of deletion or insertion of one or more amino acids in a native sequence.

As used herein, "percent identity" means the extent to which two optimally aligned DNA or protein segments are invariant throughout a window of alignment of components, for example nucleotide sequence or amino acid sequence. An "identity fraction" for aligned segments of a test sequence and a reference sequence is the number of identical components that are shared by sequences of the two aligned segments divided by the total number of sequence components in the reference segment over a window of alignment which is the smaller of the full test sequence or the full reference sequence. "Percent identity" ("% identity") is the identity fraction times 100. Such optimal alignment is understood to be deemed as local alignment of DNA sequences. For protein alignment, a local alignment of protein sequences should allow introduction of gaps to achieve optimal alignment. Percent identity is calculated over the aligned length not including the gaps introduced by the alignment per se.

As used herein "promoter" means regulatory DNA for initializing transcription. A "plant promoter" is a promoter capable of initiating transcription in plant cells whether or not its origin is a plant cell, e.g. is it well known that *Agrobacterium* promoters are functional in plant cells. Thus, plant promoters include promoter DNA obtained from plants, plant viruses and bacteria such as *Agrobacterium* and *Bradyrhizobium* bacteria. Examples of promoters under developmental control include promoters that preferentially initiate transcription in certain tissues, such as leaves, roots, or seeds. Such promoters are referred to as "tissue preferred". Promoters that initiate transcription only in certain tissues are referred to as "tissue specific". A "cell type" specific promoter primarily drives expression in certain cell types in one or more organs, for example, vascular cells in roots or leaves. An "inducible" or "repressible" promoter is a promoter which is under environmental control. Examples of environmental conditions that may effect transcription by inducible promoters include anaerobic conditions, or certain chemicals, or the presence of light. Tissue specific, tissue preferred, cell type specific, and inducible promoters constitute the class of "non-constitutive" promoters. A "constitutive" promoter is a promoter which is active under most conditions.

As used herein "operably linked" means the association of two or more DNA fragments in a DNA construct so that the function of one, e.g. protein-encoding DNA, is controlled by the other, e.g. a promoter.

As used herein "expressed" means produced, e.g. a protein is expressed in a plant cell when its cognate DNA is transcribed to mRNA that is translated to the protein.

As used herein "suppressed" means decreased, e.g. a protein is suppressed in a plant cell when there is a decrease in the amount and/or activity of the protein in the plant cell. The presence or activity of the protein can be decreased by any amount up to and including a total loss of protein expression and/or activity.

As used herein a "control plant" means a plant that does not contain the recombinant DNA that expressed a protein that imparts an enhanced trait. A control plant is to identify and select a transgenic plant that has an enhance trait. A suitable control plant can be a non-transgenic plant of the parental line used to generate a transgenic plant, i.e. devoid of recombinant DNA. A suitable control plant may in some cases be a progeny of a hemizygous transgenic plant line that is does not contain the recombinant DNA, known as a negative segregant.

As used herein an "enhanced trait" means a characteristic of a transgenic plant that includes, but is not limited to, an enhance agronomic trait characterized by enhanced plant morphology, physiology, growth and development, yield, nutritional enhancement, disease or pest resistance, or environmental or chemical tolerance. In more specific aspects of this invention enhanced trait is selected from group of enhanced traits consisting of enhanced water use efficiency, enhanced cold tolerance, increased yield, enhanced nitrogen use efficiency, enhanced seed protein and enhanced seed oil.

In an important aspect of the invention the enhanced trait is enhanced yield including increased yield under non-stress conditions and increased yield under environmental stress conditions. Stress conditions may include, for example, drought, shade, fungal disease, viral disease, bacterial disease, insect infestation, nematode infestation, cold temperature exposure, heat exposure, osmotic stress, reduced nitrogen nutrient availability, reduced phosphorus nutrient availability and high plant density. "Yield" can be affected by many properties including without limitation, plant height, pod number, pod position on the plant, number of internodes, incidence of pod shatter, grain size, efficiency of nodulation and nitrogen fixation, efficiency of nutrient assimilation, resistance to biotic and abiotic stress, carbon assimilation, plant architecture, resistance to lodging, percent seed germination, seedling vigor, and juvenile traits. Yield can also be affected by efficiency of germination (including germination in stressed conditions), growth rate (including growth rate in stressed conditions), ear number, seed number per ear, seed size, composition of seed (starch, oil, protein) and characteristics of seed fill.

Increased yield of a transgenic plant of the present invention can be measured in a number of ways, including test weight, seed number per plant, seed weight, seed number per unit area (i.e. seeds, or weight of seeds, per acre), bushels per acre, tonnes per acre, tons per acre, kilo per hectare. For example, maize yield may be measured as production of shelled corn kernels per unit of production area, for example in bushels per acre or metric tons per hectare, often reported on a moisture adjusted basis, for example at 15.5 percent moisture. Increased yield may result from improved utilization of key biochemical compounds, such as nitrogen, phosphorous and carbohydrate, or from improved responses to environmental stresses, such as cold, heat, drought, salt, and attack by pests or pathogens. Recombinant DNA used in this invention can also be used to provide plants having improved growth and development, and ultimately increased yield, as the result of modified expression of plant growth regulators or modification of cell cycle or photosynthesis pathways. Also of interest is the generation of transgenic plants that demonstrate enhanced yield with respect to a seed component that may or may not correspond to an increase in overall plant yield. Such properties include enhancements in seed oil, seed molecules such as tocopherol, protein and starch, or oil particular oil components as may be manifest by an alterations in the ratios of seed components.

"*Arabidopsis*" means plants of *Arabidopsis thaliana*.

"Pfam" database is a large collection of multiple sequence alignments and hidden Markov models covering many common protein families, e.g. Pfam version 19.0 (December 2005) contains alignments and models for 8183 protein families and is based on the Swissprot 47.0 and SP-TrEMBL 30.0 protein sequence databases. See S. R. Eddy, "Profile Hidden Markov Models", *Bioinformatics* 14:755-763, 1998. The Pfam database is currently maintained and updated by the Pfam Consortium. The alignments represent some evolutionary conserved structure that has implications for the protein's function. Profile hidden Markov models (profile HMMs) built from the protein family alignments are useful for automatically recognizing that a new protein belongs to an existing protein family even if the homology by alignment appears to be low.

A "Pfam domain module" is a representation of Pfam domains in a protein, in order from N terminus to C terminus. In a Pfam domain module individual Pfam domains are separated by double colons "::". The order and copy number of the Pfam domains from N to C terminus are attributes of a Pfam domain module. Although the copy number of repetitive domains is important, varying copy number often enables a similar function. Thus, a Pfam domain module with multiple copies of a domain should define an equivalent Pfam domain module with variance in the number of multiple copies. A Pfam domain module is not specific for distance between adjacent domains, but contemplates natural distances and variations in distance that provide equivalent function. The Pfam database contains both narrowly- and broadly-defined domains, leading to identification of overlapping domains on some proteins. A Pfam domain module is characterized by non-overlapping domains. Where there is overlap, the domain having a function that is more closely associated with the function of the protein (based on the E value of the Pfam match) is selected.

Once one DNA is identified as encoding a protein which imparts an enhanced trait when expressed in transgenic plants, other DNA encoding proteins with the same Pfam domain module are identified by querying the amino acid sequence of protein encoded by candidate DNA against the Hidden Markov Models which characterizes the Pfam domains using HMMER software which is publicly available from the Pfam Consortium. Candidate proteins meeting the same Pfam domain module are in the protein family and have cognate DNA that is useful in constructing recombinant DNA for the use in the plant cells of this invention. Hidden Markov Model databases for use with HMMER software in identifying DNA expressing protein with a common Pfam domain module for recombinant DNA in the plant cells of this invention are also publicly available from the Pfam Consortium.

Version 19.0 of the HMMER software and Pfam databases were used to identify known domains in the proteins corresponding to amino acid sequence of SEQ ID NO: 760 through SEQ ID NO: 1518. All DNA encoding proteins that have scores higher than the gathering cutoff disclosed in Table 19 by Pfam analysis disclosed herein can be used in recombinant DNA of the plant cells of this invention, e.g. for selecting transgenic plants having enhanced agronomic traits. The relevant Pfam modules for use in this invention, as more specifically disclosed below, are Saccharop_dh, Isoamylase_N::Alpha-amylase, RRM_1, Pribosyltran, Skp1_POZ::Skp1, PTR2, PSI_PsaH, OTU, Aldedh, p450, AP2, CBS, TPT, zf-UBR, zf-C3HC4, ADH_N::ADH_zinc_N, Pre-SET::SET, OstA, Myb_DNA-binding, Cpn60_TCP1, SKI, Cyt-b5::FA_desaturase, Pkinase, KT112, SNARE, NLE::WD40::WD40::WD40::WD40, zf-C3HC4, Complex1_30 kDa::Complex1_49 kDa, iPGM_N::Metalloenzyme, adh_short, IQ::IQ, Glutaredoxin, LRRNT_2::LRR_1::LRR_1::Pkinase, Pkinase, Pribosyltran, DUF623, AWPM-19, Glucokinase, Pkinase_Tyr, Ribosomal_S8, F-box::Sel1::Sel1::zf-MYND, DUF313, WRKY, Aa_trans, Aminotran_1_2, Cystatin, PFK, PGAM, F-box, Ras, WD40::WD40::WD40::WD40, C2, Gal-bind_lectin::Galactosyl_T, Pyr_redox_2::Pyr_redox_dim, Ank::Ank::Pkinase_Tyr, Aminotran_1_2, AMP-binding, Aminotran_3, PEARL1-4, RRM_1, LRRNT_2::LRR_1::LRR_1::LRR_1::LRR_1::Pkinase, SNARE_assoc, FKBP_C, ELFV_dehydrog_N::ELFV_dehydrog, Sugar_tr, SPT2, DUF23, Dehydrin, Prefoldin, WD40::WD40::WD40::WD40::WD40::WD40::WD40, IQ::IQ, zf-Tim10_DDP, PPR::PPR::PPR::PPR::PPR::PPR::PPR, F-box::FBA_3, SH3_1, RNA_poll_A14, GAF::HisKA, Pkinase::efhand::efhand, Y_phosphatase2, 60KD_IMP, ADH_zinc_N, Glutaminase, p450, p450, Transket_pyr::Transketolase_C, B3_4::B5, Zip, DUF791::MFS_1, AA_permease, Pkinase, SAC3_GANP, DUF862, Pkinase, CS, TFIIS, Ribosomal_L19, Sugar_tr, NIF, SRF-TF::K-box, MSP, PGAM, Aha1_N::AHSA1, p450, F-box::FBA_1, Amino_oxidase, Tryp_alpha_amyl, Sugar_tr, zf-CW::MBD, Cytochrom_C, Tryp_alpha_amyl, Tcp11, Cys_Met_Meta_PP, UQ_con, zf-CCHC, Pyr_redox_2, efhand::efhand::efhand, Maf, MATH::BTB, LRRNT_2::LRR_1::LRR_1::LRR_1::LRR_1::LRR_1::LRR_1::LRR_1::LRR_1::LRR_1::LRR_1::LRR_1::LRR_1::LRR_1::LRR_1::Pkinase, Glyco_hydro_17, IQ, V-SNARE, Pkinase, Thioredoxin, AA_permease, Metallothio_PEC, HLH, p450, Pyr_redox_2::efhand, PP2C, GILT, F-box::Kelch_1::Kelch_1, AlaDh_PNT_N::AlaDh_PNT_C::Saccharop_dh_N::Saccharop_dh, WD40::WD40, Molybdop_Fe4S4::Molybdopterin::Molydop_binding, Aldedh, efhand, ETC_C1_NDUFA4, PG1, Transthyretin, GRP, Spot11E, Dirigent, NUDIX, p450, Actin, Uricase::Uricase, Xan_ur_permease, NTP_transferase::Hexapep::Hexapep, zf-C3HC4, PPDK_N::PEP-utilizers::PEP-utilizers_C, Ribosomal_L37, Globin, Peptidase_M22, NADPH_Ox::Ferric_reduct::FAD_binding_8::NAD_binding_6, Glutaminase, XG_FTase, Enolase_N::Enolase_C, F-box::FBA_1, SOR_SNZ::ThiG, ABC_tran::ABC2_membrane::PDR_assoc::ABC_tran::ABC2_membrane, HMA::HMA, GATase::GMP_synt_C, Pkinase, CN_hydrolase::NAD_synthase, Usp::Pkinase, GRAM, Pkinase, DUF6::DUF6, Sugar_tr, Iso_dh, Tim17, Band_7, Polyketide_cyc, Cyclin_N::Cyclin_C, DUF26::DUF26::Pkinase, PPR::PPR::PPR::PPR::PPR::PPR::PPR::PPR, Amidohydro_2, 2OG-FeII_Oxy, PfkB, GILT, DUF246, Response_reg, TB2_DP1_HVA22, PP2C, ArfGap, TFIIF_alpha, ABC1, Methyltransf_12, Aldedh, TB2_DP1_HVA22, DUF6::TPT, Gp_dh_N::Gp_dh_C, efhand, SRF-TF, IQ::IQ, Lectin_legB::Pkinase, Self-incomp_S1, Hin1, Aminotran_1_2, Copine, ADH_N::ADH_zinc_N, Sugar_tr, DUF860, Pkinase, Sugar_tr, Nol1_Nop2_Fmu, zf-MYND::UCH, Aldedh, F-box::Kelch_1::Kelch_1, TOM20_plant, Sugar_tr, DHDPS, CPDase, Aldedh, Invertase_neut, Metallophos, PBP, Reticulon, Histone, DUF260, Phi_1, p450, Lectin_legB::Pkinase, Abhydrolase_1, AMP-binding, DAGK_cat, Pkinase::NAF, IQ::IQ, DnaJ::DnaJ_CXXCXGXG::DnaJ_C, RRM_1, RRM_1, Citrate_synt, Glutaminase, DUF6::DUF6, PRACH::PRA-PH, Aldedh, adh_short, Pkinase, Cyclin_N::Cyclin_C, CCT, AP2, Cullin, Lung_7-TM_R, DUF1677, Rib_5-P_isom_A, TPK_catalytic::TPK_B1_binding, Sugar_tr, DUF926, AstE_AspA, Cyt-b5, HEAT::Arm::HEAT::Arm, Arf, SRF-TF, Aldedh, Glyco_transf_8, F-box::LRR_2::FBD, p450, DUF833, IQ::IQ, Aldedh, P13_P14_kinase, p450, RNA_pol_1_A49, Abhydrolase_1, TFIIS_C, HMG-CoA_red, HEAT::HEAT::HEAT::HEAT::HEAT::HEAT::HEAT::HEAT::HEAT::HEAT::HEAT::HEAT, MMR_HSR1, Ank::Ank::Ank, CorA, DUF827, Cyclin, Glyco_transf_8, DUF623, zf-C3HC4, AA_permease, RRM_1::zf-CCHC, Ras, DEAD::Helicase_C::DSHCT, PAS_2::GAF::Phytochrome::HisKA::HATPase_c, Tetraspannin, NIR_SIR_ferr::NIR_SIR::NIR_SIR_ferr::NIR_SIR, ELFV_dehydrog_N::ELFV_dehydrog, F-box::Kelch_1::Kelch_1, Aldedh, RRM_1::RRM_1, RRM_1, PPR::PPR::PPR::PPR::PPR::PPR, DUF617, HD::ReIA_SpoT, Diphthamide_syn, Gp_dh_N::Gp_dh_C, ThiC, CRAL_TRIO_N::CRAL_TRIO, FTHFS, MIP, Fibrillarin, Pkinase, Pkinase, GTP_EFTU::GTP_EFTU_D2::EFG_C, PPR::PPR::PPR::PPR::PPR::PPR, PTR2, FAD_binding_4, ScpA_ScpB, NDUF_B7, TPT, DEA D::Helicase_C, DnaJ, TPT, cobW, HIT, DHquinase_1::Shikimate_dh_N::Shikimate_DH, IQ::IQ, Aldedh, DUF231, PG1, zf-C3HC4, CorA, Transketolase_N::Transket_pyr:Transketolase_C, Dehydrin, RRM_1, Sterol_desat, eIF2A, ArfGap::C2, NTP_transferase, DAG, Sugar_tr, DUF21::CBS, Pkinase::NAF, Sulfotransfer_1, p450, PGM_PMM_I::PGM_PMM_II::PGM_PMM_III::PGM_PMM_IV, CPSase_L_chain::CPSase_L_D2::CPSase_L_D3::CPSase_L_chain::CPSase_L_D2::MGS, Pro_CA, DUF617, Voltage_CLC::CBS, F-box, Histone, 14-3-3, UBX, polyprenyl_synt, Rho_GDI, TPR_2, Aldedh, LRR_I::LRR_I::LRR_I::Pkinase, DUF239, Pkinase, Glycolytic, adh_short, DUF1001, PTR2, ATP_synt_H, p450, Mito_carr:Mito_cam:Mito_carr, Gar1, Gln-synt_N::Gln-synt_C, PseudoU_synth_1::PseudoU_synth_1, DUF1635, Pkinase, Pro_dh, DUF506, Acyltransferase, DJ-1_Pfp1::DJ-1_Pfp1, PAP2, IQ, Isy1, Glutaredoxin, Molybdop_Fe4S4::Molybdopterin::Molydop_binding:Fer2_BFD, DUF778, Cyclin_N, zf-C3HC4, DUF300, DUF1639, Peptidasc_C26, P21-Arc, Mo25, Pkinasc, Ras, DUF788, iPGM_N::Metalloenzyme, adh_short, Pyr_redox, Gln-synt_N::Gln-synt_C, FA_desaturase, zf-MYND::UCH, Skp1_POZ::Skp1, Cornichon, 1GPD, Orn_Arg_deC_N::Orn_DAP_Arg_deC, DUF260, Gln-synt_N::Gln-synt_C, RRM_1, 2OG-Fell_Oxy, SNARE, RRM_1, DUF212, F-box, Phytochelatin::DUF1984, SRF-TF, TIM, MSF1, Ribonuc_L-PSP, p450, Transaldolase, Snf7, p450, FA_desaturase, F-box, efhand_like::PI-PLC-X::PI-PLC-Y::C2, Trehalose_PPase, Aminotran_4, Thioredoxin, Chitin_bind_1::Barwin, TLD, GATase_2::Asn_synthase, Pkinase, Pyridoxal_deC, Biotin_lipoyl::E3_binding::2-oxoacid_dh, H_PPase, DUF914, WD40::WD40::WD40, SIR2, Pkinase::efhand::efhand::efhand::efhand, LSM, PetM, DUF23, DUF862, tRNA-synt_1g, Radical_SAM, LRR_1::LRR_1::LRR_1::LRR_1::LRR_1::LRR_1::LRR_1::LRR_1::Pkinase, DUF1644, Mov34, NOI, DUF6::TPT, Transket_pyr:Transketolase_C, F-box::LRR_2, zf-C3HC4, Phosphoesterase, SET, adh_short, Exo_endo_phos, Pkinase, Stig1, TFIIS_M::SPOC, Gln-synt_N::Gln-synt_C, B56, Aminotran_1_2, Aldose_epim, DUF1645, iPGM_N::Metalloenzyme, LRRNT_2::LRR_1::LRR_1::LRR_1::LRR_1::LRR_1::Pkinase, DUF538, Not3::NOT2_3_5, YjeF_N::Carb_kinase, DUF538, F-box, Cyclin_N::Cyclin_C, Aldedh, F-box, Pyr_redox_2, ELFV_dehydrog_N::ELEV_dehydrog, BCNT, Mago-bind, RRM_1, DUF783, Aminotran_3, ADH_N::ADH_zinc_N, Pkinase_Tyr, Ribosomal_S8, Pkinase, LRR_1, UDPGT, Peptidase_C54, mTERF, Skp1_POZ::Skp1, WD40::WD40::WD40::WD40, MtN3_slv::MtN3_slv, LRRNT_2::LRR_1::LRR_1::LRR_1::LRR_1::Pkinase, Aminotran_1_2, adh_short, PP2C, Senescence, Response_reg, DEAD::Helicase_C, Pkinase, zf-LSD1::zf-LSD1::zf-LSD1, PB1::Pkinase_Tyr, BTB::NPH3, PBD, Exo_endo_phos, Fer4::Fer4, WD40::WD40::WD40::WD40::PWP2, LysM, NTP_transferase, Tim17, Aa_trans, Ras, 1PK, F-box::LRR_2, FBPase, PP2C, Aldedh, Ank::Ank::Ank::Pkinase, Brix, PTR2, 2OG-Fell_Oxy, MCM, NTP_transferase::Hexapep::Hexapep::Hexapep::Hexapep, SapB_1::SaPB_2::SapB_1::SapB_2, Aldedh, DUF581, AAA, Cyclin_N, ARM_1, IQ::IQ, Pkinase, ubiquitin::UBA::XPC-binding::UBA, Pkinase, TIM, Abhydrolase_1, CBS, Pkinase, Pyr_redox_2::Pyr_redox_dim, NicO, CCT, zf-PARP::zf-PARP::PADR1::BRCT::WGR::PARP_reg::PARP, Spermine_synth, NDK, E1_dh, LRR_1::LRR_1::LRR_1::LRR_1::LRR_1::LRR_1::LRR_1::LRR_1, MATH::MATH, Cyclin_N::Cyclin_C, ADH_N::ADH_zinc_N, RRM_I, DUF393, LRR_1::LRR_1::LRR_1::LRR_1::LRR_1::LRR_1::LRR_1::LRR_1::LRR_1::LRR_1::LRR_1::LRR_1::LRR_1, AAA, zf-C3HC4::YDG_SRA, RWD, GHMP_kinases_N::GHMP_kinases_C, DZC, Glutaredoxin, DEAD::Helicase_C, Sterol_desat, DUF212, Pkinase, DREPP, PTR2, MGDG_synth::Glyco_tran_28_C, ACT::ACT, OTU, Pkinase, Glyco_hydro_1, Nuc_sug_transp, WD40::WD40::WD40::WD40::WD40::WD40::WD40::WD40::WD40::WD40::WD40::Utp13, Nramp, MFS_1, Metallophos, DUF1005, CTP_transf_1, RNA_pol_A_bac, DUF383::DUF384, DUF676, SAC3_GANP, ADH_N::ADH_zinc_N, PLAT::Lipoxygenase, SIS::CBS, Pkinase, Bystin, Response_reg, Phi_1, MFS_1, Pkinase, Pkinase, Gln-synt_N::Gln-synt_C, NUDIX, NIR_SIR_ferr::NIR_SIR::NIR_SIR_ferr::NIR_SIR, UFD1, DUF581, p450, WD40::WD40::WD40::WD40, p450, Gp_dh_N::Gp_dh_C, Abhydrolase_3, TP_methylase, Pkinase, LRR_1::LRR_1::LRR_1::LRR_1::LRR_1::LRR_1::LRR_1, GATase::GMP_synt_C, PfkB, RRM_1, malic::Malic_M, DUF525, FBPase, DUF59, Pro_isomerase, Arm::Arm, Pkinase_Tyr, Pkinase::NAF, BNR::BNR::BNR, DUF1350, CAF1, TMEM14, MATH, DUF1000, PC_rep::PC_rep::PC_rep::PC_rep::PC_rep::PC_rep, Pkinase, FHA::PP2C, Pkinase, Di19, WD40::WD40, 200-Fell_Oxy, Pkinase, adh_short, Aldedh, DUF793, DUF1749, AAA, PGK, Aminotran_3, Str_synth, e1F-1a, Hydrolase, Sugar_tr, DUF640, PCI, Sina, PBP, AOX, OPT, Pkinase_Tyr, Rib_5-P_isom_A, DUF740, PP2C, Pkinase, and Cyclin_N::Cyclin_C.

Recombinant DNA Constructs

The invention uses recombinant DNA for imparting one or more enhanced traits to transgenic plant when incorporated into the nucleus of the plant cells. DNA constructs comprising one or more polynucleotides disclosed herein are assembled using methods well known to persons of ordinary skill in the art and typically comprise a promoter operably linked to DNA, the expression of which provides the enhanced agronomic trait. Other construct components may include additional regulatory elements, such as 5' leaders and introns for enhancing transcription, 3' untranslated regions (such as polyadenylation signals and sites), DNA for transit or signal peptides.

Numerous promoters that are active in plant cells have been described in the literature. These include promoters present in plant genomes as well as promoters from other sources, including nopaline synthase (NOS) promoter and octopine synthase (OCS) promoters carried on tumor-inducing plasmids of *Agrobacterium tumefaciens* and the CaMV35S promoters from the cauliflower mosaic virus as disclosed in U.S. Pat. Nos. 5,164,316 and 5,322,938. Useful promoters derived from plant genes are found in U.S. Pat. No. 5,641,876, which discloses a rice actin promoter, U.S. Pat. No. 7,151,204, which discloses a maize chloroplast aldolase promoter and a maize aldolase (FDA) promoter, and U.S. Patent Application Publication 2003/0131377 A1, which discloses a maize nicotianamine synthase promoter, all of which are incorporated herein by reference. These and numerous other promoters that function in plant cells are known to those skilled in the art and available for use in recombinant polynucleotides of the present invention to provide for expression of desired genes in transgenic plant cells.

In other aspects of the invention, preferential expression in plant green tissues is desired. Promoters of interest for such uses include those from genes such as *Arabidopsis thaliana* ribulose-1,5-bisphosphate carboxylase (Rubisco) small subunit (Fischhoff et al. (1992) *Plant Mol Biol.* 20:81-93), aldolase and pyruvate orthophosphate dikinase (PPDK) (Taniguchi et al. (2000) *Plant Cell Physiol.* 41(1): 42-48).

Furthermore, the promoters may be altered to contain multiple "enhancer sequences" to assist in elevating gene expression. Such enhancers are known in the art. By including an enhancer sequence with such constructs, the expression of the selected protein may be enhanced. These enhancers often are found 5' to the start of transcription in a promoter that functions in eukaryotic cells, but can often be inserted upstream (5') or downstream (3') to the coding sequence. In some instances, these 5' enhancing elements are introns. Particularly useful as enhancers are the 5' introns of the rice actin 1 (see U.S. Pat. No. 5,641,876) and rice actin 2 genes, the maize alcohol dehydrogenase gene intron, the maize heat shock protein 70 gene intron (U.S. Pat. No. 5.593,874) and the maize shrunken 1 gene.

In other aspects of the invention, sufficient expression in plant seed tissues is desired to affect improvements in seed composition. Exemplary promoters for use for seed composition modification include promoters from seed genes such as napin (U.S. Pat. No. 5,420,034), maize L3 oleosin (U.S. Pat. No. 6,433,252), zein Z27 (Russell et al. (1997) *Transgenic Res.* 6(2):157-166), globulin 1 (Belanger et al (1991) *Genetics* 129:863-872), glutelin 1 (Russell (1997) supra), and peroxiredoxin antioxidant (Per1) (Stacy et al. (1996) *Plant Mol Biol.* 31(6)1205-1216).

Recombinant DNA constructs prepared in accordance with the invention will also generally include a 3' element that typically contains a polyadenylation signal and site. Well-known 3' elements include those from *Agrobacterium tumefaciens* genes such as nos 3', tml 3', tmr 3', tms 3', ocs 3', tr7 3', for example disclosed in U.S. Pat. No. 6,090,627, incorporated herein by reference; 3' elements from plant genes such as wheat (*Triticum aesevitum*) heat shock protein 17 (Hsp17 3'), a wheat ubiquitin gene, a wheat fructose-1, 6-biphosphatase gene, a rice glutelin gene, a rice lactate dehydrogenase gene and a rice beta-tubulin gene, all of which arc disclosed in U.S. published patent application 2002/0192813 A1, incorporated herein by reference; and the pea (*Pisum sativum*) ribulose biphosphate carboxylase gene (rbs 3'), and 3' elements from the genes within the host plant.

Constructs and vectors may also include a transit peptide for targeting of a gene to a plant organelle, particularly to a chloroplast, leucoplast or other plastid organelle. For descriptions of the use of chloroplast transit peptides see U.S. Pat. No. 5,188,642 and U.S. Pat. No. 5,728,925, incorporated herein by reference. For description of the transit peptide region of an *Arabidopsis* EPSPS gene useful in the present invention, see Klee, H. J. et al (*MGG* (1987) 210:437-442).

Gene suppression includes any of the well-known methods for suppressing transcription of a gene or the accumulation of the mRNA corresponding to that gene thereby preventing translation of the transcript into protein. Post-transcriptional gene suppression is mediated by transcription of RNA that forms double-stranded RNA (dsRNA) having homology to a gene targeted for suppression. Suppression can also be achieved by insertion mutations created by transposable elements may also prevent gene function. For example, in many dicot plants, transformation with the T-DNA of *Agrobacterium* may be readily achieved and large numbers of transformants can be rapidly obtained. Also, some species have lines with active transposable elements that can efficiently be used for the generation of large numbers of insertion mutations, while some other species lack such options. Mutant plants produced by *Agrobacterium* or transposon mutagenesis and having altered expression of a polypeptide of interest can be identified using the polynucleotides of the present invention. For example, a large population of mutated plants may be screened with polynucleotides encoding the polypeptide of interest to detect mutated plants having an insertion in the gene encoding the polypeptide of interest.

Transgenic plants comprising or derived from plant cells of this invention transformed with recombinant DNA can be further enhanced with stacked traits, e.g. a crop plant having an enhanced trait resulting from expression of DNA disclosed herein in combination with herbicide and/or pest resistance. traits. For example, genes of the current invention can be stacked with other traits of agronomic interest, such as a trait providing herbicide resistance, or insect resistance, such as using a gene from *Bacillus thuringensis* to provide resistance against lepidopteran, coliopteran, homopteran, hemiopteran, and other insects. Herbicides for which transgenic plant tolerance has been demonstrated and the method of the present invention can be applied include, but are not limited to, glyphosate, dicamba, glufosinate, sulfonylurea, bromoxynil and norflurazon herbicides. Polynucleotide molecules encoding proteins involved in herbicide tolerance are well-known in the art and include, but are not limited to, a polynucleotide molecule encoding 5-enolpyruvylshikimate-3-phosphate synthase (EPSPS) disclosed in U.S. Pat. Nos. 5,094,945; 5,627,061; 5,633,435 and 6,040,497 for imparting glyphosate tolerance; polynucleotide molecules encoding a glyphosate oxidoreductase (GOX) disclosed in U.S. Pat. No. 5,463,175 and a glyphosate-N-acetyl transferase (GAT) disclosed in U.S. Patent Application publication 2003/0083480 A1 also for imparting glyphosate tolerance; dicamba monooxygenase disclosed in U.S. Patent Application publication 2003/0135879 A1 for imparting dicamba tolerance; a polynucleotide molecule encoding bromoxynil nitrilase (Bxn) disclosed in U.S. Pat. No. 4,810,648 for imparting bromoxynil tolerance; a polynucleotide molecule encoding phytoene desaturase (crtl) described in Misawa et al, (1993) *Plant J.* 4:833-840 and in Misawa et al, (1994) *Plant J.* 6:481-489 for norflurazon tolerance; a polynucleotide molecule encoding acetohydroxyacid synthase (AHAS, aka ALS) described in Sathasiivan et al. (1990) *Nucl. Acids Res.* 18:2188-2193 for imparting tolerance to sulfonylurea herbicides; polynucleotide molecules known as bar genes disclosed in DeBlock, et al. (1987) *EMBO J.* 6:2513-2519 for imparting glufosinate and bialaphos tolerance; polynucleotide molecules disclosed in U.S. Patent Application Publication 2003/010609 A1 for imparting N-amino methyl phosphonic acid tolerance; polynucleotide molecules disclosed in U.S. Pat. No. 6,107,549 for impartinig pyridine herbicide resistance; molecules and methods for imparting tolerance to multiple herbicides such as glyphosate, atrazine, ALS inhibitors, isoxoflutole and glufosinate herbicides are disclosed in U.S. Pat. No. 6,376,754 and U.S. Patent Application Publication 2002/0112260, all of said U.S. Patents and Patent Application Publications are incorporated herein by reference. Molecules and methods for imparting insect/nematode/virus resistance are disclosed in U.S. Pat. Nos. 5,250,515; 5,880, 275; 6,506,599; 5,986,175 and U.S. Patent Application Publication 2003/0150017 A1, all of which are incorporated herein by reference.

Table 2 provides a list of genes that provided recombinant DNA that was expressed in a model plant and identified from screening as imparting an enhanced trait. When the stated orientation is "sense", the expression of the gene or a homolog in a crop plant provides the means to identify transgenic events that provide an enhanced trait in the crop plant. When the stated orientation is "antisense", the suppression of the native homolog in a crop plant provides the means to identify transgenic events that provide an enhanced trait in the crop plant. In some cases the expression/suppression in the model plant exhibited an enhanced trait that corresponds to an enhanced agronomic trait, e.g. cold stress tolerance, water deficit stress tolerance, low nitrogen stress tolerance and the like. In other cases the expression/suppression in the model plant exhibited an enhanced trait that is a surrogate to an enhanced agronomic trait, e.g. salinity stress tolerance being a surrogate to drought tolerance or improvement in plant growth and development being a surrogate to enhanced yield. Even when expression of a transgene or suppression of a native gene imparts an enhanced trait in a model plant, not every crop plant expressing the same transgene or suppressing the same native gene will necessarily demonstrate an indicated enhanced agronomic trait. For instance, it is well known that multiple transgenic events are required to identify a transgenic plant that can exhibit an enhanced agronomic trait. However, by with routine experimentation a transgenic plant cell nuclei, cell, plant or seed of this invention can be identified by making a reasonable number of transgenic events and engaging in screening process identified in this specification and illustrated in the examples. An understanding of Table 2 is facilitated by the following description of the headings:

"NUC SEQ ID NO" refers to a SEQ ID NO. for particular DNA sequence in the Sequence Listing.

"PEP SEQ ID NO" refers to a SEQ ID NO. in the Sequence Listing for the amino acid sequence of a protein cognate to a particular DNA "construct_id" refers to an arbitrary number used to identify a particular recombinant DNA construct comprising the particular DNA.

"Gene ID" refers to an arbitrary name used to identify the particular DNA.

"orientation" refers to the orientation of the particular DNA in a recombinant DNA construct relative to the promoter.

TABLE 2

| NUC Seq ID | PEP Seq ID | Gene ID | Construct ID | Orientation |
|---|---|---|---|---|
| 1 | 760 | CGPG1022 | 12792 | ANTI-SENSE |
| 2 | 761 | CGPG1035 | 13673 | ANTI-SENSE |
| 3 | 762 | CGPG1043 | 12020 | SENSE |
| 4 | 763 | CGPG105 | 10174 | ANTI-SENSE |
| 5 | 764 | CGPG1060 | 11827 | ANTI-SENSE |
| 6 | 765 | CGPG1069 | 12435 | SENSE |
| 7 | 766 | CGPG108 | 12015 | SENSE |
| 8 | 767 | CGPG1083 | 11836 | ANTI-SENSE |
| 9 | 768 | CGPG1088 | 12141 | ANTI-SENSE |
| 10 | 769 | CGPG1092 | 12040 | SENSE |
| 11 | 770 | CGPG1108 | 12437 | SENSE |
| 12 | 771 | CGPG1136 | 12156 | ANTI-SENSE |
| 13 | 772 | CGPG1140 | 11853 | ANTI-SENSE |
| 14 | 773 | CGPG1143 | 12224 | SENSE |
| 15 | 774 | CGPG1145 | 11856 | ANTI-SENSE |
| 16 | 775 | CGPG1170 | 12065 | SENSE |
| 17 | 776 | CGPG1173 | 12419 | ANTI-SENSE |
| 18 | 777 | CGPG1176 | 12208 | SENSE |
| 19 | 778 | CGPG1192 | 14803 | SENSE |
| 20 | 779 | CGPG122 | 10176 | ANTI-SENSE |
| 21 | 780 | CGPG126 | 18011 | SENSE |
| 22 | 781 | CGPG1262 | 12714 | ANTI-SENSE |
| 23 | 782 | CGPG128 | 10507 | ANTI-SENSE |
| 24 | 783 | CGPG1280 | 15039 | SENSE |
| 25 | 784 | CGPG1291 | 12733 | ANTI-SENSE |
| 26 | 785 | CGPG1295 | 13237 | SENSE |
| 27 | 786 | CGPG1311 | 13504 | SENSE |
| 28 | 787 | CGPG1315 | 12932 | SENSE |
| 29 | 788 | CGPG1335 | 75935 | SENSE |
| 30 | 789 | CGPG1344 | 73333 | SENSE |
| 31 | 790 | CGPG1352 | 75993 | SENSE |
| 32 | 791 | CGPG1364 | 19401 | SENSE |
| 33 | 792 | CGPG1391 | 12766 | ANTI-SENSE |

TABLE 2-continued

| NUC Seq ID | PEP Seq ID | Gene ID | Construct ID | Orientation |
|---|---|---|---|---|
| 34 | 793 | CGPG1396 | 76025 | SENSE |
| 35 | 794 | CGPG1398 | 13708 | ANTI-SENSE |
| 36 | 795 | CGPG1399 | 13305 | ANTI-SENSE |
| 37 | 796 | CGPG1429 | 15806 | SENSE |
| 38 | 797 | CGPG1430 | 14712 | SENSE |
| 39 | 798 | CGPG1445 | 76013 | SENSE |
| 40 | 799 | CGPG146 | 10192 | ANTI-SENSE |
| 41 | 800 | CGPG1492 | 74775 | SENSE |
| 42 | 801 | CGPG1528 | 13841 | ANTI-SENSE |
| 43 | 802 | CGPG1530 | 15805 | SENSE |
| 44 | 803 | CGPG1535 | 14253 | ANTI-SENSE |
| 45 | 804 | CGPG1546 | 13650 | ANTI-SENSE |
| 46 | 805 | CGPG1567 | 13855 | ANTI-SENSE |
| 47 | 806 | CGPG1568 | 76049 | SENSE |
| 48 | 807 | CGPG1575 | 14271 | ANTI-SENSE |
| 49 | 808 | CGPG1619 | 73927 | SENSE |
| 50 | 809 | CGPG1633 | 13657 | ANTI-SENSE |
| 51 | 810 | CGPG1641 | 13938 | ANTI-SENSE |
| 51 | 810 | CGPG1641 | 14730 | SENSE |
| 52 | 811 | CGPG1651 | 73948 | SENSE |
| 53 | 812 | CGPG1656 | 18116 | ANTI-SENSE |
| 54 | 813 | CGPG1668 | 14341 | ANTI-SENSE |
| 55 | 814 | CGPG1715 | 13960 | ANTI-SENSE |
| 55 | 814 | CGPG1715 | 74391 | SENSE |
| 56 | 815 | CGPG1740 | 75957 | SENSE |
| 57 | 816 | CGPG177 | 70240 | SENSE |
| 58 | 817 | CGPG1785 | 70748 | ANTI-SENSE |
| 59 | 818 | CGPG182 | 70807 | SENSE |
| 60 | 819 | CGPG1837 | 73986 | SENSE |
| 61 | 820 | CGPG1873 | 77005 | SENSE |
| 62 | 821 | CGPG1891 | 70410 | ANTI-SENSE |
| 63 | 822 | CGPG1895 | 14827 | ANTI-SENSE |
| 64 | 823 | CGPG1899 | 19122 | SENSE |
| 65 | 824 | CGPG1913 | 16446 | SENSE |
| 66 | 825 | CGPG1918 | 15143 | SENSE |
| 67 | 826 | CGPG1919 | 70401 | SENSE |
| 68 | 827 | CGPG1922 | 16182 | SENSE |
| 69 | 828 | CGPG1929 | 15126 | SENSE |
| 70 | 829 | CGPG1938 | 15628 | ANTI-SENSE |
| 71 | 830 | CGPG1956 | 78355 | SENSE |
| 72 | 831 | CGPG1964 | 70560 | SENSE |
| 73 | 832 | CGPG1973 | 19133 | SENSE |
| 74 | 833 | CGPG1977 | 73602 | SENSE |
| 75 | 834 | CGPG1996 | 71702 | SENSE |
| 76 | 835 | CGPG2005 | 14909 | ANTI-SENSE |
| 77 | 836 | CGPG2035 | 14927 | ANTI-SENSE |
| 78 | 837 | CGPG2044 | 75945 | SENSE |
| 79 | 838 | CGPG2059 | 16553 | ANTI-SENSE |
| 80 | 839 | CGPG2065 | 75221 | SENSE |
| 81 | 840 | CGPG2068 | 70746 | ANTI-SENSE |
| 82 | 841 | CGPG2072 | 70403 | SENSE |
| 83 | 842 | CGPG2074 | 15966 | ANTI-SENSE |
| 84 | 843 | CGPG2116 | 76076 | SENSE |
| 85 | 844 | CGPG2118 | 17014 | SENSE |
| 86 | 845 | CGPG2142 | 16007 | ANTI-SENSE |
| 87 | 846 | CGPG2148 | 16208 | SENSE |
| 88 | 847 | CGPG2190 | 17310 | SENSE |
| 89 | 848 | CGPG2191 | 15716 | ANTI-SENSE |
| 90 | 849 | CGPG221 | 15627 | SENSE |
| 91 | 850 | CGPG2213 | 15409 | ANTI-SENSE |
| 91 | 850 | CGPG2213 | 17201 | SENSE |
| 92 | 851 | CGPG2247 | 15903 | ANTI-SENSE |
| 93 | 852 | CGPG228 | 10332 | ANTI-SENSE |
| 94 | 853 | CGPG2301 | 73968 | SENSE |
| 95 | 854 | CGPG2304 | 17003 | SENSE |
| 96 | 855 | CGPG2313 | 73847 | SENSE |
| 97 | 856 | CGPG2348 | 76041 | SENSE |
| 98 | 857 | CGPG2349 | 74567 | SENSE |
| 99 | 858 | CGPG2354 | 15809 | ANTI-SENSE |
| 100 | 859 | CGPG2369 | 70110 | SENSE |
| 101 | 860 | CGPG2382 | 70123 | SENSE |
| 102 | 861 | CGPG2392 | 74702 | SENSE |
| 103 | 862 | CGPG2397 | 75936 | SENSE |
| 104 | 863 | CGPG240 | 10462 | ANTI-SENSE |
| 105 | 864 | CGPG2426 | 17402 | SENSE |
| 106 | 865 | CGPG2433 | 73707 | SENSE |
| 107 | 866 | CGPG2437 | 17129 | ANTI-SENSE |

TABLE 2-continued

| NUC Seq ID | PEP Seq ID | Gene ID | Construct ID | Orientation |
|---|---|---|---|---|
| 108 | 867 | CGPG2452 | 72665 | SENSE |
| 109 | 868 | CGPG2464 | 18206 | SENSE |
| 110 | 869 | CGPG2472 | 17151 | ANTI-SENSE |
| 111 | 870 | CGPG2480 | 17813 | SENSE |
| 112 | 871 | CGPG253 | 70845 | SENSE |
| 113 | 872 | CGPG2538 | 16607 | SENSE |
| 114 | 873 | CGPG2567 | 72675 | SENSE |
| 115 | 874 | CGPG2571 | 72677 | SENSE |
| 116 | 875 | CGPG258 | 74534 | SENSE |
| 117 | 876 | CGPG268 | 74535 | SENSE |
| 118 | 877 | CGPG274 | 10204 | ANTI-SENSE |
| 119 | 878 | CGPG275 | 10472 | SENSE |
| 120 | 879 | CGPG277 | 10431 | ANTI-SENSE |
| 121 | 880 | CGPG2785 | 72906 | SENSE |
| 122 | 881 | CGPG2832 | 78362 | SENSE |
| 123 | 882 | CGPG2855 | 17930 | SENSE |
| 124 | 883 | CGPG2865 | 18442 | SENSE |
| 125 | 884 | CGPG2874 | 73207 | SENSE |
| 126 | 885 | CGPG2914 | 19166 | SENSE |
| 127 | 886 | CGPG295 | 10469 | SENSE |
| 128 | 887 | CGPG3004 | 18415 | SENSE |
| 129 | 888 | CGPG3009 | 18418 | SENSE |
| 130 | 889 | CGPG3030 | 19532 | SENSE |
| 131 | 890 | CGPG3048 | 18423 | SENSE |
| 132 | 891 | CGPG3056 | 77909 | SENSE |
| 133 | 892 | CGPG3084 | 19656 | SENSE |
| 134 | 893 | CGPG309 | 10217 | ANTI-SENSE |
| 135 | 894 | CGPG3094 | 18874 | SENSE |
| 136 | 895 | CGPG3095 | 18875 | SENSE |
| 137 | 896 | CGPG3137 | 19256 | SENSE |
| 138 | 897 | CGPG3156 | 19537 | SENSE |
| 139 | 898 | CGPG3157 | 74201 | SENSE |
| 140 | 899 | CGPG3205 | 74233 | SENSE |
| 141 | 900 | CGPG3236 | 18644 | SENSE |
| 142 | 901 | CGPG3248 | 18827 | SENSE |
| 143 | 902 | CGPG3255 | 18220 | SENSE |
| 144 | 903 | CGPG3258 | 18830 | SENSE |
| 145 | 904 | CGPG3261 | 19205 | SENSE |
| 146 | 905 | CGPG3269 | 18226 | SENSE |
| 147 | 906 | CGPG3270 | 18227 | SENSE |
| 148 | 907 | CGPG3283 | 18239 | SENSE |
| 149 | 908 | CGPG3302 | 70415 | SENSE |
| 150 | 909 | CGPG3334 | 18329 | SENSE |
| 151 | 910 | CGPG3361 | 72606 | SENSE |
| 152 | 911 | CGPG337 | 10230 | ANTI-SENSE |
| 153 | 912 | CGPG3400 | 19608 | SENSE |
| 154 | 913 | CGPG3410 | 18271 | SENSE |
| 155 | 914 | CGPG3424 | 18347 | SENSE |
| 156 | 915 | CGPG3428 | 18403 | SENSE |
| 157 | 916 | CGPG3465 | 74206 | SENSE |
| 158 | 917 | CGPG347 | 10234 | ANTI-SENSE |
| 159 | 918 | CGPG351 | 71115 | SENSE |
| 160 | 919 | CGPG3567 | 18406 | SENSE |
| 161 | 920 | CGPG3575 | 19619 | SENSE |
| 162 | 921 | CGPG3579 | 19623 | SENSE |
| 163 | 922 | CGPG3605 | 18381 | SENSE |
| 164 | 923 | CGPG3612 | 18408 | SENSE |
| 165 | 924 | CGPG3616 | 18720 | SENSE |
| 166 | 925 | CGPG3631 | 77537 | SENSE |
| 167 | 926 | CGPG365 | 70833 | SENSE |
| 168 | 927 | CGPG3665 | 19328 | SENSE |
| 169 | 928 | CGPG3684 | 19312 | SENSE |
| 170 | 929 | CGPG3690 | 70538 | SENSE |
| 171 | 930 | CGPG3717 | 70440 | SENSE |
| 172 | 931 | CGPG372 | 11319 | ANTI-SENSE |
| 173 | 932 | CGPG3724 | 70443 | SENSE |
| 174 | 933 | CGPG375 | 72357 | SENSE |
| 175 | 934 | CGPG3781 | 70466 | SENSE |
| 176 | 935 | CGPG380 | 70241 | SENSE |
| 177 | 936 | CGPG3821 | 70476 | SENSE |
| 178 | 937 | CGPG3824 | 70477 | SENSE |
| 179 | 938 | CGPG3901 | 19713 | SENSE |
| 180 | 939 | CGPG391 | 12601 | SENSE |
| 181 | 940 | CGPG3931 | 19747 | SENSE |
| 182 | 941 | CGPG394 | 11117 | ANTI-SENSE |
| 183 | 942 | CGPG3964 | 70965 | SENSE |
| 184 | 943 | CGPG397 | 10366 | ANTI-SENSE |
| 184 | 943 | CGPG397 | 13404 | SENSE |
| 185 | 944 | CGPG3975 | 70935 | SENSE |
| 186 | 945 | CGPG3983 | 77717 | SENSE |
| 187 | 946 | CGPG3986 | 19966 | SENSE |
| 188 | 947 | CGPG3991 | 70909 | SENSE |
| 189 | 948 | CGPG4050 | 19906 | SENSE |
| 190 | 949 | CGPG4070 | 70974 | SENSE |
| 191 | 950 | CGPG4071 | 19802 | SENSE |
| 192 | 951 | CGPG4099 | 19746 | SENSE |
| 193 | 952 | CGPG4138 | 70902 | SENSE |
| 194 | 953 | CGPG4152 | 19933 | SENSE |
| 195 | 954 | CGPG4153 | 19927 | SENSE |
| 196 | 955 | CGPG4164 | 70976 | SENSE |
| 197 | 956 | CGPG4169 | 71440 | SENSE |
| 198 | 957 | CGPG421 | 10413 | ANTI-SENSE |
| 199 | 958 | CGPG422 | 11119 | ANTI-SENSE |
| 200 | 959 | CGPG4223 | 78659 | SENSE |
| 201 | 960 | CGPG4240 | 78665 | SENSE |
| 202 | 961 | CGPG4242 | 78969 | SENSE |
| 203 | 962 | CGPG4248 | 78970 | SENSE |
| 204 | 963 | CGPG425 | 71250 | SENSE |
| 205 | 964 | CGPG4265 | 78972 | SENSE |
| 206 | 965 | CGPG4283 | 78677 | SENSE |
| 207 | 966 | CGPG4297 | 70632 | SENSE |
| 208 | 967 | CGPG43 | 75205 | SENSE |
| 209 | 968 | CGPG430 | 10359 | ANTI-SENSE |
| 209 | 968 | CGPG430 | 11408 | SENSE |
| 210 | 969 | CGPG4305 | 73616 | SENSE |
| 211 | 970 | CGPG4307 | 78358 | SENSE |
| 212 | 971 | CGPG4315 | 71839 | SENSE |
| 213 | 972 | CGPG4320 | 78417 | SENSE |
| 214 | 973 | CGPG4344 | 71952 | SENSE |
| 215 | 974 | CGPG4346 | 78717 | SENSE |
| 216 | 975 | CGPG4349 | 75040 | SENSE |
| 217 | 976 | CGPG4365 | 71843 | SENSE |
| 218 | 977 | CGPG4383 | 70666 | SENSE |
| 219 | 978 | CGPG4389 | 71846 | SENSE |
| 220 | 979 | CGPG4404 | 71314 | SENSE |
| 221 | 980 | CGPG4405 | 76410 | SENSE |
| 222 | 981 | CGPG4419 | 71322 | SENSE |
| 223 | 982 | CGPG4432 | 73214 | SENSE |
| 224 | 983 | CGPG4437 | 71963 | SENSE |
| 225 | 984 | CGPG4443 | 71326 | SENSE |
| 226 | 985 | CGPG445 | 70834 | SENSE |
| 227 | 986 | CGPG4453 | 73215 | SENSE |
| 228 | 987 | CGPG4481 | 71334 | SENSE |
| 229 | 988 | CGPG4490 | 71335 | SENSE |
| 230 | 989 | CGPG4498 | 71347 | SENSE |
| 231 | 990 | CGPG4506 | 71820 | SENSE |
| 232 | 991 | CGPG4553 | 70764 | SENSE |
| 233 | 992 | CGPG4583 | 70680 | SENSE |
| 234 | 993 | CGPG4643 | 72375 | SENSE |
| 235 | 994 | CGPG4650 | 72469 | SENSE |
| 236 | 995 | CGPG4660 | 73951 | SENSE |
| 237 | 996 | CGPG468 | 11003 | ANTI-SENSE |
| 238 | 997 | CGPG4684 | 71613 | SENSE |
| 239 | 998 | CGPG4689 | 78203 | SENSE |
| 240 | 999 | CGPG4691 | 71638 | SENSE |
| 241 | 1000 | CGPG4702 | 71631 | SENSE |
| 242 | 1001 | CGPG4703 | 72368 | SENSE |
| 243 | 1002 | CGPG4710 | 78202 | SENSE |
| 244 | 1003 | CGPG4713 | 78207 | SENSE |
| 245 | 1004 | CGPG4730 | 75209 | SENSE |
| 246 | 1005 | CGPG4747 | 72457 | SENSE |
| 247 | 1006 | CGPG4755 | 73639 | SENSE |
| 248 | 1007 | CGPG4772 | 72526 | SENSE |
| 249 | 1008 | CGPG4779 | 72531 | SENSE |
| 250 | 1009 | CGPG4848 | 73336 | SENSE |
| 251 | 1010 | CGPG4879 | 73722 | SENSE |
| 252 | 1011 | CGPG4882 | 72650 | SENSE |
| 253 | 1012 | CGPG4892 | 73686 | SENSE |
| 254 | 1013 | CGPG4903 | 78353 | SENSE |
| 255 | 1014 | CGPG4925 | 73726 | SENSE |
| 258 | 1015 | CGPG4937 | 74715 | SENSE |
| 257 | 1016 | CGPG4949 | 73230 | SENSE |
| 258 | 1017 | CGPG4971 | 72663 | SENSE |
| 259 | 1018 | CGPG499 | 70822 | SENSE |

TABLE 2-continued

| NUC Seq ID | PEP Seq ID | Gene ID | Construct ID | Orientation |
|---|---|---|---|---|
| 260 | 1019 | CGPG5004 | 72827 | SENSE |
| 261 | 1020 | CGPG5028 | 78339 | SENSE |
| 262 | 1021 | CGPG5032 | 73309 | SENSE |
| 263 | 1022 | CGPG5038 | 78725 | SENSE |
| 264 | 1023 | CGPG5045 | 74222 | SENSE |
| 265 | 1024 | CGPG5048 | 78341 | SENSE |
| 266 | 1025 | CGPG5051 | 78342 | SENSE |
| 267 | 1026 | CGPG5061 | 78349 | SENSE |
| 268 | 1027 | CGPG5062 | 73683 | SENSE |
| 269 | 1028 | CGPG5069 | 73280 | SENSE |
| 270 | 1029 | CGPG5070 | 73281 | SENSE |
| 271 | 1030 | CGPG5097 | 73313 | SENSE |
| 272 | 1031 | CGPG510 | 12772 | ANTI-SENSE |
| 273 | 1032 | CGPG5100 | 73314 | SENSE |
| 274 | 1033 | CGPG5117 | 73861 | SENSE |
| 275 | 1034 | CGPG5151 | 73676 | SENSE |
| 276 | 1035 | CGPG5155 | 74212 | SENSE |
| 277 | 1036 | CGPG5159 | 74218 | SENSE |
| 278 | 1037 | CGPG516 | 71218 | SENSE |
| 279 | 1038 | CGPG5161 | 73731 | SENSE |
| 280 | 1039 | CGPG5186 | 73251 | SENSE |
| 281 | 1040 | CGPG519 | 12773 | ANTI-SENSE |
| 282 | 1041 | CGPG5190 | 73254 | SENSE |
| 283 | 1042 | CGPG5191 | 73255 | SENSE |
| 284 | 1043 | CGPG5196 | 73257 | SENSE |
| 285 | 1044 | CGPG521 | 11049 | SENSE |
| 286 | 1045 | CGPG5211 | 74231 | SENSE |
| 287 | 1046 | CGPG5212 | 73266 | SENSE |
| 288 | 1047 | CGPG5213 | 75823 | SENSE |
| 289 | 1048 | CGPG522 | 11353 | SENSE |
| 290 | 1049 | CGPG5223 | 72025 | SENSE |
| 291 | 1050 | CGPG5224 | 72037 | SENSE |
| 292 | 1051 | CGPG5225 | 72049 | SENSE |
| 293 | 1052 | CGPG5254 | 78213 | SENSE |
| 294 | 1053 | CGPG5257 | 72007 | SENSE |
| 295 | 1054 | CGPG5262 | 72067 | SENSE |
| 296 | 1055 | CGPG5265 | 72008 | SENSE |
| 297 | 1056 | CGPG5262 | 72022 | SENSE |
| 298 | 1057 | CGPG5304 | 72096 | SENSE |
| 299 | 1058 | CGPG532 | 10811 | ANTI-SENSE |
| 300 | 1059 | CGPG5336 | 72138 | SENSE |
| 301 | 1060 | CGPG5350 | 74261 | SENSE |
| 302 | 1061 | CGPG5355 | 74264 | SENSE |
| 303 | 1062 | CGPG5376 | 74271 | SENSE |
| 304 | 1063 | CGPG5377 | 74272 | SENSE |
| 305 | 1064 | CGPG5382 | 78442 | SENSE |
| 306 | 1065 | CGPG5385 | 76709 | SENSE |
| 307 | 1066 | CGPG539 | 75002 | SENSE |
| 308 | 1067 | CGPG5437 | 78361 | SENSE |
| 309 | 1068 | CGPG5450 | 74238 | SENSE |
| 310 | 1069 | CGPG5473 | 78434 | SENSE |
| 311 | 1070 | CGPG55 | 73932 | SENSE |
| 312 | 1071 | CGPG5505 | 72713 | SENSE |
| 313 | 1072 | CGPG5510 | 72773 | SENSE |
| 314 | 1073 | CGPG5514 | 72678 | SENSE |
| 315 | 1074 | CGPG5541 | 72765 | SENSE |
| 316 | 1075 | CGPG5546 | 72730 | SENSE |
| 317 | 1076 | CGPG5552 | 72707 | SENSE |
| 318 | 1077 | CGPG5556 | 72755 | SENSE |
| 319 | 1078 | CGPG557 | 10610 | ANTI-SENSE |
| 320 | 1079 | CGPG5576 | 73953 | SENSE |
| 321 | 1080 | CGPG5596 | 73173 | SENSE |
| 322 | 1081 | CGPG5605 | 73979 | SENSE |
| 323 | 1082 | CGPG5606 | 73966 | SENSE |
| 324 | 1083 | CGPG561 | 12776 | ANTI-SENSE |
| 325 | 1084 | CGPG5618 | 72960 | SENSE |
| 326 | 1085 | CGPG5642 | 73021 | SENSE |
| 327 | 1086 | CGPG5644 | 73163 | SENSE |
| 328 | 1087 | CGPG5647 | 73187 | SENSE |
| 329 | 1088 | CGPG5655 | 73188 | SENSE |
| 330 | 1089 | CGPG5660 | 73153 | SENSE |
| 331 | 1090 | CGPG5662 | 73983 | SENSE |
| 332 | 1091 | CGPG568 | 11516 | ANTI-SENSE |
| 333 | 1092 | CGPG5686 | 73179 | SENSE |
| 334 | 1093 | CGPG5702 | 73009 | SENSE |
| 335 | 1094 | CGPG5712 | 73109 | SENSE |
| 336 | 1095 | CGPG5713 | 73121 | SENSE |
| 337 | 1096 | CGPG5715 | 73157 | SENSE |
| 338 | 1097 | CGPG5723 | 73158 | SENSE |
| 339 | 1098 | CGPG5729 | 73088 | SENSE |
| 340 | 1099 | CGPG5730 | 73135 | SENSE |
| 341 | 1100 | CGPG5732 | 73005 | SENSE |
| 342 | 1101 | CGPG5741 | 73171 | SENSE |
| 343 | 1102 | CGPG5752 | 73042 | SENSE |
| 344 | 1103 | CGPG5771 | 73067 | SENSE |
| 345 | 1104 | CGPG5778 | 73148 | SENSE |
| 346 | 1105 | CGPG5782 | 72933 | SENSE |
| 347 | 1106 | CGPG5785 | 77723 | SENSE |
| 348 | 1107 | CGPG5797 | 73048 | SENSE |
| 349 | 1108 | CGPG580 | 10616 | ANTI-SENSE |
| 350 | 1109 | CGPG5805 | 72923 | SENSE |
| 351 | 1110 | CGPG5810 | 78501 | SENSE |
| 352 | 1111 | CGPG5822 | 78371 | SENSE |
| 353 | 1112 | CGPG5837 | 74332 | SENSE |
| 354 | 1113 | CGPG5855 | 74738 | SENSE |
| 355 | 1114 | CGPG5868 | 75225 | SENSE |
| 356 | 1115 | CGPG587 | 11149 | SENSE |
| 357 | 1116 | CGPG5889 | 74739 | SENSE |
| 358 | 1117 | CGPG5893 | 74748 | SENSE |
| 359 | 1118 | CGPG5909 | 78113 | SENSE |
| 360 | 1119 | CGPG5914 | 75233 | SENSE |
| 361 | 1120 | CGPG5921 | 77311 | SENSE |
| 362 | 1121 | CGPG5925 | 77008 | SENSE |
| 363 | 1122 | CGPG5926 | 77321 | SENSE |
| 364 | 1123 | CGPG5930 | 76214 | SENSE |
| 365 | 1124 | CGPG5945 | 75238 | SENSE |
| 366 | 1125 | CGPG5958 | 76118 | SENSE |
| 367 | 1126 | CGPG5977 | 75243 | SENSE |
| 368 | 1127 | CGPG598 | 72602 | SENSE |
| 369 | 1128 | CGPG5986 | 75810 | SENSE |
| 370 | 1129 | CGPG5994 | 75094 | SENSE |
| 371 | 1130 | CGPG5996 | 75818 | SENSE |
| 372 | 1131 | CGPG6021 | 75248 | SENSE |
| 373 | 1132 | CGPG6027 | 74605 | SENSE |
| 374 | 1133 | CGPG6035 | 75252 | SENSE |
| 375 | 1134 | CGPG604 | 10620 | ANTI-SENSE |
| 376 | 1135 | CGPG6049 | 74611 | SENSE |
| 377 | 1136 | CGPG606 | 11152 | SENSE |
| 378 | 1137 | CGPG6069 | 76610 | SENSE |
| 379 | 1138 | CGPG608 | 70243 | SENSE |
| 380 | 1139 | CGPG6080 | 74371 | SENSE |
| 381 | 1140 | CGPG6082 | 74373 | SENSE |
| 382 | 1141 | CGPG6089 | 74615 | SENSE |
| 383 | 1142 | CGPG6120 | 74620 | SENSE |
| 384 | 1143 | CGPG6128 | 74626 | SENSE |
| 385 | 1144 | CGPG614 | 10622 | ANTI-SENSE |
| 386 | 1145 | CGPG6149 | 74636 | SENSE |
| 387 | 1146 | CGPG6172 | 74656 | SENSE |
| 388 | 1147 | CGPG6174 | 74658 | SENSE |
| 389 | 1148 | CGPG6176 | 74659 | SENSE |
| 390 | 1149 | CGPG6197 | 74673 | SENSE |
| 391 | 1150 | CGPG620 | 13518 | ANTI-SENSE |
| 391 | 1150 | CGPG620 | 70824 | SENSE |
| 392 | 1151 | CGPG6201 | 75267 | SENSE |
| 393 | 1152 | CGPG6204 | 75283 | SENSE |
| 394 | 1153 | CGPG621 | 13805 | SENSE |
| 395 | 1154 | CGPG6210 | 76221 | SENSE |
| 396 | 1155 | CGPG6211 | 76226 | SENSE |
| 397 | 1156 | CGPG6214 | 76222 | SENSE |
| 398 | 1157 | CGPG6215 | 76611 | SENSE |
| 399 | 1158 | CGPG6222 | 76228 | SENSE |
| 400 | 1159 | CGPG6229 | 76435 | SENSE |
| 401 | 1160 | CGPG6233 | 76436 | SENSE |
| 402 | 1161 | CGPG6237 | 78743 | SENSE |
| 403 | 1162 | CGPG6243 | 75814 | SENSE |
| 404 | 1163 | CGPG6248 | 77016 | SENSE |
| 405 | 1164 | CGPG6252 | 78734 | SENSE |
| 406 | 1165 | CGPG6267 | 75274 | SENSE |
| 407 | 1166 | CGPG6272 | 76233 | SENSE |
| 408 | 1167 | CGPG6294 | 74674 | SENSE |
| 409 | 1168 | CGPG63 | 70225 | SENSE |
| 410 | 1169 | CGPG6311 | 75291 | SENSE |
| 411 | 1170 | CGPG6317 | 75292 | SENSE |
| 412 | 1171 | CGPG6328 | 78607 | SENSE |

TABLE 2-continued

| NUC Seq ID | PEP Seq ID | Gene ID | Construct ID | Orientation |
|---|---|---|---|---|
| 413 | 1172 | CGPG6334 | 78367 | SENSE |
| 414 | 1173 | CGPG6336 | 76528 | SENSE |
| 415 | 1174 | CGPG6349 | 77319 | SENSE |
| 416 | 1175 | CGPG6352 | 74677 | SENSE |
| 417 | 1176 | CGPG6353 | 78109 | SENSE |
| 418 | 1177 | CGPG6364 | 77725 | SENSE |
| 419 | 1178 | CGPG6366 | 73437 | SENSE |
| 420 | 1179 | CGPG6375 | 73450 | SENSE |
| 421 | 1180 | CGPG6388 | 73416 | SENSE |
| 422 | 1181 | CGPG6391 | 73452 | SENSE |
| 423 | 1182 | CGPG6399 | 73453 | SENSE |
| 424 | 1183 | CGPG6407 | 73454 | SENSE |
| 425 | 1184 | CGPG6418 | 73491 | SENSE |
| 426 | 1185 | CGPG6430 | 73445 | SENSE |
| 427 | 1186 | CGPG6432 | 73469 | SENSE |
| 428 | 1187 | CGPG6437 | 73434 | SENSE |
| 429 | 1188 | CGPG6445 | 73471 | SENSE |
| 430 | 1189 | CGPG6450 | 73436 | SENSE |
| 431 | 1190 | CGPG6458 | 73525 | SENSE |
| 432 | 1191 | CGPG6465 | 73514 | SENSE |
| 433 | 1192 | CGPG6476 | 73551 | SENSE |
| 434 | 1193 | CGPG6505 | 73519 | SENSE |
| 435 | 1194 | CGPG6507 | 73543 | SENSE |
| 436 | 1195 | CGPG6509 | 73567 | SENSE |
| 437 | 1196 | CGPG6510 | 73579 | SENSE |
| 438 | 1197 | CGPG6515 | 73556 | SENSE |
| 439 | 1198 | CGPG6520 | 73545 | SENSE |
| 440 | 1199 | CGPG6531 | 73511 | SENSE |
| 441 | 1200 | CGPG6553 | 74138 | SENSE |
| 442 | 1201 | CGPG6557 | 74186 | SENSE |
| 443 | 1202 | CGPG6563 | 74163 | SENSE |
| 444 | 1203 | CGPG6564 | 74175 | SENSE |
| 445 | 1204 | CGPG6572 | 74176 | SENSE |
| 446 | 1205 | CGPG6577 | 74141 | SENSE |
| 447 | 1206 | CGPG6588 | 74178 | SENSE |
| 448 | 1207 | CGPG6596 | 74179 | SENSE |
| 449 | 1208 | CGPG6614 | 74110 | SENSE |
| 450 | 1209 | CGPG6619 | 74170 | SENSE |
| 451 | 1210 | CGPG6623 | 74123 | SENSE |
| 452 | 1211 | CGPG6626 | 74159 | SENSE |
| 453 | 1212 | CGPG663 | 10633 | ANTI-SENSE |
| 454 | 1213 | CGPG6635 | 74172 | SENSE |
| 455 | 1214 | CGPG6636 | 74184 | SENSE |
| 456 | 1215 | CGPG6641 | 74582 | SENSE |
| 457 | 1216 | CGPG6642 | 74584 | SENSE |
| 458 | 1217 | CGPG6645 | 74687 | SENSE |
| 459 | 1218 | CGPG6660 | 74461 | SENSE |
| 460 | 1219 | CGPG6671 | 74403 | SENSE |
| 461 | 1220 | CGPG6697 | 74430 | SENSE |
| 462 | 1221 | CGPG6706 | 74443 | SENSE |
| 463 | 1222 | CGPG6723 | 74457 | SENSE |
| 464 | 1223 | CGPG6729 | 74434 | SENSE |
| 465 | 1224 | CGPG6738 | 74447 | SENSE |
| 466 | 1225 | CGPG6742 | 74495 | SENSE |
| 467 | 1226 | CGPG6752 | 74513 | SENSE |
| 468 | 1227 | CGPG6760 | 74514 | SENSE |
| 469 | 1228 | CGPG6768 | 74515 | SENSE |
| 470 | 1229 | CGPG6779 | 74552 | SENSE |
| 471 | 1230 | CGPG6785 | 74529 | SENSE |
| 472 | 1231 | CGPG6800 | 74519 | SENSE |
| 473 | 1232 | CGPG686 | 10638 | ANTI-SENSE |
| 474 | 1233 | CGPG6898 | 76547 | SENSE |
| 475 | 1234 | CGPG6900 | 76548 | SENSE |
| 476 | 1235 | CGPG691 | 14703 | SENSE |
| 477 | 1236 | CGPG6920 | 75856 | SENSE |
| 478 | 1237 | CGPG6921 | 76642 | SENSE |
| 479 | 1238 | CGPG6930 | 77522 | SENSE |
| 480 | 1239 | CGPG6934 | 77516 | SENSE |
| 481 | 1240 | CGPG6945 | 75864 | SENSE |
| 482 | 1241 | CGPG6946 | 76275 | SENSE |
| 483 | 1242 | CGPG6948 | 76276 | SENSE |
| 484 | 1243 | CGPG6974 | 75869 | SENSE |
| 485 | 1244 | CGPG6976 | 76558 | SENSE |
| 486 | 1245 | CGPG6996 | 75876 | SENSE |
| 487 | 1246 | CGPG7002 | 75878 | SENSE |
| 488 | 1247 | CGPG7013 | 75881 | SENSE |
| 489 | 1248 | CGPG7021 | 77525 | SENSE |
| 490 | 1249 | CGPG7056 | 76454 | SENSE |
| 491 | 1250 | CGPG7071 | 75895 | SENSE |
| 492 | 1251 | CGPG7075 | 78377 | SENSE |
| 493 | 1252 | CGPG7080 | 75896 | SENSE |
| 494 | 1253 | CGPG7094 | 77527 | SENSE |
| 495 | 1254 | CGPG7095 | 78984 | SENSE |
| 496 | 1255 | CGPG7104 | 77528 | SENSE |
| 497 | 1256 | CGPG7118 | 76752 | SENSE |
| 498 | 1257 | CGPG7122 | 78106 | SENSE |
| 499 | 1258 | CGPG713 | 11720 | ANTI-SENSE |
| 500 | 1259 | CGPG7130 | 78740 | SENSE |
| 501 | 1260 | CGPG7145 | 76157 | SENSE |
| 502 | 1261 | CGPG7166 | 77530 | SENSE |
| 503 | 1262 | CGPG7179 | 76755 | SENSE |
| 504 | 1263 | CGPG7184 | 76166 | SENSE |
| 505 | 1264 | CGPG7185 | 76756 | SENSE |
| 506 | 1265 | CGPG7192 | 78990 | SENSE |
| 507 | 1266 | CGPG7199 | 78460 | SENSE |
| 508 | 1267 | CGPG72 | 11022 | ANTI-SENSE |
| 509 | 1268 | CGPG7231 | 77533 | SENSE |
| 510 | 1269 | CGPG7241 | 76572 | SENSE |
| 511 | 1270 | CGPG7243 | 76186 | SENSE |
| 512 | 1271 | CGPG7258 | 76190 | SENSE |
| 513 | 1272 | CGPG7265 | 77071 | SENSE |
| 514 | 1273 | CGPG7274 | 76194 | SENSE |
| 515 | 1274 | CGPG7291 | 78112 | SENSE |
| 516 | 1275 | CGPG7303 | 74802 | SENSE |
| 517 | 1276 | CGPG7315 | 74851 | SENSE |
| 518 | 1277 | CGPG7324 | 74864 | SENSE |
| 519 | 1278 | CGPG7327 | 74805 | SENSE |
| 520 | 1279 | CGPG7338 | 74842 | SENSE |
| 521 | 1280 | CGPG7347 | 78231 | SENSE |
| 522 | 1281 | CGPG7348 | 74867 | SENSE |
| 523 | 1282 | CGPG7352 | 74820 | SENSE |
| 524 | 1283 | CGPG7356 | 74868 | SENSE |
| 525 | 1284 | CGPG7359 | 74809 | SENSE |
| 526 | 1285 | CGPG7362 | 74845 | SENSE |
| 527 | 1286 | CGPG7372 | 74870 | SENSE |
| 528 | 1287 | CGPG7379 | 74859 | SENSE |
| 529 | 1288 | CGPG7398 | 74985 | SENSE |
| 530 | 1289 | CGPG7403 | 74950 | SENSE |
| 531 | 1290 | CGPG7404 | 74962 | SENSE |
| 532 | 1291 | CGPG7410 | 74939 | SENSE |
| 533 | 1292 | CGPG7417 | 74928 | SENSE |
| 534 | 1293 | CGPG7423 | 74905 | SENSE |
| 535 | 1294 | CGPG7424 | 74917 | SENSE |
| 536 | 1295 | CGPG7430 | 74989 | SENSE |
| 537 | 1296 | CGPG7438 | 74990 | SENSE |
| 538 | 1297 | CGPG7443 | 74955 | SENSE |
| 539 | 1298 | CGPG7449 | 74932 | SENSE |
| 540 | 1299 | CGPG7450 | 74944 | SENSE |
| 541 | 1300 | CGPG7452 | 74968 | SENSE |
| 542 | 1301 | CGPG7459 | 74957 | SENSE |
| 543 | 1302 | CGPG7480 | 75374 | SENSE |
| 544 | 1303 | CGPG7481 | 75386 | SENSE |
| 545 | 1304 | CGPG7483 | 77807 | SENSE |
| 546 | 1305 | CGPG7497 | 75388 | SENSE |
| 547 | 1306 | CGPG7503 | 75365 | SENSE |
| 548 | 1307 | CGPG7504 | 75377 | SENSE |
| 549 | 1308 | CGPG7510 | 75354 | SENSE |
| 550 | 1309 | CGPG7516 | 75331 | SENSE |
| 551 | 1310 | CGPG7517 | 75343 | SENSE |
| 552 | 1311 | CGPG7523 | 77809 | SENSE |
| 553 | 1312 | CGPG7524 | 75332 | SENSE |
| 554 | 1313 | CGPG7525 | 75344 | SENSE |
| 555 | 1314 | CGPG7532 | 75333 | SENSE |
| 556 | 1315 | CGPG7537 | 75393 | SENSE |
| 557 | 1316 | CGPG7548 | 75335 | SENSE |
| 558 | 1317 | CGPG7575 | 75462 | SENSE |
| 559 | 1318 | CGPG7577 | 75486 | SENSE |
| 560 | 1319 | CGPG7590 | 75452 | SENSE |
| 561 | 1320 | CGPG7599 | 75465 | SENSE |
| 562 | 1321 | CGPG7601 | 75489 | SENSE |
| 563 | 1322 | CGPG7605 | 75442 | SENSE |
| 564 | 1323 | CGPG7607 | 75466 | SENSE |
| 565 | 1324 | CGPG7616 | 75479 | SENSE |
| 566 | 1325 | CGPG7632 | 75481 | SENSE |

TABLE 2-continued

| NUC Seq ID | PEP Seq ID | Gene ID | Construct ID | Orientation |
|---|---|---|---|---|
| 567 | 1326 | CGPG7673 | 78233 | SENSE |
| 568 | 1327 | CGPG7683 | 75539 | SENSE |
| 569 | 1328 | CGPG773 | 11919 | ANTI-SENSE |
| 570 | 1329 | CGPG7776 | 75603 | SENSE |
| 571 | 1330 | CGPG7781 | 75663 | SENSE |
| 572 | 1331 | CGPG7785 | 75616 | SENSE |
| 573 | 1332 | CGPG7787 | 75640 | SENSE |
| 574 | 1333 | CGPG7793 | 75617 | SENSE |
| 575 | 1334 | CGPG7796 | 75653 | SENSE |
| 576 | 1335 | CGPG7797 | 75665 | SENSE |
| 577 | 1336 | CGPG7801 | 75618 | SENSE |
| 578 | 1337 | CGPG7813 | 78238 | SENSE |
| 579 | 1338 | CGPG7816 | 75608 | SENSE |
| 580 | 1339 | CGPG7826 | 75633 | SENSE |
| 581 | 1340 | CGPG7861 | 75761 | SENSE |
| 582 | 1341 | CGPG7863 | 75785 | SENSE |
| 583 | 1342 | CGPG7868 | 75750 | SENSE |
| 584 | 1343 | CGPG7881 | 75716 | SENSE |
| 585 | 1344 | CGPG7887 | 78129 | SENSE |
| 586 | 1345 | CGPG7899 | 77539 | SENSE |
| 587 | 1346 | CGPG7901 | 77540 | SENSE |
| 588 | 1347 | CGPG7909 | 77542 | SENSE |
| 589 | 1348 | CGPG7911 | 77543 | SENSE |
| 590 | 1349 | CGPG7919 | 77545 | SENSE |
| 591 | 1350 | CGPG7935 | 77550 | SENSE |
| 592 | 1351 | CGPG7940 | 77552 | SENSE |
| 593 | 1352 | CGPG7959 | 77556 | SENSE |
| 594 | 1353 | CGPG7967 | 77559 | SENSE |
| 595 | 1354 | CGPG7975 | 77957 | SENSE |
| 596 | 1355 | CGPG7996 | 77565 | SENSE |
| 597 | 1356 | CGPG8006 | 78508 | SENSE |
| 598 | 1357 | CGPG801 | 11748 | ANTI-SENSE |
| 599 | 1358 | CGPG8023 | 77920 | SENSE |
| 600 | 1359 | CGPG8025 | 77573 | SENSE |
| 601 | 1360 | CGPG8038 | 77961 | SENSE |
| 602 | 1361 | CGPG8053 | 77922 | SENSE |
| 603 | 1362 | CGPG8054 | 77337 | SENSE |
| 604 | 1363 | CGPG8059 | 77924 | SENSE |
| 605 | 1364 | CGPG8070 | 77926 | SENSE |
| 606 | 1365 | CGPG8073 | 77964 | SENSE |
| 607 | 1366 | CGPG8076 | 77346 | SENSE |
| 608 | 1367 | CGPG8084 | 77350 | SENSE |
| 609 | 1368 | CGPG8093 | 77929 | SENSE |
| 610 | 1369 | CGPG8095 | 77586 | SENSE |
| 611 | 1370 | CGPG8096 | 78510 | SENSE |
| 612 | 1371 | CGPG8097 | 77930 | SENSE |
| 613 | 1372 | CGPG8112 | 77590 | SENSE |
| 614 | 1373 | CGPG8120 | 77592 | SENSE |
| 615 | 1374 | CGPG8129 | 77361 | SENSE |
| 616 | 1375 | CGPG8140 | 77934 | SENSE |
| 617 | 1376 | CGPG8157 | 77367 | SENSE |
| 618 | 1377 | CGPG8158 | 78121 | SENSE |
| 619 | 1378 | CGPG8165 | 77370 | SENSE |
| 620 | 1379 | CGPG8169 | 78117 | SENSE |
| 621 | 1380 | CGPG8203 | 77950 | SENSE |
| 622 | 1381 | CGPG8205 | 78905 | SENSE |
| 623 | 1382 | CGPG8212 | 75913 | SENSE |
| 624 | 1383 | CGPG8213 | 75925 | SENSE |
| 625 | 1384 | CGPG8225 | 75974 | SENSE |
| 626 | 1385 | CGPG8227 | 75903 | SENSE |
| 627 | 1386 | CGPG8235 | 75904 | SENSE |
| 628 | 1387 | CGPG8236 | 75916 | SENSE |
| 629 | 1388 | CGPG8244 | 75917 | SENSE |
| 630 | 1389 | CGPG8254 | 75942 | SENSE |
| 631 | 1390 | CGPG8255 | 75954 | SENSE |
| 632 | 1391 | CGPG8262 | 75943 | SENSE |
| 633 | 1392 | CGPG8264 | 75967 | SENSE |
| 634 | 1393 | CGPG8269 | 75932 | SENSE |
| 635 | 1394 | CGPG8271 | 75956 | SENSE |
| 636 | 1395 | CGPG8305 | 78135 | SENSE |
| 637 | 1396 | CGPG8320 | 78612 | SENSE |
| 638 | 1397 | CGPG8326 | 77969 | SENSE |
| 639 | 1398 | CGPG8344 | 78136 | SENSE |
| 640 | 1399 | CGPG8347 | 77627 | SENSE |
| 641 | 1400 | CGPG8359 | 78142 | SENSE |
| 642 | 1401 | CGPG8370 | 77973 | SENSE |
| 643 | 1402 | CGPG8371 | 78141 | SENSE |
| 644 | 1403 | CGPG8375 | 78963 | SENSE |
| 645 | 1404 | CGPG8378 | 78153 | SENSE |
| 646 | 1405 | CGPG8383 | 78156 | SENSE |
| 647 | 1406 | CGPG841 | 11807 | ANTI-SENSE |
| 648 | 1407 | CGPG8436 | 78528 | SENSE |
| 649 | 1408 | CGPG8438 | 78530 | SENSE |
| 650 | 1409 | CGPG8450 | 78618 | SENSE |
| 651 | 1410 | CGPG8451 | 78919 | SENSE |
| 652 | 1411 | CGPG8459 | 77974 | SENSE |
| 653 | 1412 | CGPG8461 | 77630 | SENSE |
| 654 | 1413 | CGPG8463 | 78921 | SENSE |
| 655 | 1414 | CGPG8471 | 78620 | SENSE |
| 656 | 1415 | CGPG8474 | 77975 | SENSE |
| 657 | 1416 | CGPG8475 | 78536 | SENSE |
| 658 | 1417 | CGPG8476 | 78537 | SENSE |
| 659 | 1418 | CGPG8490 | 78540 | SENSE |
| 660 | 1419 | CGPG8510 | 77993 | SENSE |
| 661 | 1420 | CGPG8530 | 78924 | SENSE |
| 662 | 1421 | CGPG8533 | 78009 | SENSE |
| 663 | 1422 | CGPG8544 | 78014 | SENSE |
| 664 | 1423 | CGPG8546 | 78015 | SENSE |
| 665 | 1424 | CGPG8549 | 78018 | SENSE |
| 666 | 1425 | CGPG8555 | 78021 | SENSE |
| 667 | 1426 | CGPG8561 | 78158 | SENSE |
| 668 | 1427 | CGPG8569 | 78026 | SENSE |
| 669 | 1428 | CGPG8573 | 78028 | SENSE |
| 670 | 1429 | CGPG8588 | 78032 | SENSE |
| 671 | 1430 | CGPG8597 | 78388 | SENSE |
| 672 | 1431 | CGPG8607 | 78044 | SENSE |
| 673 | 1432 | CGPG8611 | 78047 | SENSE |
| 674 | 1433 | CGPG8629 | 78055 | SENSE |
| 675 | 1434 | CGPG8632 | 78057 | SENSE |
| 876 | 1435 | CGPG8634 | 78059 | SENSE |
| 677 | 1435 | CGPG8635 | 78553 | SENSE |
| 678 | 1437 | CGPG8636 | 78163 | SENSE |
| 679 | 1438 | CGPG8640 | 78060 | SENSE |
| 880 | 1439 | CGPG8642 | 78062 | SENSE |
| 681 | 1440 | CGPG8646 | 78065 | SENSE |
| 682 | 1441 | CGPG8666 | 78590 | SENSE |
| 683 | 1442 | CGPG8677 | 78177 | SENSE |
| 684 | 1443 | CGPG8688 | 78952 | SENSE |
| 685 | 1444 | CGPG8689 | 78559 | SENSE |
| 686 | 1445 | CGPG8704 | 78169 | SENSE |
| 687 | 1446 | CGPG8716 | 78178 | SENSE |
| 688 | 1447 | CGPG8754 | 78932 | SENSE |
| 689 | 1448 | CGPG8769 | 78185 | SENSE |
| 690 | 1449 | CGPG8774 | 78186 | SENSE |
| 691 | 1450 | CGPG8778 | 78572 | SENSE |
| 692 | 1451 | CGPG8784 | 78631 | SENSE |
| 693 | 1452 | CGPG879 | 12425 | ANTI-SENSE |
| 694 | 1453 | CGPG8797 | 78938 | SENSE |
| 695 | 1454 | CGPG8810 | 78961 | SENSE |
| 696 | 1455 | CGPG8827 | 78584 | SENSE |
| 697 | 1456 | CGPG8853 | 78589 | SENSE |
| 698 | 1457 | CGPG8873 | 78252 | SENSE |
| 699 | 1458 | CGPG8877 | 76314 | SENSE |
| 700 | 1459 | CGPG8878 | 76326 | SENSE |
| 701 | 1460 | CGPG8881 | 76362 | SENSE |
| 702 | 1461 | CGPG8895 | 76340 | SENSE |
| 703 | 1462 | CGPG8906 | 76377 | SENSE |
| 704 | 1463 | CGPG8917 | 76319 | SENSE |
| 705 | 1464 | CGPG8919 | 76343 | SENSE |
| 706 | 1465 | CGPG8925 | 76320 | SENSE |
| 707 | 1466 | CGPG8930 | 76380 | SENSE |
| 708 | 1467 | CGPG8937 | 77831 | SENSE |
| 709 | 1468 | CGPG8942 | 76334 | SENSE |
| 710 | 1469 | CGPG8946 | 76382 | SENSE |
| 711 | 1470 | CGPG8990 | 76838 | SENSE |
| 712 | 1471 | CGPG9001 | 77841 | SENSE |
| 713 | 1472 | CGPG9008 | 77838 | SENSE |
| 714 | 1473 | CGPG9016 | 76865 | SENSE |
| 715 | 1474 | CGPG9036 | 77834 | SENSE |
| 716 | 1475 | CGPG9060 | 76823 | SENSE |
| 717 | 1476 | CGPG9069 | 76836 | SENSE |
| 718 | 1477 | CGPG908 | 14133 | ANTI-SENSE |
| 719 | 1478 | CGPG9093 | 76927 | SENSE |
| 720 | 1479 | CGPG9096 | 76963 | SENSE |

TABLE 2-continued

| NUC Seq ID | PEP Seq ID | Gene ID | Construct ID | Orientation |
|---|---|---|---|---|
| 721 | 1480 | CGPG9097 | 76975 | SENSE |
| 722 | 1481 | CGPG9106 | 76988 | SENSE |
| 723 | 1482 | CGPG9111 | 76953 | SENSE |
| 724 | 1483 | CGPG9112 | 76965 | SENSE |
| 725 | 1484 | CGPG9123 | 77161 | SENSE |
| 726 | 1485 | CGPG9124 | 77852 | SENSE |
| 727 | 1486 | CGPG9138 | 77151 | SENSE |
| 728 | 1487 | CGPG9143 | 77116 | SENSE |
| 729 | 1488 | CGPG9150 | 77105 | SENSE |
| 730 | 1489 | CGPG9152 | 77129 | SENSE |
| 731 | 1490 | CGPG9162 | 77154 | SENSE |
| 732 | 1491 | CGPG9165 | 77190 | SENSE |
| 733 | 1492 | CGPG9166 | 77107 | SENSE |
| 734 | 1493 | CGPG9171 | 77167 | SENSE |
| 735 | 1494 | CGPG9177 | 77144 | SENSE |
| 736 | 1495 | CGPG9178 | 77156 | SENSE |
| 737 | 1496 | CGPG9179 | 77168 | SENSE |
| 738 | 1497 | CGPG9181 | 77192 | SENSE |
| 739 | 1498 | CGPG9188 | 77181 | SENSE |
| 740 | 1499 | CGPG9189 | 77193 | SENSE |
| 741 | 1500 | CGPG9201 | 77147 | SENSE |
| 742 | 1501 | CGPG9222 | 77853 | SENSE |
| 743 | 1502 | CGPG9234 | 77854 | SENSE |
| 744 | 1503 | CGPG9237 | 77287 | SENSE |
| 745 | 1504 | CGPG9244 | 77276 | SENSE |
| 746 | 1505 | CGPG9248 | 77229 | SENSE |
| 747 | 1506 | CGPG9249 | 77241 | SENSE |
| 748 | 1507 | CGPG9251 | 77265 | SENSE |
| 749 | 1508 | CGPG9280 | 77233 | SENSE |
| 750 | 1509 | CGPG9285 | 77293 | SENSE |
| 751 | 1510 | CGPG9302 | 77473 | SENSE |
| 752 | 1511 | CGPG931 | 76402 | SENSE |
| 753 | 1512 | CGPG9313 | 77428 | SENSE |
| 754 | 1513 | CGPG9315 | 77429 | SENSE |
| 755 | 1514 | CGPG9327 | 78277 | SENSE |
| 756 | 1515 | CGPG933 | 11935 | ANTI-SENSE |
| 757 | 1516 | CGPG9334 | 78259 | SENSE |
| 758 | 1517 | CGPG967 | 12276 | ANTI-SENSE |
| 759 | 1518 | CGPG988 | 12365 | SENSE |

Recombinant DNA

DNA for use in the present invention to improve traits in plants have a nucleotide sequence of SEQ ID NO: 1 through SEQ ID NO: 759, as well as the homologs of such DNA molecules. A subset of the DNA for gene suppression aspects of the invention includes fragments of the disclosed full polynucleotides consisting of oligonucleotides of 21 or more consecutive nucleotides. Oligonucleotides the larger molecules having a sequence selected from the group consisting of SEQ ID NO: 1 through SEQ ID NO: 759 are useful as probes and primers for detection of the polynucleotides used in the invention. Also useful in this invention are variants of the DNA. Such variants may be naturally occurring, including DNA from homologous genes from the same or a different species, or may be non-natural variants, for example DNA synthesized using chemical synthesis methods, or generated using recombinant DNA techniques. Degeneracy of the genetic code provides the possibility to substitute at least one base of the protein encoding sequence of a gene with a different base without causing the amino acid sequence of the polypeptide produced from the gene to be changed. Hence, a DNA useful in the present invention may have any base sequence that has been changed from the sequences provided herein by substitution in accordance with degeneracy of the genetic code.

Homologs of the genes providing DNA demonstrated as useful in improving traits in model plants disclosed herein will generally have significant identity with the DNA disclosed herein. DNA is substantially identical to a reference DNA if, when the sequences of the polynucleotides are optimally aligned there is about 60% nucleotide equivalence; more preferably 70%; more preferably 80% equivalence; more preferably 85% equivalence; more preferably 90%; more preferably 95%; and/or more preferably 98% or 99% equivalence over a comparison window. A comparison window is preferably at least 50-100 nucleotides, and more preferably is the entire length of the polynucleotide provided herein. Optimal alignment of sequences for aligning a comparison window may be conducted by algorithms; preferably by computerized implementations of these algorithms (for example, the Wisconsin Genetics Software Package Release 7.0-10.0, Genetics Computer Group, 575 Science Dr., Madison, Wis.). The reference polynucleotide may be a full-length molecule or a portion of a longer molecule. Preferentially, the window of comparison for determining polynucleotide identity of protein encoding sequences is the entire coding region.

Proteins useful for imparting enhanced traits are entire proteins or at least a sufficient portion of the entire protein to impart the relevant biological activity of the protein. Proteins useful for generation of transgenic plants having enhanced straits include the proteins with an amino acid sequence provided herein as SEQ ID NO: 760 through SEQ ID NO: 1518, as well as homologs of such proteins.

Homologs of the proteins useful in the invention are identified by comparison of the amino acid sequence of the protein to amino acid sequences of proteins from the same or different plant sources, e.g., manually or by using known homology-based search algorithms Such as those commonly known and referred to as BLAST, FASTA, and Smith-Waterman. As used herein, a homolog is a protein from the same or a different organism that performs the same biological function as the polypeptide to which it is compared. An orthologous relation between two organisms is not necessarily manifest as a one-to-one correspondence between two genes, because a gene can be duplicated or deleted after organism phylogenetic separation, such as speciation. For a given protein, there may be no ortholog or more than one ortholog. Other complicating factors include alternatively spliced transcripts from the same gene, limited gene identification, redundant copies of the same gene with different sequence lengths or corrected sequence. A local sequence alignment program, e.g. BLAST, can be used to search a database of sequences to find similar sequences, and the summary Expectation value (E-value) used to measure the sequence base similarity. As a protein hit with the best E-value for a particular organism may not necessarily be an ortholog or the only ortholog, a reciprocal BLAST search is used in the present invention to filter hit sequences with significant E-values for ortholog identification. The reciprocal BLAST entails search of the significant hits against a database of amino acid sequences from the base organism that are similar to the sequence of the query protein. A hit is a likely ortholog, when the reciprocal BLAST's best hit is the query protein itself or a protein encoded by a duplicated gene after speciation. Thus, homolog is used herein to describe proteins that are assumed to have functional similarity by inference from sequence base similarity. The relationship of homologs with amino acid sequences of SEQ ID NO: 1519 to SEQ ID NO: 67778 to the proteins with amino acid sequences of SEQ ID NO: to 760 to SEQ ID NO: 1518 are found in the listing of Table 16.

Other functional homolog proteins differ in one or more amino acids from those of a trait-improving protein disclosed herein as the result of one or more of the well-known conservative amino acid substitutions, e.g., valine is a conservative substitute for alanine and threonine is a conservative substitute for serine. Conservative substitutions for an amino acid within the native sequence can be selected from other members of a class to which the naturally occurring amino acid belongs. Representative amino acids within these various classes include, but are not limited to: (1) acidic (negatively charged) amino acids such as aspartic acid and glutamic acid; (2) basic (positively charged) amino acids such as arginine, histidine, and lysine; (3) neutral polar amino acids such as glycine, serine, threonine, cysteine, tyrosine, asparagine, and glutamine; and (4) neutral nonpolar (hydrophobic) amino acids such as alanine, leucine, isoleucine, valine, proline, phenylalanine, tryptophan, and methionine. Conserved substitutes for an amino acid within a native amino acid sequence can be selected from other members of the group to which the naturally occurring amino acid belongs. For example, a group of amino acids having aliphatic side chains is glycine, alanine, valine, leucine, and isoleucine; a group of amino acids having aliphatic-hydroxyl side chains is serine and threonine; a group of amino acids having amide-containing side chains is asparagine and glutamine; a group of amino acids having aromatic side chains is phenylalanine, tyrosine, and tryptophan; a group of amino acids having basic side chains is lysine, arginine, and histidine; and a group of amino acids having sulfur-containing side chains is cysteine and methionine. Naturally conservative amino acids substitution groups are: valine-leucine, valine-isoleucine, phenylalanine-tyrosine, lysine-arginine, alanine-valine, aspartic acid-glutamic acid, and asparagine-glutamine. A further aspect of the invention comprises proteins that differ in one or more amino acids from those of a described protein sequence as the result of deletion or insertion of one or more amino acids in a native sequence.

Homologs of the trait-improving proteins provided herein will generally demonstrate significant sequence identity. Of particular interest are proteins having at least 50% sequence identity, more preferably at least about 70% sequence identity or higher, e.g., at least about 80% sequence identity with an amino acid sequence of SEQ ID NO: 760 through SEQ ID NO: 1518. Of course useful proteins also include those with higher identity, e.g., 90% to 99% identity. Identity of protein homologs is determined by optimally aligning the amino acid sequence of a putative protein homolog with a defined amino acid sequence and by calculating the percentage of identical and conservatively substituted amino acids over the window of comparison. The window of comparison for determining identity can be the entire amino acid sequence disclosed herein, e.g., the full sequence of any of SEQ ID NO: 760 through SEQ ID NO: 1518.

Genes that are homologous to each other can be grouped into families and included in multiple sequence alignments. Then a consensus sequence for each group can be derived. This analysis enables the derivation of conserved and class- (family) specific residues or motifs that are functionally important. These conserved residues and motifs can be further validated with 3D protein structure if available. The consensus sequence can be used to define the full scope of the invention, e.g., to identify proteins with a homolog relationship. Thus, the present invention contemplates that protein homologs include proteins with an amino acid sequence that has at least 90% identity to such a consensus amino acid sequence sequences.

Gene Stacking

The present invention also contemplates that the trait-improving recombinant DNA provided herein can be used in combination with other recombinant DNA to create plants with multiple desired traits or a further enhanced trait. The combinations generated can include multiple copies of any one or more of the recombinant DNA constructs. These stacked combinations can be created by any method, including but not limited to cross breeding of transgenic plants, or multiple genetic transformation.

Transformation Methods

Numerous methods for transforming chromosomes in a plant cell nucleus with recombinant DNA are known in the art and are used in methods of preparing a transgenic plant cell nucleus cell, and plant. Two effective methods for such transformation are *Agrobacterium*-mediated transformation and microprojectile bombardment. Microprojectile bombardment methods are illustrated in U.S. Pat. No. 5,015,580 (soybean); U.S. Pat. No. 5,550,318 (corn); U.S. Pat. No. 5,538,880 (corn); U.S. Pat. No. 5,914,451 (soybean); U.S. Pat. No. 6,160,208 (corn); U.S. Pat. No. 6,399,861 (corn); U.S. Pat. No. 6,153,812 (wheat) and U.S. Pat. No. 6,365,807 (rice) and *Agrobacterium*-mediated transformation is described in U.S. Pat. No. 5,159,135 (cotton); U.S. Pat. No. 5,824,877 (soybean); U.S. Pat. No. 5,463,174 (canola); U.S. Pat. No. 5,591,616 (corn); U.S. Pat. No. 6,384,301 (soybean), U.S. Pat. No. 7,026,528 (wheat) and U.S. Pat. No. 6,329,57.1 (rice), all of which are incorporated herein by reference. Transformation of plant material is practiced in tissue culture on a nutrient media, i.e. a mixture of nutrients that will allow cells to grow in vitro. Recipient cell targets include, but are not limited to, meristem cells, hypocotyls, calli, immature embryos and gametic cells such as microspores, pollen, sperm and egg cells. Callus may be initiated from tissue sources including, but not limited to, immature embryos, hypocotyls, seedling apical meristems, microspores and the like. Cells containing a transgenic nucleus are grown into transgenic plants.

In addition to direct transformation of a plant material with a recombinant DNA, a transgenic plant cell nucleus can be prepared by crossing a first plant having cells with a transgenic nucleus with recombinant DNA with a second plant lacking the trangenci nucleus. For example, recombinant DNA can be introduced into a nucleus from a first plant line that is amenable to transformation to transgenic nucleus in cells that are grown into a transgenic plant which can be crossed with a second plant line to introgress the recombinant DNA into the second plant line. A transgenic plant with recombinant DNA providing an enhanced trait, e.g. enhanced yield, can be crossed with transgenic plant line having other recombinant DNA that confers another trait, for example herbicide resistance or pest resistance, to produce progeny plants having recombinant DNA that confers both traits. Typically, in such breeding for combining traits the transgenic plant donating the additional trait is a male line and the transgenic plant carrying the base traits is the female line. The progeny of this cross will segregate such that some of the plants will carry the DNA for both parental traits and some will carry DNA for one parental trait; such plants can be identified by markers associated with parental recombinant DNA, e.g. marker identification by analysis for recombinant DNA or, in the case where a selectable marker is linked to the recombinant, by application of the selecting agent such as a herbicide for use with a herbicide tolerance marker, or by selection for the enhanced trait. Progeny plants carrying DNA for both parental traits can be crossed back into the female parent line multiple times, for example usually 6 to 8 generations, to produce a progeny plant with substantially the same genotype as one original transgenic parental line but for the recombinant DNA of the other transgenic parental line In the practice of transformation DNA is typically introduced into only a small percentage of target plant cells in any one transformation experiment. Marker genes are used to provide an efficient system for identification of those cells that are stably transformed by receiving and integrating a recombinant DNA molecule into their genomes. Preferred marker genes provide selective markers which confer resistance to a selective agent, such as an antibiotic or a herbicide. Any of the herbicides to which plants of this invention may be resistant are useful agents for selective markers. Potentially transformed cells are exposed to the selective agent. In the population of surviving cells will be those cells where, generally, the resistance-conferring gene is integrated and expressed at sufficient levels to permit cell survival. Cells may be tested further to confirm stable integration of the exogenous DNA. Commonly used selective marker genes include those conferring resistance to antibiotics such as kanamycin and paromomycin (npt11), hygromycin B (aph IV), spectinomycin (aadA) and gentamycin (aac3 and aacC4) or resistance to herbicides such as glufosinate (bar or pat), dicamba (DMO) and glyphosate (aroA or EPSPS). Examples of such selectable markers are illustrated in U.S. Pat. Nos. 5,550;318; 5,633,435; 5,780,708 and 6,118,047, all of which are incorporated herein by reference. Selectable markers which provide an ability to visually identify transformants can also be employed, for example, a gene expressing a colored or fluorescent protein such as a luciferase or green fluorescent protein (GFP) or a gene expressing a beta-glucuronidase or uidA gene (GUS) for which various chromogenic substrates are known.

Plant cells that survive exposure to the selective agent, or plant cells that have been scored positive in a screening assay, may be cultured in regeneration media and allowed to mature into plants. Developing plantlets regenerated from transformed plant cells can be transferred to plant growth mix, and hardened off, for example, in an environmentally controlled chamber at about 85% relative humidity, 600 ppm $CO_2$, and 25-250 microeinsteins $m^{-2}$ $s^{-1}$ of light, prior to transfer to a greenhouse or growth chamber for maturation. Plants are regenerated from about 6 weeks to 10 months after a transformant is identified, depending on the initial tissue, and plant species. Plants may be pollinated using conventional plant breeding methods known to those of skill in the art and seed produced, for example self-pollination is commonly used with transgenic corn. The regenerated transformed plant or its progeny seed or plants can be tested for expression of the recombinant DNA and selected for the presence of enhanced agronomic trait.

Transgenic Plants and Seeds

Transgenic plants derived from transgenic plant cells having a transgenic nucleus of this invention are grown to generate transgenic plants having an enhanced trait as compared to a control plant and produce transgenic seed and haploid pollen of this invention. Such plants with enhanced traits are identified by selection of transformed plants or progeny seed for the enhanced trait. For efficiency a selection method is designed to evaluate multiple transgenic plants (events) comprising the recombinant DNA, for example multiple plants from 2 to 20 or more transgenic events. Transgenic plants grown from transgenic seed provided herein demonstrate improved agronomic traits that contribute to increased yield or other trait that provides increased plant value, including, for example, improved seed quality. Of particular interest are plants having enhanced water use efficiency, enhanced cold tolerance, increased yield, enhanced nitrogen use efficiency, enhanced seed protein and enhanced seed oil.

Discovery of Trait-improving Recombinant DNA

To identify nuclei with recombinant DNA that confer enhanced traits to plants, Arabidopsis thaliana was transformed with a candidate recombinant DNA construct and screened for an enhanced trait.

Arabidopsis thaliana is used a model for genetics and metabolism in plants. Arabidopsis has a small genome, and well-documented studies are available. It is easy to grow in large numbers and mutants defining important genetically controlled mechanisms are either available, or can readily be obtained. Various methods to introduce and express isolated homologous genes are available (see Koncz, e.g., Methods in Arabidopsis Research e.g., (1992), World Scientific, New Jersey, N.J., in "Preface").

A two-step screening process was employed which comprised two passes of trait characterization to ensure that the trait modification was dependent on expression of the recombinant DNA, but not due to the chromosomal location of the integration of the transgene. Twelve independent transgenic lines for each recombinant DNA construct were established and assayed for the transgene expression levels. Five transgenic lines with high transgene expression levels were used in the first pass screen to evaluate the transgene's function in T2 transgenic plants. Subsequently, three transgenic events, which had been shown to have one or more enhanced traits, were further evaluated in the second pass screen to confirm the transgene's ability to impart an enhanced trait. The following Table 3 summarizes the enhanced traits that have been confirmed as provided by a recombinant DNA construct.

In particular, Table 3 reports:

"PEP SEQ ID" which is the amino acid sequence of the protein cognate to the DNA in the recombinant DNA construct corresponding to a protein sequence of a SEQ ID NO. in the Sequence Listing.

"construct_id" is an arbitrary name for the recombinant DNA describe more particularly in Table 1.

"annotation" refers to a description of the top hit protein obtained from an amino acid sequence query of each PEP SEQ ID NO to GenBank database of the National Center for Biotechnology Information (ncbi). More particularly, "gi" is the GenBank ID number for the top BLAST hit.

"description" refers to the description of the top BLAST hit.

"e-value" provides the expectation value for the BLAST hit.

"% id" refers to the percentage of identically matched amino acid residues along the length of the portion of the sequences which is aligned by BLAST between the sequence of interest provided herein and the hit sequence in GenBank.

"traits" identify by two letter codes the confirmed enhancement in a transgenic plant provided by the recombinant DNA. The codes for enhanced traits are:

"CK" which indicates cold tolerance enhancement identified under a cold shock tolerance screen;

"CS" which indicates cold tolerance enhancement identified by a cold germination tolerance screen; "DS" which indicates drought tolerance enhancement identified by a soil drought stress tolerance screen;

"PEG" which indicates osmotic stress tolerance enhancement identified by a PEG induced osmotic stress tolerance screen;

"HS" which indicates heat stress tolerance enhancement identified by a heat stress tolerance screen;

"SS" which indicates high salinity stress tolerance enhancement identified by a salt stress tolerance screen;

"LN" which indicates nitrogen use efficiency enhancement identified by a limited nitrogen tolerance screen;

"LL" which indicates attenuated shade avoidance response identified by a shade tolerance screen under a low light condition;

"PP" which indicates enhanced growth and development at early stages identified by an early plant growth and development screen;

"SP" which indicates enhanced growth and development at late stages identified by a late plant growth and development screen provided herein.

TABLE 3

| PEP Seq ID No. | Construct ID | Annotation | | | Trait | |
|---|---|---|---|---|---|---|
| | | E-value | % id | Description | | |
| 760 | 12792 | 1.00E−107 | 73 | ref|NP_198588.2|nucleic acid binding [*Arabidopsis thaliana*] | DS | |
| 761 | 13673 | 0 | 94 | ref|NP_850412.1|peptidase [*Arabidopsis thaliana*] | SS | |
| 762 | 12020 | 6.00E−50 | 100 | gb|AAF70854.1|AC003113_21F24O1.1 [*Arabidopsis thaliana*] | SP | |
| 763 | 10174 | 1.00E−111 | 90 | ref|NP_567720.1|DREB1A (DEHYDRATION RESPONSE ELEMENT B1A); DNA binding/transcription factor/ transcriptional activator [*Arabidopsis thaliana*] | HS | PEG |
| 764 | 11827 | 2.00E−83 | 89 | ref|NP_565558.1|unknown protein [*Arabidopsis thaliana*] | LN | |
| 765 | 12435 | 3.00E−53 | 100 | ref|NP_565280.1|NADH dehydrogenase (ubiquinone)/NADH dehydrogenase [*Arabidopsis thaliana*] | LN | |
| 766 | 12015 | 0 | 94 | ref|NP_197429.1|KAPP; protein phosphatase type 2C [*Arabidopsis thaliana*] | LN | |
| 767 | 11836 | 1.00E−146 | 97 | ref|NP_566060.1|unknown protein [*Arabidopsis thaliana*] | LN | |
| 768 | 12141 | 1.00E−134 | 94 | ref|NP_192755.1|unknown protein [*Arabidopsis thaliana*] | LN | |
| 769 | 12040 | 5.00E−97 | 91 | ref|NP_567673.1|unknown protein [*Arabidopsis thaliana*] | DS | |
| 770 | 12437 | 7.00E−35 | 85 | ref|NP_190335.1|unknown protein [*Arabidopsis thaliana*] | LN | |
| 771 | 12156 | 6.00E−55 | 100 | ref|NP_179093.1|RNA binding/nucleic acid binding [*Arabidopsis thaliana*] | DS | |
| 772 | 11853 | 1.00E−81 | 94 | ref|NP_565677.1|unknown protein [*Arabidopsis thaliana*] gb|AAC79591.1| | SS | |
| 773 | 12224 | 1.00E−145 | 82 | ref|NP_565860.1|unknown protein [*Arabidopsis thaliana*] gb|AAC98059.1| | LL | |
| 774 | 11856 | 1.00E−103 | 100 | ref|NP_565273.1|hydrolase [*Arabidopsis thaliana*] | LN | |
| 775 | 12065 | 9.00E−20 | 78 | ref|NP_179185.1|unknown protein [*Arabidopsis thaliana*] | LN | |
| 776 | 12419 | 1.00E−148 | 100 | ref|NP_186847.1|oxidoreductase [*Arabidopsis thaliana*] | LN | |
| 777 | 12208 | 0 | 100 | ref|NP_565169.1|unknown protein [*Arabidopsis thaliana*] | LN | |
| 778 | 14803 | 2.00E−82 | 79 | ref|NP_187893.1|unknown protein [*Arabidopsis thaliana*] | HS | |
| 779 | 10176 | 0 | 100 | ref|NP_178313.1|ATPTR2-B (NITRATE TRANSPORTER 1); transporter [*Arabidopsis thaliana*] | LN | |
| 780 | 18011 | 1.00E−109 | 82 | ref|NP_172517.1|ARR4 (RESPONSE REGULATOR 4); transcription regulator/two-component response regulator [*Arabidopsis thaliana*] | CS | |
| 781 | 12714 | 5.00E−53 | 100 | ref|NP_566217.1|RNA binding/rRNA binding [*Arabidopsis thaliana*] | CK | |
| 782 | 10507 | 9.00E−99 | 100 | ref|NP_201097.1|ARR6 (RESPONSE REGULATOR 6); transcription regulator/two-component response regulator [*Arabidopsis thaliana*] | LN | |
| 783 | 15039 | 0 | 99 | dbj|BAF02191.1|hypothetical protein [*Arabidopsis thaliana*] | LN | |
| 784 | 12733 | 1.00E−137 | 94 | ref|NP_194298.1|unknown protein [*Arabidopsis thaliana*] | DS | |
| 785 | 13237 | 1.00E−52 | 100 | ref|NP_180192.1|unknown protein [*Arabidopsis thaliana*] | LN | |
| 786 | 13504 | 1.00E−137 | 100 | ref|NP_177643.1|unknown protein [*Arabidopsis thaliana*] | DS | |
| 787 | 12932 | 1.00E−174 | 94 | ref|NP_564618.1|unknown protein [*Arabidopsis thaliana*] | SP | |
| 788 | 75935 | 0 | 93 | ref|NP_565242.1|protein binding [*Arabidopsis thaliana*] | CS | |
| 789 | 73333 | 0 | 95 | ref|NP_198718.1|ATP binding/kinase/protein kinase/protein serine/threonine kinase/protein-tyrosine kinase [*Arabidopsis thaliana*] | SS | |
| 790 | 75993 | 0 | 93 | ref|NP_171661.1|ATP binding/kinase/protein kinase/protein serine/threonine kinase/protein-tyrosine kinase [*Arabidopsis thaliana*] | LL | |
| 791 | 19401 | 0 | 94 | ref|NP_195275.1|ATP binding/kinase/protein kinase/protein serine/threonine kinase/protein-tyrosine kinase [*Arabidopsis thaliana*] | LN | |
| 792 | 12766 | 5.00E−74 | 100 | ref|NP_565233.1|unknown protein [*Arabidopsis thaliana*] | SS | |
| 793 | 76025 | 0 | 95 | ref|NP_179580.1|malic enzyme/oxidoreductase, acting on NADH or NADPH, NAD or NADP as acceptor [*Arabidopsis thaliana*] | PEG | |
| 794 | 13708 | 0 | 100 | ref|NP_181187.1|fructose-bisphosphate aldolase [*Arabidopsis thaliana*] | LN | |
| 795 | 13305 | 0 | 94 | ref|NP_180287.1|PAP1 (PURPLE ACID PHOSPHATASE 1); hydrolase/protein serine/threonine phosphatase [*Arabidopsis thaliana*] | LN | |
| 796 | 15806 | 0 | 97 | ref|NP_174089.1|APL2 [*Arabidopsis thaliana*] | SS | |
| 797 | 14712 | 0 | 92 | ref|NP_171617.1|PDH-E1 ALPHA (PYRUVATE DEHYDROGENASE E1 ALPHA); oxidoreductase, acting on the aldehyde or oxo group of donors, disulfide as acceptor/pyruvate dehydrogenase (acetyl-transferring) [*Arabidopsis thaliana*] | LN | |
| 798 | 76013 | 0 | 92 | ref|NP_194141.2|ATP binding/kinase/protein kinase/protein serine/threonine kinase/protein-tyrosine kinase [*Arabidopsis thaliana*] | DS | |

TABLE 3-continued

| PEP Seq ID No. | Construct ID | Annotation | | | Trait | | | | |
|---|---|---|---|---|---|---|---|---|---|
| | | E-value | % id | Description | | | | | |
| 799 | 10192 | 0 | 99 | ref|NP_180997.1|CYP710A1; heme binding/iron ion binding/ monooxygenase/oxygen binding [*Arabidopsis thaliana*] | CS | PP | SS | | |
| 800 | 74775 | 0 | 96 | ref|NP_175812.1|ALDH7B4; aldehyde dehydrogenase/ oxidoreductase [*Arabidopsis thaliana*] | DS | | | | |
| 801 | 13841 | 2.00E-33 | 100 | ref|NP_194401.1|hydrogen-transporting ATP synthase, rotational mechanism/hydrogen-transporting ATPase, rotational mechanism [*Arabidopsis thaliana*] | LN | | | | |
| 802 | 15805 | 0 | 100 | ref|NP_567620.1|ZAC; ARF GTPase activator [*Arabidopsis thaliana*] | LN | | | | |
| 803 | 14253 | 1.00E-167 | 87 | ref|NP_195499.1|unknown protein [*Arabidopsis thaliana*] | LN | | | | |
| 804 | 13650 | 1.00E-151 | 91 | ref|NP_196069.1|phosphatidate cytidylyltransferase [*Arabidopsis thaliana*] | LN | | | | |
| 805 | 13855 | 1.00E-94 | 86 | ref|NP_567531.1|structural constituent of ribosome [*Arabidopsis thaliana*] | LN | | | | |
| 806 | 76049 | 0 | 99 | ref|NP_182198.2|unknown protein [*Arabidopsis thaliana*] | DS | HS | | | |
| 807 | 14271 | 0 | 82 | ref|NP_181342.1|unknown protein [*Arabidopsis thaliana*] | DS | | | | |
| 808 | 73927 | 0 | 100 | ref|NP_189059.1|FAD binding/disulfide oxidoreductase/ glutathione-disulfide reductase/oxidoreductase [*Arabidopsis thaliana*] | CS | | | | |
| 809 | 13657 | 6.00E-76 | 72 | ref|NP_565661.2|HDT4 [*Arabidopsis thaliana*] | LN | | | | |
| 810 | 13938 | 2.00E-90 | 77 | gb|AAL67123.1|AT3g06760/F3E22_10 [*Arabidopsis thaliana*] | SP | | | | |
| 810 | 14730 | 2.00E-90 | 77 | gb|AAL67123.1|AT3g06760/F3E22_10 [*Arabidopsis thaliana*] | SP | | | | |
| 811 | 73948 | 0 | 97 | ref|NP_176185.1|ATP binding/ATP-dependent helicase/ helicase/nucleic acid binding [*Arabidopsis thaliana*] | CS | | | | |
| 812 | 18116 | 0 | 100 | ref|NP_182144.1|oxidoreductase [*Arabidopsis thaliana*] | CS | | | | |
| 813 | 14341 | 0 | 100 | ref|NP_176646.1|unknown protein [*Arabidopsis thaliana*] | SS | | | | |
| 814 | 13960 | 1.00E-179 | 100 | ref|NP_565875.1|unknown protein [*Arabidopsis thaliana*] | SP | | | | |
| 814 | 74391 | 1.00E-179 | 100 | ref|NP_565875.1|unknown protein [*Arabidopsis thaliana*] | SP | | | | |
| 815 | 75957 | 0 | 95 | gb|ABK28258.1|unknown [*Arabidopsis thaliana*] | LL | | | | |
| 816 | 70240 | 0 | 100 | ref|NP_172751.1|AN11; nucleotide binding [*Arabidopsis thaliana*] | CS | | | | |
| 817 | 70748 | 0 | 97 | ref|NP_173077.1|ATP binding/protein kinase/protein serine/threonine kinase/protein-tyrosine kinase [*Arabidopsis thaliana*] | CK | | | | |
| 818 | 70807 | 0 | 93 | ref|NP_188160.2|protein binding [*Arabidopsis thaliana*] | CS | | | | |
| 819 | 73986 | 0 | 87 | ref|NP_974833.1|unknown protein [*Arabidopsis thaliana*] | DS | | | | |
| 820 | 77005 | 0 | 97 | ref|NP_566580.1|CIPK1 (CBL-INTERACTING PROTEIN KINASE 1); ATP binding/kinase/protein kinase/protein serine/threonine kinase/protein-tyrosine kinase [*Arabidopsis thaliana*] | CS | | | | |
| 821 | 70410 | 5.00E-34 | 86 | ref|NP_850158.1|CLE5 (CLAVATA3/ESR-RELATED 5); receptor binding [*Arabidopsis thaliana*] | SP | | | | |
| 822 | 14827 | 1.00E-153 | 88 | ref|NP_564658.2|unknown protein [*Arabidopsis thaliana*] | DS | | | | |
| 823 | 19122 | 0 | 93 | ref|NP_566009.1|unknown protein [*Arabidopsis thaliana*] | LL | | | | |
| 824 | 16446 | 0 | 94 | ref|NP_566277.2|unknown protein [*Arabidopsis thaliana*] | SP | | | | |
| 825 | 15143 | 6.00E-84 | 100 | ref|NP_194152.1|SLY1 (SLEEPY1) [*Arabidopsis thaliana*] | LN | | | | |
| 826 | 70401 | 0 | 93 | sp|Q9SMZ3|FBX13_ARATHF-box only protein 13 emb|CAB36790.1| putative protein [*Arabidopsis thaliana*] | PEG | | | | |
| 827 | 16182 | 0 | 100 | emb|CAB44691.1|putative protein [*Arabidopsis thaliana*] | DS | | | | |
| 828 | 15126 | 1.00E-138 | 95 | ref|NP_198741.1|unknown protein [*Arabidopsis thaliana*] | CS | | | | |
| 829 | 15628 | 0 | 100 | ref|NP_567421.1|unknown protein [*Arabidopsis thaliana*] | CS | | | | |
| 830 | 78355 | 0 | 90 | gb|AAD10665.1|hypothetical protein [*Arabidopsis thaliana*] | SS | | | | |
| 831 | 70560 | 0 | 100 | gb|AAB81879.1|putative zinc finger protein [*Arabidopsis thaliana*] | CS | | | | |
| 832 | 19133 | 0 | 97 | ref|NP_194117.3|protein binding/ubiquitin-protein ligase/zinc ion binding [*Arabidopsis thaliana*] | DS | | | | |
| 833 | 73602 | 0 | 74 | gb|AAR28013.1|mutant TFIIF-alpha [*Arabidopsis thaliana*] | CS | | | | |
| 834 | 71702 | 1.00E-169 | 100 | pir||T49271CELL DIVISION CONTROL PROTEIN 2 HOMOLOG A - *Arabidopsis thaliana* | LL | | | | |
| 835 | 14909 | 0 | 98 | gb|AAC39477.1|respiratory burst oxidase protein C [*Arabidopsis thaliana*] | CS | PP | HS | SS | PEG |
| 836 | 14927 | 1.00E-88 | 65 | ref|NP_568285.1|unknown protein [*Arabidopsis thaliana*] | LN | | | | |
| 837 | 75945 | 0 | 94 | ref|NP_563899.1|NRT1.1; transporter [*Arabidopsis thaliana*] | SP | | | | |
| 838 | 16553 | 0 | 100 | ref|NP_567083.1|nucleotide-sugar transporter/sugar porter [*Arabidopsis thaliana*] | SS | | | | |
| 839 | 75221 | 0 | 87 | ref|NP_195567.2|unknown protein [*Arabidopsis thaliana*] | CS | HS | | | |
| 840 | 70746 | 5.00E-60 | 79 | gb|AAM64668.1|unknown [*Arabidopsis thaliana*] | PEG | | | | |
| 841 | 70403 | 1.00E-137 | 85 | gb|AAK26011.1|AF360301_1unknown protein [*Arabidopsis thaliana*] | PP | | | | |
| 842 | 15966 | 2.00E-73 | 71 | ref|NP_568974.1|ATFP3; metal ion binding [*Arabidopsis thaliana*] | CK | | | | |
| 843 | 76076 | 4.00E-34 | 100 | ref|NP_179357.1|unknown protein [*Arabidopsis thaliana*] | PP | | | | |
| 844 | 17014 | 2.00E-57 | 76 | ref|NP_564008.1|unknown protein [*Arabidopsis thaliana*] | SS | PEG | | | |
| 845 | 16007 | 0 | 100 | ref|NP_564729.1|ZW9 [*Arabidopsis thaliana*] | DS | | | | |
| 846 | 16208 | 1.00E-06 | 100 | gb|AAF79580.1|AC022464_38F22G5.2 [*Arabidopsis thaliana*] | CS | | | | |
| 847 | 17310 | 0 | 96 | ref|NP_188117.1|catalytic [*Arabidopsis thaliana*] | HS | | | | |
| 848 | 15716 | 1.00E-164 | 96 | ref|NP_563630.1|8PS1 (BYPASS 1) [*Arabidopsis thaliana*] | LN | | | | |
| 849 | 15627 | 0 | 89 | ref|NP_565533.1|heat shock protein binding/unfolded protein binding [*Arabidopsis thaliana*] | SS | | | | |

TABLE 3-continued

| PEP Seq ID No. | Construct ID | E-value | % id | Description | Trait | |
|---|---|---|---|---|---|---|
| 850 | 15409 | 0 | 95 | ref|NP_188010.1|unknown protein [*Arabidopsis thaliana*] | CK | PEG |
| 850 | 17201 | 0 | 95 | ref|NP_188010.1|unknown protein [*Arabidopsis thaliana*] | PEG | |
| 851 | 15903 | 0 | 86 | ref|NP_199280.1|unknown protein [*Arabidopsis thaliana*] | CK | |
| 852 | 10332 | 0 | 96 | ref|NP_188080.1|CYP72A8; heme binding/iron ion binding/ monooxygenase/oxygen binding [*Arabidopsis thaliana*] | SP | |
| 853 | 73968 | 0 | 90 | ref|NP_565477.1|unknown protein [*Arabidopsis thaliana*] | LN | |
| 854 | 17003 | 1.00E−171 | 95 | ref|NP_174746.1|PHI-1 (PHOSPHATE-INDUCED 1) [*Arabidopsis thaliana*] | DS | SS |
| 855 | 73847 | 0 | 97 | ref|NP_849912.1|ATP binding/kinase [*Arabidopsis thaliana*] | LN | |
| 856 | 76041 | 0 | 97 | ref|NP_566284.1|transferase, transferring glycosyl groups/ transferase, transferring hexosyl groups [*Arabidopsis thaliana*] | CS | LL |
| 857 | 74567 | 0 | 75 | ref|NP_566917.1|calmodulin binding [*Arabidopsis thaliana*] ref|NP_974405.1|calmodulin binding [*Arabidopsis thaliana*] | CS | LL |
| 858 | 15809 | 0 | 97 | ref|NP_568150.1|unknown protein [*Arabidopsis thaliana*] | PP | |
| 859 | 70110 | 0 | 92 | ref|NP_014814.1|Lcb4p [*Saccharomyces cerevisiae*] | LN | |
| 860 | 70123 | 1.00E−180 | 100 | ref|NP_014392.1|Lst8p [*Saccharomyces cerevisiae*] | CK | SS |
| 861 | 74702 | 0 | 87 | ref|NP_850390.1|unknown protein [*Arabidopsis thaliana*] | SP | |
| 862 | 75936 | 0 | 95 | ref|NP_187671.1|CAT7 (CATIONIC AMINO ACID TRANSPORTER 7); cationic amino acid transporter [*Arabidopsis thaliana*] | CS | |
| 863 | 10462 | 1.00E−136 | 100 | ref|NP_565895.1|catalytic/hydrolase [*Arabidopsis thaliana*] | DS | |
| 864 | 17402 | 1.00E−60 | 100 | ref|NP_190775.1|unknown protein [*Arabidopsis thaliana*] | CS | |
| 865 | 73707 | 0 | 94 | ref|NP_564272.1|unknown protein [*Arabidopsis thaliana*] | CS | |
| 866 | 17129 | 3.00E−61 | 100 | ref|NP_564630.1|unknown protein [*Arabidopsis thaliana*] | LN | |
| 867 | 72665 | 3.00E−54 | 89 | ref|NP_564090.1|unknown protein [*Arabidopsis thaliana*] | LL | |
| 868 | 18206 | 0 | 100 | ref|NP_564983.1|transferase, transferring glycosyl groups/ transferase, transferring hexosyl groups [*Arabidopsis thaliana*] | LN | |
| 869 | 17151 | 1.00E−155 | 100 | ref|NP_171882.1|ATPHB2 (PROHIBITIN 2) [*Arabidopsis thaliana*] | LN | |
| 870 | 17813 | 5.00E−98 | 100 | ref|NP_199762.1|protein binding [*Arabidopsis thaliana*] | SS | |
| 871 | 70845 | 0 | 100 | ref|NP_173920.1|RCN1 (ROOTS CURL IN NPA); protein phosphatase type 2A regulator [*Arabidopsis thaliana*] | CS | |
| 872 | 16607 | 1.00E−171 | 95 | ref|NP_355455.1|hypothetical protein AGR_C_4560 [*Agrobacterium tumefaciens* str. C58] | SP | |
| 873 | 72675 | 1.00E−179 | 78 | ref|NP_200091.1|protein binding/ubiquitin-protein ligase/zinc ion binding [*Arabidopsis thaliana*] | LL | LN |
| 874 | 72677 | 0 | 86 | sp|Q5EAE9|ATL5C_ARATH RING-H2 finger protein ATL5C precursor dbj|BAB09675.1| unnamed protein product [*Arabidopsis thaliana*] | LL | |
| 875 | 74534 | 0 | 95 | ref|NP_196233.1|CYC1BAT; cyclin-dependent protein kinase regulator [*Arabidopsis thaliana*] | PP | |
| 876 | 74535 | 0 | 85 | ref|NP_564978.1|NTL1; calcium ion binding/transporter [*Arabidopsis thaliana*] | CS | |
| 877 | 10204 | 0 | 89 | ref|NP_179544.1|nucleotide binding [*Arabidopsis thaliana*] | PP | LL |
| 878 | 10472 | 1.00E−157 | 100 | ref|NP_565480.1|catalytic/protein phosphatase type 2C [*Arabidopsis thaliana*] | LN | |
| 879 | 10431 | 1.00E−118 | 88 | ref|NP_850625.1|imidazoleglycerol-phosphate dehydratase [*Arabidopsis thaliana*] | LN | |
| 880 | 72906 | 0 | 92 | ref|NP_200387.1|DNA binding [*Arabidopsis thaliana*] | PP | |
| 881 | 78362 | 0 | 95 | ref|NP_176118.2|DNA binding/transcription factor [*Arabidopsis thaliana*] | CS | |
| 882 | 17930 | 1.00E−11 | 60 | ref|NP_173425.2|unknown protein [*Arabidopsis thaliana*] | SS | |
| 883 | 18442 | 0 | 92 | ref|NP_198690.1|transcription factor [*Arabidopsis thaliana*] | SS | |
| 884 | 73207 | 0 | 94 | ref|NP_173148.2|dimethylallyltranstransferase [*Arabidopsis thaliana*] | CS | |
| 885 | 19166 | 4.00E−99 | 91 | emb|CAB45503.1|hypothetical protein [*Arabidopsis thaliana*] | DS | |
| 886 | 10469 | 1.00E−137 | 95 | ref|NP_191762.1|ROC4; peptidyl-prolyl cis-trans isomerase [*Arabidopsis thaliana*] | LN | |
| 887 | 18415 | 1.00E−111 | 71 | emb|CAB85519.1|putative protein [*Arabidopsis thaliana*] | CS | |
| 888 | 18418 | 1.00E−113 | 100 | ref|NP_200034.1|ATGB1 [*Arabidopsis thaliana*] | CK | SS |
| 889 | 19532 | 1.00E−179 | 100 | ref|NP_190986.1|CDC2B (CDC2-LIKE GENE); kinase [*Arabidopsis thaliana*] | CS | |
| 890 | 18423 | 1.00E−151 | 100 | ref|NP_180496.1|SAG13; oxidoreductase [*Arabidopsis thaliana*] | LN | |
| 891 | 77909 | 0 | 92 | ref|NP_191785.1|catalytic/protein phosphatase type 2C | CK | DS |
| 892 | 19656 | 4.00E−48 | 77 | ref|NP_200260.1|PBP1 (PINOID-BINDING PROTEIN 1); calcium ion binding [*Arabidopsis thaliana*] | CS | SS |
| 893 | 10217 | 1.00E−135 | 94 | ref|NP_199674.1|cyclin-dependent protein kinase [*Arabidopsis thaliana*] | LN | |
| 894 | 18874 | 2.00E−81 | 100 | ref|NP_176511.1|unknown protein [*Arabidopsis thaliana*] | SS | |
| 895 | 18875 | 0 | 96 | ref|NP_198127.1|unknown protein [*Arabidopsis thaliana*] | SS | |
| 896 | 19256 | 0 | 96 | ref|NP_568785.1|SPDS3 (SPERMIDINE SYNTHASE 3) [*Arabidopsis thaliana*] | DS | |
| 897 | 19537 | 0 | 100 | ref|NP_568931.1|ATP binding/ATP-dependent helicase/ helicase/nucleic acid binding [*Arabidopsis thaliana*] | LL | |
| 898 | 74201 | 0 | 90 | ref|NP_567067.1|ATP binding/ATP-dependent helicase/ helicase/nucleic acid binding [*Arabidopsis thaliana*] | LN | |

TABLE 3-continued

| PEP Seq ID No. | Construct ID | Annotation E-value | % id | Description | Trait | |
|---|---|---|---|---|---|---|
| 899 | 74233 | 0 | 97 | ref|NP_199051.1|unknown protein [*Arabidopsis thaliana*] | SS | |
| 900 | 18644 | 7.00E−62 | 100 | ref|NP_172620.1|electron transporter/thiol-disulfide exchange intermediate [*Arabidopsis thaliana*] | DS | |
| 901 | 18827 | 0 | 91 | ref|NP_565206.1|ubiquitin-protein ligase/zinc ion binding [*Arabidopsis thaliana*] | CS | |
| 902 | 18220 | 0 | 100 | ref|NP_177629.1|nucleotidyltransferase [*Arabidopsis thaliana*] | SP | |
| 903 | 18830 | 0 | 96 | ref|NP_188813.1|UDP-glycosyltransferase/transferase, transferring glycosyl groups [*Arabidopsis thaliana*] | PEG | |
| 904 | 19205 | 1.00E−161 | 84 | gb|ABF55664.2|double MYC-lagged mitogen activated protein kinase kinase 4 [synthetic construct] | LN | |
| 905 | 18226 | 7.00E−99 | 92 | ref|NP_197890.1|unknown protein [*Arabidopsis thaliana*] | CS | |
| 906 | 18227 | 1.00E−62 | 73 | ref|NP_564432.3|OHP2 (ONE-HELIX PROTEIN 2) [*Arabidopsis thaliana*] | LN | |
| 907 | 18239 | 0 | 100 | ref|NP_193460.1|unknown protein [*Arabidopsis thaliana*] | SP | |
| 908 | 70415 | 1.00E−136 | 96 | ref|NP_849930.1|AGL3 (AGAMOUS-LIKE 3); DNA binding/transcription factor [*Arabidopsis thaliana*] | CK | |
| 909 | 18329 | 7.00E−06 | 70 | ref|NP_178619.1|unknown protein [*Arabidopsis thaliana*] | LN | |
| 910 | 72606 | 1.00E−166 | 79 | ref|NP_566784.1|unknown protein [*Arabidopsis thaliana*] | CS | |
| 911 | 10230 | 0 | 96 | ref|NP_172406.1|transferase, transferring glycosyl groups/transferase, transferring hexosyl groups [*Arabidopsis thaliana*] | LN | |
| 912 | 19608 | 0 | 82 | ref|NP_201045.1|calmodulin binding [*Arabidopsis thaliana*] | CS | |
| 913 | 18271 | 3.00E−97 | 82 | gb|AAA21820.1|alpha-subunit; putative | LN | |
| 914 | 18347 | 2.00E−65 | 100 | ref|NP_566786.1|DNA binding/transcription factor [*Arabidopsis thaliana*] | SP | |
| 915 | 18403 | 0 | 89 | ref|NP_187364.1|unknown protein [*Arabidopsis thaliana*] | CK | |
| 916 | 74206 | 0 | 91 | ref|NP_201348.1|cysteine-type endopeptidase/ubiquitin thiolesterase [*Arabidopsis thaliana*] | CS | |
| 917 | 10234 | 2.00E−60 | 72 | ref|NP_193759.1|unknown protein [*Arabidopsis thaliana*] | LN | |
| 918 | 71115 | 1.00E−167 | 87 | ref|NP_189058.1|PMP (PUTATIVE TYPE 1 MEMBRANE PROTEIN) [*Arabidopsis thaliana*] | DS | |
| 919 | 18406 | 8.00E−79 | 100 | ref|NP_564160.1|unknown protein [*Arabidopsis thaliana*] | SS | |
| 920 | 19619 | 2.00E−87 | 83 | ref|NP_563890.1|unknown protein [*Arabidopsis thaliana*] | HS | |
| 921 | 19623 | 1.00E−125 | 100 | ref|NP_563994.1|SYP51 (SYNTAXIN OF PLANTS 51) [*Arabidopsis thaliana*] | DS | |
| 922 | 18381 | 9.00E−96 | 84 | ref|NP_564601.1|unknown protein [*Arabidopsis thaliana*] | SS | |
| 923 | 18408 | 8.00E−69 | 91 | ref|NP_564808.1|unknown protein [*Arabidopsis thaliana*] | DS | |
| 924 | 18720 | 1.00E−175 | 89 | ref|NP_564840.1|unknown protein [*Arabidopsis thaliana*] | CK | |
| 925 | 77537 | 1.00E−122 | 81 | ref|NP_565125.1|unknown protein [*Arabidopsis thaliana*] | CS | |
| 926 | 70833 | 0 | 90 | ref|NP_566212.2|ATBPM4; protein binding [*Arabidopsis thaliana*] | LL | |
| 927 | 19328 | 0 | 93 | ref|NP_638257.1|hypothetical protein XCC2909 [*Xanthomonas campestris* pv. *campestris* str. ATCC 33913] | DS | |
| 928 | 19312 | 0 | 100 | ref|NP_013243.1|Proline oxidase, nuclear-encoded mitochondrial protein involved in utilization of proline as sole nitrogen source; PUT1 transcription is induced by Put3p in the presence of proline and the absence of a preferred nitrogen source [*Saccharomyces cerevisiae*] | SS | |
| 929 | 70538 | 1.00E−146 | 93 | ref|NP_199892.1|unknown protein [*Arabidopsis thaliana*] | SS | |
| 930 | 70440 | 0 | 88 | ref|NP_195953.1|cysteine-type peptidase [*Arabidopsis thaliana*] | CK | LN |
| 931 | 11319 | 0 | 97 | ref|NP_177797.2|unknown protein [*Arabidopsis thaliana*] | LN | |
| 932 | 70443 | 1.00E−151 | 81 | ref|NP_173841.1|unknown protein [*Arabidopsis thaliana*] | CS | |
| 933 | 72357 | 1.00E−141 | 100 | ref|NP_190300.1|ubiquitin-protein ligase/zinc ion binding [*Arabidopsis thaliana*] | PP | |
| 934 | 70466 | 1.00E−172 | 94 | ref|NP_196084.1|DNA binding/transcription factor [*Arabidopsis thaliana*] | LL | |
| 935 | 70241 | 5.00E−39 | 100 | gb|EAZ44836.1|hypothetical protein OsJ_028319 [*Oryza sativa* (japonica cultivar-group)] | SP | |
| 936 | 70476 | 1.00E−153 | 95 | ref|NP_176240.1|unknown protein [*Arabidopsis thaliana*] | LN | |
| 937 | 70477 | 1.00E−150 | 100 | ref|NP_564877.1|WRKY67; transcription factor [*Arabidopsis thaliana*] | SS | |
| 938 | 19713 | 0 | 100 | ref|NP_637886.1|oxidoreductase [*Xanthomonas campestris* pv. *campestris* str. ATCC 33913] | PP | |
| 939 | 12601 | 3.00E−70 | 100 | ref|NP_195713.1|DNA binding [*Arabidopsis thaliana*] ref|NP_001050276.1| Os03g0390600 [*Oryza sativa* (japonica cultivar-group)] gb|AAB36494.1| histone H3.2 [*Medicago sativa*] | CK | |
| 940 | 19747 | 0 | 69 | emb|CAB54847.1|hydroperoxide lyase [*Medicago sativa*] | CS | |
| 941 | 11117 | 1.00E−174 | 91 | ref|NP_973592.1|ATPUP2 [*Arabidopsis thaliana*] | LN | |
| 942 | 70965 | 3.00E−95 | 46 | gb|EAY82507.1|hypothetical protein OsI_036466 [*Oryza sativa* (indica cultivar-group)] | CS | |
| 943 | 10366 | 1.00E−153 | 92 | ref|NP_181358.1|unknown protein [*Arabidopsis thaliana*] | CK | |
| 943 | 13404 | 1.00E−153 | 92 | ref|NP_181358.1|unknown protein [*Arabidopsis thaliana*] | LN | |
| 944 | 70935 | 0 | 77 | gb|ABE91638.1|hypothetical protein MtrDRAFT_AC142394g9v2 [*Medicago truncatula*] | CS | |
| 945 | 77717 | 1.00E−136 | 69 | ref|NP_565111.1|unknown protein [*Arabidopsis thaliana*] | CS | |
| 946 | 19966 | 1.00E−163 | 80 | gb|AAF27919.1|AF220203_1Ttg1-like protein [*Malus x domestica*] | SS | |

TABLE 3-continued

| PEP Seq ID No. | Construct ID | Annotation E-value | % id | Description | Trait | |
|---|---|---|---|---|---|---|
| 947 | 70909 | 1.00E−116 | 74 | ref|NP_192696.3|unknown protein [*Arabidopsis thaliana*] | SP | |
| 948 | 19906 | 0 | 79 | gb|AAD11430.1|protein phosphatase 2C homolog [*Mesembryanthemum crystallinum*] | CK | |
| 949 | 70974 | 0 | 72 | gb|ABN09819.1|Not CCR4-Not complex component, N-terminal; tRNA-binding arm [*Medicago truncatula*] | SP | |
| 950 | 19802 | 0 | 90 | gb|AAK11734.1|serine/threonine/tyrosine kinase [*Arachis hypogaea*] | CS | |
| 951 | 19746 | 1.00E−127 | 92 | sp|Q96450|1433A_SOYBN14-3.3-like protein A (SGF14A) gb|AAB09580.1|SGF14A [*Glycine max*] | CS | |
| 952 | 70902 | 1.00E−135 | 81 | gb|ABE77803.1|oxidoreductase; short chain dehydrogenase/reductase family, putative [*Medicago truncatula*] | PEG | |
| 953 | 19933 | 2.00E−92 | 68 | gb|ABE81369.1|RNA-binding region RNP-1 |RNA recognition motif) [*Medicago truncatula*] | SP | |
| 954 | 19927 | 0 | 76 | gb|ABE88827.1|Hydroxymethylglutaryl-coenzyme A reductase, putative [*Medicago truncatula*] | CS | SS |
| 955 | 70976 | 1.00E−164 | 79 | ref|NP_194914.1|catalytic/protein phosphatase type 2C [*Arabidopsis thaliana*] | PEG | |
| 956 | 71440 | 0 | 60 | ref|NP_196473.1|nucleotide binding [*Arabidopsis thaliana*] | CS | |
| 957 | 10413 | 0 | 93 | ref|NP_197748.1|CDPK9 (CALCIUM-DEPENDENT PROTEIN KINASE 9); ATP binding/calcium ion binding/calcium- and calmodulin-dependent protein kinase/kinase/protein kinase/ protein serine/threonine kinase/protein-tyrosine kinase [*Arabidopsis thaliana*] | LN | |
| 958 | 11119 | 1.00E−172 | 89 | ref|NP_196779.1|CPK17; ATP binding/calcium ion binding/ calcium- and calmodulin-dependent protein kinase/kinase/ protein kinase/protein serine/threonine kinase/protein-tyrosine kinase [*Arabidopsis thaliana*] | LN | |
| 959 | 78659 | 1.00E−164 | 90 | ref|NP_175249.1|DNA binding/transcription factor [*Arabidopsis thaliana*] | LN | |
| 960 | 78665 | 0 | 100 | ref|NP_567343.1|ubiquitin-protein ligase [*Arabidopsis thaliana*] | DS | |
| 961 | 78969 | 0 | 100 | ref|NP_194509.1|catalytic/protein phosphatase type 2C [*Arabidopsis thaliana*] | LN | |
| 962 | 78970 | 7.00E−86 | 100 | ref|NP_564143.1|calcium ion binding [*Arabidopsis thaliana*] | HS | |
| 963 | 71250 | 1.00E−160 | 100 | ref|NP_567676.1|ATP binding/protein kinase/protein serine/threonine kinase/protein-tyrosine kinase/signal transducer [*Arabidopsis thaliana*] | SS | LN |
| 964 | 78972 | 0 | 94 | ref|NP_176647.1|catalytic [*Arabidopsis thaliana*] | LN | |
| 965 | 78677 | 2.00E−25 | 43 | gb|AAG40050.2|AF324699_1At1g76180 [*Arabidopsis thaliana*] | SS | |
| 966 | 70632 | 3.00E−85 | 100 | ref|NP_187663.1|AHB2 [*Arabidopsis thaliana*] | DS | |
| 967 | 75205 | 0 | 92 | ref|NP_196484.1|AAP2 (AMINO ACID PERMEASE 2); amino acid permease [*Arabidopsis thaliana*] | SS | |
| 968 | 10359 | 1.00E−156 | 100 | gb|AAR10436.1|YDA [*Arabidopsis thaliana*] | DS | |
| 968 | 11408 | 1.00E−156 | 100 | gb|AAR10436.1|YDA [*Arabidopsis thaliana*] | LL | |
| 969 | 73616 | 1.00E−163 | 100 | ref|NP_199265.1|ribose-5-phosphate isomerase [*Arabidopsis thaliana*] | LN | |
| 970 | 78358 | 0 | 100 | ref|NP_188056.1|diaminopimelate decarboxylase [*Arabidopsis thaliana*] | LL | |
| 971 | 71839 | 0 | 96 | ref|NP_200945.1|unknown protein [*Arabidopsis thaliana*] | LN | PEG |
| 972 | 78417 | 0 | 91 | ref|NP_191221.1|unknown protein [*Arabidopsis thaliana*] | LN | |
| 973 | 71952 | 1.00E−169 | 100 | ref|NP_197477.1|binding/oxidative phosphorylation uncoupler [*Arabidopsis thaliana*] | LL | |
| 974 | 78717 | 0 | 85 | ref|NP_566301.1|unknown protein [*Arabidopsis thaliana*] | LN | PEG |
| 975 | 75040 | 0 | 92 | ref|NP_566410.1|unknown protein [*Arabidopsis thaliana*] | LL | |
| 976 | 71843 | 1.00E−134 | 94 | ref|NP_194519.1|unknown protein [*Arabidopsis thaliana*] | LN | |
| 977 | 70666 | 3.00E−79 | 91 | ref|NP_565742.1|unknown protein [*Arabidopsis thaliana*] | LN | |
| 978 | 71846 | 0 | 100 | ref|NP_177890.1|1-aminocyclopropane-1-carboxylate synthase/ transaminase/transferase, transferring nitrogenous groups [*Arabidopsis thaliana*] | SP | |
| 979 | 71314 | 0 | 96 | ref|NP_172774.1|CYP86C4; heme binding/iron ion binding/ monooxygenase/oxygen binding [*Arabidopsis thaliana*] | SP | |
| 980 | 76410 | 0 | 99 | ref|NP_188081.1|CYP72A9; heme binding/iron ion binding/ monooxygenase/oxygen binding [*Arabidopsis thaliana*] | LL | LN |
| 981 | 71322 | 0 | 93 | ref|NP_680111.1|CYP71A21; heme binding/iron ion binding/ monooxygenase/oxygen binding [*Arabidopsis thaliana*] | LN | |
| 982 | 73214 | 0 | 97 | ref|NP_196559.1|CYP78A7; heme binding/iron ion binding/ monooxygenase/oxygen binding [*Arabidopsis thaliana*] | DS | |
| 983 | 71963 | 0 | 97 | ref|NP_199079.1|AOS (ALLENE OXIDE SYNTHASE); hydro- lyase/oxygen binding [*Arabidopsis thaliana*] | SP | PP |
| 984 | 71326 | 0 | 83 | pir||T00605probable cytochrome P450 At2g02580 [imported] - *Arabidopsis thaliana* | LN | |
| 985 | 70834 | 0 | 95 | ref|NP_175900.1|LOX1; lipoxygenase [*Arabidopsis thaliana*] | CS | |
| 986 | 73215 | 0 | 97 | gb|AAF97287.1|AC010164_9Putative cytochrome P450 [*Arabidopsis thaliana*] | CS | |
| 987 | 71334 | 0 | 97 | ref|NP_193568.2|hydrolase, hydrolyzing O-glycosyl compounds [*Arabidopsis thaliana*] | SP | LN |

TABLE 3-continued

| PEP Seq ID No. | Construct ID | E-value | % id | Description | Trait | |
|---|---|---|---|---|---|---|
| 988 | 71335 | 0 | 96 | ref|NP_173573.1|catalytic [*Arabidopsis thaliana*] | LN | |
| 989 | 71347 | 0 | 100 | ref|NP_568479.1|TGG2 (GLUCOSIDE GLUCOHYDROLASE 2); hydrolase, hydrolyzing O-glycosyl compounds [*Arabidopsis thaliana*] | CK | |
| 990 | 71820 | 3.00E−55 | 75 | emb|CAC03600.1|splicing factor SC35 [*Arabidopsis thaliana*] | LL | |
| 991 | 70764 | 1.00E−164 | 94 | ref|NP_172084.2|unknown protein [*Arabidopsis thaliana*] | LL | |
| 992 | 70680 | 8.00E−79 | 100 | ref|NP_567038.1|protein kinase C binding/zinc ion binding [*Arabidopsis thaliana*] | LL | |
| 993 | 72375 | 0 | 73 | gb|ABE85332.1|Protein kinase [*Medicago truncatula*] | SP | |
| 994 | 72469 | 0 | 90 | dbj|BAD95891.1|Ser/Thr protein kinase [*Lotus japonicus*] | CK | |
| 995 | 73951 | 0 | 81 | gb|AAR15466.1|WD-repeat protein [*Capsella rubella*] | CS | |
| 996 | 11003 | 1.00E−118 | 94 | ref|NP_178022.1|NADH dehydrogenase (ubiquinone)/electron transporter/iron ion binding [*Arabidopsis thaliana*] | LN | |
| 997 | 71613 | 1.00E−110 | 85 | ref|NP_199556.1|AtTIP2; 3; water channel [*Arabidopsis thaliana*] | LL | |
| 998 | 78203 | 0 | 93 | gb|AAF27063.1|AC008262_12F4N2.23 [*Arabidopsis thaliana*] | CS | |
| 999 | 71638 | 0 | 90 | ref|NP_174210.1|ATS9 (19S PROTEOSOME SUBUNIT 9) [*Arabidopsis thaliana*] | CS | |
| 1000 | 71631 | 0 | 96 | ref|NP_564785.1|antiporter/glucose-6-phosphate transporter [*Arabidopsis thaliana*] | LL | |
| 1001 | 72368 | 0 | 98 | ref|NP_187640.1|organic anion transporter [*Arabidopsis thaliana*] | SP | |
| 1002 | 78202 | 0 | 98 | ref|NP_564338.1|CARB (CARBAMOYL PHOSPHATE SYNTHETASE B); ATP binding/carbamoyl-phosphate synthase/ligase [*Arabidopsis thaliana*] | CK | |
| 1003 | 78207 | 0 | 96 | ref|NP_030560.1|unknown protein [*Arabidopsis thaliana*] | CS | HS |
| 1004 | 75209 | 0 | 92 | ref|NP_187286.1|EMB3004; 3-dehydroquinate dehydratase/shikimate 5-dehydrogenase [*Arabidopsis thaliana*] | LN | |
| 1005 | 72457 | 7.00E−86 | 100 | ref|NP_568956.1|ubiquitin conjugating enzyme/ubiquitin-like activating enzyme [*Arabidopsis thaliana*] | CS | |
| 1006 | 73639 | 0 | 98 | ref|NP_197589.1|ATP binding/protein binding [*Arabidopsis thaliana*] | CS | |
| 1007 | 72526 | 1.00E−55 | 81 | ref|NP_567335.1|unknown protein [*Arabidopsis thaliana*] | CK | |
| 1008 | 72531 | 0 | 100 | ref|NP_194003.1|O-sialoglycoprotein endopeptidase [*Arabidopsis thaliana*] | CS | |
| 1009 | 73336 | 1.00E−167 | 100 | ref|NP_201090.1|catalytic [*Arabidopsis thaliana*] | LL | |
| 1010 | 73722 | 0 | 94 | ref|NP_191029.1|sugar binding [*Arabidopsis thaliana*] | CS | |
| 1011 | 72650 | 1.00E−168 | 85 | ref|NP_568218.1|unknown protein [*Arabidopsis thaliana*] | DS | |
| 1012 | 73686 | 5.00E−67 | 100 | ref|NP_189296.1|unknown protein [*Arabidopsis thaliana*] | CK | LL |
| 1013 | 78353 | 1.00E−14 | 86 | sp|Q9SLB6|LBD17_ARATHLOB domain-containing protein 17 gb|AAD23726.1| hypothelical protein [*Arabidopsis thaliana*] | LL | LN |
| 1014 | 73726 | 0 | 100 | ref|NP_179795.1|nucleotide binding [*Arabidopsis thaliana*] | LN | |
| 1015 | 74715 | 0 | 97 | ref|NP_197059.1|nucleotide binding [*Arabidopsis thaliana*] | CS | |
| 1016 | 73230 | 0 | 96 | ref|NP_191164.1|ATP binding/kinase/protein kinase/protein serine/threonine kinase/protein-tyrosine kinase [*Arabidopsis thaliana*] | CS | |
| 1017 | 72663 | 2.00E−97 | 100 | ref|NP_565393.1|ATP binding/kinase/shikimate kinase [*Arabidopsis thaliana*] | LN | |
| 1018 | 70822 | 0 | 94 | ref|NP_198905.1|ATCLC-A (CHLORIDE CHANNEL A); anion channel/voltage-gated chloride channel [*Arabidopsis thaliana*] | HS | |
| 1019 | 72827 | 1.00E−164 | 95 | ref|NP_173856.1|oxidoreductase [*Arabidopsis thaliana*] | LN | |
| 1020 | 78339 | 0 | 96 | ref|NP_197098.1|oxidoreductase [*Arabidopsis thaliana*] | LL | |
| 1021 | 73309 | 1.00E−171 | 100 | dbj|BAA96982.1|11-beta-hydroxysteroid dehydrogenase-like [*Arabidopsis thaliana*] | LL | |
| 1022 | 78725 | 0 | 94 | ref|NP_192359.1|kinase [*Arabidopsis thaliana*] | LN | |
| 1023 | 74222 | 0 | 93 | ref|NP_174039.1|ATP binding/kinase/protein serine/threonine kinase [*Arabidopsis thaliana*] | LL | LN |
| 1024 | 78341 | 0 | 93 | ref|NP_176603.1|ATP binding/kinase/protein serine/threonine kinase [*Arabidopsis thaliana*] | LN | PEG |
| 1025 | 78342 | 1.00E−178 | 93 | ref|NP_188875.1|AOX1B; alternative oxidase [*Arabidopsis thaliana*] | LL | LN |
| 1026 | 78349 | 2.00E−55 | 100 | ref|NP_568772.3|FIB1 (FIBRILLARIN 1) [*Arabidopsis thaliana*] | CS | |
| 1027 | 73683 | 7.00E−90 | 100 | ref|NP_564105.1|ASK4; ubiquitin-protein ligase [*Arabidopsis thaliana*] | DS | |
| 1028 | 73280 | 7.00E−86 | 94 | ref|NP_565297.1|ASK16 (*ARABIDOPSIS* SKP1-LIKE 16); ubiquitin-protein ligase [*Arabidopsis thaliana*] | SP | |
| 1029 | 73281 | 3.00E−77 | 96 | ref|NP_565467.1|MEO (MEIDOS); ubiquitin-protein ligase [*Arabidopsis thaliana*] | LN | |
| 1030 | 73313 | 0 | 95 | ref|NP_172572.1|kinase [*Arabidopsis thaliana*] | CS | |
| 1031 | 12772 | 1.00E−117 | 94 | ref|NP_176435.1|Rho GDP-dissociation inhibitor [*Arabidopsis thaliana*] | SS | |
| 1032 | 73314 | 0 | 89 | ref|NP_186833.1|ATP binding/kinase/protein kinase/protein serine/threonine kinase/protein-tyrosine kinase [*Arabidopsis thaliana*] | DS | |
| 1033 | 73861 | 0 | 97 | ref|NP_195565.2|ATPLC1; phospholipase C [*Arabidopsis thaliana*] | PEG | |
| 1034 | 73676 | 1.00E−164 | 100 | ref|NP_201532.2|CYP81G1; heme binding/iron ion binding/monooxygenase/oxygen binding [*Arabidopsis thaliana*] | PEG | |

TABLE 3-continued

| PEP Seq ID No. | Construct ID | Annotation | | | Trait | |
|---|---|---|---|---|---|---|
| | | E-value | % id | Description | | |
| 1035 | 74212 | 0 | 100 | ref|NP_176086.1|heme binding/iron ion binding/ monooxygenase/oxygen binding [Arabidopsis thaliana] | LL | |
| 1036 | 74218 | 0 | 98 | gb|AAG60111.1|AC073178_22cytochrome P450 putative [Arabidopsis thaliana] | CK | DS |
| 1037 | 71218 | 0 | 91 | ref|NP_188021.1|RSH2 (RELA-SPOT HOMOLOG); catalytic [Arabidopsis thaliana] | PP | |
| 1038 | 73731 | 0 | 94 | ref|NP_179782.1|CYP96A5; heme binding/iron ion binding/ monooxygenase/oxygen binding [Arabidopsis thaliana] | CS | |
| 1039 | 73251 | 1.00E-98 | 100 | ref|NP_186922.1|electron transporter/thiol-disulfide exchange intermediate [Arabidopsis thaliana] | CS | |
| 1040 | 12773 | 0 | 100 | ref|NP_565903.1|catalytic/hydrolase [Arabidopsis thaliana] | PEG | |
| 1041 | 73254 | 8.00E-50 | 80 | ref|NP_566150.1|unknown protein [Arabidopsis thaliana] | CS | |
| 1042 | 73255 | 1.00E-169 | 100 | ref|NP_850995.1|unknown protein [Arabidopsis thaliana] | SP | |
| 1043 | 73257 | 6.00E-39 | 85 | gb|AAF01528.1|AC009991_24hypothetical protein [Arabidopsis thaliana] | LN | |
| 1044 | 11049 | 0 | 100 | ref|NP_181474.2|catalytic/hydrolase [Arabidopsis thaliana] | LN | |
| 1045 | 74231 | 0 | 84 | ref|NP_190740.1|unknown protein [Arabidopsis thaliana] | CS | |
| 1046 | 73266 | 2.00E-89 | 79 | ref|NP_190816.1|unknown protein [Arabidopsis thaliana] | PP | |
| 1047 | 75823 | 1.00E-101 | 70 | ref|NP_566967.1|unknown protein [Arabidopsis thaliana] | LL | |
| 1048 | 11353 | 1.00E-155 | 85 | ref|NP_565721.1|ADS2; iron ion binding/oxidoreductase/ stearoyl-CoA 9-desaturase [Arabidopsis thaliana] | LN | |
| 1049 | 72025 | 0 | 95 | ref|NP_199995.1|PGM (PHOSPHOGLUCOMUTASE) [Arabidopsis thaliana] | CS | |
| 1050 | 72037 | 0 | 91 | ref|NP_179336.1|protein binding [Arabidopsis thaliana] | SS | |
| 1051 | 72049 | 0 | 100 | emb|CAA16713.1|cytochrome P450 [Arabidopsis thaliana] | SP | |
| 1052 | 78213 | 1.00E-151 | 93 | ref|NP_181836.1|AT-P4H-1; oxidoreductase, acting on paired donors, with incorporation or reduction of molecular oxygen, 2-oxoglutarate as one donor, and incorporation of one atom each of oxygen into both donors/procollagen-proline 4-dioxygenase [Arabidopsis thaliana] | CS | |
| 1053 | 72007 | 0 | 100 | ref|NP_011943.1|Mitochondrially localized type 2C protein phosphatase; expression induced by growth on ethanol and by sustained osmotic stress; possible role in carbon source utilization in low oxygen environments (Saccharomyces cerevisiae) | CK | |
| 1054 | 72067 | 1.00E-171 | 83 | ref|NP_011043.1|Sho1p (Saccharomyces cerevisiae) | DS | |
| 1055 | 72008 | 4.00E-71 | 100 | sp|P40001|YEA8_YEASTHypothetical 14.0 kDa protein in GCN4-WBP1 intergenic region gb|AAB64485.1| Yel008wp [Saccharomyces cerevisiae] | LL | |
| 1056 | 72022 | 1.00E-127 | 72 | ref|NP_564894.1|unknown protein [Arabidopsis thaliana] | CK | |
| 1057 | 72096 | 3.00E-64 | 66 | ref|NP_001051798.1|Os03g0831900 [Oryza sativa (japonica cultivar-group)] | CS | |
| 1058 | 10811 | 0 | 96 | ref|NP_175947.1|BCDH BETA1 (BRANCHED-CHAIN ALPHA-KETO ACID DECARBOXYLASE E1 BETA SUBUNIT); 3-methyl-2-oxobutanoate dehydrogenase (2-methylpropanoyl-transferring) [Arabidopsis thaliana] | LN | |
| 1059 | 72138 | 4.00E-89 | 65 | ref|NP_180496.1|SAG13; oxidoreductase [Arabidopsis thaliana] | CK | |
| 1060 | 74261 | 0 | 98 | ref|NP_566923.1|branched-chain-amino-acid transaminase/ catalytic [Arabidopsis thaliana] | LL | |
| 1061 | 74264 | 1.00E-122 | 100 | ref|NP_196452.1|unknown protein [Arabidopsis thaliana] | CS | |
| 1062 | 74271 | 0 | 93 | ref|NP_195096.2|unknown protein [Arabidopsis thaliana] | CS | |
| 1063 | 74272 | 1.00E-112 | 90 | ref|NP_195409.1|unknown protein [Arabidopsis thaliana] | SS | |
| 1064 | 78442 | 0 | 91 | ref|NP_189231.1|protein phosphatase type 2A regulator [Arabidopsis thaliana] | LL | |
| 1065 | 76709 | 0 | 96 | ref|NP_174119.1|carboxy-lyase [Arabidopsis thaliana] | CK | |
| 1066 | 75002 | 0 | 94 | ref|NP_566016.1|ATCS; citrate (SI)-synthase [Arabidopsis thaliana] | CS | PP |
| 1067 | 78361 | 0 | 82 | gb|AAL09767.1|AT5g03040/F15A17_70 [Arabidopsis thaliana] | SS | |
| 1068 | 74238 | 0 | 92 | ref|NP_850730.1|dihydrodipicolinate synthase [Arabidopsis thaliana] | SS | |
| 1069 | 78434 | 0 | 100 | ref|NP_180966.1|permease [Arabidopsis thaliana] | DS | |
| 1070 | 73932 | 0 | 85 | ref|NP_173508.1|carbohydrate transporter/nucleoside transporter/sugar porter [Arabidopsis thaliana] | SS | |
| 1071 | 72713 | 0 | 97 | ref|NP_567914.1|LKR [Arabidopsis thaliana] ref|NP_849486.1| LKR [Arabidopsis thaliana] | SS | |
| 1072 | 72773 | 1.00E-149 | 93 | ref|NP_013180.1|Inhibitor of Cdc28-Clb kinase complexes that controls G1/S phase transition, preventing premature S phase and ensuring genomic integrity; phosphorylation targets Sic1p for SCF(CDC4)-dependent turnover; functional homolog of mammalian Kip1 [Saccharomyces cerevisiae] | PP | |
| 1073 | 72678 | 0 | 91 | ref|NP_015445.1|B-type cyclin involved in DNA replication during S phase; activates Cdc28p to promote initiation of DNA synthesis; functions in formation of mitotic spindles along with Clb3p and Clb4p; most abundant during late G1 phase [Saccharomyces cerevisiae] | PEG | |

TABLE 3-continued

| PEP Seq ID No. | Construct ID | Annotation | | | Trait | | |
|---|---|---|---|---|---|---|---|
| | | E-value | % id | Description | | | |
| 1074 | 72765 | 0 | 88 | ref|NP_009934.1|Sat4p [*Saccharomyces cerevisiae*] | PP | PEG | |
| 1075 | 72730 | 1.00E−146 | 92 | ref|NP_012214.1|Pcl7p [*Saccharomyces cerevisiae*] | CS | | |
| 1076 | 72707 | 5.00E−66 | 90 | ref|NP_011461.1|Erv14p [*Saccharomyces cerevisiae*] | CK | | |
| 1077 | 72755 | 1.00E−134 | 89 | ref|NP_116710.1|Rpn12p [*Saccharomyces cerevisiae*] | PP | PEG | |
| 1078 | 10610 | 1.00E−110 | 89 | ref|NP_187123.1|PR4 (PATHOGENESIS-RELATED 4) [*Arabidopsis thaliana*] | LN | | |
| 1079 | 73953 | 0 | 92 | ref|NP_850165.1|DNA binding/NAD+ ADP-ribosyltransferase [*Arabidopsis thaliana*] | LL | | |
| 1080 | 73173 | 1.00E−113 | 91 | ref|NP_191263.1|ARR9 (RESPONSE REACTOR 4); transcription regulator [*Arabidopsis thaliana*] | HS | | |
| 1081 | 73979 | 0 | 96 | sp|O49289|RH29_ARATHPutative DEAD-box ATP-dependent RNA helicase 29 gb|AAC00620.1| Similar ATP-dependent RNA Helicase [*Arabidopsis thaliana*] | SS | PEG | |
| 1082 | 73966 | 0 | 94 | ref|NP_194578.1|HAESA (RECEPTOR-LIKE PROTEIN KINASE 5); ATP binding/kinase/protein serine/threonine kinase [*Arabidopsis thaliana*] | LN | | |
| 1083 | 12776 | 0 | 100 | ref|NP_178421.1|FT1 (FUCOSYLTRANSFERASE 1); fucosyltransferase/transferase, transferring glycosyl groups [*Arabidopsis thaliana*] | PP | | |
| 1084 | 72960 | 0 | 87 | ref|NP_190906.1|carbohydrate binding/kinase) *Arabidopsis thaliana*] | PEG | | |
| 1085 | 73021 | 0 | 100 | ref|NP_243103.1|NADP-dependent glyceraldehyde-3-phosphate dehydrogenase [*Bacillus halodurans* C-125] | CS | PP | PEG |
| 1086 | 73163 | 0 | 99 | ref|NP_243584.1|glutamate dehydrogenase [*Bacillus halodurans* C-125] | CS | SS | |
| 1087 | 73187 | 0 | 93 | ref|NP_244808.1|1-pyrroline-5-carboxylate dehydrogenase [*Bacillus halodurans* C-125] | CK | | |
| 1088 | 73188 | 1.00E−173 | 100 | ref|NP_389366.1|glutaminase [*Bacillus subtilis* subsp. *subtilis* str. 168] | PEG | | |
| 1089 | 73153 | 1.00E−159 | 92 | ref|NP_415018.1|predicted glutaminase [*Escherichia coli* K12] | CK | | |
| 1090 | 73983 | 0 | 99 | ref|ZP_00107721.1|COG0160: 4-aminobutyrate aminotransferase and related aminotransferases [*Nostoc punctiforme* PCC 73102] | CK | | |
| 1091 | 11516 | 0 | 98 | ref|NP_564571.1|THFS (10-FORMYLTETRAHYDROFOLATE SYNTHETASE); ATP binding/formate-tetrahydrofolate ligase [*Arabidopsis thaliana*] | LN | | |
| 1092 | 73179 | 0 | 97 | ref|NP_387399.1|beta alanine-pyruvate transaminase [*Sinorhizobium meliloti* 1021] | LL | | |
| 1093 | 73009 | 0 | 87 | ref|NP_927600.1|glutamine synthetase [*Photorhabdus luminescens* subsp. *laumondii* TTO1] | SS | | |
| 1094 | 73109 | 4.00E−95 | 100 | ref|NP_840275.1|adenine phosphoribosyltransferase [*Nitrosomonas europaea* ATCC 19718] | PEG | | |
| 1095 | 73121 | 1.00E−117 | 94 | ref|ZP_00109456.1|COG0120: Ribose 5-phosphate isomerase [*Nostoc punctiforme* PCC 73102] | PEG | | |
| 1096 | 73157 | 1.00E−98 | 100 | ref|NP_791813.1|adenine phosphoribosyltransferase [*Pseudomonas syringae* pv. tomato str. DC3000] | CS | | |
| 1097 | 73158 | 5.00E−71 | 93 | ref|NP_928672.1|nucleoside diphosphate kinase [*Photorhabdus luminescens* subsp. *laumondii* TTO1] | SS | | |
| 1098 | 73088 | 0 | 100 | ref|NP_013311.1|B-type cyclin involved in cell cycle progression; activates Cdc28p to promote the G2/M transition; may be involved in DNA replication and spindle assembly; accumulates during S phase and G2, then targeted for ubiquitin-mediated degradation [*Saccharomyces cerevisiae*] | DS | | |
| 1099 | 73135 | 0 | 91 | ref|NP_011846.1|Putative protein of unknown function; green fluorescent protein (GFP)-fusion protein co-localizes with clathrin-coated vesicles [*Saccharomyces cerevisiae*] | PP | | |
| 1100 | 73005 | 2.00E−63 | 90 | ref|NP_014508.1|Hrt1p [*Saccharomyces cerevisiae*) | CS | | |
| 1101 | 73171 | 0 | 87 | ref|NP_015262.1|Constituent of the mitochondrial inner membrane presequence translocase (TIM23 complex); may promote binding of incoming precursor proteins to the intermembrane space domain of Tom22p during translocation [*Saccharomyces cerevisiae*] | CK | | |
| 1102 | 73042 | 0 | 88 | ref|NP_014450.1|Pop2p [*Saccharomyces cerevisiae*) | SS | | |
| 1103 | 73067 | 0 | 100 | ref|NP_010301.1|Probable membrane protein with three predicted transmembrane domains; homologous to Ybr042cp, similar to *C. elegans* F55A11.5 and maize 1-acyl-glycerol-3-phosphate acyltransferase; null exhibits no apparent phenotype [*Saccharomyces cerevisiae*] | CS | | |
| 1104 | 73148 | 0 | 100 | emb|CAA56013.1|A-509 protein [*Saccharomyces cerevisiae*) | CS | | |
| 1105 | 72933 | 0 | 94 | ref|NP_010632.1|Hxt3p [*Saccharomyces cerevisiae*] | LN | | |
| 1106 | 77723 | 0 | 90 | ref|NP_012321.1|Hxt8p [*Saccharomyces cerevisiae*] | CK | CS | |
| 1107 | 73048 | 0 | 93 | ref|NP_010331.1|Amino acid permease involved in the uptake of cysteine, leucine, isoleucine and valine [*Saccharomyces cerevisiae*] | CS | | |
| 1108 | 10616 | 0 | 100 | ref|NP_194906.1|MGD1 (MONOGALACTOSYLDIACYLGLYCEROL SYNTHASE 1); 1,2-diacylglycerol 3-beta-galactosyltransferase [*Arabidopsis thaliana*] | LN | | |

TABLE 3-continued

| PEP Seq ID No. | Construct ID | E-value | % id | Annotation Description | Trait | | |
|---|---|---|---|---|---|---|---|
| 1109 | 72923 | 0 | 98 | ref|NP_116600.1|Agp3p [*Saccharomyces cerevisiae*] | SP | | |
| 1110 | 78501 | 0 | 100 | gb|AAD32292.1|putative protein kinase [*Arabidopsis thaliana*] | SP | | |
| 1111 | 78371 | 0 | 94 | gb|AAF27112.1|AC011809_21Putative protein kinase [*Arabidopsis thaliana*] | LL | | |
| 1112 | 74332 | 1.00E−174 | 95 | ref|NP_178581.1|ATP binding/kinase/protein kinase/protein serine/threonine kinase/protein-tyrosine kinase [*Arabidopsis thaliana*] | LL | | |
| 1113 | 74738 | 0 | 94 | ref|NP_850311.1|ATP binding/kinase/protein kinase/protein serine/threonine kinase/protein-tyrosine kinase [*Arabidopsis thaliana*] | SS | LN | |
| 1114 | 75225 | 0 | 100 | ref|NP_849998.1|ATP binding/kinase/protein kinase/protein serine/threonine kinase/protein-tyrosine kinase [*Arabidopsis thaliana*] | CS | | |
| 1115 | 11149 | 1.00E−110 | 91 | ref|NP_568067.1|FK506 binding/peptidyl-prolyl cis-trans isomerase [*Arabidopsis thaliana*] | DS | | |
| 1116 | 74739 | 0 | 87 | ref|NP_564844.1|ATP binding/protein kinase [*Arabidopsis thaliana*] | CS | | |
| 1117 | 74748 | 1.00E−172 | 92 | ref|NP_179308.1[ATP binding/kinase/protein kinase/protein serine/threonine kinase/protein-tyrosine kinase [*Arabidopsis thaliana*] | LL | | |
| 1118 | 78113 | 0 | 100 | ref|NP_198610.1|oxidoreductase/zinc ion binding [*Arabidopsis thaliana*] | PEG | | |
| 1119 | 75233 | 0 | 96 | ref|NP_851257.1|oxidoreductase/zinc ion binding [*Arabidopsis thaliana*] | CS | | |
| 1120 | 77311 | 0 | 83 | ref|NP_850553.1|ATP binding/nucleoside-triphosphatase/ nucleotide binding [*Arabidopsis thaliana*] | LN | | |
| 1121 | 77008 | 0 | 89 | ref|NP_177460.2|ATP binding/ATP-dependent peptidase/ nucleoside-triphosphatase/nucleotide binding/serine-type endopeptidase [*Arabidopsis thaliana*] | CS | | |
| 1122 | 77321 | 0 | 98 | ref|NP_565299.1|ATP binding/ATP-dependent helicase/DNA binding/nucleoside-triphosphatase/nucleotide binding [*Arabidopsis thaliana*] | CS | | |
| 1123 | 76214 | 0 | 100 | ref|NP_564533.1|unknown protein [*Arabidopsis thaliana*] | DS | | |
| 1124 | 75238 | 0 | 96 | ref|NP_566361.1|disulfide oxidoreductase/oxidoreductase [*Arabidopsis thaliana*] | PEG | | |
| 1125 | 76118 | 0 | 92 | ref|NP_568125.1|disulfide oxidoreductase/oxidoreductase [*Arabidopsis thaliana*] | PP | HS | |
| 1126 | 75243 | 0 | 91 | ref|NP_567074.2|ATP binding/kinase/protein kinase/protein serine/threonine kinase/protein-tyrosine kinase [*Arabidopsis thaliana*] | CS | | |
| 1127 | 72602 | 0 | 91 | ref|NP_178198.1|NRAMP1; manganese ion transporter/metal ion transporter [*Arabidopsis thaliana*] | LN | | |
| 1128 | 75810 | 0 | 100 | gb|ABG54332.1|double HA-tagged mitogen activated protein kinase 5 [synthetic construct] | SS | | |
| 1129 | 75094 | 0 | 89 | ref|NP_199951.1|unknown protein [*Arabidopsis thaliana*] | CS | | |
| 1130 | 75818 | 1.00E−150 | 91 | ref|NP_566411.2|unknown protein [*Arabidopsis thaliana*] | CS | | |
| 1131 | 75248 | 0 | 88 | ref|NP_568685.1|RNA binding/nucleic acid binding [*Arabidopsis thaliana*] | LL | | |
| 1132 | 74605 | 6.00E−60 | 86 | ref|NP_200911.1|RNA binding/nucleic acid binding [*Arabidopsis thaliana*] | LL | | |
| 1133 | 75252 | 0 | 97 | ref|NP_567801.1|NADH dehydrogenase/disulfide oxidoreductase [*Arabidopsis thaliana*] | LL | | |
| 1134 | 10620 | 2.00E−56 | 77 | ref|NP_175633.1|unknown protein [*Arabidopsis thaliana*] | LN | | |
| 1135 | 74611 | 4.00E−57 | 63 | ref|NP_683304.1|unknown protein [*Arabidopsis thaliana*] | LL | LN | |
| 1136 | 11152 | 0 | 91 | ref|NP_199220.1|CAD1 (CADMIUM SENSITIVE 1) [*Arabidopsis thaliana*] | LL | | |
| 1137 | 76610 | 0 | 100 | ref|NP_176261.1|ATRPAC43: DNA binding/DNA-directed RNA polymerase [*Arabidopsis thaliana*] | CS | | |
| 1138 | 70243 | 1.00E−107 | 100 | ref|NP_177128.1|ATHVA22C [*Arabidopsis thaliana*] | SS | | |
| 1139 | 74371 | 1.00E−170 | 100 | ref|NP_177541.1|strictosidine synthase [*Arabidopsis thaliana*] | LN | | |
| 1140 | 74373 | 1.00E−100 | 93 | ref|NP_177712.1|ATROP4 (RHO-LIKE GTP BINDING PROTEIN 4); GTP binding [*Arabidopsis thaliana*] | CS | SS | LN |
| 1141 | 74615 | 1.00E−177 | 87 | ref|NP_565394.1|nickel ion transporter [*Arabidopsis thaliana*] | SS | | |
| 1142 | 74620 | 6.00E−77 | 100 | ref|NP_188045.1|unknown protein [*Arabidopsis thaliana*] | LN | | |
| 1143 | 74626 | 5.00E−93 | 88 | ref|NP_566635.1|unknown protein [*Arabidopsis thaliana*] | LL | | |
| 1144 | 10622 | 1.00E−147 | 100 | ref|NP_001031481.1|UREG; metal ion binding/nickel ion binding/ nucleotide binding [*Arabidopsis thaliana*] | LN | | |
| 1145 | 74636 | 2.00E−89 | 94 | gb|AAO19647.1|CAXIP1 protein [*Arabidopsis thaliana*] | LL | | |
| 1146 | 74656 | 1.00E−107 | 93 | ref|NP_195699.1|GTP binding [*Arabidopsis thaliana*] | CS | | |
| 1147 | 74658 | 1.00E−115 | 100 | ref|NP_195709.1|ATGB3 (GTP-BINDING PROTEIN 3); GTP binding [*Arabidopsis thaliana*] | HS | | |
| 1148 | 74659 | 4.00E−99 | 88 | ref|NP_568121.1|ATRAB ALPHA; GTP binding [*Arabidopsis thaliana*] | CS | | |
| 1149 | 74673 | 0 | 92 | gb|AAL24269.1|AT5g51550/K17N15_10 [*Arabidopsis thaliana*] | SS | | |
| 1150 | 13518 | 0 | 94 | ref|NP_191100.1|ATP binding/methionine-tRNA ligase/tRNA ligase [*Arabidopsis thaliana*] | DS | | |

TABLE 3-continued

| PEP Seq ID No. | Construct ID | Annotation | | | Trait | |
|---|---|---|---|---|---|---|
| | | E-value | % id | Description | | |
| 1150 | 70824 | 0 | 94 | ref|NP_191100.1|ATP binding/methionine-tRNA ligase/tRNA ligase [*Arabidopsis thaliana*] | CK | |
| 1151 | 75267 | 0 | 90 | ref|NP_200758.1|unknown protein [*Arabidopsis thaliana*] | LL | |
| 1152 | 75283 | 0 | 93 | ref|NP_201300.1|unknown protein [*Arabidopsis thaliana*] | LN | |
| 1153 | 13805 | 0 | 94 | ref|NP_186764.1|PTB (POLYPYRIMIDINE TRACT-BINDING); RNA binding/nucleic acid binding [*Arabidopsis thaliana*] | LN | |
| 1154 | 76221 | 0 | 97 | ref|NP_187191.2|carbohydrate transporter/sugar porter [*Arabidopsis thaliana*] | SP | PP |
| 1155 | 76226 | 0 | 93 | ref|NP_187247.1|carbohydrate transporter/sugar porter [*Arabidopsis thaliana*] | DS | |
| 1156 | 76222 | 0 | 95 | ref|NP_188627.1|STP4 (SUGAR TRANSPORTER); carbohydrate transporter/sugar porter [*Arabidopsis thaliana*] | LL | |
| 1157 | 76611 | 0 | 97 | ref|NP_190157.2|transporter [*Arabidopsis thaliana*] | LL | |
| 1158 | 76228 | 0 | 92 | ref|NP_197718.1|carbohydrate transporter/sugar porter [*Arabidopsis thaliana*] | LL | |
| 1159 | 76435 | 0 | 93 | ref|NP_175449.1|carbohydrate transporter/sugar porter [*Arabidopsis thaliana*] | LL | |
| 1160 | 76436 | 0 | 91 | ref|NP_178054.1|carbohydrate transporter/sugar porter [*Arabidopsis thaliana*] | DS | |
| 1161 | 78743 | 0 | 90 | ref|NP_179438.1|carbohydrate transporter/sugar porter [*Arabidopsis thaliana*] | LN | |
| 1162 | 75814 | 0 | 91 | ref|NP_201166.1|HEN3 (HUA ENHANCER 3); ATP binding/kinase/kinase/protein serine/threonine kinase/protein-tyrosine kinase [*Arabidopsis thaliana*] | CS | PP |
| 1163 | 77016 | 0 | 93 | ref|NP_195802.1|ATSR1 (SERINE/THREONINE PROTEIN KINASE 1); ATP binding/kinase/protein kinase/protein serine/threonine kinase/protein-tyrosine kinase [*Arabidopsis thaliana*] | CS | |
| 1164 | 78734 | 0 | 98 | ref|NP_199394.1|CIPK20 (CBL-INTERACTING PROTEIN KINASE 20); kinase [*Arabidopsis thaliana*] | PEG | |
| 1165 | 75274 | 0 | 100 | ref|NP_200709.2|ATP binding/protein kinase/protein serine/threonine kinase/protein-tyrosine kinase [*Arabidopsis thaliana*] | CS | |
| 1166 | 76233 | 0 | 89 | ref|NP_197154.2|ATP binding/kinase/protein kinase/protein serine/threonine kinase/protein-tyrosine kinase [*Arabidopsis thaliana*] | SP | |
| 1167 | 74674 | 0 | 100 | ref|NP_191331.2|ATP binding/kinase/protein kinase/protein serine/threonine kinase/protein-tyrosine kinase [*Arabidopsis thaliana*] | PEG | |
| 1168 | 70225 | 0 | 94 | ref|NP_187668.1|CYP77A6; heme binding/iron ion binding/monooxygenase/oxygen binding [*Arabidopsis thaliana*] | CS | |
| 1169 | 75291 | 0 | 98 | ref|NP_201303.1|unknown protein [*Arabidopsis thaliana*] dbj|BAA97310.1| unnamed protein product [*Arabidopsis thaliana*] | CS | |
| 1170 | 75292 | 0 | 91 | gb|AAL57662.1|At1g72120/F28P5_2 [*Arabidopsis thaliana*] | SS | |
| 1171 | 78607 | 0 | 96 | gb|AAC39370.1|trehalose-6-phosphate phosphatase [*Arabidopsis thaliana*] | LN | |
| 1172 | 78367 | 1.00E−172 | 100 | ref|NP_186907.1|STE1 (STEROL 1); C-5 sterol desaturase [*Arabidopsis thaliana*] | CK | DS |
| 1173 | 76528 | 1.00E−165 | 93 | gb|AAM64961.1|putative C-4 sterol methyl oxidase [*Arabidopsis thaliana*] | DS | LL |
| 1174 | 77319 | 0 | 77 | ref|NP_568416.1|protein binding [*Arabidopsis thaliana*] | CS | |
| 1175 | 74677 | 2.00E−73 | 87 | gb|AAM67086.1|unknown [*Arabidopsis thaliana*] | SS | |
| 1176 | 78109 | 1.00E−149 | 87 | ref|NP_182332.1|PAC (PALE CRESS) [*Arabidopsis thaliana*] | CS | |
| 1177 | 77725 | 0 | 100 | ref|NP_391274.1|glyceraldehyde-3-phosphate dehydrogenase [*Bacillus subtilis* subsp. *subtilis* str. 168] | HS | |
| 1178 | 73437 | 0 | 99 | ref|YP_517842.1|glyceraldehyde 3-phosphate dehydrogenase [*Desulfitobacterium hafniense* Y51] | SS | |
| 1179 | 73450 | 0 | 100 | ref|YP_350062.1|hypothetical protein Pfl_4334 [*Pseudomonas fluorescens* PfO-1] | CS | |
| 1180 | 73416 | 0 | 100 | ref|NP_443010.1|glucose-1-phosphate adenylyltransferase [*Synechocystis* sp. PCC 6803] | HS | |
| 1181 | 73452 | 0 | 97 | ref|NP_388496.1|sorbitol dehydrogenase [*Bacillus subtilis* subsp. *subtilis* str. 168] | SS | LN |
| 1182 | 73453 | 0 | 95 | ref|NP_414890.1|alcohol dehydrogenase class III/glutathione-dependent formaldehyde dehydrogenase [*Escherichia coli* K12] | CK | |
| 1183 | 73454 | 0 | 95 | ref|ZP_00110545.1|COG0837: Glucokinase [*Nostoc punctiforme* PCC 73102] | PP | SS |
| 1184 | 73491 | 0 | 91 | ref|NP_791383.1|alcohol dehydrogenase, class III [*Pseudomonas syringae* pv. tomato str. DC3000] | CS | |
| 1185 | 73445 | 1.00E−176 | 83 | ref|ZP_00709024.1|COG0473: Isocitrate/isopropylmalate dehydrogenase [*Escherichia coli* B171] | SP | |
| 1186 | 73469 | 1.00E−131 | 65 | ref|YP_958498.1|Alcohol dehydrogenase GroES domain protein [*Marinobacter aquaeolei* VT8] | CS | |

TABLE 3-continued

| PEP Seq ID No. | Construct ID | E-value | % id | Annotation Description | Trait | | |
|---|---|---|---|---|---|---|---|
| 1187 | 73434 | 0 | 94 | ref|NP_012342.1|Putative protein of unknown function, predicted to encode a triose phosphate transporter subfamily member based on phylogenetic analysis; similar to YOR307C/SLY41; deletion mutant has a respiratory growth defect [*Saccharomyces cerevisiae*] | CS | | |
| 1188 | 73471 | 0 | 93 | ref|NP_391658.1|pyrroline-5 carboxylate dehydrogenase [*Bacillus subtilis* subsp. *subtilis* str. 168] | CS | | |
| 1189 | 73436 | 0 | 91 | ref|YP_355035.1|Aldehyde dehydrogenase family protein [*Rhodobacter sphaeroides* 2.4.1] | SP | SS | |
| 1190 | 73525 | 0 | 95 | ref|NP_790108.1|succinate-semialdehyde dehydrogenase [*Pseudomonas syringae* pv. tomato str. DC3000] | PP | | |
| 1191 | 73514 | 1.00E-174 | 100 | ref|NP_242723.1|fructokinase [*Bacillus halodurans* C-125] dbj|BAB05576.1|fructokinase [*Bacillus halodurans* C-125] | SP | | |
| 1192 | 73551 | 1.00E-171 | 95 | ref|YP_690914.1|6-phosphofructokinase I [*Shigella flexneri* 5 str. 8401] | LL | | |
| 1193 | 73519 | 0 | 95 | ref|NP_414696.1|glutamate-1-semialdehyde aminotransferase [*Escherichia coli* K12] | CS | | |
| 1194 | 73543 | 0 | 99 | ref|NP_389628.1|glutamine synthetase [*Bacillus subtilis* subsp. *subtilis* str. 168] | CS | | |
| 1195 | 73567 | 1.00E-159 | 92 | ref|NP_415018.1|predicted glutaminase [*Escherichia coli* K12] | CS | DS | |
| 1196 | 73579 | 0 | 96 | ref|NP_792487.1|succinate-semialdehyde dehydrogenase [*Pseudomonas syringae* pv. tomato str. DC3000] | PP | | |
| 1197 | 73556 | 0 | 97 | ref|NP_790150.1|succinate-semialdehyde dehydrogenase [*Pseudomonas syringae* pv. tomato str. DC3000] | SP | | |
| 1198 | 73545 | 0 | 99 | ref|NP_792858.1|aldehyde dehydrogenase family protein [*Pseudomonas syringae* pv. tomato str. DC3000] | PEG | | |
| 1199 | 73511 | 1.00E-161 | 66 | ref|YP_546017.1|Phosphopyruvate hydratase [*Methylobacillus flagellatus* KT] | LL | | |
| 1200 | 74138 | 0 | 97 | ref|NP_415933.1|aldehyde dehydrogenase A, NAD-linked [*Escherichia coli* K12] | PEG | | |
| 1201 | 74186 | 0 | 100 | ref|NP_416275.1|glutamate dehydrogenase [*Escherichia coli* K12] | CS | | |
| 1202 | 74163 | 0 | 95 | ref|NP_391649.1|hypothetical protein BSU37690 [*Bacillus subtilis* subsp. *subtilis* str. 168] | PP | | |
| 1203 | 74175 | 0 | 96 | ref|NP_244424.1|phosphoglyceromutase [*Bacillus halodurans* C-125] | LN | | |
| 1204 | 74176 | 0 | 99 | ref|YP_517842.1|glyceraldehyde 3-phosphate dehydrogenase [*Desulfitobacterium hafniense* Y51] | LN | | |
| 1205 | 74141 | 0 | 99 | ref|YP_543116.1|2,3-bisphosphoglycerate-independent phosphoglycerate mutase [*Escherichia coli* UTI89] | LN | | |
| 1206 | 74178 | 0 | 98 | ref|NP_387154.1|dihydrolipoamide dehydrogenase [*Sinorhizobium meliloti* 1021] | LN | | |
| 1207 | 74179 | 0 | 83 | ref|NP_441936.1|dihydrolipoamide acetyltransferase [*Synechocystis* sp. PCC 6803] | CS | | |
| 1208 | 74110 | 0 | 92 | ref|NP_930835.1|pyruvate dehydrogenase E1 component [*Photorhabdus luminescens* subsp. *laumondii* TT01] | SP | | |
| 1209 | 74170 | 0 | 98 | ref|ZP_00106110.1|COG0021: Transketolase [*Nostoc punctiforme* PCC 73102] | CS | | |
| 1210 | 74123 | 1.00E-174 | 100 | ref|NP_014585.1|Gpm3p [*Saccharomyces cerevisiae*] | LL | | |
| 1211 | 74159 | 1.00E-71 | 88 | ref|NP_440036.1|hypothetical protein slr0250 [*Synechocystis* sp. PCC 6803] | PP | | |
| 1212 | 10633 | 1.00E-150 | 81 | ref|NP_850491.1|CA1 (CARBONIC ANHYDRASE 1); carbonate dehydratase/zinc ion binding [*Arabidopsis thaliana*] | LN | | |
| 1213 | 74172 | 2.00E-62 | 99 | ref|NP_440674.1|cytochrome c553 [*Synechocystis* sp. PCC 6803] | SS | | |
| 1214 | 74184 | 7.00E-47 | 98 | ref|NP_440475.1|hypothetical protein ssr1698 [*Synechocystis* sp. PCC 6803] | CS | PP | SS |
| 1215 | 74582 | 1.00E-164 | 99 | ref|NP_440558.1|aspartoacylase [*Synechocystis* sp. PCC 6803] | CS | | |
| 1216 | 74584 | 0 | 99 | ref|NP_009780.1|E1 beta subunit of the pyruvate dehydrogenase (PDH) complex, which is an evolutionarily-conserved multi-protein complex found in mitochondria [*Saccharomyces cerevisiae*] | CS | | |
| 1217 | 74687 | 1.00E-142 | 99 | ref|NP_385544.1|PROBABLE TRIOSEPHOSPHATE ISOMERASE PROTEIN [*Sinorhizobium meliloti* 1021] | LL | | |
| 1218 | 74461 | 3.00E-70 | 99 | ref|NP_638210.1|hypothetical protein XCC2862 [*Xanthomonas campestris* pv. *campestris* str. ATCC 33913] | SS | | |
| 1219 | 74403 | 0 | 98 | ref|NP_356568.1|glucose-1-phosphate adenylyltransferase [*Agrobacterium tumefaciens* str. C58] | LL | | |
| 1220 | 74430 | 1.00E-178 | 99 | ref|NP_289016.1|transaldolase [*Escherichia coli* O157:H7 EDL933] | SS | | |
| 1221 | 74443 | 0 | 97 | ref|NP_391271.1|phosphoglyceromutase [*Bacillus subtilis* subsp. *subtilis* str. 168] | LL | | |
| 1222 | 74457 | 0 | 100 | ref|YP_350062.1|hypothetical protein Pfl_4334 [*Pseudomonas fluorescens* PfO-1] | LL | | |
| 1223 | 74434 | 0 | 99 | ref|NP_790208.1|glutamine synthetase, type I [*Pseudomonas syringae* pv. tomato str. DC3000] | CS | | |
| 1224 | 74447 | 0 | 91 | ref|NP_385430.1|PUTATIVE AMINOTRANSFERASE PROTEIN [*Sinorhizobium meliloti* 1021] | LN | | |

TABLE 3-continued

| PEP Seq ID No. | Construct ID | E-value | % id | Description | Trait | |
|---|---|---|---|---|---|---|
| 1225 | 74495 | 0 | 94 | ref\|NP_386611.1\|PUTATIVE ALDEHYDE DEHYDROGENASE PROTEIN [*Sinorhizobium meliloti* 1021] | PEG | |
| 1226 | 74513 | 1.00E−115 | 87 | ref\|YP_052359.1\|triosephosphate isomerase [*Erwinia carotovora* subsp. *atroseptica* SCRI1043] | LL | |
| 1227 | 74514 | 0 | 100 | ref\|NP_242374.1\|asparagine synthetase [*Bacillus halodurans* C-125] | PEG | |
| 1228 | 74515 | 0 | 98 | ref\|YP_350541.1\|glucose-6-phosphate isomerase [*Pseudomonas fluorescens* PfO-1] | CS | LL |
| 1229 | 74552 | 0 | 98 | ref\|NP_390871.1\|pullulanase [*Bacillus subtilis* subsp. *subtilis* str. 168] | PEG | |
| 1230 | 74529 | 0 | 96 | ref\|NP_418330.1\|formate dehydrogenase-O, large subunit [*Escherichia coli* K12] | CS | |
| 1231 | 74519 | 0 | 86 | ret\|NP_931552. 1\|glucose-6-phosphate isomerase [*Photorhabdus luminescens* subsp. *laumondii* TT01] | CS | |
| 1232 | 10638 | 1.00E−70 | 58 | ref\|NP_189273.1\|ARRZ-1A; RNA binding/nucleotide binding [*Arabidopsis thaliana*] | LN | |
| 1233 | 76547 | 5.00E−89 | 89 | ref\|NP_190024.1\|unknown protein [*Arabidopsis thaliana*] | PP | |
| 1234 | 76548 | 0 | 94 | ref\|NP_190153.1\|ATP binding/kinase/protein kinase/protein serine/threonine kinase/protein-tyrosine kinase [*Arabidopsis thaliana*] | SS | |
| 1235 | 14703 | 1.00E−56 | 87 | gb\|ABK28584.1\|unknown [*Arabidopsis thaliana*] | LN | |
| 1236 | 75856 | 8.00E−18 | 42 | ref\|NP_190667.2\|unknown protein [*Arabidopsis thaliana*] | CS | |
| 1237 | 76642 | 0 | 92 | ref\|NP_563988.1\|metal ion transporter [*Arabidopsis thaliana*] | LL | |
| 1238 | 77522 | 0 | 83 | ref\|NP_190912.1\|unknown protein [*Arabidopsis thaliana*] | CK | |
| 1239 | 77516 | 0 | 90 | ref\|NP_191095.1\|unknown protein [*Arabidopsis thaliana*] | CS | |
| 1240 | 75864 | 3.00E−63 | 100 | ref\|NP_191376.1\|ATBS14A; protein transporter [*Arabidopsis thaliana*] | LL | |
| 1241 | 76275 | 1.00E−157 | 84 | ref\|NP_191386.1\|unknown protein [*Arabidopsis thaliana*] | CS | |
| 1242 | 76276 | 0 | 100 | ref\|NP_191408.1\|phosphoric ester hydrolase [*Arabidopsis thaliana*] | SP | |
| 1243 | 75869 | 1.00E−85 | 100 | ref\|NP_192145.1\|unknown protein [*Arabidopsis thaliana*] | DS | |
| 1244 | 76558 | 2.00E−77 | 73 | ref\|NP_192181.2\|unknown protein [*Arabidopsis thaliana*] | PP | |
| 1245 | 75876 | 1.00E−101 | 100 | pdb\|1FSI\|AChain A, Crystal Structure Of Cyclic Nucleotide Phosphodiesterase Of Appr>p From *Arabidopsis Thaliana* | HS | |
| 1246 | 75878 | 2.00E−82 | 78 | emb\|CAA20466.1\|putative protein [*Arabidopsis thaliana*] | CS | |
| 1247 | 75881 | 7.00E−91 | 89 | ref\|NP_194766.1\|protein binding/ubiquitin-protein ligase/zinc ion binding [*Arabidopsis thaliana*] | LL | |
| 1248 | 77525 | 0 | 95 | ref\|NP_195212.1\|beta-fructofuranosidase [*Arabidopsis thaliana*] | CS | |
| 1249 | 76454 | 1.00E−176 | 88 | ref\|NP_196814.1\|unknown protein [*Arabidopsis thaliana*] | LL | |
| 1250 | 75895 | 2.00E−27 | 78 | ref\|NP_197316.1\|unknown protein [*Arabidopsis thaliana*] | LL | |
| 1251 | 78377 | 1.00E−154 | 85 | ref\|NP_197406.1\|catalytic [*Arabidopsis thaliana*] | HS | |
| 1252 | 75896 | 7.00E−70 | 100 | ref\|NP_197550.1\|arsenate reductase (glutaredoxin)/electron transporter/thiol-disulfide exchange intermediate [*Arabidopsis thaliana*] | CS | |
| 1253 | 77527 | 0 | 85 | ref\|NP_850871.1\|unknown protein [*Arabidopsis thaliana*] | CS | |
| 1254 | 78984 | 0 | 100 | ref\|NP_198084.1\|catalytic [*Arabidopsis thaliana*] | SS | |
| 1255 | 77528 | 0 | 92 | ref\|NP_568564.1\|unknown protein [*Arabidopsis thaliana*] | SS | |
| 1256 | 76752 | 0 | 84 | ref\|NP_199429.1\|unknown protein [*Arabidopsis thaliana*] | LL | |
| 1257 | 78106 | 0 | 100 | gb\|ABK06440.1\|flag-tagged protein kinase domain of putative mitogen-activated protein kinase kinase kinase [synthetic construct] | SS | |
| 1258 | 11720 | 0 | 89 | ref\|NP_565622.1\|RCY1; cyclin-dependent protein kinase regulator [*Arabidopsis thaliana*] | LN | |
| 1259 | 78740 | 1.00E−121 | 75 | ref\|NP_200152.1\|unknown protein [*Arabidopsis thaliana*] | PP | |
| 1260 | 76157 | 1.00E−154 | 88 | ref\|NP_001032094.1\|carrier/steroid binding [*Arabidopsis thaliana*] | LN | |
| 1261 | 77530 | 0 | 83 | ref\|NP_201241.1\|heat shock protein binding/unfolded protein binding [*Arabidopsis thaliana*] | SP | CS |
| 1262 | 76755 | 0 | 87 | gb\|AAM14093.1\|putative bystin [*Arabidopsis thaliana*] | PEG | |
| 1263 | 76166 | 4.00E−99 | 82 | ref\|NP_171940.1\|RIC3 (ROP-INTERACTIVE CRIB MOTIF-CONTAINING PROTEIN 3) [*Arabidopsis thaliana*] | PEG | |
| 1264 | 76756 | 0 | 90 | ref\|NP_171927.1\|ERS2 (ETHYLENE RESPONSE SENSOR 2); receptor [*Arabidopsis thaliana*] | LN | |
| 1265 | 78990 | 0 | 100 | ref\|NP_175364.1\|oxidoreductase, acting on paired donors, with incorporation or reduction of molecular oxygen, 2-oxoglutarate as one donor, and incorporation of one atom each of oxygen into both donors [*Arabidopsis thaliana*] | CS | |
| 1266 | 78460 | 9.00E−97 | 75 | ref\|NP_175584.1\|unknown protein [*Arabidopsis thaliana*] | LN | |
| 1267 | 11022 | 0 | 95 | ref\|NP_192078.1\|PPOX; protoporphyrinogen oxidase [*Arabidopsis thaliana*] | LN | |
| 1268 | 77533 | 0 | 96 | ref\|NP_177399.1\|ATP binding/phenylalanine-tRNA ligase [*Arabidopsis thaliana*] | PEG | |
| 1269 | 76572 | 0 | 100 | ref\|NP_177988.1\|gamma-glutamyl hydrolase [*Arabidopsis thaliana*] | PEG | |
| 1270 | 76186 | 7.00E−48 | 84 | ref\|NP_172210.1\|unknown protein [*Arabidopsis thaliana*] | LL | |
| 1271 | 76190 | 7.00E−35 | 63 | ref\|NP_565499.1\|unknown protein [*Arabidopsis thaliana*] | LL | |

TABLE 3-continued

| PEP Seq ID No. | Construct ID | E-value | % id | Description | Trait | | |
|---|---|---|---|---|---|---|---|
| 1272 | 77071 | 1.00E−160 | 96 | ref|NP_565626.1|unknown protein [*Arabidopsis thaliana*] | SP | | |
| 1273 | 76194 | 3.00E−94 | 79 | ref|NP_565716.1|unknown protein [*Arabidopsis thaliana*] | LN | | |
| 1274 | 78112 | 1.00E−83 | 91 | ref|NP_181610.1|RNA binding/translation initiation factor [*Arabidopsis thaliana*] | CS | | |
| 1275 | 74802 | 0 | 80 | gb|AAO171B3.1|Orf17 [*Photorhabdus luminescens*] | SS | | |
| 1276 | 74851 | 1.00E−163 | 100 | ref|NP_014366.1|Siw14p [*Saccharomyces cerevisiae*] | CK | | |
| 1277 | 74864 | 6.00E−61 | 95 | ref|NP_014486.1|Hxl11p [*Saccharomyces cerevisiae*] | CK | | |
| 1278 | 74805 | 0 | 97 | ref|NP_015359.1|Actin-related protein involved in transcriptional regulation; subunit of the chromatin remodeling Snf/Swi complex [*Saccharomyces cerevisiae*] | HS | | |
| 1279 | 74842 | 2.00E−61 | 65 | ref|NP_001044880.1|Os01g0862200 [*Oryza sativa* (japonica cultivar-group)] | SS | PEG | |
| 1280 | 78231 | 0 | 66 | gb|EAY94228.1|hypothetical protein OsI_01546.1 [*Oryza sativa* (indica cultivar-group)] | LL | | |
| 1281 | 74867 | 1.00E−154 | 65 | gb|EAZ43471.1|hypothetical protein OsJ_026954 [*Oryza sativa* (japonica cultivar-group)] | SS | | |
| 1282 | 74820 | 1.00E−136 | 48 | gb|EAY97430.1|hypothetical protein OsI_018663 [*Oryza sativa* (indica cultivar-group)] | LN | | |
| 1283 | 74868 | 1.00E−101 | 94 | ref|NP_001046499.1|Os02g0265400 [*Oryza sativa* (japonica cultivar-group)] | PP | | |
| 1284 | 74809 | 1.00E−122 | 80 | gb|EAZ13333.1|hypothetical protein OsJ_003158 [*Oryza sativa* (japonica cultivar-group)] | LN | | |
| 1285 | 74845 | 7.00E−43 | 83 | ref|NP_001050930.1|Os03g0685900 [*Oryza sativa* (japonica cultivar-group)] | CS | PP | |
| 1286 | 74870 | 6.00E−91 | 48 | sp|Q5XF85|ATL4J_ARATHRING-H2 finger protein ATL4J precursor emb|CAB43903.1|putative protein [*Arabidopsis thaliana*] | LN | | |
| 1287 | 74859 | 1.00E−109 | 55 | gb|ABD32420.1|Zinc finger, RING-type [*Medicago truncatula*] | CS | | |
| 1288 | 74985 | 3.00E−75 | 94 | ref|NP_001045113.1|Os01g0901800 [*Oryza sativa* (japonica cultivar-group)] | PEG | | |
| 1289 | 74950 | 1.00E−159 | 75 | gb|EAZ00193.1|hypothetical protein OsI_021425 [*Oryza sativa* (indica cultivar-group)] | LN | | |
| 1290 | 74962 | 3.00E−89 | 91 | gb|ABB99414.1|FT-like protein [*Hordeum vulgare* subsp. *vulgare*] | CS | | |
| 1291 | 74939 | 5.00E−42 | 65 | ref|NP_563746.1|transcription factor [*Arabidopsis thaliana*] | LL | | |
| 1292 | 74928 | 1.00E−134 | 87 | ref|NP_001044154.1|Os01g0732200 [*Oryza sativa* (japonica cultivar-group)] | SP | CS | |
| 1293 | 74905 | 0 | 87 | ref|NP_927600.1|glutamine synthetase (*Photorhabdus luminescens* subsp. *laumondii* TTO1) | SP | | |
| 1294 | 74917 | 0 | 99 | ref|YP_346085.1|Inositol phosphatase/fructose-1,6-bisphosphatase [*Pseudomonas fluorescens* PfO-1] | CS | | |
| 1295 | 74989 | 4.00E−69 | 89 | ref|NP_439999.1|hypothetical protein slr0732 [*Synechocystis* sp. PCC 6803] | CS | | |
| 1296 | 74990 | 1.00E−92 | 95 | ref|NP_441647.1|hypothetical protein slr1160 [*Synechocystis* sp. PCC 6803] | LL | | |
| 1297 | 74955 | 1.00E−110 | 99 | ref|NP_441787.1|hypothetical protein slr1649 [*Synechocystis* sp. PCC 6803] | CS | PP | |
| 1298 | 74932 | 1.00E−123 | 83 | ref|NP_441624.1|hypothetical protein slr1530 [*Synechocystis* sp. PCC 6803] | CS | | |
| 1299 | 74944 | 8.00E−76 | 99 | ref|NP_440928.1|hypothetical protein sll0871 [*Synechocystis* sp. PCC 6803] | SS | | |
| 1300 | 74968 | 6.00E−76 | 99 | ref|NP_441307.1|hypothetical protein sll1979 [*Synechocystis* sp. PCC 6803] | CS | | |
| 1301 | 74957 | 1.00E−161 | 100 | ref|NP_440540.1|hypothetical protein slr1699 [*Synechocystis* sp. PCC 6-803] | LL | | |
| 1302 | 75374 | 0 | 72 | ref|NP_001067247.1|Os12g0610500 [*Oryza sativa* (japonica cultivar-group)] | CK | LN | |
| 1303 | 75386 | 1.00E−147 | 74 | emb|CAH67158.1|H0717B12.5 [*Oryza sativa* (indica cultivar-group)] | CS | | |
| 1304 | 77807 | 0 | 85 | ref|NP_001044268.1|Os01g0752700 [*Oryza sativa* (japonica cultivar-group)] | SP | | |
| 1305 | 75388 | 0 | 76 | gb|EAZ29806.1|hypothetical protein OsJ_013289 [*Oryza sativa* (japonica cultivar-group)] | SS | | |
| 1306 | 75365 | 1.00E−82 | 81 | ref|NP_001057701.1|Os06g0498800 [*Oryza sativa* (japonica cultivar-group)] | DS | LL | LN |
| 1307 | 75377 | 3.00E−81 | 77 | gb|EAZ24403.1|hypothetical protein OsJ_007886 [*Oryza sativa* (japonica cultivar-group)] | CK | | |
| 1308 | 75354 | 8.00E−77 | 82 | ref|NP_001062977.1|Os09g0360400 [*Oryza sativa* (japonica cultivar-group)] | LL | | |
| 1309 | 75331 | 1.00E−108 | 84 | ref|NP_001061046.1|Os08g0160000 [*Oryza sativa* (japonica cultivar-group)] | CS | | |
| 1310 | 75343 | 1.00E−122 | 59 | ref|NP_001053728.1|Os04g0594500 [*Oryza sativa* (japonica cultivar-group)] | CS | PEG | |
| 1311 | 77809 | 1.00E−27 | 75 | ref|NP_001059709.1|Os07g0498300 [*Oryza sativa* (japonica cultivar-group)] | LL | | |
| 1312 | 75332 | 1.00E−119 | 72 | dbj|BAD19345.1|2 coiled coil domains of eukaryotic origin (31.3 kD)-like protein [*Oryza sativa* (japonica cultivar-group)] | SP | | |

TABLE 3-continued

| PEP Seq ID No. | Construct ID | Annotation | | | Trait | |
|---|---|---|---|---|---|---|
| | | E-value | % id | Description | | |
| 1313 | 75344 | 1.00E−146 | 81 | gb|EAZ31718.1|hypothetical protein OsJ_015201 [*Oryza sativa* (japonica cultivar-group)] | PP | |
| 1314 | 75333 | 2.00E−78 | 58 | gb|EAZ32939.1|hypothetical protein OsJ_016422 [*Oryza sativa* (japonica cultivar-group)] | LL | |
| 1315 | 75393 | 1.00E−136 | 79 | gb|EAT82167.1|hypothetical protein SNOG_10773 [*Phaeosphaeria nodorum* SN15] | CS | |
| 1316 | 75335 | 2.00E−63 | 79 | ref|NP_001046956.1|Os02g0515600 [*Oryza sativa* (japonica cultivar-group)] | CS | |
| 1317 | 75462 | 1.00E−85 | 90 | dbj|BAD36027.1|putative calcineurin B subunit [*Oryza sativa* (japonica cultivar-group)] | CS | |
| 1318 | 75486 | 1.00E−139 | 89 | ref|NP_001050137.1|Os03g0355800 [*Oryza sativa* (japonica cultivar-group)] | HS | |
| 1319 | 75452 | 1.00E−61 | 91 | ref|NP_001059781.1|Os07g0516200 [*Oryza sativa* (japonica cultivar-group)] | CS | |
| 1320 | 75465 | 2.00E−82 | 29 | ref|NP_974032.1|unknown protein [*Arabidopsis thaliana*] | HS | |
| 1321 | 75489 | 1.00E−115 | 73 | gb|ABE-82748.1|CCT [*Medicago truncatula*] | PP | LN |
| 1322 | 75442 | 3.00E−51 | 51 | emb|CAG26903.1|ALY protein (*Nicotiana benthamiana*) | CS | |
| 1323 | 75466 | 1.00E−147 | 84 | ref|NP_001052646.1|Os04g0391900 [*Oryza sativa* (japonica cultivar-group)] | SP | CS |
| 1324 | 75479 | 1.00E−118 | 87 | ref|NP_001044439.1|Os01g0780800 [*Oryza sativa* (japonica cultivar group)] | LL | |
| 1325 | 75481 | 7.00E−35 | 87 | gb|ABE89387.1|Zinc finger, Tim10/DDP-type [*Medicago truncatula*] | CS | |
| 1326 | 78233 | 0 | 70 | gb|ABE91310.1|F20D23.20 protein - *Arabidopsis thaliana*-related [*Medicago truncatula*] | CK | CS |
| 1327 | 75539 | 2.00E−51 | 79 | ref|NP_564405.1|LOL1 (LSD ONE LIKE 1) [*Arabidopsis thaliana*] | LL | |
| 1328 | 11919 | 0 | 91 | ref|NP_565195.1|AVP2 [*Arabidopsis thaliana*] | PP | |
| 1329 | 75603 | 1.00E−162 | 64 | ref|NP_001067658.1|Os11g0265200 [*Oryza sativa* (japonica cultivar-group)] | LN | |
| 1330 | 75663 | 7.00E−87 | 70 | gb|AAV57783.1|unknown protein [*Oryza sativa* (japonica cultivar-group)] | SS | |
| 1331 | 75616 | 0 | 96 | ref|NP_194004.1|ATP binding/protein kinase/protein serine/threonine kinase/protein-tyrosine kinase [*Arabidopsis thaliana*] | CK | |
| 1332 | 75640 | 1.00E−153 | 81 | ref|NP_001043765.1|Os01g0658700 [*Oryza sativa* (japonica cultivar-group)] | LL | LN |
| 1333 | 75617 | 4.00E−40 | 88 | ref|NP_001054886.1|Os05g0154900 [*Oryza sativa* (japonica cultivar-group)] | SS | |
| 1334 | 75653 | 0 | 92 | ref|NP_568338.2|TOZ (TORMOZEMBRYO DEFECTIVE); nucteotide binding [*Arabidopsis thaliana*] | LN | |
| 1335 | 75665 | 2.00E−95 | 77 | gb|EAY76352.1|hypothetical protein OsI_004199 [*Oryza sativa* indica cultivar-group)] | SS | |
| 1336 | 75618 | 0 | 85 | ref|NP_178381.2|ATP binding/protein kinase/protein serine/threonine kinase [*Arabidopsis thaliana*] | HS | |
| 1337 | 78238 | 0 | 95 | ref|NP_172998.1|nucleotide binding [*Arabidopsis thaliana*] | DS | |
| 1338 | 75608 | 9.00E−72 | 70 | gb|EAZ21409.1|hypothetical protein OsJ_004892 [*Oryza sativa* (japonica cultivar-group)] | LL | |
| 1339 | 75633 | 5.00E−89 | 64 | ref|NP_001046704.1|Os02g0326000 [*Oryza sativa* (japonica cultivar-group)] | HS | |
| 1340 | 75761 | 5.00E−50 | 54 | ref|NP_174505.1|unknown protein [*Arabidopsis thaliana*] | PEG | |
| 1341 | 75785 | 1.00E−74 | 53 | gb|AAK40310.1|putative methyl-binding domain protein MBD111 [*Zea mays*] | CS | |
| 1342 | 75750 | 2.00E−47 | 45 | ref|NP_001042916.1|Os01g0328500 [*Oryza sativa* (japonica cultivar-group)] | PEG | |
| 1343 | 75716 | 0 | 96 | ref|NP_386374.1|PUTATIVE ALDEHYDE DEHYDROGENASE PROTEIN [*Sinorhizobium meliloti* 1021] | DS | LN |
| 1344 | 78129 | 0 | 98 | ref|NP_182096.1|unknown protein [*Arabidopsis thaliana*] | CK | |
| 1345 | 77539 | 1.00E−147 | 88 | ref|NP_187983.1|RNA binding/nucleic acid binding [*Arabidopsis thaliana*] | SP | |
| 1346 | 77540 | 0 | 86 | ref|NP_188270.1|calmodulin binding [*Arabidopsis thaliana*] | LN | |
| 1347 | 77542 | 1.00E−170 | 92 | ref|NP_172882.1|unknown protein [*Arabidopsis thaliana*] | SP | |
| 1348 | 77543 | 0 | 83 | ref|NP_189492.1|ATP binding/ATPase/nucleoside-triphosphatase/nucleotide binding [*Arabidopsis thaliana*] | LL | |
| 1349 | 77545 | 1.00E−141 | 100 | ref|NP_190275.1|unknown protein [*Arabidopsis thaliana*] | SS | |
| 1350 | 77550 | 1.00E−163 | 81 | ref|NP_173191.2|calmodulin binding [*Arabidopsis thaliana*] | SP | |
| 1351 | 77552 | 1.00E−104 | 89 | emb|CAB78029.1|putative protein [*Arabidopsis thaliana*] | CK | |
| 1352 | 77556 | 0 | 94 | ref|NP_173485.1|CYCB; 3; cyclin-dependent protein kinase regulator [*Arabidopsis thaliana*] | PP | SS |
| 1353 | 77559 | 1.00E−174 | 78 | ref|NP_196341.1|calmodulin binding [*Arabidopsis thaliana*] | CS | |
| 1354 | 77957 | 1.00E−168 | 97 | ref|NP_196955.1|unknown protein [*Arabidopsis thaliana*] | CK | |
| 1355 | 77565 | 1.00E−138 | 100 | gb|AAO00857.1|putative protein [*Arabidopsis thaliana*] | DS | LN |
| 1356 | 78508 | 0 | 97 | ref|NP_175058.1|ATP binding/ATPase/nucleoside-triphosphatase/nucleotide binding [*Arabidopsis thaliana*] | LL | LN |
| 1357 | 11748 | 1.00E−105 | 88 | ref|NP_200037.1|MSBP1 [*Arabidopsis thaliana*] | LN | |
| 1358 | 77920 | 0 | 89 | ref|NP_177325.2|RNA binding/nucleic acid binding [*Arabidopsis thaliana*] | CS | DS |

TABLE 3-continued

| PEP Seq ID No. | Construct ID | E-value | % id | Annotation Description | Trait | |
|---|---|---|---|---|---|---|
| 1359 | 77573 | 0 | 81 | ref|NP_177411.1|calmodulin binding [*Arabidopsis thaliana*] | LN | |
| 1360 | 77961 | 0 | 94 | gb|AAD25685.1|putative membrane transporter [*Arabidopsis thaliana*] | CS | |
| 1361 | 77922 | 0 | 100 | ref|NP_181978.1|unknown protein [*Arabidopsis thaliana*] | LL | |
| 1362 | 77337 | 1.00E−121 | 93 | ref|NP_186871.1|unknown protein [*Arabidopsis thaliana*] | PEG | |
| 1363 | 77924 | 4.00E−44 | 100 | ref|NP_566521.1|unknown protein [*Arabidopsis thaliana*] | CK | |
| 1364 | 77926 | 1.00E−136 | 100 | ref|NP_193032.1|catalytic [*Arabidopsis thaliana*] | SS | |
| 1365 | 77964 | 5.00E−91 | 88 | ref|NP_194100.1|unknown protein [*Arabidopsis thaliana*] | CS | |
| 1366 | 77346 | 4.00E−62 | 100 | emb|CAA20568.1|putative protein [*Arabidopsis thaliana*] | CS | |
| 1367 | 77350 | 1.00E−51 | 88 | ref|NP_564175.2|unknown protein [*Arabidopsis thaliana*] | CS | |
| 1368 | 77929 | 0 | 84 | ref|NP_174029.1|unknown protein [*Arabidopsis thaliana*] | CS | |
| 1369 | 77586 | 1.00E−175 | 100 | ref|NP_200984.1|ATIPK2BETA; inositol or phosphatidylinositol kinase [*Arabidopsis thaliana*] | PEG | |
| 1370 | 78510 | 0 | 93 | ref|NP_201011.1|OXA1; protein translocase [*Arabidopsis thaliana*] | LN | |
| 1371 | 77930 | 1.00E−170 | 92 | ref|NP_201115.1|S-adenosylmethionine-dependent methyltransferase [*Arabidopsis thaliana*] | CS | |
| 1372 | 77590 | 1.00E−113 | 84 | ref|NP_172126.1|unknown protein [*Arabidopsis thaliana*] | SS | |
| 1373 | 77592 | 0 | 97 | ref|NP_172535.1|unknown protein [*Arabidopsis thaliana*] | PEG | |
| 1374 | 77361 | 5.00E−99 | 84 | ref|NP_193650.2|protein binding [*Arabidopsis thaliana*] | CK | SS |
| 1375 | 77934 | 0 | 91 | ref|NP_195066.1|unknown protein [*Arabidopsis thaliana*] | PEG | |
| 1376 | 77367 | 2.00E−74 | 66 | ref|NP_196973.1|unknown protein [*Arabidopsis thaliana*] | CS | |
| 1377 | 78121 | 0 | 100 | emb|CAC01785.1|Carboxylesterase-like protein [*Arabidopsis thaliana*] | LL | |
| 1378 | 77370 | 7.00E−70 | 100 | ref|NP_197550.1|arsenate reductase (glutaredoxin)/electron transporter/thiol-disulfide exchange intermediate [*Arabidopsis thaliana*] | CS | |
| 1379 | 78117 | 0 | 96 | ref|NP_851079.1|unknown protein [*Arabidopsis thaliana*] | CS | |
| 1380 | 77950 | 1.00E−177 | 100 | ref|NP_180191.1|urate oxidase [*Arabidopsis thaliana*] | PP | |
| 1381 | 78905 | 1.00E−155 | 75 | ref|NP_565809.1|unknown protein [*Arabidopsis thaliana*] | CK | |
| 1382 | 75913 | 2.00E−73 | 80 | ref|NP_001052968.1|Os04g0456700 [*Oryza sativa* (japonica cultivar-group)] | LL | |
| 1383 | 75925 | 0 | 80 | gb|EAY77273.1|hypothetical protein OsI_005120 [*Oryza sativa* (indica cultivar-group)] | SP | |
| 1384 | 75974 | 0 | 100 | ref|NP_488061.1|fructose-1,6-bisphosphatase [*Nostoc* sp. PCC 7120] | PP | |
| 1385 | 75903 | 0 | 95 | ref|NP_385577.1|PUTATIVE NITRITE REDUCTASE PROTEIN [*Sinorhizobium meliloti* 1021] | SS | |
| 1386 | 75904 | 0 | 97 | ref|NP_244182.1|succinate-semialdehyde dehydrogenase [*Bacillus halodurans* C-125] dbj|BAB07035.1| | CS | LN |
| 1387 | 75916 | 0 | 100 | ref|NP_792120.1|nitrate reductase [*Pseudomonas syringae* pv. tomato str. DC3000] | SP | SS |
| 1388 | 75917 | 0 | 98 | ref|NP_487197.1|phytochrome A, two-component sensor protein [*Nostoc* sp. PCC 7120] | SS | |
| 1389 | 75942 | 0 | 100 | ref|NP_485391.1|ferredoxin-sulfite reductase [*Nostoc* sp. PCC 7120] | CS | |
| 1390 | 75954 | 0 | 100 | ref|NP_662565.1|pyruvate phosphate dikinase [*Chlorobium tepidum* TLS] gb|AAM72907.1| | CS | |
| 1391 | 75943 | 0 | 99 | ref|NP_442685.1|glutamate dehydrogenase (NADP+) [*Synechocystis* sp. PCC 6803] | CS | PEG |
| 1392 | 75967 | 0 | 96 | ref|ZP_00768095.1|Aldehyde dehydrogenase [*Chloroflexus aurantiacus* J-10-fl] | CK | LN |
| 1393 | 75932 |  | 96 | ref|ZP_00767023.1|Phosphoglycerate kinase [*Chloroflexus aurantiacus* J-10-fl] | CS | HS |
| 1394 | 75956 | 0 | 99 | ref|NP_440375.1|glutamate-ammonia ligase [*Synechocystis* sp. PCC 6803] | HS | |
| 1395 | 78135 | 1.00E−170 | 85 | ref|NP_172800.2|sulfotransferase [*Arabidopsis thaliana*] | LL | |
| 1396 | 78612 | 0 | 75 | ref|NP_188602.1|unknown protein [*Arabidopsis thaliana*] | DS | |
| 1397 | 77969 | 0 | 90 | ref|NP_188797.1|unknown protein [*Arabidopsis thaliana*] | PP | |
| 1398 | 78136 | 0 | 93 | ref|NP_171739.1|unknown protein [*Arabidopsis thaliana*] | CS | |
| 1399 | 77627 | 6.00E−69 | 100 | ref|NP_190190.1|structural constituent of ribosome [*Arabidopsis thaliana*] | SS | |
| 1400 | 78142 | 4.00E−43 | 58 | ref|NP_192985.1|PEARLI 1 1; lipid binding [*Arabidopsis thaliana*] | LN | |
| 1401 | 77973 | 1.00E−103 | 92 | emb|CAB36513.1|putative protein [*Arabidopsis thaliana*] | LL | |
| 1402 | 78141 | 0 | 100 | ref|NP_564112.1|pseudouridylate synthase/tRNA-pseudouridine synthase [*Arabidopsis thaliana*] | PEG | |
| 1403 | 78963 | 1.00E−102 | 100 | ref|NP_195300.1|unknown protein [*Arabidopsis thaliana*] | LN | |
| 1404 | 78153 | 0 | 92 | emb|CAB93721.1|hypothetical protein [*Arabidopsis thaliana*] | CS | |
| 1405 | 78156 | 1.00E−160 | 83 | ref|NP_564205.1|unknown protein [*Arabidopsis thaliana*] | LL | |
| 1406 | 11807 | 0 | 83 | ref|NP_181291.1|ASP1 (PDE1 SUPPRESSOR 1); DNA binding [*Arabidopsis thaliana*] | LN | |
| 1407 | 78528 | 0 | 90 | ref|NP_177234.1|unknown protein [*Arabidopsis thaliana*] | LN | |
| 1408 | 78530 | 0 | 100 | ref|NP_177212.2|unknown protein [*Arabidopsis thaliana*] | CK | |
| 1409 | 78618 | 0 | 91 | ref|NP_565086.1|unknown protein [*Arabidopsis thaliana*] | LL | |
| 1410 | 78919 | 0 | 95 | gb|AAG52386.1|AC011765_38unknown protein; 120049-117988 [*Arabidopsis thaliana*] | PP | |

TABLE 3-continued

| PEP Seq ID No. | Construct ID | E-value | % id | Annotation Description | Trait | |
|---|---|---|---|---|---|---|
| 1411 | 77974 | 1.00E−174 | 86 | gb|AAF68123.1|AC010793_18F20B17.8 [*Arabidopsis thaliana*] | CK | |
| 1412 | 77630 | 7.00E−69 | 100 | ref|NP_172256.1|RPS15A (RIBOSOMAL PROTEIN S15A); structural constituent of ribosome [*Arabidopsis thaliana*] | PP | |
| 1413 | 78921 | 0 | 95 | ref|NP_565307.1|inositol or phosphatidylinositol kinase/phosphotransferase, alcohol group as acceptor [*Arabidopsis thaliana*] | LN | |
| 1414 | 78620 | 0 | 100 | gb|AAD03575.1|unknown protein [*Arabidopsis thaliana*] | DS | |
| 1415 | 77975 | 4.00E−40 | 100 | ref|NP_179905.1|zinc ion binding [*Arabidopsis thaliana*] | CS | |
| 1416 | 78536 | 0 | 95 | ref|NP_180034.1|sarcosine oxidase [*Arabidopsis thaliana*] | CS | |
| 1417 | 78537 | 1.00E−179 | 79 | ref|NP_180187.1|calmodulin binding [*Arabidopsis thaliana*] | PEG | |
| 1418 | 78540 | 0 | 100 | ref|NP_565908.1|amino acid binding [*Arabidopsis thaliana*] | SS | LL |
| 1419 | 77993 | 3.00E−86 | 100 | gb|AAF02163.1|AC009853_23unknown protein [*Arabidopsis thaliana*] | PEG | |
| 1420 | 78924 | 0 | 95 | ref|NP_188597.1|catalytic/iron ion binding [*Arabidopsis thaliana*] | LL | |
| 1421 | 78009 | 5.00E−63 | 79 | ref|NP_188798.2|unknown protein [*Arabidopsis thaliana*] | LL | |
| 1422 | 78014 | 1.00E−136 | 88 | ref|NP_189478.2|unknown protein [*Arabidopsis thaliana*] | CS | |
| 1423 | 78015 | 1.00E−165 | 96 | ref|NP_190352.1|DNA binding [*Arabidopsis thaliana*] | CS | |
| 1424 | 78018 | 1.00E−132 | 100 | ref|NP_563661.1|unknown protein [*Arabidopsis thaliana*] | PEG | |
| 1425 | 78021 | 1.00E−108 | 93 | ref|NP_173266.1|hydrolase [*Arabidopsis thaliana*] | CK | |
| 1426 | 78158 | 5.00E−90 | 87 | emb|CAA16775.1|hypothetical protein [*Arabidopsis thaliana*] | CK | |
| 1427 | 78026 | 1.00E−154 | 93 | ref|NP_564109.1|oxidoreductase, acting on paired donors, with incorporation or reduction of molecular oxygen, 2-oxoglutarate as one donor, and incorporation of one atom each of oxygen into both donors [*Arabidopsis thaliana*] | LL | |
| 1428 | 78028 | 1.00E−102 | 80 | ref|NP_564130.1|unknown protein [*Arabidopsis thaliana*] gb|ABD19644.1| | CS | |
| 1429 | 78032 | 5.00E−78 | 91 | gb|ABK28138.1|unknown [*Arabidopsis thaliana*] | PEG | |
| 1430 | 78388 | 2.00E−68 | 100 | ref|NP_171877.1|unknown protein [*Arabidopsis thaliana*] | LL | |
| 1431 | 78044 | 1.00E−156 | 94 | gb|AAF99798.1|AC012463_15T2E6.19 [*Arabidopsis thaliana*] | LL | |
| 1432 | 78047 | 5.00E−78 | 88 | ref|NP_175487.1|unknown protein [*Arabidopsis thaliana*] | CS | |
| 1433 | 78055 | 1.00E−167 | 95 | ref|NP_176410.1|unknown protein [*Arabidopsis thaliana*] | SS | |
| 1434 | 78057 | 1.00E−168 | 100 | ref|NP_176835.1|ubiquitin-protein ligase/zinc ion binding [*Arabidopsis thaliana*] | CK | |
| 1435 | 78059 | 1.00E−167 | 90 | ref|NP_172124.2|iron ion binding/oxidoreductase/stearoyl-CoA 9-desaturase [*Arabidopsis thaliana*] | CS | |
| 1436 | 78553 | 3.00E−77 | 92 | ref|NP_176998.1|unknown protein [*Arabidopsis thaliana*] | SS | |
| 1437 | 78163 | 1.00E−108 | 80 | gb|AAG52601.1|AC016447_10hypothetical protein; 95246-97368 [*Arabidopsis thaliana*] | LN | |
| 1438 | 78060 | 1.00E−118 | 100 | gb|AAD55282.1|AC008263_13ESTs gb|T04387, gb|R84022 and gb|T42239 come from this gene. [*Arabidopsis thaliana*] | DS | PEG |
| 1439 | 78062 | 1.00E−173 | 100 | ref|NP_177653.1|transporter [*Arabidopsis thaliana*] | CS | PP |
| 1440 | 78065 | 1.00E−113 | 100 | gb|AAG52095.1|AC012680_6unknown protein; 48924-49705 [*Arabidopsis thaliana*] | CS | LL |
| 1441 | 78590 | 4.00E−63 | 100 | ref|NP_565623.1|plastoquinol-plastocyanin reductase [*Arabidopsis thaliana*] | LL | |
| 1442 | 78177 | 2.00E−70 | 72 | ref|NP_180909.2|unknown protein [*Arabidopsis thaliana*] | DS | |
| 1443 | 78952 | 1.00E−107 | 95 | ref|NP_565887.1|unknown protein [*Arabidopsis thaliana*] | LL | |
| 1444 | 78559 | 1.00E−155 | 89 | ref|NP_973636.1|unknown protein [*Arabidopsis thaliana*] | LN | |
| 1445 | 78169 | 1.00E−151 | 100 | gb|AAF01548.1|AC009325_18unknown protein [*Arabidopsis thaliana*] | PP | |
| 1446 | 78178 | 1.00E−157 | 100 | ref|NP_187462.1|unknown protein [*Arabidopsis thaliana*] | CS | |
| 1447 | 78932 | 0 | 75 | emb|CAB80914.1|hypothetical protein [*Arabidopsis thaliana*] | CK | |
| 1448 | 78185 | 2.00E−87 | 100 | ref|NP_196768.1|unknown protein [*Arabidopsis thaliana*] | PEG | |
| 1449 | 78186 | 1.00E−99 | 92 | ref|NP_199091.2|unknown protein [*Arabidopsis thaliana*] | CS | |
| 1450 | 78572 | 0 | 96 | ref|NP_171850.1|unknown protein [*Arabidopsis thaliana*] | LL | |
| 1451 | 78631 | 1.00E−98 | 91 | gb|AAD10675.1|Similar to human BC-2 protein, [*Arabidopsis thaliana*] | LL | |
| 1452 | 12425 | 0 | 93 | gb|AAD39650.1|AC007591_15Similar to gb|Z70524 PDR5-like ABC transporter from Spirodela polyrrhiza and is a member of the PF|00005 ABC transporter family. ESTs gb|N97039 and gb|T43169 come from this gene. [*Arabidopsis thaliana*] | LN | |
| 1453 | 78938 | 0 | 95 | ref|NP_175579.1|4CL1 (4-COUMARATE: COA LIGASE 1); 4-coumarate-CoA ligase [*Arabidopsis thaliana*] | PP | |
| 1454 | 78961 | 1.00E−127 | 84 | ref|NP_564988.1|unknown protein [*Arabidopsis thaliana*] | LN | |
| 1455 | 78584 | 1.00E−117 | 75 | ref|NP_178114.1|unknown protein [*Arabidopsis thaliana*] | PP | |
| 1456 | 78589 | 1.00E−106 | 90 | ref|NP_180437.2|unknown protein [*Arabidopsis thaliana*] | CS | |
| 1457 | 78252 | 0 | 61 | ref|NP_001043638.1|Os01g0628900 [*Oryza sativa* (japonica cultivar-group)] | LN | |
| 1458 | 76314 | 1.00E−134 | 76 | gb|AAR01658.1|putative inositol polyphosphate 5-phosphatase [*Oryza sativa* (japonica cultivar-group)] | CK | |
| 1459 | 76326 | 0 | 78 | ref|NP_001048842.1|Os03g0128700 [*Oryza sativa* (japonica cultivar-group)] | CK | |
| 1460 | 76362 | 1.00E−47 | 80 | gb|AAR87161.1|hypotheticat protein [*Oryza sativa* (japonica cultivar-group)] | PEG | |
| 1461 | 76340 | 7.00E−64 | 92 | ref|NP_010440.1|RNA polymerase I subunit A14 [*Saccharomyces cerevisiae*] | LN | |

TABLE 3-continued

| PEP Seq ID No. | Construct ID | Annotation | | | Trait | |
|---|---|---|---|---|---|---|
| | | E-value | % id | Description | | |
| 1462 | 76377 | 0 | 98 | ref|NP_199440.1|ATP binding/DNA binding/DNA-dependent ATPase/nucleoside-triphosphatase/nucleotide binding [*Arabidopsis thaliana*] | CK | |
| 1463 | 76319 | 0 | 93 | ref|NP_850426.1|kinase [*Arabidopsis thaliana*] | LL | LN |
| 1464 | 76343 | 0 | 90 | ref|NP_173578.2|ATP binding/kinase/protein kinase/protein serine/threonine kinase/protein-tyrosine kinase [*Arabidopsis thaliana*] | LN | |
| 1465 | 76320 | 1.00E−109 | 84 | ref|NP_001063406.1|Os09g0463600 [*Oryza sativa* (japonica cultivar-group)] | LL | |
| 1466 | 76380 | 0 | 76 | ref|NP_001044432.1|Os01g0779300 [*Oryza sativa* (japonica cultivar-group)] | LN | |
| 1467 | 77831 | 0 | 80 | gb|ABA91110.1|leucine-rich repeat family protein, putative, expressed [*Oryza sativa* (japonica cultivar-group)] | SS | |
| 1468 | 76334 | 8.00E−21 | 56 | ref|NP_190188.1|RNA binding/nucleic acid binding [*Arabidopsis thaliana*] | LN | |
| 1469 | 76382 | 0 | 78 | emb|CAH66974.1|H0714H04.1 [*Oryza sativa* (indica cultivar-group)] | LN | |
| 1470 | 76838 | 3.00E−98 | 81 | gb|EAY84304.1|hypothetical protein OsI_005537 [*Oryza sativa* (indica cultivar-group)] | LL | LN |
| 1471 | 77841 | 1.00E−102 | 85 | ref|NP_001067006.1|Os12g0557400 [*Oryza sativa* (japonica cultivar-group)] | LL | |
| 1472 | 77838 | 1.00E−134 | 86 | ref|NP_001043004.1|Os01g0356500 [*Oryza sativa* (japonica cultivar-group)] | SS | |
| 1473 | 76865 | 2.00E−79 | 91 | ref|NP_001060126.1|Os07g0585800 [*Oryza sativa* (japonica cultivar-group)] | SP | |
| 1474 | 77834 | 1.00E−166 | 89 | ref|NP_001043134.1|Os01g0501800 [*Oryza sativa* (japonica cultivar-group)] | PEG | |
| 1475 | 76823 | 4.00E−46 | 100 | gb|EAY97498.1|hypothetical protein OsI_018731 [*Oryza sativa* (indica cultivar-group)] | CS | |
| 1476 | 76836 | 1.00E−46 | 65 | ref|NP_001049532.1|Os03g0244000 [*Oryza sativa* (japonica cultivar-group)] | PP | |
| 1477 | 14133 | 0 | 89 | pir||G71435hypothetical protein - *Arabidopsis thaliana* | LN | |
| 1478 | 76927 | 5.00E−58 | 74 | gb|EAY75504.1|hypothetical protein OsI_003351 [*Oryza sativa* (indica cultivar-group)] | LL | |
| 1479 | 76963 | 1.00E−107 | 90 | gb|EAY84610.1|hypothetical protein OsI_005843 [*Oryza sativa* (indica cultivar-group)] | LN | |
| 1480 | 76975 | 3.00E−32 | 62 | ref|NP_001055878.1|Os05g0486200 [*Oryza sativa* (japonica cultivar-group)] | SS | |
| 1481 | 76988 | 4.00E−44 | 81 | ref|NP_001053850.1|Os04g0612900 [*Oryza sativa* (japonica cultivar-group)] dbj|BAF15764.1| | DS | |
| 1482 | 76953 | 7.00E−43 | 75 | sp|Q07764|HVA22_HORVUProtein HVA22 gb|AAA16094.1| A22 | CS | |
| 1483 | 76965 | 3.00E−89 | 75 | gb|EAZ28929.1|hypothetical protein OsJ_012412 [*Oryza sativa* (japonica cultivar-group)] | SP | |
| 1484 | 77161 | 1.00E−123 | 77 | emb|CAH66750.1|H0409D10.8 [*Oryza sativa* (indica cultivar-group)] | CS | |
| 1485 | 77852 | 0 | 87 | ref|NP_001064303.1|Os10g0203000 [*Oryza sativa* (japonica cultivar-group)] | CK | |
| 1486 | 77151 | 0 | 91 | ref|NP_001050897.1|Os03g0679700 [*Oryza sativa* (japonica cultivar-group)] | SS | |
| 1487 | 77116 | 1.00E−133 | 84 | gb|EAY87341.1|hypothetical protein OsI_008574 [*Oryza sativa* (indica cultivar-group)] | SP | |
| 1488 | 77105 | 0 | 81 | gb|EAZ26357.1|hypothetical protein OsJ_009840 [*Oryza sativa* (japonica cultivar-group)] | CK | PP |
| 1489 | 77129 | 0 | 73 | dbj|BAD19329.1|putative eukaryotic translation initiation factor 2A [*Oryza sativa* (japonica cultivar-group)] | CS | |
| 1490 | 77154 | 0 | 98 | ref|NP_001056944.1|Os06g0173100 [*Oryza sativa* (japonica cultivar-group)] | PEG | |
| 1491 | 77190 | 0 | 100 | ref|NP_417002.1|bifunctional GMP synthase/glutamine amidotransferase protein [*Escherichia coli* K12] | LL | |
| 1492 | 77107 | 0 | 100 | ref|NP_486886.1|bifunctional GMP synthase/glutamine amidotransferase protein [*Nostoc* sp. PCC 7120] | SP | CS |
| 1493 | 77167 | 1.00E−141 | 92 | gb|AAZ20768.1|branchy [*Setaria italica*] | PP | |
| 1494 | 77144 | 0 | 100 | ref|NP_416789.1|NADH: ubiquinone oxidoreductase. chain C, D [*Escherichia coli* K12] | CK | |
| 1495 | 77156 | 1.00E−132 | 100 | ref|NP_443063.1|bifunctional phosphoribosyl-AMP cyclohydrolase/phosphoribosyl-ATP pyrophosphatase protein [*Synechocystis* sp. PCC 6803] | CS | |
| 1496 | 77168 | 0 | 83 | ref|NP_001047841.1|Os02g0700600 [*Oryza sativa* (japonica cultivar-group)] | SP | |
| 1497 | 77192 | 7.00E−77 | 84 | dbj|BAD27669.1|putative actin related protein 2/3 complex, 21 kDa subunit [*Oryza sativa* (japonica cultivar-group)] | PEG | |
| 1498 | 77181 | 8.00E−29 | 84 | ref|NP_001049737.1|Os03g0280400 [*Oryza sativa* (japonica cultivar-group)] | LL | |
| 1499 | 77193 | 1.00E−111 | 87 | ref|NP_001049175.1|Os03g0182700 [*Oryza sativa* (japonica cultivar-group)] | PP | PEG |

TABLE 3-continued

| PEP Seq ID No. | Construct ID | Annotation | | | Trait | |
|---|---|---|---|---|---|---|
| | | E-value | % id | Description | | |
| 1500 | 77147 | 1.00E−124 | 64 | emb|CAE04316.1|OSJNBb0016D16.7 [*Oryza sativa* (japonica cultivar-group)] | DS | LL |
| 1501 | 77853 | 0 | 91 | ref|NP_418588.1|predicted carbohydrate kinase [*Escherichia coli* K12] | LN | |
| 1502 | 77854 | 4.00E−68 | 86 | ref|NP_001042156.1|Os01g0173000 [*Oryza sativa* (japonica cultivar-group)] | SS | |
| 1503 | 77287 | 1.00E−46 | 63 | ref|NP_001054446.1|Os05g0111200 [*Oryza sativa* (japonica cultivar-group)] | CS | LL |
| 1504 | 77276 | 2.00E−73 | 66 | ref|NP_001045229.1|Os01g0921600 [*Oryza sativa* (japonica cultivar-group)] | LN | |
| 1505 | 77229 | 1.00E−53 | 90 | gb|AAL67582.1|AC018929_4unknown protein [*Oryza sativa*] | CS | SS |
| 1506 | 77241 | 1.00E−159 | 73 | ref|NP_001045995.1|Os02g0165100 [*Oryza sativa* (japonica cultivar-group)] | SS | |
| 1507 | 77265 | 1.00E−115 | 60 | gb|EAZ04741.1|hypothetical protein OsI_025973 [*Oryza sativa* (indica cultivar-group)] | LN | |
| 1508 | 77233 | 1.00E−113 | 96 | ref|NP_001043339.1|Os01g0559000 [*Oryza sativa* (japonica cultivar-group)] | CS | |
| 1509 | 77293 | 1.00E−102 | 81 | ref|NP_001056330.1|Os05g0564100 [*Oryza sativa* (japonica cultivar-group)] | PEG | |
| 1510 | 77473 | 0 | 75 | ref|NP_001067661.1|Os11g0265600 [*Oryza sativa* (japonica cultivar-group)] | CK | |
| 1511 | 76402 | 0 | 95 | ref|NP_199899.1|ATP binding/protein kinase/protein serine/threonine kinase/protein-tyrosine kinase [*Arabidopsis thaliana*] | CK | PEG |
| 1512 | 77428 | 0 | 86 | dbj|BAC07390.1|putative NAD synthetase [*Oryza sativa* (japonica cultivar-group)] | SS | |
| 1513 | 77429 | 3.00E−93 | 73 | ref|NP_001044830.1|Os01g0853000 [*Oryza sativa* (japonica cultivar-group)] | CS | |
| 1514 | 78277 | 0 | 95 | ref|NP_192815.1|ATOPT7; oligopeptide transporter [*Arabidopsis thaliana*] | DS | |
| 1515 | 11935 | 0 | 97 | ref|NP_188434.2|nucleotide binding [*Arabidopsis thaliana*] | SP | |
| 1516 | 78259 | 0 | 93 | ref|NP_190717.1|carbohydrate transporter/nucleoside transporter/sugar porter [*Arabidopsis thaliana*] | LN | |
| 1517 | 12276 | 0 | 87 | ref|NP_199691.1|protein binding/signal transducer [*Arabidopsis thaliana*] | CS | |
| 1518 | 12365 | 3.00E−66 | 100 | ref|NP_181620.1|FL3-27; cysteine protease inhibitor [*Arabidopsis thaliana*] | CK | |

Trait Enhancement Screens

DS-Enhancement of drought tolerance identified by a soil drought stress tolerance screen: Drought or water deficit conditions impose mainly osmotic stress on plants. Plants are particularly vulnerable to drought during the flowering stage. The drought condition in the screening process disclosed in Example 1B started from the flowering time and was sustained to the end of harvesting. The present invention provides recombinant DNA that can improve the plant survival rate under such sustained drought condition. Exemplary recombinant DNA for conferring such drought tolerance are identified as such in Table 3. Such recombinant DNA may find particular use in generating transgenic plants that are tolerant to the drought condition imposed during flowering time and in other stages of the plant life cycle. As demonstrated from the model plant screen, in some embodiments of transgenic plants with trait-improving recombinant DNA grown under such sustained drought condition can also have increased total seed weight per plant in addition to the increased survival rate within a transgenic population, providing a higher yield potential as compared to control plants.

PEG-Enhancement of drought tolerance identified by PEG induced osmotic stress tolerance screen: Various drought levels can be artificially induced by using various concentrations of polyethylene glycol (PEG) to produce different osmotic potentials (Pilon-Smits e.g., (1995) Plant Physiol. 107:125-130). Several physiological characteristics have been reported as being reliable indications for selection of plants possessing drought tolerance. These characteristics include the rate of seed germination and seedling growth. The traits can be assayed relatively easily by measuring the growth rate of seedling in PEG solution. Thus, a PEG-induced osmotic stress tolerance screen is a useful surrogate for drought tolerance screen. As demonstrated from the model plant screen, embodiments of transgenic plants with trait-improving recombinant DNA identified in the PEG-induced osmotic stress tolerance screen can survive better drought conditions providing a higher yield potential as compared to control plants.

SS-Enhancement of drought tolerance identified by high salinity stress tolerance screen: Three different factors are responsible for salt damages: (1) osmotic effects, (2) disturbances in the mineralization process, and (3) toxic effects caused by the salt ions, e.g., inactivation of enzymes. While the first factor of salt stress results in the wilting of the plants that is similar to drought effect, the ionic aspect of salt stress is clearly distinct from drought. The present invention provides genes that help plants maintain biomass, root growth, and/or plant development in high salinity conditions, which are identified as such in Table 3. Since osmotic effect is one of the major components of salt stress, which is common to the drought stress, trait-improving recombinant DNA identified in a high salinity stress tolerance screen can also provide transgenic crops with enhanced drought tolerance. As demonstrated from the model plant screen, embodiments of transgenic plants with trait-improving recombinant DNA identified in a high salinity stress tolerance screen can survive better drought conditions and/or high salinity conditions providing a higher yield potential as compared to control plants.

HS-Enhancement of drought tolerance identified by heat stress tolerance screen: Heat and drought stress often occur simultaneously, limiting plant growth. Heat stress can cause the reduction in photosynthesis rate, inhibition of leaf growth and osmotic potential in plants. Thus, genes identified by the present invention as heat stress tolerance conferring genes may also impart enhanced drought tolerance to plants. As demonstrated from the model plant screen, embodiments of transgenic plants with trait-improving recombinant DNA identified in a heat stress tolerance screen can survive better heat stress conditions and/or drought conditions providing a higher yield potential as compared to control plants.

CK and CS-Enhancement of tolerance to cold stress: Low temperature may immediately result in mechanical constraints, changes in activities of macromolecules, and reduced osmotic potential. In the present invention, two screening conditions, i.e., cold shock tolerance screen (CK) and cold germination tolerance screen (CS), were set up to look for transgenic plants that display visual growth advantage at lower temperature. In cold germination tolerance screen, the transgenic *Arabidopsis* plants were exposed to a constant temperature of 8° C. from planting until day 28 post plating. The trait-improving recombinant DNA identified by such screen are particular useful for the production of transgenic plant that can germinate more robustly in a cold temperature as compared to the wild type plants. In cold shock tolerance screen, the transgenic plants were first grown under the normal growth temperature of 22° C. until day 8 post plating, and subsequently were placed under 8° C. until day 28 post plating. As demonstrated from the model plant screen, embodiments of transgenic plants with trait-improving recombinant DNA identified in a cold shock stress tolerance screen and/or a cold germination stress tolerance screen can survive better cold conditions providing a higher yield potential as compared to control plants.

Enhancement of tolerance to multiple stresses: Different kinds of stresses often lead to identical or similar reaction in the plants. Genes that are activated or inactivated as a reaction to stress can either act directly in a way the genetic product reduces a specific stress, or they can act indirectly by activating other specific stress genes. By manipulating the activity of such regulatory genes, i.e., multiple stress tolerance genes, the plant can be enabled to react to different kinds of stresses. For examples, PEP SEQ ID NO: 892 can be used to enhance both salt stress tolerance and cold stress tolerance in plants. Of particular interest, plants transformed with PEP SEQ ID NO: 835 can resist heat stress, salt stress and cold stress. Plants transformed with PEP SEQ ID NO: 835 can also improve growth in early stage and under osmotic stress. In addition to these multiple stress tolerance genes, the stress tolerance conferring genes provided by the present invention may be used in combinations to generate transgenic plants that can resist multiple stress conditions.

PP-Enhancement of early plant growth and development: It has been known in the art that to minimize the impact of disease on crop profitability, it is important to start the season with healthy and vigorous plants. This means avoiding seed and seedling diseases, leading to increased nutrient uptake and increased yield potential. Traditionally early planting and applying fertilizer are the methods used for promoting early seedling vigor. In early development stage, plant embryos establish only the basic root-shoot axis, a cotyledon storage organ(s), and stem cell populations, called the root and shoot apical meristems, that continuously generate new organs throughout post-embryonic development. "Early growth and development" used herein encompasses the stages of seed imbibition through the early vegetative phase. The present invention provides genes that are useful to produce transgenic plants that have advantages in one or more processes including, but not limited to, germination, seedling vigor, root growth and root morphology under non-stressed conditions. The transgenic plants starting from a more robust seedling are less susceptible to the fungal and bacterial pathogens that attach germinating seeds and seedling. Furthermore, seedlings with advantage in root growth are more resistant to drought stress due to extensive and deeper root architecture. Therefore, it can be recognized by those skilled in the art that genes conferring the growth advantage in early stages to plants may also be used to generate transgenic plants that are more resistant to various stress conditions due to enhanced early plant development. The present invention provides such exemplary, recombinant DNA that confer both the stress tolerance and growth advantages to plants, identified as such in Table 3, e.g., PEP SEQ ID NO: 799 which can improve the plant early growth and development, and impart heat and cold tolerance to plants. As demonstrated from the model plant screen, embodiments of transgenic plants with trait-improving recombinant DNA identified in the early plant development screen can grow better under non-stress conditions and/or stress conditions providing a higher yield potential as compared to control plants.

SP-Enhancement of late plant growth and development: "Late growth and development" used herein encompasses the stages of leaf development, flower production, and seed maturity. In certain embodiments, transgenic plants produced using genes that confer growth advantages to plants provided by the present invention, identified as such in Table 3, exhibit at least one phenotypic characteristics including, but not limited to, increased rosette radius, increased rosette dry weight, seed dry weight, silique dry weight, and silique length. On one hand, the rosette radius and rosette dry weight are used as the indexes of photosynthesis capacity, and thereby plant source strength and yield potential of a plant. On the other hand, the seed dry weight, silique dry weight and silique length are used as the indexes for plant sink strength, which are considered as the direct determinants of yield. As demonstrated from the model plant screen, embodiments of transgenic plants with trait-improving recombinant DNA identified in the late development screen can grow better and/or have enhanced development during leaf development and seed maturation providing a higher yield potential as compared to control plants.

LL-Enhancement of tolerance to shade stress identified in a low light screen: The effects of light on plant development are especially prominent at the seedling stage. Under normal light conditions with unobstructed direct light, a plant seedling develops according to a characteristic photomorphogenic pattern, in which plants have open and expanded cotyledons and short hypocotyls. Then the plant's energy is devoted to cotyledon and leaf development while longitudinal extension growth is minimized. Under low light condition where light quality and intensity are reduced by shading, obstruction or high population density, a seedling displays a shade-avoidance pattern, in which the seedling displays a reduced cotyledon expansion, and hypocotyls extension is greatly increased. As the result, a plant under low light condition increases significantly its stem length at the expanse of leaf, seed or fruit and storage organ development, thereby adversely affecting of yield. The present invention provides recombinant DNA that enable plants to have an attenuated shade avoidance response so that the source of plant can be contributed to reproductive growth efficiently, resulting higher yield as compared to the wild type plants. As demonstrated from the model plant screen, embodiments of transgenic plants with trait-improving recombinant DNA identified in a shade stress tolerance screen can have attenuated shade response under shade conditions providing a higher yield potential as compared to control plants. The transgenic plants generated by the present invention may be suitable for a higher density planting, thereby resulting increased yield per unit area.

LN-Enhancement of Tolerance to Low Nitrogen Availability Stress

Nitrogen is a key factor in plant growth and crop yield. The metabolism, growth and development of plants are profoundly affected by their nitrogen supply. Restricted nitrogen supply alters shoot to root ratio, root development, activity of enzymes of primary metabolism and the rate of senescence (death) of older leaves. All field crops have a fundamental dependence on inorganic nitrogenous fertilizer. Since fertilizer is rapidly depleted from most soil types, it must be supplied to growing crops two or three times during the growing season. Enhanced nitrogen use efficiency by plants should enable crops cultivated under low nitrogen availability stress condition resulted from low fertilizer input or poor soil quality.

According to the present invention, transgenic plants generated using the recombinant nucleotides, which confer enhanced nitrogen use efficiency, identified as such in Table 3, exhibit one or more desirable traits including, but not limited to, increased seedling weight, greener leaves, increased number of rosette leaves, increased or decreased root length. One skilled in the art may recognize that the transgenic plants provided by the present invention with enhanced nitrogen use efficiency may also have altered amino acid or protein compositions, increased yield and/or better seed quality. The transgenic plants of the present invention may be productively cultivated under low nitrogen growth conditions, i.e., nitrogen-poor soils and low nitrogen fertilizer inputs, which would cause the growth of wild type plants to cease or to be so diminished as to make the wild type plants practically useless. The transgenic plants also may be advantageously used to achieve earlier maturing, faster growing, and/or higher yielding crops and/or produce more nutritious foods and animal feedstocks when cultivated using nitrogen non-limiting growth conditions.

Stacked Traits: The present invention also encompasses transgenic plants with stacked engineered traits, e.g., a crop having an enhanced phenotype resulting from expression of a trait-improving recombinant DNA, in combination with herbicide and/or pest resistance traits. For example, genes of the current invention can be stacked with other traits of agronomic interest, such as a trait providing herbicide resistance, for example a RoundUp Ready® trait, or insect resistance, such as using a gene from *Bacillus thuringensis* to provide resistance against lepidopteran, coliopteran, homopteran, hemiopteran, and other insects. Herbicides for which resistance is useful in a plant include glyphosate herbicides, phosphinothricin herbicides, oxynil herbicides, imidazolinone herbicides, dinitroaniline herbicides, pyridine herbicides, sulfonylurea herbicides, bialaphos herbicides, sulfonamide herbicides and gluphosinate herbicides. To illustrate that the production of transgenic plants with herbicide resistance is a capability of those of ordinary skill in the art, reference is made to U.S. patent application publications 2003/0106096A1 and 2002/0112260A1 and U.S. Pat. Nos. 5,034,322; 5,776,760, 6,107,549 and 6,376,754, all of which are incorporated herein by reference. To illustrate that the production of transgenic plants with pest resistance is a capability of those of ordinary skill in the art reference is made to U.S. Pat. Nos. 5,250,515 and 5,880,275 which disclose plants expressing an endotoxin of *Bacillus thuringiensis* bacteria, to U.S. Pat. No. 6,506,599 which discloses control of invertebrates which feed on transgenic plants which express dsRNA for suppressing a target gene in the invertebrate, to U.S. Pat. No. 5,986,175 which discloses the control of viral pests by transgenic plants which express viral replicase, and to U.S. Patent Application Publication 2003/0150017 A1 which discloses control of pests by a transgenic plant which express a dsRNA targeted to suppressing a gene in the pest, all of which are incorporated herein by reference.

Once one recombinant DNA has been identified as conferring an enhanced trait of interest in transgenic *Arabidopsis* plants, several methods are available for using the sequence of that recombinant DNA and knowledge about the protein it encodes to identify homologs of that sequence from the same plant or different plant species or other organisms, e.g., bacteria and yeast. Thus, in one aspect, the invention provides methods for identifying a homologous gene with a DNA sequence homologous to any of SEQ ID NO: 1 through SEQ ID NO: 759, or a homologous protein with an amino acid sequence homologous to any of SEQ ID NO: 760 through SEQ ID NO: 1518. In another aspect, the present invention provides the protein sequences of identified homologs for a sequence listed, as SEQ ID NO: 1519 through SEQ ID NO: 67778. In yet another aspect, the present invention also includes linking or associating one or more desired traits, or gene function with a homolog sequence provided herein.

The trait-improving recombinant DNA and methods of using such trait-improving recombinant DNA for generating transgenic plants with enhanced traits provided by the present invention are not limited to any particular plant species. Indeed, the plants according to the present invention may be of any plant species, i.e., may be monocotyledonous or dicotyledonous. Preferably, they will be agricultural useful plants, i.e., plants cultivated by man for purposes of food production or technical, particularly industrial applications. Of particular interest in the present invention are corn and soybean plants. The recombinant DNA constructs optimized for soybean transformation and recombinant DNA constructs optimized for corn transformation are provided by the present invention. Other plants of interest in the present invention for production of transgenic plants having enhanced traits include, without limitation, cotton, canola, wheat, sunflower, sorghum, alfalfa, barley, millet, rice, tobacco, fruit and vegetable crops, and turfgrass.

In certain embodiments, the present invention contemplates to use an orthologous gene in generating the transgenic plants with similarly enhanced traits as the transgenic *Arabidopsis* counterpart. Enhanced physiological properties in transgenic plants of the present invention may be confirmed in responses to stress conditions, for example in assays using imposed stress conditions to detect enhanced responses to drought stress, nitrogen deficiency, cold growing conditions, or alternatively, under naturally present stress conditions, for example under field conditions. Biomass measures may be made on greenhouse or field grown plants and may include such measurements as plant height, stem diameter, root and shoot dry weights, and, for corn plants, ear length and diameter.

Trait data on morphological changes may be collected by visual observation during the process of plant regeneration as well as in regenerated plants transferred to soil. Such trait data includes characteristics such as normal plants, bushy plants, taller plants, thicker stalks, narrow leaves, striped leaves, knotted phenotype, chlorosis, albino, anthocyanin production, or altered tassels, ears or roots. Other enhanced traits may be identified by measurements taken under field conditions, such as days to pollen shed, days to silking, leaf extension rate, chlorophyll content, leaf temperature, stand, seedling vigor, internode length, plant height, leaf number, leaf area, tillering, brace roots, stay green, stalk lodging, root lodging, plant health, barreness/prolificacy, green snap, and pest resistance. In addition, trait characteristics of harvested grain may be confirmed, including number of kernels per row on the ear, number of rows of kernels on the ear, kernel abortion, kernel weight, kernel size, kernel density and physical grain quality.

To confirm hybrid yield in transgenic corn plants expressing genes of the present invention, it may be desirable to test hybrids over multiple years at multiple locations in a geographical location where maize is conventionally grown, e.g., in Iowa, Illinois or other locations in the midwestern United States, under "normal" field conditions as well as under stress conditions, e.g., under drought or population density stress.

Transgenic plants can be used to provide plant parts according to the invention for regeneration or tissue culture of cells or tissues containing the constructs described herein. Plant parts for these purposes can include leaves, stems, roots, flowers, tissues, epicotyl, meristems, hypocotyls, cotyledons, pollen, ovaries, cells and protoplasts, or any other portion of the plant which can be used to regenerate additional transgenic plants, cells, protoplasts or tissue culture. Seeds of transgenic plants are provided by this invention can be used to propagate more plants containing the trait-improving recombinant DNA constructs of this invention. These descendants are intended to be included in the scope of this invention if they contain a trait-improving recombinant DNA construct of this invention, whether or not these plants are selfed or crossed with different varieties of plants.

The various aspects of the invention are illustrated by means of the following examples which are in no way intended to limit the full breath and scope of claims.

EXAMPLES

Example 1

Identification of Recombinant DNA that Confers Enhanced Trait(s) to Plants

A. Plant Expression Constructs for *Arabidopsis* Transformation

Each gene of interest was amplified from a genomic or cDNA library using primers specific to sequences upstream and downstream of the coding region. Transformation vectors were prepared to constitutively transcribe DNA in either sense orientation (for enhanced protein expression) or antisense orientation (for endogenous gene suppression) under the control of an enhanced Cauliflower Mosaic Virus 35S promoter (U.S. Pat. No. 5,359,142) directly or indirectly (Moore, e.g., PNAS 95:376-381, 1998; Guyer, e.g., Genetics 149: 633-639, 1998; International patent application NO. PCT/EP98/07577). The transformation vectors also contain a bar gene as a selectable marker for resistance to glufosinate herbicide. The transformation of *Arabidopsis* plants was carried out using the vacuum infiltration method known in the art (Bethtold, e.g., Methods Mol. Biol. 82:259-66, 1998). Seeds harvested from the plants, named as T1 seeds, were subsequently grown in a glufosinate-containing selective medium to select for plants which were actually transformed and which produced T2 transgenic seed.

B. Soil Drought Tolerance Screen

This example describes a soil drought tolerance screen to identify *Arabidopsis* plants transformed with recombinant DNA that wilt less rapidly and/or produce higher seed yield when grown in soil under drought conditions T2 seeds were sown in flats filled with Metro/Mix' 200 (The Scotts° Company, USA). Humidity domes were added to each flat and flats were assigned locations and placed in climate-controlled growth chambers. Plants were grown under a temperature regime of 22° C. at day and 20° C. at night, with a photoperiod of 16 hours and average light intensity of 170 µmol/m$^2$/s. After the first true leaves appeared, humidity domes were removed. The plants were sprayed with glufosinate herbicide and put back in the growth chamber for 3 additional days. Flats were watered for I hour the week following the herbicide treatment. Watering was continued every seven days until the flower bud primordia became apparent, at which time plants were watered for the last time.

To identify drought tolerant plants, plants were evaluated for wilting response and seed yield. Beginning ten days after the last watering, plants were examined daily until 4 plants/line had wilted. In the next six days, plants were monitored for wilting response. Five drought scores were assigned according to the visual inspection of the phenotypes: 1 for healthy, 2 for dark green, 3 for wilting, 4 severe wilting, and 5 for dead. A score of 3 or higher was considered as wilted.

At the end of this assay, seed yield measured as seed weight per plant under the drought condition was characterized for the transgenic plants and their controls and analyzed as a quantitative response according to example 1M.

Two approaches were used for statistical analysis on the wilting response. First, the risk score was analyzed for wilting phenotype and treated as a qualitative response according to the example 1L. Alternatively, the survival analysis was carried out in which the proportions of wilted and non-wilted transgenic and control plants were compared over each of the six days under scoring and an overall log rank test was performed to compare the two survival curves using S-PLUS statistical software (S-PLUS 6, Guide to statistics, Insightful, Seattle, Wash., USA). A list of recombinant DNA constructs which improve drought tolerance in transgenic plants is illustrated in Table 4.

TABLE 4

| PEP SEQ ID NO | Construct ID | Nomination ID | Orientation | Drought score Delta mean | P-value | Seed yield Delta mean | P-value | Time to wilting Risk score mean | P-value |
|---|---|---|---|---|---|---|---|---|---|
| 968 | 10359 | CGPG430 | ANTI-SENSE | −0.103 | 0.104 | 0.134 | 0.469 | −0.147 | 1.000 |
| 863 | 10462 | CGPG240 | ANTI-SENSE | 0.133 | 0.006 | −0.101 | 0.331 | 0.306 | 1.000 |
| 1115 | 11149 | CGPG587 | SENSE | −0.021 | 0.741 | 0.277 | 0.158 | −0.105 | 0.852 |
| 769 | 12040 | CGPG1092 | SENSE | 0.025 | 0.240 | 0.227 | 0.258 | 0.058 | 1.000 |
| 771 | 12156 | CGPG1136 | ANTI-SENSE | −0.009 | 0.068 | 0.512 | 0.045 | 0.154 | 0.857 |
| 784 | 12733 | CGPG1291 | ANTI-SENSE | 0.165 | 0.034 | −0.368 | 0.009 | 0.209 | 1.000 |
| 760 | 12792 | CGPG1022 | ANTI-SENSE | 0.070 | 0.184 | 0.223 | 0.077 | 0.083 | 1.000 |
| 786 | 13504 | CGPG1311 | SENSE | −0.055 | 0.704 | 0.109 | 0.445 | −0.042 | 1.000 |
| 1150 | 13518 | CGPG620 | ANTI-SENSE | 0.176 | 0.023 | 0.026 | 0.891 | 0.160 | 1.000 |

TABLE 4-continued

| PEP SEQ ID NO | Construct ID | Nomination ID | Orientation | Drought score Delta mean | P-value | Seed yield Delta mean | P-value | Time to wilting Risk score mean | P-value |
|---|---|---|---|---|---|---|---|---|---|
| 807 | 14271 | CGPG1575 | ANTI-SENSE | 0.163 | 0.014 | −0.144 | 0.536 | −0.186 | 1.000 |
| 822 | 14827 | CGPG1895 | ANTI-SENSE | 0.171 | 0.047 | 0.001 | 0.995 | 0.092 | 1.000 |
| 845 | 16007 | CGPG2142 | ANTI-SENSE | −0.234 | 0.127 | 0.992 | 0.006 | −0.217 | 1.000 |
| 827 | 16182 | CGPG1922 | SENSE | 0.034 | 0.424 | 0.171 | 0.298 | 0.127 | 1.000 |
| 854 | 17003 | CGPG2304 | SENSE | 0.372 | 0.005 | 0.083 | 0.267 | 0.613 | 1.000 |
| 923 | 18408 | CGPG3612 | SENSE | −0.009 | 0.589 | 0.494 | 0.002 | 0.134 | 0.941 |
| 900 | 18644 | CGPG3236 | SENSE | 0.016 | 0.758 | 0.072 | 0.432 | 0.049 | 0.920 |
| 832 | 19133 | CGPG1973 | SENSE | 0.308 | 0.019 | 0.410 | 0.074 | 0.192 | 1.000 |
| 885 | 19166 | CGPG2914 | SENSE | 0.152 | 0.037 | 0.370 | 0.292 | 0.152 | 1.000 |
| 896 | 19256 | CGPG3137 | SENSE | −0.121 | 0.142 | 0.168 | 0.056 | −0.087 | 0.939 |
| 927 | 19328 | CGPG3665 | SENSE | 0.161 | 0.027 | −0.388 | 0.337 | −0.011 | 1.000 |
| 921 | 19623 | CGPG3579 | SENSE | 0.039 | 0.689 | 0.232 | 0.084 | 0.051 | 1.000 |
| 966 | 70632 | CGPG4297 | SENSE | 0.116 | 0.004 | −0.281 | 0.185 | 0.080 | 1.000 |
| 918 | 71115 | CGPG351 | SENSE | 0.240 | 0.005 | −0.793 | 0.088 | 0.257 | 0.936 |
| 1054 | 72067 | CGPG5262 | SENSE | 0.194 | 0.021 | −0.633 | 0.034 | 0.138 | 1.000 |
| 1011 | 72650 | CGPG4882 | SENSE | 0.187 | 0.032 | −1.980 | 0.088 | 0.481 | 1.000 |
| 1098 | 73088 | CGPG5729 | SENSE | −0.134 | 0.488 | 0.027 | 0.792 | 0.066 | 1.000 |
| 982 | 73214 | CGPG4432 | SENSE | 1.524 | 0.033 | — | — | 0.484 | 1.000 |
| 1032 | 73314 | CGPG5100 | SENSE | 0.117 | 0.018 | −1.005 | 0.082 | 0.056 | 1.000 |
| 1195 | 73567 | CGPG6509 | SENSE | 0.216 | 0.159 | 0.581 | 0.020 | 0.067 | 0.961 |
| 1027 | 73683 | CGPG5062 | SENSE | 0.275 | 0.012 | −0.547 | 0.085 | 0.109 | 0.946 |
| 819 | 73986 | CGPG1837 | SENSE | −0.280 | 0.122 | 0.214 | 0.010 | −0.152 | 1.000 |
| 1036 | 74218 | CGPG5159 | SENSE | 0.241 | 0.006 | −0.057 | 0.670 | 0.140 | 0.785 |
| 800 | 74775 | CGPG1492 | SENSE | 0.156 | 0.105 | 0.231 | 0.049 | 0.122 | 0.804 |
| 1306 | 75365 | CGPG7503 | SENSE | 0.830 | 0.001 | −3.139 | 0.047 | 1.008 | 1.000 |
| 1343 | 75716 | CGPG7881 | SENSE | −0.079 | 0.018 | 0.040 | 0.135 | 0.010 | 0.852 |
| 1243 | 75869 | CGPG6974 | SENSE | −0.016 | 0.708 | 0.133 | 0.162 | −0.136 | 0.893 |
| 798 | 76013 | CGPG1445 | SENSE | 0.414 | 0.021 | −0.269 | 0.297 | 0.386 | 1.000 |
| 806 | 76049 | CGPG1568 | SENSE | 0.196 | 0.025 | −0.991 | 0.033 | 0.221 | 1.000 |
| 1123 | 76214 | CGPG5930 | SENSE | −0.069 | 0.101 | 0.158 | 0.001 | −0.157 | 1.000 |
| 1155 | 76226 | CGPG6211 | SENSE | 0.261 | 0.019 | −1.212 | 0.007 | 0.298 | 1.000 |
| 1160 | 76436 | CGPG6233 | SENSE | 0.412 | 0.017 | −0.566 | 0.040 | 0.316 | 0.837 |
| 1173 | 76528 | CGPG6336 | SENSE | 0.732 | 0.009 | −0.069 | 0.624 | 0.898 | 0.833 |
| 1481 | 76988 | CGPG9106 | SENSE | 0.395 | 0.021 | −0.841 | 0.026 | 0.270 | 1.000 |
| 1500 | 77147 | CGPG9201 | SENSE | 0.493 | 0.005 | −1.475 | 0.015 | 0.997 | 0.909 |
| 1355 | 77565 | CGPG7996 | SENSE | 0.778 | 0.049 | −0.185 | 0.190 | 0.170 | 1.000 |
| 891 | 77909 | CGPG3056 | SENSE | −0.140 | 0.118 | 0.093 | 0.458 | −0.220 | 0.813 |
| 1358 | 77920 | CGPG8023 | SENSE | −0.221 | 0.070 | 0.232 | 0.313 | −0.159 | 0.947 |
| 1438 | 78060 | CGPG8640 | SENSE | 0.550 | 0.008 | −2.055 | 0.013 | 0.390 | 0.944 |
| 1442 | 78177 | CGPG8677 | SENSE | 0.029 | 0.548 | 0.496 | 0.007 | 0.020 | 1.000 |
| 1337 | 78238 | CGPG7813 | SENSE | 0.250 | 0.020 | −0.915 | 0.029 | 0.110 | 1.000 |
| 1514 | 78277 | CGPG9327 | SENSE | 0.274 | 0.003 | −0.267 | 0.456 | 0.064 | 1.000 |
| 1172 | 78367 | CGPG6334 | SENSE | 0.169 | 0.037 | −0.691 | 0.039 | 0.305 | 0.941 |
| 1069 | 78434 | CGPG5473 | SENSE | 0.327 | 0.018 | −2.055 | 0.112 | 0.196 | 1.000 |
| 1396 | 78612 | CGPG8320 | SENSE | 0.198 | 0.017 | 0.374 | 0.237 | −0.020 | 0.953 |
| 1414 | 78620 | CGPG8471 | SENSE | 0.248 | 0.030 | −0.127 | 0.108 | 0.016 | 1.000 |
| 960 | 78665 | CGPG4240 | SENSE | 0.605 | 0.035 | −2.631 | 0.047 | 0.376 | 1.000 |

If $p<0.05$ and delta or risk score mean $>0$, the transgenic plants showed statistically significant trait enhancement as compared to the reference (p value, of the delta of a quantitative response or of the risk score of a qualitative response, is the probability that the observed difference between the transgenic plants and the reference occur by chance) If $p<0.2$ and delta or risk score mean $>0$, the transgenic plants showed a trend of trait enhancement as compared to the reference.

C. Heat Stress Tolerance Screen

Under high temperatures, *Arabidopsis* seedlings become chlorotic and root growth is inhibited. This example sets forth the heat stress tolerance screen to identify *Arabidopsis* plants transformed with the gene of interest that are more resistant to heat stress based on primarily their seedling weight and root growth under high temperature.

T2 seeds were plated on ½× MS salts, 11% phytagel, with 10 µg/ml BASTA (7 per plate with 2 control seeds; 9 seeds total per plate). Plates were placed at 4° C. for 3 days to stratify seeds. Plates were then incubated at room temperature for 3 hours and then held vertically for 11 additional days at temperature of 34° C. at day and 20° C. at night. Photoperiod was 16 h. Average light intensity was ~140 µmol/m²/s. After 14 days of growth, plants were scored for glufosinate resistance, root length, final growth stage, visual color, and seedling fresh weight. A photograph of the whole plate was taken on day 14.

The seedling weight and root length were analyzed as quantitative responses according to example 1M. The final grow stage at day 14 was scored as success if 50% of the plants had reached 3 rosette leaves and size of leaves are greater than 1 mm (Boyes, e.g., (2001) The Plant Cell 13, 1499-1510). The growth stage data was analyzed as a qualitative response according to example 1L. A list of recombinant DNA constructs that improve heat tolerance in transgenic plants illustrated in Table 5.

TABLE 5

| PEP SEQ ID NO | Construct ID | Nomination ID | Orientation | Root length at day 14 Delta mean | P-value | Growth stage at day 14 Risk score mean | P-value | Seedling weight at day 14 Delta mean | P-value |
|---|---|---|---|---|---|---|---|---|---|
| 763 | 10174 | CGPG105 | ANTI-SENSE | 0.263 | 0.011 | −0.010 | 0.930 | 1.029 | 0.003 |
| 778 | 14803 | CGPG1192 | SENSE | 0.202 | 0.011 | 1.151 | 0.391 | 0.828 | 0.015 |
| 835 | 14909 | CGPG2005 | ANTI-SENSE | 0.394 | 0.050 | 0.093 | 0.553 | 1.084 | 0.044 |
| 847 | 17310 | CGPG2190 | SENSE | 0.140 | 0.039 | 1.726 | 0.160 | 1.100 | 0.027 |
| 920 | 19619 | CGPG3575 | SENSE | 0.342 | 0.020 | 1.537 | 0.108 | 1.277 | 0.000 |
| 1018 | 70822 | CGPG499 | SENSE | 0.402 | 0.015 | 0.644 | 0.180 | 1.386 | 0.005 |
| 1080 | 73173 | CGPG5596 | SENSE | 0.686 | 0.003 | 1.254 | 0.054 | 1.482 | 0.002 |
| 1180 | 73416 | CGPG6388 | SENSE | 0.184 | 0.013 | 0.640 | 0.454 | 0.830 | 0.008 |
| 1147 | 74658 | CGPG6174 | SENSE | 0.298 | 0.036 | 1.390 | 0.166 | 0.933 | 0.008 |
| 1278 | 74805 | CGPG7327 | SENSE | 0.441 | 0.017 | 0.071 | 0.080 | 1.258 | 0.019 |
| 839 | 75221 | CGPG2065 | SENSE | 0.345 | 0.049 | 0.686 | 0.402 | 1.294 | 0.005 |
| 1320 | 75465 | CGPG7599 | SENSE | 0.160 | 0.030 | 0.000 | 0.998 | 1.010 | 0.007 |
| 1318 | 75486 | CGPG7577 | SENSE | 0.361 | 0.024 | −0.046 | 0.172 | 1.009 | 0.008 |
| 1336 | 75618 | CGPG7801 | SENSE | 0.364 | 0.038 | 0.136 | 0.664 | 1.246 | 0.006 |
| 1339 | 75633 | CGPG7826 | SENSE | 0.325 | 0.010 | 0.100 | 0.609 | 0.948 | 0.024 |
| 1245 | 75876 | CGPG6996 | SENSE | 0.186 | 0.041 | −0.162 | 0.005 | 0.834 | 0.032 |
| 1393 | 75932 | CGPG8269 | SENSE | 0.379 | 0.000 | 0.377 | 0.333 | 0.836 | 0.008 |
| 1394 | 75956 | CGPG8271 | SENSE | 0.265 | 0.047 | 0.751 | 0.248 | 1.071 | 0.011 |
| 806 | 76049 | CGPG1568 | SENSE | 0.422 | 0.035 | 0.795 | 0.179 | 1.058 | 0.088 |
| 1125 | 76118 | CGPG5958 | SENSE | 0.248 | 0.032 | 0.316 | 0.503 | 0.921 | 0.002 |
| 1177 | 77725 | CGPG6364 | SENSE | 0.181 | 0.029 | 0.469 | 0.266 | 1.059 | 0.005 |
| 1003 | 78207 | CGPG4713 | SENSE | 0.330 | 0.039 | 0.578 | 0.488 | 1.079 | 0.006 |
| 1251 | 78377 | CGPG7075 | SENSE | 0.519 | 0.004 | 0.051 | 0.442 | 0.908 | 0.004 |
| 962 | 78970 | CGPG4248 | SENSE | 0.251 | 0.017 | 1.680 | 0.056 | 1.044 | 0.007 |

If p<0.05 and delta or risk score mean >0, the transgenic plants showed statistically significant trait enhancement as compared to the reference. If p<0.2 and delta or risk score mean >0, the transgenic plants showed a trend of trait enhancement as compared to the reference.

D. Salt Stress Tolerance Screen

This example sets forth the high salinity stress screen to identify *Arabidopsis* plants transformed with the gene of interest that are tolerant to high levels of salt based on their rate of development, root growth and chlorophyll accumulation under high salt conditions.

T2 seeds were plated on glufosinate selection plates containing 90 mM NaCl and grown under standard light and temperature conditions. All seedlings used in the experiment were grown at a temperature of 22° C. at day and 20° C. at night, a 16-hour photoperiod, an average light intensity of approximately 120 umol/m$^2$. On day 11, plants were measured for primary root length. After 3 more days of growth (day 14), plants were scored for transgenic status, primary root length, growth stage, visual color, and the seedlings were pooled for fresh weight measurement. A photograph of the whole plate was also taken on day 14.

The seedling weight and root length were analyzed as quantitative responses according to example 1M. The final growth stage at day 14 was scored as success if 50% of the plants reached 3 rosette leaves and size of leaves are greater than 1 mm (Boyes, D. C., et al., (2001), The Plant Cell 13, 1499/1510). The growth stage data was analyzed as a qualitative response according to example 1L. A list of recombinant DNA constructs that improve high salinity tolerance in transgenic plants illustrated in Table 6.

TABLE 6

| PEP SEQ ID | Construct ID | Root length at day 11 Delta mean | P-value | Root length at day 14 Delta mean | P-value | Growth stage at day 14 Delta mean | P-value | Seedling weight at day 14 Delta mean | P-value |
|---|---|---|---|---|---|---|---|---|---|
| 799 | 10192 | 0.372 | 0.009 | 0.330 | 0.001 | 0.915 | 0.033 | 0.668 | 0.005 |
| 772 | 11853 | 0.141 | 0.208 | 0.082 | 0.241 | — | — | 0.319 | 0.025 |
| 792 | 12766 | 0.317 | 0.048 | 0.253 | 0.112 | — | — | 0.360 | 0.006 |
| 1031 | 12772 | 0.150 | 0.111 | 0.178 | 0.014 | — | — | 0.223 | 0.175 |
| 761 | 13673 | 0.101 | 0.216 | 0.174 | 0.009 | 0.134 | 0.521 | 0.534 | 0.002 |
| 813 | 14341 | 0.490 | 0.012 | 0.487 | 0.014 | 2.561 | 0.007 | 1.051 | 0.025 |
| 835 | 14909 | 0.406 | 0.004 | 0.504 | 0.001 | 1.099 | 0.100 | 0.802 | 0.015 |
| 849 | 15627 | 0.168 | 0.123 | 0.208 | 0.000 | 0.735 | 0.500 | 0.512 | 0.089 |
| 796 | 15806 | 0.180 | 0.003 | 0.122 | 0.025 | — | — | −0.023 | 0.780 |
| 838 | 16553 | 0.229 | 0.004 | 0.243 | 0.016 | 0.399 | 0.157 | 0.552 | 0.104 |
| 854 | 17003 | 0.214 | 0.002 | 0.174 | 0.006 | 0.672 | 0.060 | 0.383 | 0.021 |
| 844 | 17014 | 0.080 | 0.200 | 0.182 | 0.080 | 0.912 | 0.283 | 0.468 | 0.022 |
| 870 | 17813 | 0.385 | 0.044 | 0.428 | 0.038 | 2.319 | 0.112 | 1.246 | 0.006 |
| 882 | 17930 | 0.330 | 0.021 | 0.224 | 0.102 | 0.860 | 0.133 | 0.414 | 0.009 |
| 922 | 18381 | 0.209 | 0.200 | 0.191 | 0.041 | 0.521 | 0.192 | 0.496 | 0.301 |

TABLE 6-continued

| PEP | | Root length at day 11 | | Root length at day 14 | | Growth stage at day 14 | | Seedling weight at day 14 | |
|---|---|---|---|---|---|---|---|---|---|
| SEQ ID | Construct ID | Delta mean | P-value | Delta mean | P-value | Delta mean | P-value | Delta mean | P-value |
| 919 | 18406 | 0.272 | 0.077 | 0.351 | 0.022 | 1.292 | 0.106 | 0.783 | 0.046 |
| 888 | 18418 | 0.203 | 0.070 | 0.186 | 0.014 | 0.031 | 0.823 | 0.086 | 0.365 |
| 883 | 18442 | 0.186 | 0.152 | 0.205 | 0.038 | 0.341 | 0.307 | 0.417 | 0.072 |
| 894 | 18874 | 0.238 | 0.058 | 0.182 | 0.278 | 0.854 | 0.044 | 0.462 | 0.026 |
| 895 | 18875 | 0.299 | 0.003 | 0.316 | 0.009 | 0.332 | 0.102 | 0.569 | 0.022 |
| 928 | 19312 | 0.309 | 0.066 | 0.293 | 0.008 | 0.549 | 0.025 | 0.475 | 0.024 |
| 892 | 19656 | 0.093 | 0.126 | 0.198 | 0.008 | 0.054 | 0.698 | 0.453 | 0.031 |
| 954 | 19927 | 0.454 | 0.033 | 0.401 | 0.018 | 0.887 | 0.023 | 0.499 | 0.013 |
| 946 | 19966 | 0.184 | 0.210 | 0.345 | 0.052 | 0.088 | 0.490 | 0.514 | 0.038 |
| 860 | 70123 | 0.175 | 0.019 | 0.119 | 0.026 | 0.367 | 0.171 | 0.335 | 0.026 |
| 1138 | 70243 | 0.347 | 0.036 | 0.386 | 0.026 | 0.479 | 0.331 | 0.551 | 0.007 |
| 937 | 70477 | 0.123 | 0.093 | 0.045 | 0.570 | 0.682 | 0.218 | 0.278 | 0.008 |
| 929 | 70538 | 0.455 | 0.003 | 0.356 | 0.006 | 1.166 | 0.321 | 0.598 | 0.005 |
| 963 | 71250 | 0.262 | 0.147 | 0.299 | 0.033 | 0.999 | 0.124 | 0.592 | 0.067 |
| 1050 | 72037 | 0.336 | 0.054 | 0.356 | 0.004 | 0.046 | 0.770 | 0.564 | 0.016 |
| 1071 | 72713 | 0.064 | 0.675 | 0.204 | 0.183 | 0.520 | 0.383 | 0.528 | 0.030 |
| 1093 | 73009 | 0.383 | 0.028 | 0.323 | 0.030 | 2.526 | 0.076 | 0.749 | 0.013 |
| 1102 | 73042 | 0.278 | 0.087 | 0.216 | 0.031 | 0.703 | 0.011 | 0.360 | 0.158 |
| 1097 | 73158 | 0.210 | 0.259 | 0.251 | 0.101 | 0.655 | 0.229 | 0.482 | 0.009 |
| 1086 | 73163 | 0.327 | 0.016 | 0.422 | 0.028 | 1.516 | 0.357 | 0.666 | 0.034 |
| 789 | 73333 | 0.024 | 0.728 | 0.012 | 0.855 | 0.380 | 0.191 | 0.400 | 0.032 |
| 1189 | 73436 | 0.340 | 0.106 | 0.315 | 0.016 | 3.045 | 0.086 | 0.697 | 0.055 |
| 1178 | 73437 | 0.232 | 0.100 | 0.268 | 0.030 | 0.239 | 0.433 | 0.157 | 0.592 |
| 1181 | 73452 | −0.026 | 0.593 | 0.238 | 0.029 | −0.028 | — | 0.345 | 0.274 |
| 1183 | 73454 | −0.072 | 0.456 | 0.020 | 0.863 | −0.307 | 0.041 | 0.337 | 0.026 |
| 1070 | 73932 | 0.191 | 0.068 | 0.254 | 0.058 | 2.253 | .0.125 | 0.524 | 0.006 |
| 1081 | 73979 | 0.323 | 0.014 | 0.241 | 0.207 | 1.728 | 0.066 | 0.957 | 0.000 |
| 1213 | 74172 | 0.235 | 0.015 | 0.261 | 0.024 | 0.476 | 0.513 | 0.276 | 0.567 |
| 1214 | 74184 | 0.183 | 0.139 | 0.193 | 0.049 | −0.143 | 0.317 | 0.308 | 0.305 |
| 899 | 74233 | — | — | — | — | — | — | 0.599 | 0.029 |
| 1068 | 74238 | 0.129 | 0.171 | 0.147 | 0.030 | 1.234 | 0.173 | 0.492 | 0.047 |
| 1063 | 74272 | 0.187 | 0.339 | 0.226 | 0.051 | 1.278 | 0.447 | 0.553 | 0.040 |
| 1140 | 74373 | 0.058 | 0.684 | 0.102 | 0.644 | 1.245 | 0.465 | 0.734 | 0.049 |
| 1220 | 74430 | 0.286 | 0.054 | 0.128 | 0.086 | 2.820 | 0.139 | 0.500 | 0.001 |
| 1218 | 74461 | 0.324 | 0.001 | 0.197 | 0.025 | −0.064 | 0.428 | 0.457 | 0.017 |
| 1141 | 74615 | 0.245 | 0.042 | 0.223 | 0.045 | 2.483 | 0.082 | 0.600 | 0.035 |
| 1149 | 74673 | 0.083 | 0.465 | 0.160 | 0.052 | −0.241 | 0.465 | 0.422 | 0.012 |
| 1175 | 74677 | 0.319 | 0.032 | 0.317 | 0.000 | 2.140 | 0.155 | 0.724 | 0.003 |
| 1113 | 74738 | −0.081 | 0.388 | −0.050 | 0.733 | 0.471 | 0.274 | 0.310 | 0.018. |
| 1275 | 74802 | 0.256 | 0.035 | 0.251 | 0.027 | 1.218 | 0.019 | 0.481 | 0.096 |
| 1279 | 74842 | 0.091 | 0.269 | 0.196 | 0.001 | 0.858 | 0.085 | 0.410 | 0.055 |
| 1281 | 74867 | 0.195 | 0.125 | 0.170 | 0.041 | −0.518 | 0.560 | −0.101 | 0.439 |
| 1299 | 74944 | — | — | — | — | — | — | 0.499 | 0.002 |
| 967 | 75205 | 0.195 | 0.114 | 0.210 | 0.085 | 0.941 | 0.098 | 0.458 | 0.010 |
| 1170 | 75292 | −0.056 | 0.658 | −0.086 | 0.593 | 1.203 | 0.180 | 0.380 | 0.026 |
| 1305 | 75388 | 0.263 | 0.028 | 0.305 | 0.006 | 1.879 | 0.037 | 0.655 | 0.027 |
| 1333 | 75617 | 0.352 | 0.044 | 0.366 | 0.025 | 0.878 | 0.179 | 0.854 | 0.010 |
| 1330 | 75663 | 0.151 | 0.148 | 0.147 | 0.044 | — | — | 0.251 | 0.102 |
| 1335 | 75665 | 0.468 | 0.009 | 0.276 | 0.109 | 0.302 | 0.052 | 0.779 | 0.001 |
| 1128 | 75810 | 0.238 | 0.058 | 0.230 | 0.002 | 1.794 | 0.286 | 0.599 | 0.006 |
| 1385 | 75903 | 0.198 | 0.104 | 0.176 | 0.049 | — | — | 0.171 | 0.401 |
| 1387 | 75916 | 0.318 | 0.041 | 0.360 | 0.049 | 0.819 | 0.245 | 0.677 | 0.015 |
| 1388 | 75917 | 0.391 | 0.012 | 0.428 | 0.006 | 0.269 | 0.200 | 0.861 | 0.013 |
| 1234 | 76548 | 0.237 | 0.051 | 0.266 | 0.014 | 0.385 | 0.336 | 0.680 | 0.049 |
| 1480 | 76975 | 0.216 | 0.114 | 0.198 | 0.001 | −0.162 | 0.362 | 0.316 | 0.061 |
| 1486 | 77151 | 0.181 | 0.001 | 0.235 | 0.017 | 0.641 | 0.099 | 0.365 | 0.034 |
| 1505 | 77229 | 0.265 | 0.226 | 0.338 | 0.088 | 1.988 | 0.005 | 1.093 | 0.003 |
| 1506 | 77241 | 0.039 | 0.795 | 0.038 | 0.632 | 0.903 | 0.388 | 0.350 | 0.038 |
| 1374 | 77361 | 0.271 | 0.000 | 0.232 | 0.156 | 0.508 | 0.273 | 0.238 | 0.016 |
| 1512 | 77428 | 0.355 | 0.005 | 0.429 | 0.012 | 1.455 | 0.381 | 0.800 | 0.042 |
| 1255 | 77528 | 0.284 | 0.126 | 0.254 | 0.031 | 0.608 | 0.368 | 0.753 | 0.087 |
| 1349 | 77545 | 0.469 | 0.004 | 0.324 | 0.072 | 0.283 | 0.300 | 0.652 | 0.022 |
| 1352 | 77556 | 0.068 | 0.597 | 0.017 | 0.884 | 1.080 | 0.379 | 0.320 | 0.044 |
| 1372 | 77590 | 0.342 | 0.026 | 0.250 | 0.145 | 2.393 | 0.019 | 0.549 | 0.039 |
| 1399 | 77627 | 0.192 | 0.005 | 0.146 | 0.011 | −0.147 | 0.734 | 0.275 | 0.025 |
| 1467 | 77831 | 0.299 | 0.087 | 0.332 | 0.062 | 3.081 | 0.079 | 0.774 | 0.006 |
| 1472 | 77838 | 0.301 | 0.041 | 0.296 | 0.005 | 0.121 | 0.423 | 1.151 | 0.258 |
| 1502 | 77854 | 0.131 | 0.183 | 0.205 | 0.082 | 0.341 | 0.470 | 0.419 | 0.036 |
| 1364 | 77926 | 0.232 | 0.030 | 0.219 | 0.049 | 2.642 | 0.061 | 0.321 | 0.089 |
| 1433 | 78055 | 0.244 | 0.007 | 0.393 | 0.011 | 1.371 | 0.410 | 0.634 | 0.024 |
| 1257 | 78106 | 0.276 | 0.017 | 0.327 | 0.003 | 2.062 | 0.024 | 0.900 | 0.001 |
| 830 | 78355 | 0.295 | 0.044 | 0.309 | 0.005 | 1.146 | 0.284 | 0.549 | 0.028 |
| 1067 | 78361 | 0.217 | 0.032 | 0.220 | 0.016 | 1.351 | 0.181 | 0.463 | 0.057 |

TABLE 6-continued

| PEP | | Root length at day 11 | | Root length at day 14 | | Growth stage at day 14 | | Seedling weight at day 14 | |
|---|---|---|---|---|---|---|---|---|---|
| SEQ ID | Construct ID | Delta mean | P-value | Delta mean | P-value | Delta mean | P-value | Delta mean | P-value |
| 1418 | 78540 | 0.116 | 0.039 | 0.166 | 0.021 | 1.290 | 0.473 | 0.170 | 0.191 |
| 1436 | 78553 | 0.236 | 0.083 | 0.190 | 0.016 | — | — | 0.219 | 0.253 |
| 965 | 78677 | 0.126 | 0.074 | 0.217 | 0.005 | — | — | 0.205 | 0.068 |
| 1254 | 78984 | 0.206 | 0.183 | 0.283 | 0.044 | — | — | 0.575 | 0.019 |

If $p<0.05$ and delta or risk score mean $>0$, the transgenic plants showed statistically significant trait enhancement as compared to the reference. If $p<0.2$ and delta or risk score mean $>0$, the transgenic plants showed a trend of trait enhancement as compared to the reference.

E. Polyethylene Glycol (PEG) Induced Osmotic Stress Tolerance Screen

There are numerous factors, which can influence seed germination and subsequent seedling growth, one being the availability of water. Genes, which can directly affect the success rate of germination and early seedling growth, are potentially useful agronomic traits for improving the germination and growth of crop plants under drought stress. In this assay, PEG was used to induce osmotic stress on germinating transgenic lines of *Arabiclopsis thaliana* seeds in order to screen for osmotically resistant seed lines.

T2 seeds were plated on BASTA selection plates containing 3% PEG and grown under standard light and temperature conditions. Seeds were plated on each plate containing 3% PEG, ½× MS salts, 1% phytagel, and 10 µg/ml glufosinate. Plates were placed at 4° C. for 3 days to stratify seeds. On day 11, plants were measured for primary root length. After 3 more days of growth, i.e., at day 14, plants were scored for transgenic status, primary root length, growth stage, visual color, and the seedlings were pooled for fresh weight measurement. A photograph of the whole plate was taken on day14.

Seedling weight and root length were analyzed as quantitative responses according to example 1 M. The final growth stage at day 14 was scored as success or failure based on whether the plants reached 3 rosette leaves and size of leaves are greater than 1 mm. The growth stage data was analyzed as a qualitative response according to example 1L. A list of recombinant DNA constructs that improve osmotic stress tolerance in transgenic plants illustrated in Table 7.

TABLE 7

| PEP | | Root length at day 11 | | Root length at day 14 | | Growth stage at day 14 | | Seedling weight at day 14 | |
|---|---|---|---|---|---|---|---|---|---|
| SEQ ID | Construct ID | Delta mean | P-value | Delta mean | P-value | Delta mean | P-value | Delta mean | P-value |
| 763 | 10174 | 0.193 | 0.202 | 0.148 | 0.120 | 0.926 | 0.610 | 0.228 | 0.043 |
| 1040 | 12773 | 0.142 | 0.020 | 0.138 | 0.086 | 3.109 | 0.073 | 0.465 | 0.020 |
| 835 | 14909 | 0.167 | 0.038 | 0.057 | 0.383 | 3.041 | 0.087 | 0.411 | 0.014 |
| 850 | 15409 | 0.017 | 0.742 | −0.042 | 0.706 | 1.533 | 0.369 | 0.299 | 0.014 |
| 844 | 17014 | 0.164 | 0.005 | 0.116 | 0.074 | 4.000 | 0.000 | 0.287 | 0.002 |
| 850 | 17201 | 0.305 | 0.041 | 0.290 | 0.023 | 2.929 | 0.112 | 0.122 | 0.441 |
| 903 | 18830 | 0.038 | 0.553 | −0.100 | 0.008 | 1.463 | 0.372 | 0.427 | 0.004 |
| 826 | 70401 | 0.041 | 0.558 | 0.025 | 0.833 | 3.230 | 0.052 | 0.281 | 0.033 |
| 840 | 70746 | — | — | — | — | — | — | 0.462 | 0.003 |
| 952 | 70902 | 0.268 | 0.064 | 0.276 | 0.021 | 4.000 | 0.000 | 0.510 | 0.013 |
| 955 | 70976 | 0.198 | 0.199 | 0.159 | 0.200 | — | — | 0.477 | 0.033 |
| 971 | 71839 | 0.269 | 0.008 | 0.185 | 0.019 | 1.178 | 0.506 | 0.108 | 0.316 |
| 1073 | 72678 | 0.373 | 0.087 | 0.404 | 0.027 | 2.998 | 0.096 | 0.188 | 0.527 |
| 1077 | 72755 | 0.206 | 0.089 | 0.132 | 0.048 | 4.000 | 0.000 | 0.397 | 0.136 |
| 1074 | 72765 | 0.169 | 0.040 | −0.006 | 0.836 | 4.000 | 0.000 | 0.335 | 0.008 |
| 1084 | 72960 | 0.111 | 0.065 | 0.197 | 0.050 | 3.068 | 0.081 | 0.243 | 0.110 |
| 1085 | 73021 | 0.364 | 0.011 | 0.300 | 0.018 | 4.000 | 0.000 | 0.758 | 0.023 |
| 1094 | 73109 | 0.261 | 0.045 | 0.202 | 0.004 | 4.000 | 0.000 | 0.344 | 0.027 |
| 1095 | 73121 | 0.503 | 0.003 | 0.508 | 0.013 | 4.000 | 0.000 | 0.713 | 0.029 |
| 1088 | 73188 | 0.298 | 0.109 | 0.539 | 0.048 | 3.140 | 0.067 | 0.860 | 0.029 |
| 1198 | 73545 | 0.115 | 0.037 | 0.110 | 0.275 | 4.000 | 0.000 | 0.378 | 0.023 |
| 1034 | 73676 | 0.169 | 0.005 | 0.130 | 0.118 | 4.000 | 0.000 | 0.405 | 0.008 |
| 1033 | 73861 | 0.055 | 0.321 | 0.009 | 0.777 | 0.510 | 0.151 | 0.203 | 0.036 |
| 1081 | 73979 | 0.274 | 0.063 | 0.249 | 0.202 | 4.000 | 0.000 | 0.325 | 0.017 |
| 1200 | 74138 | 0.146 | 0.006 | 0.141 | 0.008 | 2.512 | 0.233 | 0.080 | 0.734 |
| 1225 | 74495 | 0.091 | 0.636 | 0.294 | 0.028 | 2.352 | 0.290 | −0.029 | 0.911 |
| 1227 | 74514 | 0.181 | 0.342 | 0.219 | 0.232 | 4.000 | 0.000 | 0.441 | 0.036 |
| 1229 | 74552 | 0.238 | 0.100 | 0.177 | 0.092 | 3.055 | 0.084 | 0.261 | 0.005 |
| 1167 | 74674 | 0.196 | 0.073 | 0.289 | 0.008 | 2.780 | 0.150 | 0.261 | 0.138 |
| 1279 | 74842 | 0.012 | 0.920 | −0.027 | 0.757 | 4.000 | 0.000 | 0.281 | 0.021 |
| 1288 | 74985 | 0.401 | 0.014 | 0.421 | 0.036 | 2.179 | 0.139 | 0.756 | 0.041 |
| 1124 | 75238 | 0.176 | 0.226 | 0.123 | 0.362 | 4.000 | 0.000 | 0.364 | 0.040 |
| 1310 | 75343 | 0.216 | 0.078 | 0.465 | 0.025 | 1.251 | 0.464 | 0.420 | 0.005 |
| 1342 | 75750 | 0.161 | 0.266 | 0.216 | 0.094 | 4.000 | 0.000 | 0.281 | 0.004 |

TABLE 7-continued

| PEP SEQ ID | Construct ID | Root length at day 11 Delta mean | P-value | Root length at day 14 Delta mean | P-value | Growth stage at day 14 Delta mean | P-value | Seedling weight at day 14 Delta mean | P-value |
|---|---|---|---|---|---|---|---|---|---|
| 1340 | 75761 | 0.437 | 0.006 | 0.385 | 0.024 | 4.000 | 0.000 | 0.473 | 0.023 |
| 1391 | 75943 | 0.316 | 0.001 | 0.390 | 0.025 | 1.263 | 0.454 | −0.029 | 0.627 |
| 793 | 76025 | 0.356 | 0.074 | 0.309 | 0.076 | 2.832 | 0.136 | 0.519 | 0.019 |
| 1263 | 76166 | 0.179 | 0.190 | 0.003 | 0.894 | 0.470 | 0.590 | 0.397 | 0.038 |
| 1460 | 76362 | 0.153 | 0.302 | 0.174 | 0.385 | 2.051 | 0.403 | 0.746 | 0.043 |
| 1511 | 76402 | 0.224 | 0.153 | 0.215 | 0.192 | 4.000 | 0.000 | 0.448 | 0.006 |
| 1269 | 76572 | 0.256 | 0.026 | 0.289 | 0.106 | 2.708 | 0.171 | 0.294 | 0.031 |
| 1262 | 76755 | 0.245 | 0.141 | 0.153 | 0.143 | 1.174 | 0.493 | 0.299 | 0.043 |
| 1490 | 77154 | 0.208 | 0.114 | 0.215 | 0.043 | 4.000 | 0.000 | 0.403 | 0.060 |
| 1497 | 77192 | 0.075 | 0.400 | −0.036 | 0.402 | 4.000 | 0.000 | 0.559 | 0.009 |
| 1499 | 77193 | 0.256 | 0.116 | 0.207 | 0.141 | 3.235 | 0.052 | 0.498 | 0.041 |
| 1509 | 77293 | 0.424 | 0.034 | 0.280 | 0.106 | 2.931 | 0.111 | 0.609 | 0.002 |
| 1362 | 77337 | 0.182 | 0.077 | 0.109 | 0.098 | 4.000 | 0.000 | 0.571 | 0.032 |
| 1268 | 77533 | 0.143 | 0.089 | 0.146 | 0.002 | 1.381 | 0.404 | 0.257 | 0.030 |
| 1369 | 77586 | 0.227 | 0.020 | 0.160 | 0.138 | 3.298 | 0.042 | 0.723 | 0.014 |
| 1373 | 77592 | — | — | — | — | — | — | 0.397 | 0.014 |
| 1474 | 77834 | 0.180 | 0.025 | 0.211 | 0.009 | — | — | −0.019 | 0.787 |
| 1375 | 77934 | 0.179 | 0.081 | 0.183 | 0.327 | 0.556 | 0.316 | 0.349 | 0.003 |
| 1419 | 77993 | 0.074 | 0.395 | 0.131 | 0.147 | 1.394 | 0.406 | 0.380 | 0.004 |
| 1424 | 78018 | 0.192 | 0.073 | 0.135 | 0.014 | 0.322 | 0.626 | 0.284 | 0.096 |
| 1429 | 78032 | 0.142 | 0.010 | 0.099 | 0.050 | 4.000 | 0.000 | 0.266 | 0.049 |
| 1438 | 78060 | 0.235 | 0.207 | 0.381 | 0.030 | 1.696 | 0.325 | 0.285 | 0.327 |
| 1118 | 78113 | 0.122 | 0.032 | −0.106 | 0.179 | 2.732 | 0.164 | 0.353 | 0.002 |
| 1402 | 78141 | 0.119 | 0.497 | 0.152 | 0.349 | 2.567 | 0.215 | 0.202 | 0.033 |
| 1448 | 78185 | 0.283 | 0.048 | 0.344 | 0.079 | 4.000 | 0.000 | 0.513 | 0.000 |
| 1024 | 78341 | 0.148 | 0.031 | 0.270 | 0.010 | −0.914 | 0.129 | −0.182 | 0.172 |
| 1417 | 78537 | −0.001 | 0.988 | 0.191 | 0.014 | 1.801 | 0.499 | −0.171 | 0.287 |
| 974 | 78717 | −0.022 | 0.692 | 0.106 | 0.037 | 1.170 | 0.497 | 0.284 | 0.042 |
| 1164 | 78734 | 0.145 | 0.233 | 0.068 | 0.620 | 4.000 | 0.000 | 0.375 | 0.012 |

If $p<0.05$ and delta or risk score mean $>0$, the transgenic plants showed statistically significant trait enhancement as compared to the reference.

If $p<0.2$ and delta or risk score mean $>0$, the transgenic plants showed a trend of trait enhancement as compared to the reference.

F. Cold Shock Tolerance Screen

This example set forth a screen to identify *Arabidopsis* plants transformed with the genes of interest that are more tolerant to cold stress subjected during day 8 to day 28 after seed planting. During these crucial early stages, seedling growth and leaf area increase were measured to assess tolerance when *Arabidopsis* seedlings were exposed to low temperatures. Using this screen, genetic alterations can be found that enable plants to germinate and grow better than wild type plants under sudden exposure to low temperatures.

Eleven seedlings from T2 seeds of each transgenic line plus one control line were plated together on a plate containing ½× Gamborg Salts with 0.8 Phytagel™, 1% Phytagel, and 0.3% Sucrose. Plates were then oriented horizontally and stratified for three days at 4° C. At day three, plates were removed from stratification and exposed to standard conditions (16 hr photoperiod, 22° C. at day and 20° C. at night) until day 8. At day eight, plates were removed from standard conditions and exposed to cold shock conditions (24 hr photoperiod, 8° C. at both day and night) until the final day of the assay, i.e., day 28. Rosette areas were measured to at day 8 and day 28, which were analyzed as quantitative responses according to example 1M. A list of recombinant nucleotides that improve cold shock stress tolerance in plants illustrated in Table 8.

TABLE 8

| PEP SEQ ID | Construct ID | Orientation | Rosette area at day 8 Delta mean | P-value | Rosette area at day 28 Risk score mean | P-value | Rosette area difference Delta mean | P-value |
|---|---|---|---|---|---|---|---|---|
| 943 | 10366 | ANTI-SENSE | 0.361 | 0.009 | 0.569 | 0.038 | 0.588 | 0.036 |
| 1518 | 12365 | SENSE | −0.114 | 0.771 | 0.663 | 0.009 | 0.717 | 0.008 |
| 939 | 12601 | SENSE | −0.240 | 0.390 | 0.612 | 0.034 | 1.531 | 0.003 |
| 781 | 12714 | ANTI-SENSE | 0.818 | 0.064 | 0.896 | 0.025 | 0.901 | 0.016 |
| 850 | 15409 | ANTI-SENSE | 0.637 | 0.157 | 0.426 | 0.220 | 0.615 | 0.050 |
| 851 | 15903 | ANTI-SENSE | −0.276 | 0.592 | 0.287 | 0.041 | 0.247 | 0.102 |
| 842 | 15966 | ANTI-SENSE | 0.140 | 0.650 | 0.282 | 0.015 | 0.297 | 0.003 |
| 915 | 18403 | SENSE | 0.366 | 0.197 | 0.729 | 0.007 | 0.785 | 0.004 |
| 888 | 18418 | SENSE | −0.236 | 0.125 | 0.379 | 0.023 | 0.366 | 0.026 |
| 924 | 18720 | SENSE | 0.620 | 0.144 | 0.740 | 0.015 | 0.659 | 0.014 |

TABLE 8-continued

| PEP SEQ ID | Construct ID | Orientation | Rosette area at day 8 | | Rosette area at day 28 Risk | | Rosette area difference | |
|---|---|---|---|---|---|---|---|---|
| | | | Delta mean | P-value | score mean | P-value | Delta mean | P-value |
| 948 | 19906 | SENSE | 0.788 | 0.005 | 0.635 | 0.030 | 0.560 | 0.039 |
| 860 | 70123 | SENSE | 0.556 | 0.114 | 0.968 | 0.067 | 1.245 | 0.028 |
| 908 | 70415 | SENSE | 0.334 | 0.147 | 0.763 | 0.009 | 0.977 | 0.023 |
| 930 | 70440 | SENSE | −0.175 | 0.249 | 0.541 | 0.049 | 0.622 | 0.067 |
| 817 | 70748 | ANTI-SENSE | 0.503 | 0.075 | 0.700 | 0.048 | 0.527 | 0.116 |
| 1150 | 70824 | SENSE | −0.134 | 0.679 | 0.829 | 0.002 | 0.921 | 0.011 |
| 989 | 71347 | SENSE | −0.346 | 0.381 | 0.401 | 0.003 | 0.412 | 0.014 |
| 1053 | 72007 | SENSE | 0.161 | 0.573 | 1.180 | 0.026 | 1.302 | 0.042 |
| 1056 | 72022 | SENSE | 0.976 | 0.025 | 1.051 | 0.001 | 1.124 | 0.002 |
| 1059 | 72138 | SENSE | 0.486 | 0.009 | 0.817 | 0.005 | 0.669 | 0.000 |
| 994 | 72469 | SENSE | 0.335 | 0.300 | 0.767 | 0.025 | 0.948 | 0.023 |
| 1007 | 72526 | SENSE | 0.323 | 0.223 | 0.413 | 0.003 | 0.505 | 0.002 |
| 1076 | 72707 | SENSE | 0.146 | 0.596 | 0.396 | 0.012 | 0.400 | 0.074 |
| 1089 | 73153 | SENSE | 0.728 | 0.031 | 0.290 | 0.044 | 0.311 | 0.047 |
| 1101 | 73171 | SENSE | 0.333 | 0.336 | 0.320 | 0.059 | 0.378 | 0.038 |
| 1087 | 73187 | SENSE | 0.454 | 0.037 | 0.492 | 0.008 | 0.460 | 0.003 |
| 1182 | 73453 | SENSE | 0.672 | 0.013 | 0.708 | 0.010 | 0.879 | 0.004 |
| 1012 | 73686 | SENSE | 0.704 | 0.040 | 0.906 | 0.000 | 0.888 | 0.000 |
| 1090 | 73983 | SENSE | −0.071 | 0.867 | 0.431 | 0.004 | 0.286 | 0.037 |
| 1036 | 74218 | SENSE | 0.002 | 0.993 | 0.294 | 0.020 | 0.089 | 0.625 |
| 1276 | 74851 | SENSE | 0.626 | 0.184 | 0.917 | 0.074 | 1.028 | 0.033 |
| 1277 | 74864 | SENSE | 0.879 | 0.041 | 0.742 | 0.031 | 0.752 | 0.044 |
| 1302 | 75374 | SENSE | 0.278 | 0.273 | 2.374 | 0.016 | 2.950 | 0.013 |
| 1307 | 75377 | SENSE | −0.307 | 0.316 | 0.085 | 0.166 | 0.212 | 0.009 |
| 1331 | 75616 | SENSE | 0.399 | 0.473 | 0.807 | 0.022 | 1.015 | 0.015 |
| 1392 | 75967 | SENSE | 0.714 | 0.027 | 1.588 | 0.007 | 1.793 | 0.006 |
| 1458 | 76314 | SENSE | 0.420 | 0.049 | 0.787 | 0.004 | 0.970 | 0.002 |
| 1459 | 76326 | SENSE | 0.232 | 0.383 | 0.894 | 0.018 | 0.930 | 0.034 |
| 1462 | 76377 | SENSE | 0.263 | 0.137 | 0.254 | 0.014 | 0.227 | 0.435 |
| 1511 | 76402 | SENSE | −0.265 | 0.435 | 0.402 | 0.024 | 0.490 | 0.046 |
| 1065 | 76709 | SENSE | −0.566 | 0.063 | 0.091 | 0.110 | 0.250 | 0.016 |
| 1488 | 77105 | SENSE | 0.954 | 0.016 | 0.817 | 0.015 | 0.925 | 0.011 |
| 1494 | 77144 | SENSE | 0.163 | 0.523 | 0.946 | 0.003 | 0.906 | 0.000 |
| 1374 | 77361 | SENSE | 0.595 | 0.065 | 1.056 | 0.006 | 1.207 | 0.016 |
| 1510 | 77473 | SENSE | −0.048 | 0.732 | 0.170 | 0.019 | 0.091 | 0.057 |
| 1238 | 77522 | SENSE | 0.132 | 0.616 | 1.709 | 0.011 | 2.008 | 0.009 |
| 1351 | 77552 | SENSE | 1.221 | 0.028 | 1.687 | 0.004 | 1.900 | 0.004 |
| 1106 | 77723 | SENSE | 0.342 | 0.151 | 0.100 | 0.051 | 0.141 | 0.037 |
| 1485 | 77852 | SENSE | 0.236 | 0.151 | 0.416 | 0.197 | 0.587 | 0.040 |
| 891 | 77909 | SENSE | 0.722 | 0.034 | 1.330 | 0.003 | 1.285 | 0.010 |
| 1363 | 77924 | SENSE | 0.547 | 0.057 | 0.480 | 0.017 | 0.576 | 0.016 |
| 1354 | 77957 | SENSE | 0.417 | 0.256 | 0.930 | 0.026 | 0.827 | 0.013 |
| 1411 | 77974 | SENSE | 0.512 | 0.030 | 1.175 | 0.013 | 1.036 | 0.013 |
| 1425 | 78021 | SENSE | 0.391 | 0.250 | 0.460 | 0.005 | 0.532 | 0.009 |
| 1434 | 78057 | SENSE | 0.086 | 0.766 | 0.534 | 0.007 | 0.588 | 0.013 |
| 1344 | 78129 | SENSE | 1.189 | 0.001 | 0.613 | 0.030 | 0.599 | 0.111 |
| 1426 | 78158 | SENSE | 1.261 | 0.005 | 0.732 | 0.001 | 1.040 | 0.016 |
| 1002 | 78202 | SENSE | 0.842 | 0.004 | 0.835 | 0.000 | 0.865 | 0.000 |
| 1326 | 78233 | SENSE | 0.162 | 0.477 | 0.771 | 0.013 | 0.822 | 0.007 |
| 1172 | 78367 | SENSE | −0.153 | 0.668 | 0.522 | 0.047 | 0.514 | 0.068 |
| 1408 | 78530 | SENSE | 2.039 | 0.005 | 2.026 | 0.002 | 2.244 | 0.002 |
| 1381 | 78905 | SENSE | 0.615 | 0.181 | 0.863 | 0.007 | 0.925 | 0.007 |
| 1447 | 78932 | SENSE | 0.472 | 0.046 | 0.626 | 0.027 | 0.715 | 0.030 |

If p<0.05 and delta or risk score mean >0, the transgenic plants showed statistically significant trait enhancement as compared to the reference (p value, of the delta of a quantitative response or of the risk score of a qualitative response, is the probability that the observed difference between the transgenic plants and the reference occur by chance) If p<0.2 and delta or risk score mean >0, the transgenic plants showed a trend of trait enhancement as compared to the reference.

G. Cold Germination Tolerance Screen

This example sets forth a screen to identify *Arabidopsis* plants transformed with the genes of interests are resistant to cold stress based on their rate of development, root growth and chlorophyll accumulation under low temperature conditions.

T2 seeds were plated and all seedlings used in the experiment were grown at 8° C. Seeds were first surface disinfested using chlorine gas and then seeded on assay plates containing an aqueous solution of ½× Garnborg's B/5 Basal Salt Mixture (Sigma/Aldrich Corp., St. Louis, Mo., USA G/5788), 1% Phytagel™ (Sigma-Aldrich, P-8169), and 10 ug/ml glufosinate with the final pH adjusted to 5.8 using KOH. Test plates were held vertically for 28 days at a constant temperature of 8° C., a photoperiod of 16 hr, and average light intensity of approximately 100 umol/m²/s. At 28 days post plating, root length was measured, growth stage was observed, the visual color was assessed, and a whole plate photograph was taken.

The root length at day 28 was analyzed as a quantitative response according to example 1M. The growth stage at day 7 was analyzed as a qualitative response according to example 1L. A list of recombinant DNA constructs that improve cold stress tolerance in transgenic plants illustrated in Table 9.

TABLE 9

| PEP SEQ ID | Construct ID | Nomination ID | Orientation | Root length at day 28 | | Growth stage at day 28 | |
|---|---|---|---|---|---|---|---|
| | | | | Delta-mean | P-value | Delta mean | P-value |
| 799 | 10192 | CGPG146 | ANTI-SENSE | 0.461 | 0.094 | 4.000 | 0.000 |
| 1517 | 12276 | CGPG967 | ANTI-SENSE | 0.203 | 0.217 | 4.000 | 0.000 |
| 835 | 14909 | CGPG2005 | ANTI-SENSE | 0.311 | 0.005 | 4.000 | 0.000 |
| 828 | 15126 | CGPG1929 | SENSE | 0.216 | 0.016 | 4.000 | 0.000 |
| 829 | 15628 | CGPG1938 | ANTI-SENSE | 0.132 | 0.205 | 4.000 | 0.000 |
| 846 | 16208 | CGPG2148 | SENSE | −0.068 | 0.734 | 4.000 | 0.000 |
| 864 | 17402 | CGPG2426 | SENSE | 0.105 | 0.581 | 4.000 | 0.000 |
| 780 | 18011 | CGPG126 | SENSE | −0.248 | 0.184 | 4.000 | 0.000 |
| 812 | 18116 | CGPG1656 | ANTI-SENSE | −0.231 | 0.358 | 4.000 | 0.000 |
| 905 | 18226 | CGPG3269 | SENSE | 0.196 | 0.313 | 4.000 | 0.000 |
| 887 | 18415 | CGPG3004 | SENSE | −0.024 | 0.845 | 4.000 | 0.000 |
| 901 | 18827 | CGPG3248 | SENSE | 0.023 | 0.845 | 4.000 | 0.000 |
| 889 | 19532 | CGPG3030 | SENSE | 0.332 | 0.044 | 4.000 | 0.000 |
| 912 | 19608 | CGPG3400 | SENSE | −0.053 | 0.705 | 4.000 | 0.000 |
| 892 | 19656 | CGPG3084 | SENSE | 0.037 | 0.746 | 4.000 | 0.000 |
| 951 | 19746 | CGPG4099 | SENSE | 0.328 | 0.209 | 4.000 | 0.000 |
| 940 | 19747 | CGPG3931 | SENSE | −0.008 | 0.938 | 4.000 | 0.000 |
| 950 | 19802 | CGPG4071 | SENSE | 0.150 | 0.602 | 4.000 | 0.000 |
| 954 | 19927 | CGPG4153 | SENSE | — | — | 4.000 | 0.000 |
| 1168 | 70225 | CGPG63 | SENSE | 0.291 | 0.006 | 4.000 | 0.000 |
| 816 | 70240 | CGPG177 | SENSE | 0.033 | 0.755 | 4.000 | 0.000 |
| 932 | 70443 | CGPG3724 | SENSE | −0.087 | 0.321 | 4.000 | 0.000 |
| 831 | 70560 | CGPG1964 | SENSE | 0.401 | 0.128 | 4.000 | 0.000 |
| 818 | 70807 | CGPG182 | SENSE | 0.200 | 0.055 | 4.000 | 0.000 |
| 985 | 70834 | CGPG445 | SENSE | −0.300 | 0.322 | 4.000 | 0.000 |
| 871 | 70845 | CGPG253 | SENSE | 0.094 | 0.290 | 4.000 | 0.000 |
| 944 | 70935 | CGPG3975 | SENSE | −0.087 | 0.236 | 4.000 | 0.000 |
| 942 | 70965 | CGPG3964 | SENSE | 0.318 | 0.030 | 4.000 | 0.000 |
| 956 | 71440 | CGPG4169 | SENSE | 0.046 | 0.154 | 4.000 | 0.000 |
| 999 | 71638 | CGPG4691 | SENSE | 0.362 | 0.225 | 4.000 | 0.000 |
| 1049 | 72025 | CGPG5223 | SENSE | — | — | 4.000 | 0.000 |
| 1057 | 72096 | CGPG5304 | SENSE | — | — | 4.000 | 0.000 |
| 1005 | 72457 | CGPG4747 | SENSE | −0.010 | 0.907 | 4.000 | 0.000 |
| 1008 | 72531 | CGPG4779 | SENSE | 0.062 | 0.704 | 4.000 | 0.000 |
| 910 | 72606 | CGPG3361 | SENSE | 0.133 | 0.315 | 4.000 | 0.000 |
| 1075 | 72730 | CGPG5546 | SENSE | 0.179 | 0.134 | 4.000 | 0.000 |
| 1100 | 73005 | CGPG5732 | SENSE | — | — | 4.000 | 0.000 |
| 1085 | 73021 | CGPG5642 | SENSE | 0.110 | 0.531 | 4.000 | 0.000 |
| 1107 | 73048 | CGPG5797 | SENSE | — | — | 4.000 | 0.000 |
| 1103 | 73067 | CGPG5771 | SENSE | −0.244 | 0.395 | 4.000 | 0.000 |
| 1104 | 73148 | CGPG5778 | SENSE | 0.211 | 0.260 | 4.000 | 0.000 |
| 1096 | 73157 | CGPG5715 | SENSE | 0.168 | 0.440 | 4.000 | 0.000 |
| 1086 | 73163 | CGPG5644 | SENSE | 0.327 | 0.003 | 4.000 | 0.000 |
| 884 | 73207 | CGPG2874 | SENSE | −0.185 | 0.626 | 4.000 | 0.000 |
| 986 | 73215 | CGPG4453 | SENSE | 0.433 | 0.010 | 4.000 | 0.000 |
| 1016 | 73230 | CGPG4949 | SENSE | 0.273 | 0.150 | 4.000 | 0.000 |
| 1039 | 73251 | CGPG5186 | SENSE | 0.061 | 0.636 | 4.000 | 0.000 |
| 1041 | 73254 | CGPG5190 | SENSE | 0.205 | 0.018 | 4.000 | 0.000 |
| 1030 | 73313 | CGPG5097 | SENSE | 0.638 | 0.006 | 3.090 | 0.077 |
| 1187 | 73434 | CGPG6437 | SENSE | 0.116 | 0.345 | 4.000 | 0.000 |
| 1179 | 73450 | CGPG6375 | SENSE | 0.174 | 0.250 | 4.000 | 0.000 |
| 1186 | 73469 | CGPG6432 | SENSE | — | — | 4.000 | 0.000 |
| 1188 | 73471 | CGPG6445 | SENSE | −0.101 | 0.604 | 4.000 | 0.000 |
| 1184 | 73491 | CGPG6418 | SENSE | 0.061 | 0.230 | 4.000 | 0.000 |
| 1193 | 73519 | CGPG6505 | SENSE | 0.118 | 0.064 | 4.000 | 0.000 |
| 1194 | 73543 | CGPG6507 | SENSE | 0.219 | 0.385 | 4.000 | 0.000 |
| 1195 | 73567 | CGPG6509 | SENSE | 0.371 | 0.101 | 4.000 | 0.000 |
| 833 | 73602 | CGPG1977 | SENSE | −0.037 | 0.762 | 4.000 | 0.000 |
| 1006 | 73639 | CGPG4755 | SENSE | 0.035 | 0.724 | 4.000 | 0.000 |
| 865 | 73707 | CGPG2433 | SENSE | 0.149 | 0.133 | 4.000 | 0.000 |
| 1010 | 73722 | CGPG4879 | SENSE | 0.022 | 0.763 | 4.000 | 0.000 |
| 1038 | 73731 | CGPG5161 | SENSE | 0.050 | 0.825 | 3.321 | 0.039 |
| 808 | 73927 | CGPG1619 | SENSE | 0.083 | 0.050 | 4.000 | 0.000 |
| 811 | 73948 | CGPG1651 | SENSE | 0.203 | 0.154 | 4.000 | 0.000 |
| 995 | 73951 | CGPG4660 | SENSE | 0.220 | 0.104 | 4.000 | 0.000 |
| 1209 | 74170 | CGPG6619 | SENSE | −0.054 | 0.750 | 4.000 | 0.000 |
| 1207 | 74179 | CGPG6596 | SENSE | 0.258 | 0.237 | 4.000 | 0.000 |
| 1214 | 74184 | CGPG6636 | SENSE | 0.415 | 0.000 | 4.000 | 0.000 |

TABLE 9-continued

| PEP SEQ ID | Construct ID | Nomination ID | Orientation | Root length at day 28 Delta-mean | P-value | Growth stage at day 28 Delta mean | P-value |
|---|---|---|---|---|---|---|---|
| 1201 | 74186 | CGPG6557 | SENSE | −0.426 | 0.017 | 4.000 | 0.000 |
| 916 | 74206 | CGPG3465 | SENSE | 0.346 | 0.088 | 4.000 | 0.000 |
| 1045 | 74231 | CGPG5211 | SENSE | 0.191 | 0.235 | 4.000 | 0.000 |
| 1061 | 74264 | CGPG5355 | SENSE | — | — | 4.000 | 0.000 |
| 1062 | 74271 | CGPG5376 | SENSE | 0.390 | 0.096 | 4.000 | 0.000 |
| 1140 | 74373 | CGPG6082 | SENSE | — | — | 4.000 | 0.000 |
| 1223 | 74434 | CGPG6729 | SENSE | −0.073 | 0.551 | 4.000 | 0.000 |
| 1228 | 74515 | CGPG6768 | SENSE | 0.333 | 0.170 | 4.000 | 0.000 |
| 1231 | 74519 | CGPG6800 | SENSE | 0.245 | 0.075 | 4.000 | 0.000 |
| 1230 | 74529 | CGPG6785 | SENSE | 0.186 | 0.034 | 4.000 | 0.000 |
| 876 | 74535 | CGPG268 | SENSE | 0.085 | 0.201 | 4.000 | 0.000 |
| 857 | 74567 | CGPG2349 | SENSE | 0.223 | 0.189 | 4.000 | 0.000 |
| 1215 | 74582 | CGPG6641 | SENSE | — | — | 4.000 | 0.000 |
| 1216 | 74584 | CGPG6642 | SENSE | 0.065 | 0.795 | 4.000 | 0.000 |
| 1146 | 74656 | CGPG6172 | SENSE | 0.225 | 0.005 | 4.000 | 0.000 |
| 1148 | 74659 | CGPG6176 | SENSE | −0.112 | 0.271 | 4.000 | 0.000 |
| 1015 | 74715 | CGPG4937 | SENSE | 0.167 | 0.043 | 4.000 | 0.000 |
| 1116 | 74739 | CGPG5889 | SENSE | 0.154 | 0.356 | 4.000 | 0.000 |
| 1285 | 74845 | CGPG7362 | SENSE | 0.248 | 0.021 | 4.000 | 0.000 |
| 1287 | 74859 | CGPG7379 | SENSE | 0.331 | 0.115 | 4.000 | 0.000 |
| 1294 | 74917 | CGPG7424 | SENSE | 0.028 | 0.885 | 4.000 | 0.000 |
| 1292 | 74928 | CGPG7417 | SENSE | 0.227 | 0.263 | 4.000 | 0.000 |
| 1298 | 74932 | CGPG7449 | SENSE | 0.053 | 0.562 | 4.000 | 0.000 |
| 1297 | 74955 | CGPG7443 | SENSE | 0.232 | 0.010 | 4.000 | 0.000 |
| 1290 | 74962 | CGPG7404 | SENSE | 0.194 | 0.433 | 4.000 | 0.000 |
| 1300 | 74968 | CGPG7452 | SENSE | 0.184 | 0.204 | 4.000 | 0.000 |
| 1295 | 74989 | CGPG7430 | SENSE | 0.098 | 0.494 | 4.000 | 0.000 |
| 1066 | 75002 | CGPG539 | SENSE | 0.529 | 0.001 | 4.000 | 0.000 |
| 1129 | 75094 | CGPG5994 | SENSE | 0.087 | 0.017 | 4.000 | 0.000 |
| 839 | 75221 | CGPG2065 | SENSE | 0.447 | 0.028 | 4.000 | 0.000 |
| 1114 | 75225 | CGPG5868 | SENSE | −0.063 | 0.602 | 4.000 | 0.000 |
| 1119 | 75233 | CGPG5914 | SENSE | — | — | 4.000 | 0.000 |
| 1126 | 75243 | CGPG5977 | SENSE | 0.298 | 0.017 | 4.000 | 0.000 |
| 1165 | 75274 | CGPG6267 | SENSE | −0.038 | 0.744 | 4.000 | 0.000 |
| 1169 | 75291 | CGPG6311 | SENSE | −0.095 | 0.371 | 4.000 | 0.000 |
| 1309 | 75331 | CGPG7516 | SENSE | −0.336 | 0.022 | 4.000 | 0.000 |
| 1316 | 75335 | CGPG7548 | SENSE | −0.059 | 0.778 | 4.000 | 0.000 |
| 1310 | 75343 | CGPG7517 | SENSE | 0.098 | 0.652 | 4.000 | 0.000 |
| 1303 | 75386 | CGPG7481 | SENSE | 0.463 | 0.072 | 4.000 | 0.000 |
| 1315 | 75393 | CGPG7537 | SENSE | −0.122 | 0.605 | 4.000 | 0.000 |
| 1322 | 75442 | CGPG7605 | SENSE | 0.183 | 0.133 | 4.000 | 0.000 |
| 1319 | 75452 | CGPG7590 | SENSE | 0.554 | 0.054 | 4.000 | 0.000 |
| 1317 | 75462 | CGPG7575 | SENSE | 0.244 | 0.345 | 4.000 | 0.000 |
| 1323 | 75466 | CGPG7607 | SENSE | 0.028 | 0.042 | 4.000 | 0.000 |
| 1325 | 75481 | CGPG7632 | SENSE | 0.110 | 0.284 | 4.000 | 0.000 |
| 1341 | 75785 | CGPG7863 | SENSE | −0.038 | 0.826 | 4.000 | 0.000 |
| 1162 | 75814 | CGPG6243 | SENSE | 0.008 | 0.952 | 4.000 | 0.000 |
| 1130 | 75818 | CGPG5996 | SENSE | 0.050 | 0.550 | 4.000 | 0.000 |
| 1236 | 75856 | CGPG6920 | SENSE | 0.118 | 0.579 | 4.000 | 0.000 |
| 1246 | 75878 | CGPG7002 | SENSE | 0.182 | 0.165 | 4.000 | 0.000 |
| 1252 | 75896 | CGPG7080 | SENSE | — | — | 4.000 | 0.000 |
| 1386 | 75904 | CGPG8235 | SENSE | 0.089 | 0.730 | 4.000 | 0.000 |
| 1393 | 75932 | CGPG8269 | SENSE | 0.567 | 0.067 | 4.000 | 0.000 |
| 788 | 75935 | CGPG1335 | SENSE | 0.306 | 0.098 | 4.000 | 0.000 |
| 862 | 75936 | CGPG2397 | SENSE | 0.212 | 0.090 | 4.000 | 0.000 |
| 1389 | 75942 | CGPG8254 | SENSE | 0.038 | 0.373 | 4.000 | 0.000 |
| 1391 | 75943 | CGPG8262 | SENSE | 0.121 | 0.566 | 4.000 | 0.000 |
| 1390 | 75954 | CGPG8255 | SENSE | 0.215 | 0.436 | 4.000 | 0.000 |
| 856 | 76041 | CGPG2348 | SENSE | 0.362 | 0.096 | 4.000 | 0.000 |
| 1241 | 76275 | CGPG6946 | SENSE | −0.079 | 0.533 | 4.000 | 0.000 |
| 1137 | 76610 | CGPG6069 | SENSE | 0.521 | 0.112 | 4.000 | 0.000 |
| 1475 | 76823 | CGPG9060 | SENSE | 0.068 | 0.707 | 4.000 | 0.000 |
| 1482 | 76953 | CGPG9111 | SENSE | −0.271 | 0.139 | 4.000 | 0.000 |
| 820 | 77005 | CGPG1873 | SENSE | 0.235 | 0.102 | 4.000 | 0.000 |
| 1121 | 77008 | CGPG5925 | SENSE | 0.076 | 0.709 | 4.000 | 0.000 |
| 1163 | 77016 | CGPG6248 | SENSE | 0.121 | 0.325 | 4.000 | 0.000 |
| 1492 | 77107 | CGPG9166 | SENSE | 0.036 | 0.900 | 4.000 | 0.000 |
| 1489 | 77129 | CGPG9152 | SENSE | 0.198 | 0.069 | 4.000 | 0.000 |
| 1495 | 77156 | CGPG9178 | SENSE | 0.440 | 0.110 | 4.000 | 0.000 |
| 1484 | 77161 | CGPG9123 | SENSE | 0.265 | 0.223 | 4.000 | 0.000 |
| 1505 | 77229 | CGPG9248 | SENSE | −0.024 | 0.810 | 4.000 | 0.000 |
| 1508 | 77233 | CGPG9280 | SENSE | 0.451 | 0.020 | 4.000 | 0.000 |
| 1503 | 77287 | CGPG9237 | SENSE | 0.249 | 0.157 | 4.000 | 0.000 |
| 1174 | 77319 | CGPG6349 | SENSE | −0.144 | 0.485 | 4.000 | 0.000 |

TABLE 9-continued

| PEP SEQ ID | Construct ID | Nomination ID | Orientation | Root length at day 28 Delta-mean | Root length at day 28 P-value | Growth stage at day 28 Delta mean | Growth stage at day 28 P-value |
|---|---|---|---|---|---|---|---|
| 1122 | 77321 | CGPG5926 | SENSE | −0.241 | 0.172 | 4.000 | 0.000 |
| 1366 | 77346 | CGPG8076 | SENSE | 0.001 | 0.993 | 4.000 | 0.000 |
| 1367 | 77350 | CGPG8084 | SENSE | −0.221 | 0.300 | 4.000 | 0.000 |
| 1376 | 77367 | CGPG8157 | SENSE | 0.130 | 0.228 | 4.000 | 0.000 |
| 1378 | 77370 | CGPG8165 | SENSE | −0.114 | 0.477 | 4.000 | 0.000 |
| 1513 | 77429 | CGPG9315 | SENSE | 0.336 | 0.042 | 4.000 | 0.000 |
| 1239 | 77516 | CGPG6934 | SENSE | 0.452 | 0.002 | 1.413 | 0.409 |
| 1248 | 77525 | CGPG7021 | SENSE | 0.450 | 0.038 | 4.000 | 0.000 |
| 1253 | 77527 | CGPG7094 | SENSE | 0.300 | 0.045 | 4.000 | 0.000 |
| 1261 | 77530 | CGPG7166 | SENSE | −0.031 | 0.790 | 4.000 | 0.000 |
| 925 | 77537 | CGPG3631 | SENSE | 0.167 | 0.539 | 4.000 | 0.000 |
| 1353 | 77559 | CGPG7967 | SENSE | −0.205 | 0.278 | 4.000 | 0.000 |
| 945 | 77717 | CGPG3983 | SENSE | 0.147 | 0.350 | 4.000 | 0.000 |
| 1106 | 77723 | CGPG5785 | SENSE | −0.078 | 0.573 | 4.000 | 0.000 |
| 1358 | 77920 | CGPG8023 | SENSE | — | — | 4.000 | 0.000 |
| 1368 | 77929 | CGPG8093 | SENSE | 0.445 | 0.031 | 4.000 | 0.000 |
| 1371 | 77930 | CGPG8097 | SENSE | 0.039 | 0.737 | 4.000 | 0.000 |
| 1360 | 77961 | CGPG8038 | SENSE | 0.218 | 0.019 | 4.000 | 0.000 |
| 1365 | 77964 | CGPG8073 | SENSE | 0.270 | 0.022 | 2.762 | 0.156 |
| 1415 | 77975 | CGPG8474 | SENSE | 0.116 | 0.035 | 1.333 | 0.423 |
| 1422 | 78014 | CGPG8544 | SENSE | 0.415 | 0.030 | 4.000 | 0.000 |
| 1423 | 78015 | CGPG8546 | SENSE | 0.157 | 0.597 | 4.000 | 0.000 |
| 1428 | 78028 | CGPG8573 | SENSE | 0.238 | 0.346 | 4.000 | 0.000 |
| 1432 | 78047 | CGPG8611 | SENSE | — | — | 4.000 | 0.000 |
| 1435 | 78059 | CGPG8634 | SENSE | −0.009 | 0.947 | 4.000 | 0.000 |
| 1439 | 78062 | CGPG8642 | SENSE | −0.034 | 0.909 | 4.000 | 0.000 |
| 1440 | 78065 | CGPG8646 | SENSE | 0.004 | 0.782 | 4.000 | 0.000 |
| 1176 | 78109 | CGPG6353 | SENSE | 0.198 | 0.277 | 4.000 | 0.000 |
| 1274 | 78112 | CGPG7291 | SENSE | −0.173 | 0.212 | 4.000 | 0.000 |
| 1379 | 78117 | CGPG8169 | SENSE | 0.319 | 0.051 | 4.000 | 0.000 |
| 1398 | 78136 | CGPG8344 | SENSE | 0.410 | 0.030 | 4.000 | 0.000 |
| 1404 | 78153 | CGPG8378 | SENSE | 0.102 | 0.238 | 4.000 | 0.000 |
| 1446 | 78178 | CGPG8716 | SENSE | −0.027 | 0.861 | 4.000 | 0.000 |
| 1449 | 78186 | CGPG8774 | SENSE | −0.002 | 0.993 | 4.000 | 0.000 |
| 998 | 78203 | CGPG4689 | SENSE | 0.001 | 0.995 | 4.000 | 0.000 |
| 1003 | 78207 | CGPG4713 | SENSE | 0.131 | 0.276 | 4.000 | 0.000 |
| 1052 | 78213 | CGPG5254 | SENSE | 0.260 | 0.001 | 4.000 | 0.000 |
| 1326 | 78233 | CGPG7673 | SENSE | 0.169 | 0.183 | 4.000 | 0.000 |
| 1026 | 78349 | CGPG5061 | SENSE | 0.096 | 0.479 | 4.000 | 0.000 |
| 881 | 78362 | CGPG2832 | SENSE | — | — | 4.000 | 0.000 |
| 1416 | 78536 | CGPG8475 | SENSE | −0.104 | 0.537 | 4.000 | 0.000 |
| 1456 | 78589 | CGPG8853 | SENSE | −0.154 | 0.060 | 4.000 | 0.000 |
| 1265 | 78990 | CGPG7192 | SENSE | — | — | 4.000 | 0.000 |

If p<0.05 and delta or risk score mean >0, the transgenic plants showed statistically significant trait enhancement as compared to the reference. If p<0.2 and delta or risk score mean >0, the transgenic plants showed a trend of trait enhancement as compared to the reference.

H. Shade Tolerance Screen

Plants undergo a characteristic morphological response in shade that includes the elongation of the petiole, a change in the leaf angle, and a reduction in chlorophyll content. While these changes may confer a competitive advantage to individuals, in a monoculture the shade avoidance response is thought to reduce the overall biomass of the population. Thus, genetic alterations that prevent the shade avoidance response may be associated with higher yields. Genes that favor growth under low light conditions may also promote yield, as inadequate light levels frequently limit yield. This protocol describes a screen to look for *Arabidopsis* plants that show an attenuated shade avoidance response and/or grow better than control plants under low light intensity. Of particular interest, we were looking for plants that didn't extend their petiole length, had an increase in seedling weight relative to the reference and had leaves that were more close to parallel with the plate surface.

T2 seeds were plated on glufosinate selection plates with ½ MS medium. Seeds were sown on ½× MS salts, 1% Phytagel, 10 ug/ml BASTA. Plants were grown on vertical plates at a temperature of 22° C. at day, 20° C. at night and under low light (approximately 30 uE/m$^2$/s, far/red ratio (655/665/725/735) ~0.35 using PLAQ lights with GAM color filter #680). Twenty-three days after seedlings were sown, measurements were recorded including seedling status, number of rosette leaves, status of flower bud, petiole leaf angle, petiole length, and pooled fresh weights. A digital image of the whole plate was taken on the measurement day. Seedling weight and petiole length were analyzed as quantitative responses according to example 1M. The number of rosette leaves, flowering bud formation and leaf angel were analyzed as qualitative responses according to example 1L.

A list of recombinant DNA constructs that improve shade tolerance in plants illustrated in Table 10:

TABLE 10

| PEP SEQ ID | Construct ID | Nomination ID | Orientation | Seedling weight at day 23 Delta mean | Seedling weight at day 23 P-value | Petiole length at day 23 Delta mean | Petiole length at day 23 P-value |
|---|---|---|---|---|---|---|---|
| 877 | 10204 | CGPG274 | ANTI-SENSE | 0.763 | 0.001 | 0.617 | 0.141 |
| 1136 | 11152 | CGPG606 | SENSE | 0.658 | 0.006 | 0.784 | 0.002 |
| 968 | 11408 | CGPG430 | SENSE | −0.458 | 0.210 | −0.311 | 0.065 |
| 773 | 12224 | CGPG1143 | SENSE | 0.010 | 0.974 | −0.378 | 0.055 |
| 823 | 19122 | CGPG1899 | SENSE | −0.397 | 0.110 | −0.291 | 0.043 |
| 897 | 19537 | CGPG3156 | SENSE | −0.299 | 0.107 | −0.245 | 0.054 |
| 934 | 70466 | CGPG3781 | SENSE | −0.531 | 0.071 | −0.342 | 0.031 |
| 992 | 70680 | CGPG4583 | SENSE | 0.051 | 0.591 | −0.345 | 0.038 |
| 991 | 70764 | CGPG4553 | SENSE | −0.407 | 0.550 | −0.991 | 0.012 |
| 926 | 70833 | CGPG365 | SENSE | −0.195 | 0.201 | −0.247 | 0.084 |
| 997 | 71613 | CGPG4684 | SENSE | −0.464 | 0.031 | −0.328 | 0.014 |
| 1000 | 71631 | CGPG4702 | SENSE | −0.806 | 0.032 | −0.607 | 0.011 |
| 834 | 71702 | CGPG1996 | SENSE | 0.385 | 0.053 | 0.293 | 0.032 |
| 990 | 71820 | CGPG4506 | SENSE | −0.663 | 0.053 | −0.921 | 0.094 |
| 973 | 71952 | CGPG4344 | SENSE | −1.336 | 0.011 | −0.931 | 0.054 |
| 1055 | 72008 | CGPG5265 | SENSE | −0.515 | 0.042 | −0.379 | 0.043 |
| 867 | 72665 | CGPG2452 | SENSE | −0.229 | 0.236 | −0.314 | 0.052 |
| 873 | 72675 | CGPG2567 | SENSE | −1.355 | 0.051 | −1.051 | 0.024 |
| 874 | 72677 | CGPG2571 | SENSE | −1.011 | 0.070 | −1.259 | 0.017 |
| 1092 | 73179 | CGPG5686 | SENSE | 0.230 | 0.030 | 0.186 | 0.133 |
| 1021 | 73309 | CGPG5032 | SENSE | −0.347 | 0.026 | −0.277 | 0.007 |
| 1009 | 73336 | CGPG4848 | SENSE | −1.640 | 0.045 | −1.744 | 0.008 |
| 1199 | 73511 | CGPG6531 | SENSE | 0.103 | 0.505 | −0.210 | 0.016 |
| 1192 | 73551 | CGPG6476 | SENSE | −0.881 | 0.070 | −0.744 | 0.050 |
| 1012 | 73686 | CGPG4892 | SENSE | 0.080 | 0.905 | −1.178 | 0.007 |
| 1079 | 73953 | CGPG5576 | SENSE | 0.381 | 0.054 | 0.325 | 0.098 |
| 1210 | 74123 | CGPG6623 | SENSE | −0.442 | 0.002 | −0.424 | 0.048 |
| 1035 | 74212 | CGPG5155 | SENSE | −0.380 | 0.069 | −0.262 | 0.026 |
| 1023 | 74222 | CGPG5045 | SENSE | −0.913 | 0.051 | −1.766 | 0.051 |
| 1060 | 74261 | CGPG5350 | SENSE | −0.207 | 0.140 | −0.532 | 0.022 |
| 1112 | 74332 | CGPG5837 | SENSE | −0.544 | 0.015 | −0.630 | 0.019 |
| 1219 | 74403 | CGPG6671 | SENSE | −1.289 | 0.039 | −1.057 | 0.038 |
| 1221 | 74443 | CGPG6706 | SENSE | −0.664 | 0.057 | −0.968 | 0.015 |
| 1222 | 74457 | CGPG6723 | SENSE | −0.913 | 0.008 | −0.993 | 0.066 |
| 1226 | 74513 | CGPG6752 | SENSE | −0.405 | 0.010 | −0.356 | 0.042 |
| 1228 | 74515 | CGPG6768 | SENSE | −0.523 | 0.258 | −0.227 | 0.070 |
| 857 | 74567 | CGPG2349 | SENSE | −0.424 | 0.132 | −0.532 | 0.026 |
| 1132 | 74605 | CGPG6027 | SENSE | −0.353 | 0.268 | −0.652 | 0.097 |
| 1135 | 74611 | CGPG6049 | SENSE | −0.732 | 0.015 | −0:985 | 0.023 |
| 1143 | 74626 | CGPG6128 | SENSE | −0.638 | 0.084 | −0.691 | 0.030 |
| 1145 | 74636 | CGPG6149 | SENSE | −0.259 | 0.527 | −0.597 | 0.095 |
| 1217 | 74687 | CGPG6645 | SENSE | −0.882 | 0.027 | −0.431 | 0.024 |
| 1117 | 74748 | CGPG5893 | SENSE | −0.731 | 0.175 | −0.825 | 0.080 |
| 1291 | 74939 | CGPG7410 | SENSE | −0.867 | 0.020 | −0.620 | 0.001 |
| 1301 | 74957 | CGPG7459 | SENSE | −1.058 | 0.008 | −0.937 | 0.088 |
| 1296 | 74990 | CGPG7438 | SENSE | −1.717 | 0.007 | −1.271 | 0.032 |
| 975 | 75040 | CGPG4349 | SENSE | −0.643 | 0.100 | −0.406 | 0.000 |
| 1131 | 75248 | CGPG6021 | SENSE | −0.504 | 0.069 | −0.247 | 0.051 |
| 1133 | 75252 | CGPG6035 | SENSE | −0.395 | 0.097 | −0.290 | 0.072 |
| 1151 | 75267 | CGPG6201 | SENSE | −0.243 | 0.267 | −0.193 | 0.080 |
| 1314 | 75333 | CGPG7532 | SENSE | −0.632 | 0.031 | −0.362 | 0.089 |
| 1308 | 75354 | CGPG7510 | SENSE | −0.658 | 0.018 | −1.165 | 0.019 |
| 1306 | 75365 | CGPG7503 | SENSE | −0.329 | 0.033 | −0.526 | 0.061 |
| 1324 | 75479 | CGPG7616 | SENSE | −1.296 | 0.018 | −1.485 | 0.027. |
| 1327 | 75539 | CGPG7683 | SENSE | −0.463 | 0.183 | −1.074 | 0.052 |
| 1338 | 75608 | CGPG7816 | SENSE | −0.392 | 0.145 | −0.101 | 0.046 |
| 1332 | 75640 | CGPG7787 | SENSE | −0.603 | 0.006 | −0.539 | 0.041 |
| 1047 | 75823 | CGPG5213 | SENSE | −0.433 | 0.132 | −0.505 | 0.076 |
| 1240 | 75864 | CGPG6945 | SENSE | 0.596 | 0.008 | 0.045 | 0.730 |
| 1247 | 75881 | CGPG7013 | SENSE | −1.632 | 0.014 | −1.898 | 0.000 |
| 1250 | 75895 | CGPG7071 | SENSE | −0.808 | 0.006 | −0.543 | 0.084 |
| 1382 | 75913 | CGPG8212 | SENSE | −0.866 | 0.072 | −0.779 | 0.030 |
| 815 | 75957 | CGPG1740 | SENSE | −0.514 | 0.006 | −0.383 | 0.032 |
| 790 | 75993 | CGPG1352 | SENSE | −0.606 | 0.040 | −0.590 | 0.008 |
| 856 | 76041 | CGPG2348 | SENSE | 0.642 | 0.006 | 0.151 | 0.187 |
| 1270 | 76186 | CGPG7243 | SENSE | −0.603 | 0.016 | −0.427 | 0.080 |
| 1271 | 76190 | CGPG7258 | SENSE | −0.032 | 0.887 | −0.125 | 0.011 |
| 1156 | 76222 | CGPG6214 | SENSE | −0.653 | 0.011 | −0.632 | 0.046 |
| 1158 | 76228 | CGPG6222 | SENSE | −0.259 | 0.179 | −0.310 | 0.013 |
| 1463 | 76319 | CGPG8917 | SENSE | −0.354 | 0.147 | −0.767 | 0.097 |
| 1465 | 76320 | CGPG8925 | SENSE | −0.655 | 0.087 | −1.218 | 0.010 |
| 980 | 76410 | CGPG4405 | SENSE | −1.709 | 0.008 | −2.126 | 0.042 |
| 1159 | 76435 | CGPG6229 | SENSE | −0.308 | 0.051 | −0.453 | 0.078 |
| 1249 | 76454 | CGPG7056 | SENSE | −0.603 | 0.016 | −0.821 | 0.052 |

TABLE 10-continued

| PEP SEQ ID | Construct ID | Nomination ID | Orientation | Seedling weight at day 23 | | Petiole length at day 23 | |
|---|---|---|---|---|---|---|---|
| | | | | Delta mean | P-value | Delta mean | P-value |
| 1173 | 76528 | CGPG6336 | SENSE | −0.086 | 0.245 | −0.337 | 0.069 |
| 1157 | 76611 | CGPG6215 | SENSE | −0.624 | 0.077 | −0.668 | 0.008 |
| 1237 | 76642 | CGPG6921 | SENSE | −1.027 | 0.010 | −0.738 | 0.041 |
| 1256 | 76752 | CGPG7118 | SENSE | −0.345 | 0.286 | −0.600 | 0.066 |
| 1470 | 76838 | CGPG8990 | SENSE | −1.442 | 0.073 | −1.521 | 0.049 |
| 1478 | 76927 | CGPG9093 | SENSE | −0.384 | 0.161 | −0.261 | 0.039 |
| 1500 | 77147 | CGPG9201 | SENSE | −0.975 | 0.035 | −0.888 | 0.099 |
| 1498 | 77181 | CGPG9188 | SENSE | −1.360 | 0.000 | −1.347 | 0.016 |
| 1491 | 77190 | CGPG9165 | SENSE | 0.005 | 0.954 | −0.239 | 0.021 |
| 1503 | 77287 | CGPG9237 | SENSE | −0.315 | 0.377 | −0.602 | 0.097 |
| 1348 | 77543 | CGPG7911 | SENSE | −0.166 | 0.104 | −0.676 | 0.072 |
| 1311 | 77809 | CGPG7523 | SENSE | −0.466 | 0.063 | −0.144 | 0.035 |
| 1471 | 77841 | CGPG9001 | SENSE | −0.651 | 0.072 | −0.316 | 0.022 |
| 1361 | 77922 | CGPG8053 | SENSE | −0.447 | 0.020 | −0.270 | 0.050 |
| 1401 | 77973 | CGPG8370 | SENSE | −0.722 | 0.059 | −1.092 | 0.036 |
| 1421 | 78009 | CGPG8533 | SENSE | −0.468 | 0.072 | −0.268 | 0.034 |
| 1427 | 78026 | CGPG8569 | SENSE | −0.555 | 0.154 | −0.467 | 0.085 |
| 1431 | 78044 | CGPG8607 | SENSE | −0.838 | 0.007 | −0.803 | 0.013 |
| 1440 | 78065 | CGPG8646 | SENSE | −0.085 | 0.595 | −0.517 | 0.096 |
| 1377 | 78121 | CGPG8158 | SENSE | 0.274 | 0.079 | 0.172 | 0.036 |
| 1395 | 78135 | CGPG8305 | SENSE | −1.246 | 0.024 | −1.112 | 0.023 |
| 1405 | 78156 | CGPG8383 | SENSE | −0.343 | 0.243 | −1.089 | 0.002 |
| 1280 | 78231 | CGPG7347 | SENSE | −0.441 | 0.022 | −0.297 | 0.084 |
| 1020 | 78339 | CGPG5028 | SENSE | −0.295 | 0.147 | −0.334 | 0.042 |
| 1025 | 78342 | CGPG5051 | SENSE | −1.534 | 0.023 | −1.513 | 0.022 |
| 1013 | 78353 | CGPG4903 | SENSE | −1.018 | 0.043 | −1.290 | 0.020 |
| 970 | 78358 | CGPG4307 | SENSE | −0.531 | 0.022 | −0.430 | 0.066 |
| 1111 | 78371 | CGPG5822 | SENSE | −0.743 | 0.091 | −1.382 | 0.002 |
| 1430 | 78388 | CGPG8597 | SENSE | −0.200 | 0.409 | −0.417 | 0.055 |
| 1064 | 78442 | CGPG5382 | SENSE | −1.106 | 0.000 | −1.187 | 0.012 |
| 1356 | 78508 | CGPG8006 | SENSE | −1.184 | 0.009 | −0.784 | 0.071 |
| 1418 | 78540 | CGPG8490 | SENSE | 0.253 | 0.057 | 0.289 | 0.137 |
| 1450 | 78572 | CGPG8778 | SENSE | −0.586 | 0.088 | −0.474 | 0.070 |
| 1441 | 78590 | CGPG8666 | SENSE | −0.854 | 0.073 | −0.875 | 0.043 |
| 1409 | 78618 | CGPG8450 | SENSE | −0.953 | 0.037 | −1.088 | 0.008 |
| 1451 | 78631 | CGPG8784 | SENSE | −1.128 | 0.250 | −1.224 | 0.048 |
| 1420 | 78924 | CGPG8530 | SENSE | 0.213 | 0.001 | 0.305 | 0.058 |
| 1443 | 78952 | CGPG8688 | SENSE | −0.264 | 0.282 | −0.721 | 0.023 |

For "seeding weight", if p<0.05 and delta or risk score mean >0, the transgenic plants showed statistically significant trait enhancement as compared to the reference. If p<0.2 and delta or risk score mean >0, the transgenic plants showed a trend of trait enhancement as compared to the reference with p<0.2.

For "petiole length", if p<0.05 and delta <0, the transgenic plants showed statistically significant trait enhancement as compared to the reference. If p<0.2 and delta <0, the transgenic plants showed a trend of trait enhancement as compared to the reference.

I. Early Plant Growth and Development Screen

This example sets forth a plate based phenotypic analysis platform for the rapid detection of phenotypes that are evident during the first two weeks of growth. In this screen, we were looking for genes that confer advantages in the processes of germination, seedling vigor, root growth and root morphology under non-stressed growth conditions to plants. The transgenic plants with advantages in seedling growth and development were determined by the seedling weight and root length at day14 after seed planting.

T2 seeds were plated on glufosinate selection plates and grown under standard conditions (~100 uE/m$^2$/s, 16 h photoperiod, 22° C. at day, 20° C. at night). Seeds were stratified for 3 days at 4° C. Seedlings were grown vertically (at a temperature of 22° C. at day 20° C. at night). Observations were taken on day 10 and day 14. Both seedling weight and root length at day 14 were analyzed as quantitative responses according to example 1M.

A list recombinant DNA constructs that improve early plant growth and development illustrated in Table 11.

TABLE 11

| PEP SEQ ID | Construct ID | Orientation | Root length at day 10 | | Root length at day 14 | | Seedling weight at day 14 | |
|---|---|---|---|---|---|---|---|---|
| | | | Delta mean | P-value | Delta mean | P-value | Delta mean | P-value |
| 799 | 10192 | ANTI-SENSE | 0.269 | 0.024 | 0.222 | 0.026 | 0.417 | 0.021 |
| 877 | 10204 | ANTI-SENSE | 0.290 | 0.057 | 0.234 | 0.095 | 0.512 | 0.014 |
| 1328 | 11919 | ANTI-SENSE | 0.207 | 0.249 | 0.115 | 0.330 | 0.537 | 0.035 |

TABLE 11-continued

| PEP SEQ ID | Construct ID | Orientation | Root length at day 10 Delta mean | Root length at day 10 P-value | Root length at day 14 Delta mean | Root length at day 14 P-value | Seedling weight at day 14 Delta mean | Seedling weight at day 14 P-value |
|---|---|---|---|---|---|---|---|---|
| 1083 | 12776 | ANTI-SENSE | 0.237 | 0.002 | 0.092 | 0.280 | 0.233 | 0.147 |
| 835 | 14909 | ANTI-SENSE | 0.151 | 0.053 | 0.074 | 0.582 | 0.398 | 0.001 |
| 858 | 15809 | ANTI-SENSE | 0.212 | 0.184 | 0.066 | 0.493 | 0.403 | 0.061 |
| 938 | 19713 | SENSE | 0.139 | 0.141 | 0.008 | 0.954 | 0.177 | 0.090 |
| 841 | 70403 | SENSE | 0.295 | 0.017 | 0.077 | 0.280 | 0.337 | 0.044 |
| 1037 | 71218 | SENSE | 0.208 | 0.308 | 0.145 | 0.034 | 0.554 | 0.138 |
| 983 | 71963 | SENSE | 0.151 | 0.099 | −0.094 | 0.359 | 0.106 | 0.030 |
| 933 | 72357 | SENSE | 0.164 | 0.073 | −0.033 | 0.571 | −0.168 | 0.023 |
| 1077 | 72755 | SENSE | 0.339 | 0.014 | 0.218 | 0.047 | 0.307 | 0.281 |
| 1074 | 72765 | SENSE | 0.295 | 0.075 | 0.158 | 0.196 | 0.419 | 0.094 |
| 1072 | 72773 | SENSE | 0.185 | 0.051 | 0.111 | 0.183 | 0.239 | 0.057 |
| 880 | 72906 | SENSE | 0.224 | 0.086 | 0.074 | 0.246 | 0.150 | 0.027 |
| 1085 | 73021 | SENSE | 0.134 | 0.098 | 0.141 | 0.083 | 0.217 | 0.036 |
| 1099 | 73135 | SENSE | 0.255 | 0.073 | 0.214 | 0.057 | 0.329 | 0.082 |
| 1046 | 73266 | SENSE | 0.222 | 0.085 | 0.038 | 0.745 | 0.175 | 0.183 |
| 1183 | 73454 | SENSE | 0.276 | 0.046 | 0.201 | 0.131 | 0.277 | 0.234 |
| 1190 | 73525 | SENSE | 0.204 | 0.016 | −0.109 | 0.216 | 0.245 | 0.265 |
| 1196 | 73579 | SENSE | 0.166 | 0.028 | 0.257 | 0.011 | 0.379 | 0.024 |
| 1211 | 74159 | SENSE | 0.413 | 0.025 | 0.218 | 0.012 | 0.548 | 0.010 |
| 1202 | 74163 | SENSE | 0.188 | 0.140 | 0.126 | 0.244 | 0.408 | 0.096 |
| 1214 | 74184 | SENSE | 0.153 | 0.068 | 0.042 | 0.555 | −0.084 | 0.710 |
| 875 | 74534 | SENSE | 0.143 | 0.026 | 0.055 | 0.136 | 0.066 | 0.416 |
| 1285 | 74845 | SENSE | 0.190 | 0.183 | 0.035 | 0.622 | 0.383 | 0.044 |
| 1283 | 74868 | SENSE | 0.111 | 0.017 | 0.081 | 0.014 | 0.257 | 0.041 |
| 1297 | 74955 | SENSE | 0.345 | 0.006 | 0.256 | 0.002 | 0.464 | 0.011 |
| 1066 | 75002 | SENSE | 0.126 | 0.027 | 0.110 | 0.013 | 0.144 | 0.081 |
| 1313 | 75344 | SENSE | 0.100 | 0.079 | 0.015 | 0.296 | 0.083 | 0.541 |
| 1321 | 75489 | SENSE | −0.047 | 0.839 | 0.037 | 0.763 | 0.405 | 0.091 |
| 1162 | 75814 | SENSE | 0.246 | 0.021 | 0.144 | 0.041 | 0.233 | 0.107 |
| 1384 | 75974 | SENSE | 0.133 | 0.034 | 0.103 | 0.037 | 0.214 | 0.109 |
| 843 | 76076 | SENSE | 0.417 | 0.050 | 0.250 | 0.028 | 0.347 | 0.034 |
| 1125 | 76118 | SENSE | 0.200 | 0.035 | 0.127 | 0.024 | 0.311 | 0.125 |
| 1154 | 76221 | SENSE | 0.188 | 0.086 | −0.010 | 0.913 | 0.353 | 0.039 |
| 1233 | 76547 | SENSE | 0.198 | 0.038 | 0.080 | 0.307 | 0.105 | 0.183 |
| 1244 | 76558 | SENSE | 0.279 | 0.036 | 0.239 | 0.005 | 0.290 | 0.026 |
| 1476 | 76836 | SENSE | 0.263 | 0.012 | 0.200 | 0.003 | 0.292 | 0.089 |
| 1488 | 77105 | SENSE | 0.325 | 0.114 | 0.235 | 0.056 | 0.224 | 0.170 |
| 1493 | 77167 | SENSE | 0.186 | 0.004 | −0.068 | 0.308 | 0.235 | 0.068 |
| 1499 | 77193 | SENSE | 0.312 | 0.027 | 0.275 | 0.007 | 0.444 | 0.005 |
| 1352 | 77556 | SENSE | — | — | — | — | 0.468 | 0.001 |
| 1412 | 77630 | SENSE | 0.146 | 0.199 | 0.180 | 0.025 | 0.236 | 0.060 |
| 1380 | 77950 | SENSE | 0.121 | 0.084 | 0.088 | 0.302 | 0.141 | 0.259 |
| 1397 | 77969 | SENSE | 0.461 | 0.009 | 0.375 | 0.008 | 0.503 | 0.001 |
| 1439 | 78062 | SENSE | 0.163 | 0.060 | 0.185 | 0.043 | 0.380 | 0.080 |
| 1445 | 78169 | SENSE | 0.104 | 0.358 | 0.143 | 0.014 | 0.096 | 0.071 |
| 1455 | 78584 | SENSE | 0.164 | 0.056 | −0.020 | 0.749 | −0.108 | 0.303 |
| 1259 | 78740 | SENSE | — | — | — | — | 0.367 | 0.099 |
| 1410 | 78919 | SENSE | 0.273 | 0.052 | 0.155 | 0.085 | 0.225 | 0.310 |
| 1453 | 78938 | SENSE | 0.187 | 0.107 | 0.113 | 0.010 | 0.309 | 0.303 |

If $p<0.05$ and delta or risk score mean >0, the transgenic plants showed statistically significant trait enhancement as compared to the reference. If $p<0.2$ and delta or risk score mean >0, the transgenic plants showed a trend of trait enhancement as compared to the reference.

J. Late Plant Growth and Development Screen

This example sets forth a soil based phenotypic platform to identify genes that confer advantages in the processes of leaf development, flowering production and seed maturity to plants.

*Arabidopsis* plants were grown on a commercial potting mixture (Metro Mix 360, Scotts Co., Marysville, Ohio) consisting of 30-40% medium grade horticultural vermiculite, 35-55% sphagnum peat moss, 10-20% processed bark ash, 1-15% pine bark and a starter nutrient charge. Soil was supplemented with Osmocote time-release fertilizer at a rate of 30 mg/ft$^3$. T2 seeds were imbibed in 1% agarose solution for 3 days at 4° C. and then sown at a to density of ~5 per 2½" pot. Thirty-two pots were ordered in a 4 by 8 grid in standard greenhouse flat. Plants were grown in environmentally controlled rooms under a 16 h day length with an average light intensity of ~200 μmoles/m$^2$/s. Day and night temperature set points were 22° C. and 20° C., respectively. Humidity was maintained at 65%. Plants were watered by sub-irrigation every two days on average until mid-flowering, at which point the plants were watered daily until flowering was complete.

Application of the herbicide glufosinate was performed to select T2 individuals containing the target transgene. A single application of glufosinate was applied when the first true leaves were visible. Each pot was thinned to leave a single glufosinate-resistant seedling ~3 days after the selection was applied.

The rosette radius was measured at day 25. The silique length was measured at day 40. The plant parts were harvested at day 49 for dry weight measurements if flowering production was stopped. Otherwise, the dry weights of rosette and silique were carried out at day 53. The seeds were harvested at day 58. All measurements were analyzed as quantitative responses according to example 1M.

A list of recombinant DNA constructs that improve late plant growth and development illustrated in Table 12.

TABLE 12

| PEP SEQ ID | Construct ID | Rosette dry weight at day 53 | | Rosette radius at day 25 | | Seed net dry weight at day 62 | | Silique dry weight at day 53 | | Silique length at day 40 | |
|---|---|---|---|---|---|---|---|---|---|---|---|
| | | Delta mean | P-value | Delta mean | P-value | Delta mean | P-value | Delta mean | P-value | Delta mean | P-value |
| 1515 | 11935 | 0.099 | 0.072 | −0.093 | 0.030 | 1.235 | 0.027 | 0.041 | 0.679 | 0.039 | 0.247 |
| 762 | 12020 | −0.040 | 0.812 | −0.191 | 0.054 | 0.871 | 0.010 | −0.060 | 0.746 | −0.075 | 0.107 |
| 787 | 12932 | 0.438 | 0.013 | — | — | −0.701 | 0.057 | 0.618 | 0.012 | −0.013 | 0.692 |
| 810 | 14730 | −0.045 | 0.534 | 0.325 | 0.001 | 0.817 | 0.003 | 0.236 | 0.140 | 0.017 | 0.123 |
| 824 | 16446 | −0.152 | 0.214 | −0.097 | 0.367 | 0.701 | 0.032 | 0.055 | 0.450 | −0.017 | 0.832 |
| 902 | 18220 | 0.209 | 0.049 | −0.182 | 0.052 | 0.295 | 0.259 | −0.205 | 0.036 | −0.134 | 0.072 |
| 907 | 18239 | 0.482 | 0.004 | 0.071 | 0.077 | −0.245 | 0.113 | −0.024 | 0.818 | −0.045 | 0.346 |
| 953 | 19933 | 0.211 | 0.020 | — | — | −0.755 | 0.005 | 0.257 | 0.154 | 0.045 | 0.214 |
| 821 | 70410 | −0.208 | 0.070 | — | — | 0.505 | 0.028 | −0.348 | 0.015 | −0.081 | 0.421 |
| 978 | 71846 | −0.285 | 0.012 | — | — | 0.511 | 0.017 | 0.277 | 0.185 | −0.046 | 0.534 |
| 983 | 71963 | −0.146 | 0.231 | −0.035 | 0.312 | 0.421 | 0.037 | 0.120 | 0.131 | 0.037 | 0.048 |
| 1051 | 72049 | 0.351 | 0.153 | −0.047 | 0.683 | 0.419 | 0.025 | −0.108 | 0.180 | 0.024 | 0.493 |
| 1001 | 72368 | 0.282 | 0.013 | −0.407 | 0.051 | −0.912 | 0.082 | −0.244 | 0.208 | −0.096 | 0.017 |
| 993 | 72375 | 0.327 | 0.002 | — | — | −0.261 | 0.014 | 0.022 | 0.324 | 0.042 | 0.076 |
| 1185 | 73445 | −0.042 | 0.704 | −0.126 | 0.091 | 1.499 | 0.015 | −0.037 | 0.330 | 0.009 | 0.633 |
| 852 | 10332 | 0.108 | 0.156 | 0.101 | 0.449 | 0.799 | 0.038 | — | — | −0.072 | 0.208 |
| 810 | 13938 | 0.450 | 0.064 | 0.225 | 0.094 | 0.874 | 0.021 | 0.331 | 0.029 | 0.258 | 0.005 |
| 814 | 13960 | −0.042 | 0.697 | 0.191 | 0.010 | 0.387 | 0.033 | 0.657 | 0.005 | 0.098 | 0.005 |
| 872 | 16607 | 0.246 | 0.041 | 0.170 | 0.076 | −1.029 | 0.012 | −0.675 | 0.018 | 0.197 | 0.029 |
| 914 | 18347 | −0.240 | 0.238 | 0.188 | 0.026 | 1.183 | 0.017 | −0.019 | 0.873 | 0.071 | 0.236 |
| 935 | 70241 | −0.146 | 0.264 | 0.116 | 0.068 | 0.851 | 0.012 | 0.245 | 0.007 | 0.023 | 0.640 |
| 947 | 70909 | −0.163 | 0.084 | −0.026 | 0.345 | 0.792 | 0.004 | 0.484 | 0.011 | 0.647 | 0.001 |
| 949 | 70974 | −0.111 | 0.119 | −0.036 | 0.794 | 1.359 | 0.002 | — | — | −0.027 | 0.476 |
| 979 | 71314 | −0.076 | 0.209 | −0.007 | 0.793 | 0.426 | 0.027 | — | — | 0.021 | 0.098 |
| 987 | 71334 | 1.355 | 0.001 | −0.002 | 0.971 | −0.472 | 0.206 | 0.328 | 0.052 | −0.134 | 0.322 |
| 1109 | 72923 | 0.331 | 0.002 | −0.108 | 0.335 | 1.545 | 0.005 | 0.345 | 0.297 | 0.630 | 0.002 |
| 1042 | 73255 | 0.147 | 0.018 | −0.001 | 0.972 | 0.581 | 0.005 | 0.829 | 0.002 | 0.080 | 0.016 |
| 1028 | 73280 | −0.377 | 0.134 | −0.042 | 0.512 | 0.824 | 0.014 | 0.324 | 0.202 | 0.003 | 0.976 |
| 1189 | 73436 | 0.563 | 0.014 | 0.072 | 0.106 | 0.766 | 0.052 | 0.335 | 0.120 | −0.049 | 0.171 |
| 1191 | 73514 | −0.409 | 0.051 | −0.027 | 0.588 | 0.384 | 0.006 | 0.103 | 0.575 | −0.032 | 0.335 |
| 1197 | 73556 | 0.282 | 0.275 | 0.049 | 0.055 | 0.975 | 0.011 | 0.203 | 0.273 | −0.106 | 0.220 |
| 1208 | 74110 | 0.745 | 0.014 | 0.177 | 0.116 | −0.983 | 0.178 | 1.131 | 0.009 | −0.104 | 0.214 |
| 814 | 74391 | 0.299 | 0.002 | 0.036 | 0.095 | −0.578 | 0.004 | — | — | 0.076 | 0.044 |
| 861 | 74702 | −0.335 | 0.019 | 0.092 | 0.173 | 1.364 | 0.003 | 0.080 | 0.546 | 0.083 | 0.041 |
| 1293 | 74905 | 0.143 | 0.537 | −0.085 | 0.246 | 1.488 | 0.002 | 0.092 | 0.454 | −0.004 | 0.910 |
| 1292 | 74928 | 0.330 | 0.031 | 0.087 | 0.114 | 0.303 | 0.173 | 0.542 | 0.050 | 0.082 | 0.019 |
| 1312 | 75332 | −0.145 | 0.035 | 0.222 | 0.027 | 0.919 | 0.021 | 0.149 | 0.476 | 0.012 | 0.694 |
| 1323 | 75466 | 0.137 | 0.237 | 0.264 | 0.009 | 0.479 | 0.039 | 0.539 | 0.010 | 0.062 | 0.171 |
| 1387 | 75916 | 0.342 | 0.027 | 0.029 | 0.549 | −0.137 | 0.634 | 0.257 | 0.042 | 0.027 | 0.655 |
| 1383 | 75925 | −0.207 | 0.072 | 0.038 | 0.662 | 1.374 | 0.001 | −0.025 | 0.853 | −0.009 | 0.727 |
| 837 | 75945 | 0.550 | 0.001 | −0.188 | 0.113 | 0.440 | 0.022 | 0.050 | 0.769 | −0.236 | 0.045 |
| 1154 | 76221 | −0.042 | 0.742 | 0.090 | 0.132 | 0.863 | 0.002 | 0.295 | 0.139 | 0.029 | 0.469 |
| 1166 | 76233 | 0.115 | 0.162 | 0.110 | 0.160 | 1.062 | 0.008 | 0.196 | 0.005 | 0.065 | 0.343 |
| 1242 | 76276 | 0.295 | 0.029 | 0.058 | 0.333 | 0.732 | 0.022 | 0.258 | 0.110 | −0.060 | 0.400 |
| 1473 | 76865 | −0.084 | 0.474 | −0.155 | 0.034 | 0.719 | 0.039 | 0.267 | 0.104 | −0.005 | 0.968 |
| 1483 | 76965 | 0.107 | 0.469 | −0.329 | 0.058 | 0.446 | 0.001 | 0.067 | 0.770 | −0.174 | 0.320 |
| 1272 | 77071 | −0.354 | 0.006 | 0.108 | 0.020 | 0.854 | 0.002 | −0.200 | 0.125 | 0.012 | 0.647 |
| 1492 | 77107 | 0.077 | 0.748 | −0.026 | 0.709 | 1.343 | 0.003 | −0.451 | 0.256 | −0.092 | 0.349 |
| 1487 | 77116 | −0.064 | 0.634 | 0.048 | 0.066 | 1.289 | 0.003 | 0.006 | 0.935 | 0.004 | 0.475 |
| 1496 | 77168 | −0.287 | 0.410 | −0.105 | 0.148 | 0.389 | 0.018 | −0.407 | 0.281 | −0.069 | 0.161 |
| 1261 | 77530 | 0.535 | 0.050 | −0.055 | 0.706 | −1.462 | 0.041 | — | — | −0.240 | 0.224 |
| 1345 | 77539 | 0.655 | 0.009 | −0.079 | 0.264 | 0.618 | 0.022 | — | — | 0.041 | 0.044 |
| 1347 | 77542 | 0.161 | 0.003 | 0.035 | 0.273 | 0.708 | 0.010 | −0.480 | 0.039 | 0.025 | 0.461 |
| 1350 | 77550 | 0.606 | 0.015 | −0.187 | 0.043 | −0.907 | 0.002 | — | — | −0.338 | 0.044 |
| 1304 | 77807 | −0.079 | 0.511 | 0.078 | 0.184 | 0.770 | 0.008 | 0.162 | 0.258 | 0.039 | 0.112 |
| 1110 | 78501 | 0.073 | 0.568 | −0.202 | 0.040 | 0.292 | 0.006 | — | — | −0.009 | 0.796 |
| 1185 | 73445 | | | | | | | | | | |

If p<0.05 and delta or risk score mean >0, the transgenic plants showed statistically significant trait enhancement as compared to the reference. If p<0.2 and delta or risk score mean >0, the transgenic plants showed a trend of trait enhancement as compared to the reference.

K. Limited Nitrogen Tolerance Screen

Under low nitrogen conditions, *Arabidopsis* seedlings become chlorotic and have less to biomass. This example sets forth the limited nitrogen tolerance screen to identify *Arabidopsis* plants transformed with the gene of interest that are altered in their ability to accumulate biomass and/or retain chlorophyll under low nitrogen condition.

T2 seeds were plated on glufosinate selection plates containing 0.5× N-Free Hoagland's T 0.1 mM NH₄NO₃ T 0.1% sucrose T 1% phytagel media and grown under standard light and temperature conditions. At 12 days of growth, plants were scored for seedling status (i.e., viable or nonviable) and root length. After 21 days of growth, plants were scored for BASTA resistance, visual color, seedling weight, number of green leaves, number of rosette leaves, root length and formation of flowering buds. A photograph of each plant was also taken at this time point.

The seedling weight and root length were analyzed as quantitative responses according to example 1M. The number green leaves, the number of rosette leaves and the flowerbud formation were analyzed as qualitative responses according to example 1L. The leaf color raw data were collected on each plant as the percentages of five color elements (Green, DarkGreen, LightGreen, RedPurple, YellowChlorotic) using a computer imaging system. A statistical logistic regression model was developed to predict an overall value based on five colors for each plant.

A list of recombinant DNA constructs that improve low nitrogen availability tolerance in plants illustrated in Table 13.

TABLE 13

| PEP SEQ ID | Construct ID | Orientation | Root length at day 21 Delta mean | P-value | Leaf color at day 21 Risk score mean | P-value | Rosette weight at day 21 Delta mean | P-value |
|---|---|---|---|---|---|---|---|---|
| 779 | 10176 | ANTI-SENSE | −0.448 | 0.045 | 2.804 | 0.082 | 0.174 | 0.077 |
| 893 | 10217 | ANTI-SENSE | −0.237 | 0.066 | 0.820 | 0.051 | 0.027 | 0.787 |
| 911 | 10230 | ANTI-SENSE | — | — | 3.346 | 0.001 | −0.006 | 0.844 |
| 917 | 10234 | ANTI-SENSE | −0.415 | 0.068 | 7.023 | 0.002 | 0.028 | 0.772 |
| 957 | 10413 | ANTI-SENSE | −0.401 | 0.084 | 3.636 | 0.046 | −0.026 | 0.767 |
| 879 | 10431 | ANTI-SENSE | −0.476 | 0.022 | 3.731 | 0.010 | −0.037 | 0.731 |
| 886 | 10469 | SENSE | −0.570 | 0.002 | 5.909 | 0.004 | 0.019 | 0.652 |
| 878 | 10472 | SENSE | −0.337 | 0.013 | 3.669 | 0.035 | −0.089 | 0.173 |
| 782 | 10507 | ANTI-SENSE | −0.494 | 0.011 | 4.504 | 0.014 | −0.134 | 0.200 |
| 1078 | 10610 | ANTI-SENSE | −0.379 | 0.078 | 0.591 | 0.016 | −0.039 | 0.413 |
| 1108 | 10616 | ANTI-SENSE | −0.462 | 0.013 | 4.827 | 0.058 | −0.122 | 0.054 |
| 1134 | 10620 | ANTI-SENSE | −0.279 | 0.002 | 2.695 | 0.022 | −0.057 | 0.244 |
| 1144 | 10622 | ANTI-SENSE | −0.567 | 0.021 | 4.506 | 0.010 | −0.160 | 0.252 |
| 1212 | 10633 | ANTI-SENSE | −0.320 | 0.051 | 3.471 | 0.012 | −0.165 | 0.055 |
| 1232 | 10638 | ANTI-SENSE | −0.692 | 0.004 | 5.933 | 0.026 | −0.089 | 0.346 |
| 1058 | 10811 | ANTI-SENSE | −0.290 | 0.005 | 1.439 | 0.021 | −0.002 | 0.952 |
| 996 | 11003 | ANTI-SENSE | — | — | 3.118 | 0.019 | −0.138 | 0.054 |
| 1267 | 11022 | ANTI-SENSE | −0.273 | 0.033 | 4.514 | 0.044 | 0.000 | 0.987 |
| 1044 | 11049 | SENSE | −0.173 | 0.177 | 0.986 | 0.059 | 0.086 | 0.406 |
| 941 | 11117 | ANTI-SENSE | −0.707 | 0.027 | 5.220 | 0.004 | −0.112 | 0.488 |
| 958 | 11119 | ANTI-SENSE | — | — | 6.165 | 0.025 | −0.012 | 0.899 |
| 931 | 11319 | ANTI-SENSE | −0.334 | 0.293 | 1.469 | 0.062 | −0.099 | 0.149 |
| 1048 | 11353 | SENSE | −0.152 | 0.034 | 1.063 | 0.058 | −0.072 | 0.044 |
| 1091 | 11516 | ANTI-SENSE | −0.293 | 0.016 | 4.740 | 0.030 | 0.050 | 0.594 |
| 1258 | 11720 | ANTI-SENSE | −0.553 | 0.007 | 4.801 | 0.007 | −0.044 | 0.519 |
| 1357 | 11748 | ANTI-SENSE | −0.181 | 0.032 | 1.491 | 0.022 | 0.034 | 0.679 |
| 1406 | 11807 | ANTI-SENSE | −0.538 | 0.080 | 5.467 | 0.057 | −0.001 | 0.985 |
| 764 | 11827 | ANTI-SENSE | −0.510 | 0.005 | 6.450 | 0.001 | 0.080 | 0.391 |
| 767 | 11836 | ANTI-SENSE | −0.154 | 0.001 | 0.513 | 0.099 | −0.112 | 0.127 |
| 774 | 11856 | ANTI-SENSE | −0.127 | 0.273 | 2.401 | 0.035 | −0.023 | 0.788 |
| 766 | 12015 | SENSE | −0.402 | 0.088 | 0.799 | 0.030 | −0.104 | 0.162 |
| 775 | 12065 | SENSE | 0.264 | 0.121 | 174.221 | 0.424 | 0.193 | 0.012 |
| 768 | 12141 | ANTI-SENSE | −0.343 | 0.001 | 1.939 | 0.010 | −0.059 | 0.278 |
| 777 | 12208 | SENSE | 0.064 | 0.731 | 1.066 | 0.453 | 0.209 | 0.073 |
| 776 | 12419 | ANTI-SENSE | −0.399 | 0.128 | 4.501 | 0.068 | 0.095 | 0.183 |
| 1452 | 12425 | ANTI-SENSE | −0.894 | 0.160 | 4.996 | 0.056 | −0.176 | 0.184 |
| 765 | 12435 | SENSE | 0.101 | 0.355 | −0.040 | 0.909 | 0.135 | 0.066 |
| 770 | 12437 | SENSE | — | — | 1.828 | 0.051 | −0.077 | 0.324 |
| 785 | 13237 | SENSE | −0.287 | 0.009 | 4.272 | 0.017 | 0.169 | 0.174 |
| 795 | 13305 | ANTI-SENSE | −0.221 | 0.051 | 0.981 | 0.076 | −0.062 | 0.543 |
| 943 | 13404 | SENSE | −0.372 | 0.121 | 3.277 | 0.059 | 0.089 | 0.096 |
| 804 | 13650 | ANTI-SENSE | — | — | 3.220 | 0.055 | 0.302 | 0.004 |
| 809 | 13657 | ANTI-SENSE | −0.500 | 0.018 | 5.368 | 0.037 | −0.059 | 0.462 |
| 794 | 13708 | ANTI-SENSE | −0.527 | 0.021 | 4.121 | 0.079 | 0.077 | 0.402 |
| 1153 | 13805 | SENSE | — | — | 5.349 | 0.049 | −0.085 | 0.433 |
| 801 | 13841 | ANTI-SENSE | −0.460 | 0.009 | 5.012 | 0.009 | 0.162 | 0.031 |
| 805 | 13855 | ANTI-SENSE | −0.141 | 0.024 | 1.477 | 0.072 | 0.056 | 0.426 |
| 1477 | 14133 | ANTI-SENSE | −0.461 | 0.074 | 3.450 | 0.085 | 0.012 | 0.868 |
| 803 | 14253 | ANTI-SENSE | — | — | 4.232 | 0.034 | 0.023 | 0.906 |
| 1235 | 14703 | SENSE | −0.450 | 0.039 | 4.394 | 0.019 | −0.001 | 0.990 |
| 797 | 14712 | SENSE | −0.429 | 0.034 | 4.370 | 0.025 | 0.152 | 0.112 |
| 836 | 14927 | ANTI-SENSE | −0.293 | 0.083 | 4.557 | 0.006 | 0.134 | 0.255 |
| 783 | 15039 | SENSE | −0.491 | 0.102 | 4.688 | 0.003 | −0.096 | 0.230 |
| 825 | 15143 | SENSE | — | — | 5.445 | 0.010 | −0.028 | 0.831 |
| 848 | 15716 | ANTI-SENSE | −0.473 | 0.018 | 3.843 | 0.014 | −0.087 | 0.024 |
| 802 | 15805 | SENSE | −0.347 | 0.073 | 3.195 | 0.001 | −0.003 | 0.931 |
| 866 | 17129 | ANTI-SENSE | −0.356 | 0.185 | 2.082 | 0.099 | −0.095 | 0.068 |
| 869 | 17151 | ANTI-SENSE | — | — | 4.021 | 0.022 | 0.024 | 0.747 |
| 868 | 18206 | SENSE | −0.160 | 0.337 | 1.069 | 0.052 | 0.643 | 0.014 |

TABLE 13-continued

| PEP SEQ ID | Construct ID | Orientation | Root length at day 21 Delta mean | P-value | Leaf color at day 21 Risk score mean | P-value | Rosette weight at day 21 Delta mean | P-value |
|---|---|---|---|---|---|---|---|---|
| 906 | 18227 | SENSE | −0.273 | 0.185 | 1.990 | 0.020 | −0.045 | 0.201 |
| 913 | 18271 | SENSE | −0.036 | 0.744 | 0.278 | 0.082 | 0.004 | 0.925 |
| 909 | 18329 | SENSE | −0.220 | 0.418 | 5.264 | 0.067 | 0.118 | 0.119 |
| 890 | 18423 | SENSE | −0.304 | 0.018 | 3.789 | 0.079 | 0.025 | 0.771 |
| 904 | 19205 | SENSE | −0.313 | 0.084 | 0.702 | 0.004 | −0.061 | 0.491 |
| 791 | 19401 | SENSE | −0.032 | 0.850 | 0.086 | 0.874 | 0.161 | 0.096 |
| 859 | 70110 | SENSE | −0.264 | 0.020 | 2.237 | 0.076 | 0.105 | 0.354 |
| 930 | 70440 | SENSE | −0.347 | 0.017 | 1.576 | 0.032 | 0.115 | 0.251 |
| 936 | 70476 | SENSE | −0.297 | 0.072 | 0.965 | 0.044 | −0.141 | 0.095 |
| 977 | 70666 | SENSE | −0.351 | 0.007 | 3.536 | 0.039 | −0.085 | 0.127 |
| 963 | 71250 | SENSE | −0.018 | 0.901 | 2.025 | 0.110 | 0.278 | 0.022 |
| 981 | 71322 | SENSE | −0.046 | 0.431 | 1.676 | 0.080 | 0.026 | 0.628 |
| 984 | 71326 | SENSE | −0.380 | 0.065 | 3.996 | 0.032 | −0.047 | 0.399 |
| 987 | 71334 | SENSE | −0.482 | 0.028 | 3.737 | 0.074 | 0.042 | 0.322 |
| 988 | 71335 | SENSE | −0.264 | 0.060 | 3.812 | 0.035 | 0.133 | 0.220 |
| 971 | 71839 | SENSE | 0.052 | 0.538 | 2.437 | 0.013 | 0.140 | 0.150 |
| 976 | 71843 | SENSE | −0.316 | 0.045 | 1.660 | 0.219 | 0.232 | 0.038 |
| 1127 | 72602 | SENSE | 0.021 | 0.833 | 0.410 | 0.025 | 0.043 | 0.751 |
| 1017 | 72663 | SENSE | 0.002 | 0.989 | −0.270 | 0.862 | 0.199 | 0.016 |
| 873 | 72675 | SENSE | −0.173 | 0.135 | 1.435 | 0.055 | −0.117 | 0.096 |
| 1019 | 72827 | SENSE | −0.264 | 0.054 | 1.909 | 0.080 | 0.000 | 0.995 |
| 1105 | 72933 | SENSE | −0.245 | 0.122 | 3.963 | 0.025 | 0.076 | 0.442 |
| 1043 | 73257 | SENSE | — | — | 4.972 | 0.090 | −0.045 | 0.609 |
| 1029 | 73281 | SENSE | −0.305 | 0.097 | 4.638 | 0.040 | −0.043 | 0.175 |
| 1181 | 73452 | SENSE | 0.043 | 0.102 | 0.097 | 0.808 | 0.154 | 0.053 |
| 969 | 73616 | SENSE | 0.307 | 0.023 | 1.292 | 0.012 | −0.036 | 0.222 |
| 1014 | 73726 | SENSE | −0.049 | 0.097 | 2.396 | 0.041 | −0.024 | 0.788 |
| 855 | 73847 | SENSE | −0.100 | 0.149 | 1.517 | 0.044 | −0.075 | 0.036 |
| 1082 | 73966 | SENSE | −0.273 | 0.001 | 2.969 | 0.035 | −0.179 | 0.224 |
| 853 | 73968 | SENSE | — | — | 4.339 | 0.056 | −0.022 | 0.584 |
| 1205 | 74141 | SENSE | −0.362 | 0.112 | 1.484 | 0.051 | −0.224 | 0.015 |
| 1203 | 74175 | SENSE | −0.305 | 0.069 | 3.974 | 0.023 | −0.007 | 0.901 |
| 1204 | 74176 | SENSE | 0.048 | 0.225 | 1.673 | 0.005 | −0.042 | 0.558 |
| 1206 | 74178 | SENSE | −0.546 | 0.051 | 3.934 | 0.038 | −0.117 | 0.062 |
| 898 | 74201 | SENSE | −0.223 | 0.046 | 1.264 | 0.077 | −0.200 | 0.018 |
| 1023 | 74222 | SENSE | — | — | 5.858 | 0.048 | −0.076 | 0.268 |
| 1139 | 74371 | SENSE | — | — | 4.728 | 0.007 | −0.117 | 0.322 |
| 1140 | 74373 | SENSE | −0.027 | 0.715 | −0.646 | 0.465 | 0.106 | 0.051 |
| 1224 | 74447 | SENSE | −0.867 | 0.064 | 3.200 | 0.055 | −0.197 | 0.206 |
| 1135 | 74611 | SENSE | −0.189 | 0.350 | 2.233 | 0.060 | −0.118 | 0.205 |
| 1142 | 74620 | SENSE | −0.736 | 0.094 | 5.605 | 0.047 | 0.004 | 0.979 |
| 1113 | 74738 | SENSE | 0.036 | 0.145 | −0.181 | 0.528 | 0.168 | 0.098 |
| 1284 | 74809 | SENSE | −0.256 | 0.031 | 2.481 | 0.053 | −0.021 | 0.606 |
| 1282 | 74820 | SENSE | −0.173 | 0.032 | 1.129 | 0.036 | −0.168 | 0.064 |
| 1286 | 74870 | SENSE | −0.448 | 0.051 | 4.227 | 0.061 | −0.103 | 0.154 |
| 1289 | 74950 | SENSE | −0.115 | 0.085 | 1.801 | 0.070 | −0.107 | 0.291 |
| 1004 | 75209 | SENSE | −0.231 | 0.065 | 2.947 | 0.046 | 0.008 | 0.887 |
| 1152 | 75283 | SENSE | −0.190 | 0.011 | 0.627 | 0.047 | −0.038 | 0.323 |
| 1306 | 75365 | SENSE | 0.125 | 0.219 | 1.830 | 0.047 | −0.056 | 0.569 |
| 1302 | 75374 | SENSE | −0.326 | 0.031 | 2.123 | 0.080 | −0.193 | 0.015 |
| 1321 | 75489 | SENSE | 0.208 | 0.053 | −4.236 | 0.035 | 0.184 | 0.054 |
| 1329 | 75603 | SENSE | 0.035 | 0.604 | 0.552 | 0.179 | 0.124 | 0.009 |
| 1332 | 75640 | SENSE | −0.353 | 0.018 | 3.264 | 0.026 | −0.152 | 0.231 |
| 1334 | 75653 | SENSE | −0.256 | 0.151 | 3.269 | 0.076 | −0.023 | 0.755 |
| 1343 | 75716 | SENSE | 0.292 | 0.079 | 2.436 | 0.028 | −0.066 | 0.580 |
| 1386 | 75904 | SENSE | 0.254 | 0.052 | −1.863 | 0.084 | 0.312 | 0.025 |
| 1392 | 75967 | SENSE | — | — | 1.628 | 0.003 | −0.038 | 0.729 |
| 1260 | 76157 | SENSE | — | — | 2.689 | 0.064 | 0.155 | 0.058 |
| 1273 | 76194 | SENSE | — | — | 7.881 | 0.009 | −0.078 | 0.728 |
| 1463 | 76319 | SENSE | — | — | 7.442 | 0.029 | −0.388 | 0.417 |
| 1468 | 76334 | SENSE | −0.338 | 0.068 | 1.019 | 0.036 | −0.036 | 0.517 |
| 1461 | 76340 | SENSE | −0.159 | 0.020 | 0.346 | 0.061 | −0.026 | 0.682 |
| 1464 | 76343 | SENSE | −0.042 | 0.710 | 0.257 | 0.390 | 0.111 | 0.081 |
| 1466 | 76380 | SENSE | — | — | 2.459 | 0.019 | −0.130 | 0.254 |
| 1469 | 76382 | SENSE | −0.693 | 0.013 | 5.109 | 0.008 | −0.304 | 0.007 |
| 980 | 76410 | SENSE | −0.203 | 0.007 | 3.337 | 0.004 | −0.107 | 0.294 |
| 1264 | 76756 | SENSE | — | — | 3.459 | 0.034 | −0.147 | 0.126 |
| 1470 | 76838 | SENSE | — | — | 4.610 | 0.021 | −0.067 | 0.168 |
| 1479 | 76963 | SENSE | — | — | 1.779 | 0.046 | −0.188 | 0.096 |
| 1507 | 77265 | SENSE | — | — | 2.573 | 0.025 | −0.097 | 0.265 |
| 1504 | 77276 | SENSE | — | — | 3.580 | 0.010 | −0.113 | 0.219 |
| 1120 | 77311 | SENSE | — | — | 2.744 | 0.032 | −0.035 | 0.696 |

TABLE 13-continued

| PEP SEQ ID | Construct ID | Orientation | Root length at day 21 Delta mean | P-value | Leaf color at day 21 Risk score mean | P-value | Rosette weight at day 21 Delta mean | P-value |
|---|---|---|---|---|---|---|---|---|
| 1346 | 77540 | SENSE | −0.322 | 0.016 | 3.433 | 0.004 | −0.164 | 0.013 |
| 1355 | 77565 | SENSE | — | — | 2.221 | 0.006 | −0.026 | 0.272 |
| 1359 | 77573 | SENSE | −0.404 | 0.005 | 5.266 | 0.007 | 0.092 | 0.178 |
| 1501 | 77853 | SENSE | — | — | 4.686 | 0.004 | −0.072 | 0.264 |
| 1400 | 78142 | SENSE | — | — | 3.787 | 0.059 | 0.010 | 0.566 |
| 1437 | 78163 | SENSE | — | — | 1.541 | 0.029 | 0.038 | 0.603 |
| 1457 | 78252 | SENSE | — | — | 5.384 | 0.026 | −0.043 | 0.728 |
| 1516 | 78259 | SENSE | — | — | 3.387 | 0.036 | 0.004 | 0.928 |
| 1024 | 78341 | SENSE | — | — | 4.261 | 0.040 | −0.056 | 0.478 |
| 1025 | 78342 | SENSE | −0.469 | 0.027 | 7.592 | 0.050 | −0.272 | 0.023 |
| 1013 | 78353 | SENSE | — | — | 7.028 | 0.040 | 0.013 | 0.930 |
| 972 | 78417 | SENSE | 0.041 | 0.366 | −0.590 | 0.551 | 0.282 | 0.076 |
| 1266 | 78460 | SENSE | — | — | 2.353 | 0.087 | −0.159 | 0.017 |
| 1356 | 78508 | SENSE | — | — | 4.369 | 0.001 | −0.241 | 0.000 |
| 1370 | 78510 | SENSE | −0.216 | 0.041 | 3.626 | 0.043 | −0.125 | 0.126 |
| 1407 | 78528 | SENSE | — | — | 4.716 | 0.014 | −0.241 | 0.075 |
| 1444 | 78559 | SENSE | — | — | 4.385 | 0.022 | −0.029 | 0.877 |
| 1171 | 78607 | SENSE | — | — | 4.547 | 0.049 | −0.162 | 0.319 |
| 959 | 78659 | SENSE | — | — | 6.713 | 0.013 | −0.060 | 0.637 |
| 974 | 78717 | SENSE | — | — | 1.926 | 0.179 | 0.121 | 0.013 |
| 1022 | 78725 | SENSE | −0.157 | 0.213 | 1.656 | 0.054 | 0.028 | 0.683 |
| 1161 | 78743 | SENSE | — | — | 2.003 | 0.048 | 0.107 | 0.258 |
| 1413 | 78921 | SENSE | — | — | 2.641 | 0.040 | 0.039 | 0.795 |
| 1454 | 78961 | SENSE | −0.475 | 0.006 | 4.949 | 0.000 | 0.002 | 0.972 |
| 1403 | 78963 | SENSE | — | — | 5.358 | 0.057 | 0.042 | 0.725 |
| 961 | 78969 | SENSE | — | — | 2.921 | 0.097 | 0.196 | 0.127 |
| 964 | 78972 | SENSE | — | — | 1.621 | 0.050 | 0.009 | 0.814 |

For rosette weight, if p<0.05 and delta or risk score mean >0, the transgenic plants showed statistically significant trait enhancement as compared to the reference. If p<0.2 and delta or risk score mean >0, the transgenic plants showed a trend of trait enhancement as compared to the reference with p<0.2. For root length, if p<0.05, the transgenic plants showed statistically significant trait enhancement as compared to the reference. if p<0.2, the transgenic plants showed a trend of trait enhancement as compared to the reference.

L. Statistic Analysis for Qualitative Responses

A list of responses that were analyzed as qualitative responses illustrated in Table 14.

TABLE 14

| response | Screen | categories (success vs. failure) |
|---|---|---|
| Wilting response Risk Score | Soil drought tolerance screen | non-wilted vs. wilted |
| growth stage at day 14 | heat stress tolerance screen | 50% of plants reach stage1.03 vs. not |
| growth stage at day 14 | salt stress tolerance screen | 50% of plants reach stage1.03 vs. not |
| growth stage at day 14 | PEG induced osmotic stress tolerance screen | 50% of plants reach stage1.03 vs. not |
| growth stage at day 7 | cold germination tolerance screen | 50% of plants reach stage 0.5 vs. not |
| number of rosette leaves at day 23 | Shade tolerance screen | 5 leaves appeared vs. not |
| Flower bud formation at day 23 | Shade tolerance screen | flower buds appear vs. not |
| leaf angle at day 23 | Shade tolerance screen | >60 degree vs. <60 degree |
| number of green leaves at day 21 | limited nitrogen tolerance screen | 6 or 7 leaves appeared vs. not |
| number of rosette leaves at day 21 | limited nitrogen tolerance screen | 6 or 7 leaves appeared vs. not |
| Flower bud formation at day 21 | limited nitrogen tolerance screen | flower buds appear vs. not |

Plants were grouped into transgenic and reference groups and were scored as success or failure according to Table 14. First, the risk (R) was calculated, which is the proportion of plants that were scored as of failure plants within the group. Then the relative risk (RR) was calculated as the ratio of R (transgenic) to R (reference). Risk score (RS) was calculated as $-\log_2{RR}$. Subsequently the risk scores from multiple events for each transgene of interest were evaluated for statistical significance by t-test using SAS statistical software (SAS 9, SAS/STAT User's Guide, SAS institute Inc, Cary, N.C., USA). RS with a value greater than 0 indicates that the transgenic plants perform better than the reference. RS with a value less than 0 indicates that the transgenic plants perform worse than the reference. The RS with a value equal to 0 indicates that the performance of the transgenic plants and the reference don't show any difference.

M. Statistic Analysis for Quantitative Responses

A list of responses that were analyzed as quantitative responses illustrated in Table 15.

TABLE 15

| response | screen |
|---|---|
| seed yield | Soil drought stress tolerance screen |
| seedling weight at day 14 | heat stress tolerance screen |
| root length at day 14 | heat stress tolerance screen |
| seedling weight at day 14 | salt stress tolerance screen |
| root length at day 14 | salt stress tolerance screen |
| root length at day 11 | salt stress tolerance screen |
| seedling weight at day 14 | PEG induced osmotic stress tolerance screen |
| root length at day 11 | PEG induced osmotic stress tolerance screen |
| root length at day 14 | PEG induced osmotic stress tolerance screen |
| rosette area at day 8 | cold shock tolerance screen |
| rosette area at day 28 | cold shock tolerance screen |

TABLE 15-continued

| response | screen |
| --- | --- |
| difference in rosette area from day 8 to day 28 | cold shock tolerance screen |
| root length at day 28 | cold germination tolerance screen |
| seedling weight at day 23 | Shade tolerance screen |
| petiole length at day 23 | Shade tolerance screen |
| root length at day 14 | Early plant growth and development screen |
| Seedling weight at day 14 | Early plant growth and development screen |
| Rosette dry weight at day 53 | Late plant growth and development screen |
| rosette radius at day 25 | Late plant growth and development screen |
| seed dry weight at day 58 | Late plant growth and development screen |
| silique dry weight at day 53 | Late plant growth and development screen |
| silique length at day 40 | Late plant growth and development screen |
| Seedling weight at day 21 | Limited nitrogen tolerance screen |
| Root length at day 21 | Limited nitrogen tolerance screen |

The measurements (M) of each plant were transformed by $\log_2$ calculation. The Delta was calculated as $\log_2 M$(transgenic)–$\log_2 M$(reference). Subsequently the mean delta from multiple events of the transgene of interest was evaluated for statistical significance by t-test using SAS statistical software (SAS 9, SAS/STAT User's Guide, SAS Institute Inc, Cary, N.C., USA). The Delta with a value greater than 0 indicates that the transgenic plants perform better than the reference. The Delta with a value less than 0 indicates that the transgenic plants perform worse than the reference. The Delta with a value equal to 0 indicates that the performance of the transgenic plants and the reference don't show any difference.

Example 2

Identification of Homologs

A BLAST searchable "All Protein Database" is constructed of known protein sequences using a proprietary sequence database and the National Center for Biotechnology Information (NCBI) non-redundant amino acid database (nr.aa). For each organism from which a DNA sequence provided herein was obtained, an "Organism Protein Database" is constructed of known protein sequences of the organism; the Organism Protein Database is a subset of the All Protein Database based on the NCBI taxonomy ID for the organism.

The All Protein Database is queried using amino acid sequence of cognate protein for gene DNA used in trait-improving recombinant DNA, i.e., sequences of SEQ ID NO: 760 through SEQ ID NO: 1518 using "blastp" with E-value cutoff of 1e-8. Up to 1000 top hits were kept, and separated by organism names. For each organism other than that of the query sequence, a list is kept for hits from the query organism itself with a more significant E-value than the best hit of the organism. The list contains likely duplicated genes, and is referred to as the Core List. Another list was kept for all the hits from each organism, sorted by E-value, and referred to as the Hit List.

The Organism Protein Database is queried using amino acid sequences of SEQ ID NO: 760 through SEQ ID NO: 1518 using "blastp" with E-value cutoff of 1e-4. Up to 1000 top hits are kept. A BLAST searchable database is constructed based on these hits, and is referred to as "SubDB".

SubDB was queried with each sequence in the Hit List using "blastp" with E-value cutoff of 1e-8. The hit with the best E-value is compared with the Core List from the corresponding organism. The hit is deemed a likely ortholog if it belongs to the Core List, otherwise it is deemed not a likely ortholog and there is no further search of sequences in the Hit List for the same organism. Likely orthologs from a large number of distinct organisms were identified and are reported by amino acid sequences of SEQ ID NO: 1519 to SEQ ID NO: 67778. These orthologs are reported in Tables 16 as homologs to the proteins cognate to genes used in trait-improving recombinant DNA.

Example 3

Consensus Sequence Build

ClustalW program is selected for multiple sequence alignments of an amino acid sequence of SEQ ID NO: 760 and its homologs, through SEQ ID NO: 1518 and its homologs. Three major factors affecting the sequence alignments dramatically are (1) protein weight matrices; (2) gap open penalty; (3) gap extension penalty. Protein weight matrices available for ClustalW program include Blosum, Pam and Gonnet series. Those parameters with gap open penalty and gap extension penalty were extensively tested. On the basis of the test results, Blosum weight matrix, gap open penalty of 10 and gap extension penalty of 1 were chosen for multiple sequence alignment. The consensus sequence of SEQ ID NO: 768 and its 17 homologs were derived according to the procedure described above and is displayed in FIGS. 4A-4D.

Example 4

Pfam Module Annoation

This example illustrates the identification of domain and domain module by Pfam analysis.

The amino acid sequence of the expressed proteins that were shown to be associated with an enhanced trait were analyzed for Pfam protein family against the current Pfam collection of multiple sequence alignments and hidden Markov models using the HMMER software. The Pfam domain modules and individual protein domain for the proteins of SEQ ID NO: 760 through 1518 are shown in Table 17 and Table 18 respectively. The Hidden Markov model databases for the identified patent families allow identification of other homologous proteins and their cognate encoding DNA to enable the full breadth of the invention for a person of ordinary skill in the art. Certain proteins are identified by a single Pfam domain and others by multiple Pfam domains. For instance, the protein with amino acids of SEQ ID NO: 766 is characterized by two Pfam domains, i.e. "FHA" and "PP2C". See also the protein with amino acids of SEQ ID NO: 1515 which is characterized by seven copies of the Pfam domain "WD40". In Table 18 "score" is the gathering score for the Hidden Markov Model of the domain which exceeds the gathering cutoff reported in Table 19.

TABLE 17

| PEP SEQ ID | Construct ID | Module | Position |
|---|---|---|---|
| 760 | CGPG1022.pep | RRM_1 | 95-165 |
| 761 | CGPG1035.pep | Peptidase_C54 | 82-373 |
| 763 | CGPG105.pep | AP2 | 48-112 |
| 764 | CGPG1060.pep | DUF788 | 1-169 |
| 765 | CGPG1069.pep | NDUF_B7 | 2-81 |
| 766 | CGPG108.pep | FHA::PP2C | 208-284::309-570 |
| 771 | CGPG1136.pep | RRM_1 | 22-87 |
| 774 | CGPG1145.pep | NUDIX | 24-160 |
| 776 | CGPG1173.pep | adh_short | 6-181 |
| 777 | CGPG1176.pep | F-box | 2-50 |
| 779 | CGPG122.pep | PTR2 | 113-517 |
| 780 | CGPG126.pep | Response_reg | 34-158 |
| 781 | CGPG1262.pep | Gar1 | 51-152 |
| 782 | CGPG128.pep | Response_reg | 25-149 |
| 783 | CGPG1280.pep | DUF676 | 515-717 |
| 784 | CGPG1291.pep | DUF862 | 2-156 |
| 785 | CGPG1295.pep | TMEM14 | 7-104 |
| 787 | CGPG1315.pep | Brix | 60-255 |
| 788 | CGPG1335.pep | LRR_1 | 424-447 |
| 789 | CGPG1344.pep | Pkinase | 496-767 |
| 790 | CGPG1352.pep | Pkinase_Tyr | 154-425 |
| 791 | CGPG1364.pep | Pkinase | 38-416 |
| 793 | CGPG1396.pep | malic::Malic_M | 106-295::297-550 |
| 794 | CGPG1398.pep | Glycolytic | 11-358 |
| 795 | CGPG1399.pep | Metallophos | 161-360 |
| 796 | CGPG1429.pep | NTP_transferase::Hexapep::Hexapep | 86-365::413-430::466-483 |
| 797 | CGPG1430.pep | E1_dh | 89-393 |
| 798 | CGPG1445.pep | Pkinase | 33-294 |
| 799 | CGPG146.pep | p450 | 38-482 |
| 800 | CGPG1492.pep | Aldedh | 29-491 |
| 801 | CGPG1528.pep | ATP_synt_H | 1-70 |
| 802 | CGPG1530.pep | ArfGap::C2 | 15-137::183-262 |
| 803 | CGPG1535.pep | SPT2 | 230-329 |
| 804 | CGPG1546.pep | CTP_transf_1 | 101-300 |
| 805 | CGPG1567.pep | Ribosomal_L19 | 107-212 |
| 806 | CGPG1568.pep | FAD_binding_4 | 82-221 |
| 807 | CGPG1575.pep | DUF740 | 24-595 |
| 808 | CGPG1619.pep | Pyr_redox_2::Pyr_redox_dim | 27-343::373-483 |
| 810 | CGPG1641.pep | Di19 | 11-219 |
| 811 | CGPG1651.pep | DEAD::Helicase_C::DSHCT | 69-220::378-462::800-988 |
| 812 | CGPG1656.pep | Cyt-b5::FA_desaturase | 9-82::145-399 |
| 813 | CGPG1668.pep | DUF791::MFS_1 | 4-358::42-406 |
| 815 | CGPG1740.pep | DUF860 | 25-364 |
| 816 | CGPG177.pep | WD40::WD40 | 168-205::257-296 |
| 817 | CGPG1785.pep | PB1::Pkinase_Tyr | 179-266::863-1126 |
| 818 | CGPG182.pep | LRR_1::LRR_1::LRR_1::LRR_1::LRR_1::LRR_1::LRR_1::LRR_1::LRR_1::LRR_1::LRR_1::LRR_1::LRR_1::LRR_1 | 46-67::69-90::115-136::161-183::208-229::231-252::276-297::382-403::405-427::429-451::477-498::500-521::523-544 |
| 819 | CGPG1837.pep | TFIIS_M::SPOC | 328-445::656-762 |
| 820 | CGPG1873.pep | Pkinase::NAF | 20-275::314-374 |
| 823 | CGPG1899.pep | F-box::Kelch_1::Kelch_1 | 18-65::139-186::189-235 |
| 824 | CGPG1913.pep | F-box::FBA_1 | 31-78::268-416 |
| 825 | CGPG1918.pep | F-box | 30-77 |
| 826 | CGPG1919.pep | F-box | 65-112 |
| 827 | CGPG1922.pep | F-box::Kelch_1::Kelch_1 | 25-72::118-163::165-210 |
| 828 | CGPG1929.pep | F-box | 1-44 |
| 829 | CGPG1938.pep | F-box::LRR_2 | 8-55::159-185 |
| 830 | CGPG1956.pep | Pre-SET::SET | 409-558::560-702 |
| 831 | CGPG1964.pep | zf-C3HC4::YDG_SRA | 109-147::228-345 |
| 832 | CGPG1973.pep | zf-UBR | 40-109 |
| 833 | CGPG1977.pep | TFIIF_alpha | 18-542 |
| 834 | CGPG1996.pep | Pkinase | 3-286 |
| 835 | CGPG2005.pep | NADPH_Ox::Ferric_reduct::FAD_binding_8::NAD_binding_6 | 130-229::352-511::552-671::677-850 |
| 837 | CGPG2044.pep | PTR2 | 99-507 |
| 838 | CGPG2059.pep | Nuc_sug_transp | 104-340 |
| 839 | CGPG2065.pep | PEARLI-4 | 342-611 |
| 841 | CGPG2072.pep | DUF1639 | 264-300 |
| 842 | CGPG2074.pep | HMA::HMA | 75-138::173-235 |
| 843 | CGPG2116.pep | NOI | 1-67 |
| 845 | CGPG2142.pep | MATH::MATH | 101-233::258-375 |
| 847 | CGPG2190.pep | DJ-1_PfpI::DJ-1_PfpI | 34-174::240-378 |
| 849 | CGPG221.pep | DnaJ::DnaJ_CXXCXGXG::DnaJ_C | 35-96::160-243::256-378 |
| 850 | CGPG2213.pep | RNA_pol_I_A49 | 83-441 |
| 851 | CGPG2247.pep | DUF23 | 256-497 |
| 852 | CGPG228.pep | p450 | 67-511 |
| 853 | CGPG2301.pep | PC_rep::PC_rep::PC_rep::PC_rep::PC_rep::PC_rep | 414-447::448-484::485-519::523-557::671-705::706-740 |

TABLE 17-continued

| PEP SEQ ID | Construct ID | Module | Position |
|---|---|---|---|
| 854 | CGPG2304.pep | Phi_1 | 32-309 |
| 856 | CGPG2348.pep | Gal-bind_lectin::Galactosyl_T | 165-343::385-580 |
| 857 | CGPG2349.pep | IQ::IQ | 120-140::142-162 |
| 858 | CGPG2354.pep | ABC1 | 183-306 |
| 859 | CGPG2369.pep | DAGK_cat | 228-368 |
| 860 | CGPG2382.pep | WD40::WD40::WD40::WD40 | 65-103::106-144::197-235::240-278 |
| 861 | CGPG2392.pep | UBX | 311-392 |
| 862 | CGPG2397.pep | AA_permease | 64-510 |
| 863 | CGPG240.pep | Hydrolase | 22-210 |
| 865 | CGPG2433.pep | DUF23 | 289-544 |
| 868 | CGPG2464.pep | Glyco_transf_8 | 83-345 |
| 869 | CGPG2472.pep | Band_7 | 35-227 |
| 870 | CGPG2480.pep | Prefoldin | 53-175 |
| 871 | CGPG253.pep | HEAT::HEAT::HEAT::HEAT::HEAT::HEAT::HEAT::HEAT::HEAT::HEAT::HEAT::HEAT | 82-117::158-194::197-233::236-272::275-311::314-350::353-389::392-428::431-467::470-506::509-545::548-584 |
| 872 | CGPG2538.pep | PfkB | 7-297 |
| 873 | CGPG2567.pep | zf-C3HC4 | 372-412 |
| 874 | CGPG2571.pep | zf-C3HC4 | 146-187 |
| 875 | CGPG258.pep | Cyclin_N::Cyclin_C | 185-310::312-433 |
| 876 | CGPG268.pep | PTR2 | 97-514 |
| 877 | CGPG274.pep | WD40::WD40::WD40 | 259-298::303-342::350-389 |
| 878 | CGPG275.pep | PP2C | 32-271 |
| 879 | CGPG277.pep | IGPD | 103-247 |
| 880 | CGPG2785.pep | SIR2 | 52-216 |
| 881 | CGPG2832.pep | Myb_DNA-binding | 195-243 |
| 883 | CGPG2865.pep | SRF-TF | 17-67 |
| 884 | CGPG2874.pep | polyprenyl_synt | 123-383 |
| 885 | CGPG2914.pep | AP2 | 84-142 |
| 886 | CGPG295.pep | Pro_isomerase | 96-256 |
| 888 | CGPG3009.pep | Arf | 4-184 |
| 889 | CGPG3030.pep | Pkinase | 4-301 |
| 890 | CGPG3048.pep | adh_short | 18-186 |
| 891 | CGPG3056.pep | PP2C | 76-341 |
| 893 | CGPG309.pep | Cyclin_N | 4-143 |
| 894 | CGPG3094.pep | C2 | 6-87 |
| 895 | CGPG3095.pep | F-box::LRR_2::FBD | 5-52::163-188::374-426 |
| 896 | CGPG3137.pep | Spermine_synth | 54-313 |
| 897 | CGPG3156.pep | DEAD::Helicase_C | 33-212::279-355 |
| 898 | CGPG3157.pep | DEAD::Helicase_C | 175-355::427-503 |
| 899 | CGPG3205.pep | F-box::Kelch_1::Kelch_1 | 130-177::220-269::347-389 |
| 900 | CGPG3236.pep | Thioredoxin | 4-108 |
| 901 | CGPG3248.pep | Copine | 102-250 |
| 902 | CGPG3255.pep | NTP_transferase::Hexapep::Hexapep::Hexapep::Hexapep | 10-246::294-311::312-329::335-352::379-396 |
| 903 | CGPG3258.pep | UDPGT | 23-484 |
| 904 | CGPG3261.pep | Pkinase | 79-334 |
| 907 | CGPG3283.pep | Mo25 | 1-339 |
| 908 | CGPG3302.pep | SRF-TF::K-box | 9-59::76-174 |
| 909 | CGPG3334.pep | GRP | 1-113 |
| 910 | CGPG3361.pep | DUF1644 | 38-255 |
| 911 | CGPG337.pep | Glyco_transf_8 | 19-264 |
| 912 | CGPG3400.pep | IQ | 304-324 |
| 914 | CGPG3424.pep | TFIIS_C | 79-117 |
| 915 | CGPG3428.pep | DUF914 | 136-435 |
| 916 | CGPG3465.pep | zf-MYND::UCH | 57-94::326-630 |
| 917 | CGPG347.pep | DREPP | 1-225 |
| 919 | CGPG3567.pep | DUF581 | 63-121 |
| 920 | CGPG3575.pep | Mago-bind | 22-48 |
| 921 | CGPG3579.pep | SNARE | 141-203 |
| 926 | CGPG365.pep | MATH::BTB | 53-182::206-328 |
| 927 | CGPG3665.pep | BNR::BNR::BNR | 138-149::189-200::239-250 |
| 928 | CGPG3684.pep | Pro_dh | 113-464 |
| 929 | CGPG3690.pep | MtN3_slv::MtN3_slv | 10-97::131-217 |
| 930 | CGPG3717.pep | OTU | 219-331 |
| 931 | CGPG372.pep | SET | 83-212 |
| 934 | CGPG3781.pep | SRF-TF | 11-65 |
| 935 | CGPG380.pep | Histone | 25-94 |
| 936 | CGPG3821.pep | F-box::FBA_3 | 5-52::205-281 |
| 937 | CGPG3824.pep | WRKY | 107-169 |
| 938 | CGPG3901.pep | 2OG-FeII_Oxy | 166-271 |
| 939 | CGPG391.pep | Histone | 58-132 |
| 941 | CGPG394.pep | DUF6::TPT | 11-152::170-319 |
| 942 | CGPG3964.pep | Pyr_redox | 174-248 |
| 943 | CGPG397.pep | SOR_SNZ::ThiG | 24-229::123-290 |
| 945 | CGPG3983.pep | DUF6::DUF6 | 31-164::213-342 |
| 946 | CGPG3986.pep | WD40::WD40 | 160-197::249-288 |
| 947 | CGPG3991.pep | SNARE_assoc | 111-232 |

TABLE 17-continued

| PEP SEQ ID | Construct ID | Module | Position |
|---|---|---|---|
| 948 | CGPG4050.pep | PP2C | 49-327 |
| 949 | CGPG4070.pep | Not3::NOT2_3_5 | 2-246::693-881 |
| 950 | CGPG4071.pep | Pkinase_Tyr | 135-389 |
| 951 | CGPG4099.pep | 14-3-3 | 6-243 |
| 952 | CGPG4138.pep | adh_short | 44-217 |
| 953 | CGPG4152.pep | RRM_1 | 11-78 |
| 954 | CGPG4153.pep | HMG-CoA_red | 190-583 |
| 955 | CGPG4164.pep | PP2C | 22-322 |
| 956 | CGPG4169.pep | WD40::WD40::WD40::WD40 | 253-291::298-336::340-378::510-549 |
| 957 | CGPG421.pep | Pkinase::efhand::efhand::efhand::efhand | 22-280::327-355::363-391::399-427::433-461 |
| 958 | CGPG4222.pep | Pkinase | 73-331 |
| 959 | CGPG4223.pep | SRF-TF | 23-76 |
| 960 | CGPG4240.pep | F-box | 8-56 |
| 961 | CGPG4242.pep | PP2C | 58-341 |
| 962 | CGPG4248.pep | efhand::efhand::efhand | 10-38::89-117::127-155 |
| 963 | CGPG425.pep | Pkinase_Tyr | 8-260 |
| 964 | CGPG4265.pep | Cys_Met_Meta_PP | 42-432 |
| 965 | CGPG4283.pep | Dehydrin | 36-183 |
| 966 | CGPG4297.pep | Globin | 10-149 |
| 967 | CGPG43.pep | Aa_trans | 46-481 |
| 968 | CGPG430.pep | Pkinase | 8-264 |
| 969 | CGPG4305.pep | Rib_5-P_isom_A | 85-273 |
| 970 | CGPG4307.pep | Orn_Arg_deC_N::Orn_DAP_Arg_deC | 98-348::351-459 |
| 971 | CGPG4315.pep | PPR::PPR::PPR::PPR::PPR::PPR | 139-173::209-243::286-320::321-355::356-390::391-425 |
| 972 | CGPG4320.pep | DUF6::DUF6 | 20-153::190-319 |
| 973 | CGPG4344.pep | Mito_carr::Mito_carr::Mito_carr | 13-98::104-199::203-297 |
| 975 | CGPG4349.pep | Aha1_N::AHSA1 | 29-165::233-291 |
| 976 | CGPG4365.pep | CCT | 220-258 |
| 978 | CGPG4389.pep | Aminotran_1_2 | 23-376 |
| 979 | CGPG4404.pep | p450 | 37-514 |
| 980 | CGPG4405.pep | p450 | 69-504 |
| 981 | CGPG4419.pep | p450 | 33-477 |
| 982 | CGPG4432.pep | p450 | 70-528 |
| 984 | CGPG4443.pep | p450 | 32-551 |
| 985 | CGPG445.pep | PLAT::Lipoxygenase | 54-159::171-843 |
| 986 | CGPG4453.pep | p450 | 40-500 |
| 987 | CGPG4481.pep | Glyco_hydro_17 | 34-352 |
| 988 | CGPG4490.pep | AMP-binding | 42-473 |
| 989 | CGPG4498.pep | Glyco_hydro_1 | 40-516 |
| 990 | CGPG4506.pep | RRM_1 | 18-89 |
| 991 | CGPG4553.pep | DUF313 | 158-265 |
| 992 | CGPG4583.pep | HIT | 43-142 |
| 993 | CGPG4643.pep | Pkinase | 400-656 |
| 994 | CGPG4650.pep | Pkinase | 141-425 |
| 996 | CGPG468.pep | Fer4::Fer4 | 116-139::155-178 |
| 997 | CGPG4684.pep | MIP | 11-232 |
| 998 | CGPG4689.pep | LRRNT_2::LRR_1::LRR_1::Pkinase | 29-70::120-144::144-165::261-532 |
| 999 | CGPG4691.pep | PCI | 281-385 |
| 1000 | CGPG4702.pep | DUF6::TPT | 106-231::240-385 |
| 1001 | CGPG4703.pep | TPT | 205-349 |
| 1002 | CGPG4710.pep | CPSase_L_chain::CPSase_L_D2::CPSase_L_D3::CPSase_L_chain::CPSase_L_D2::MGS | 97-217::219-455::515-638::648-775::777-989::1061-1148 |
| 1003 | CGPG4713.pep | DUF231 | 241-420 |
| 1004 | CGPG4730.pep | DHquinase_I::Shikimate_dh_N::Shikimate_DH | 96-313::328-408::440-558 |
| 1005 | CGPG4747.pep | UQ_con | 8-145 |
| 1006 | CGPG4755.pep | Cpn60_TCP1 | 30-520 |
| 1008 | CGPG4779.pep | Peptidase_M22 | 27-305 |
| 1009 | CGPG4848.pep | PGAM | 77-246 |
| 1010 | CGPG4879.pep | SIS::CBS | 64-197::229-350 |
| 1011 | CGPG4882.pep | TFIIS | 121-206 |
| 1012 | CGPG4892.pep | DUF260 | 5-105 |
| 1013 | CGPG4903.pep | DUF260 | 7-108 |
| 1014 | CGPG4925.pep | WD40::WD40::WD40::WD40 | 74-112::116-153::207-245::249-287 |
| 1015 | CGPG4937.pep | NLE::WD40::WD40::WD40::WD40 | 11-79::140-182::195-233::262-299::348-387 |
| 1016 | CGPG4949.pep | Pkinase | 208-470 |
| 1017 | CGPG4971.pep | SKI | 11-177 |
| 1018 | CGPG499.pep | Voltage_CLC::CBS | 138-560::593-759 |
| 1019 | CGPG5004.pep | Adh_short | 53-224 |
| 1020 | CGPG5028.pep | Adh_short | 42-200 |
| 1021 | CGPG5032.pep | Adh_short | 48-216 |
| 1022 | CGPG5038.pep | DUF26::DUF26::Pkinase | 74-134::200-254::345-620 |
| 1023 | CGPG5045.pep | LRRNT_2::LRR_1::LRR_1::LRR_1::LRR_1::Pkinase | 24-67::97-119::122-144::146-168::170-192::306-576 |
| 1024 | CGPG5048.pep | LRRNT_2::LRR_1::LRR_1::LRR_1::LRR_1::LRR_1::Pkinase | 22-59::89-111::113-135::137-159::161-182::183-205::307-578 |
| 1025 | CGPG5051.pep | AOX | 45-323 |

TABLE 17-continued

| PEP SEQ ID | Construct ID | Module | Position |
|---|---|---|---|
| 1026 | CGPG5061.pep | Fibrillarin | 1-99 |
| 1027 | CGPG5062.pep | Skp1_POZ::Skp1 | 6-66::86-163 |
| 1028 | CGPG5069.pep | Skp1_POZ::Skp1 | 4-64::89-167 |
| 1029 | CGPG5070.pep | Skp1_POZ::Skp1 | 4-64::72-150 |
| 1030 | CGPG5097.pep | Pkinase | 295-579 |
| 1031 | CGPG510.pep | Rho_GDI | 20-223 |
| 1032 | CGPG5100.pep | Pkinase | 353-615 |
| 1033 | CGPG5117.pep | efhand_like::PI-PLC-X::PI-PLC-Y::C2 | 25-105::107-251::294-412::430-523 |
| 1034 | CGPG5151.pep | p450 | 1-282 |
| 1035 | CGPG5155.pep | p450 | 27-493 |
| 1036 | CGPG5159.pep | p450 | 26-520 |
| 1037 | CGPG516.pep | HD::RelA_SpoT | 233-337::427-537 |
| 1038 | CGPG5161.pep | p450 | 31-503 |
| 1039 | CGPG5186.pep | Thioredoxin | 70-172 |
| 1040 | CGPG519.pep | Abhydrolase_1 | 59-279 |
| 1041 | CGPG5190.pep | Ribosomal_L37 | 15-125 |
| 1042 | CGPG5191.pep | TPR_2 | 166-199 |
| 1044 | CGPG521.pep | Abhydrolase_1 | 65-282 |
| 1045 | CGPG5211.pep | DUF827 | 16-271 |
| 1047 | CGPG5213.pep | DUF623 | 143-203 |
| 1048 | CGPG522.pep | FA_desaturase | 62-277 |
| 1049 | CGPG5223.pep | PGM_PMM_I::PGM_PMM_II::PGM_PMM_III::PGM_PMM_IV | 79-222::251-360::362-486::507-612 |
| 1050 | CGPG5224.pep | LRR_1::LRR_1::LRR_1::LRR_1::LRR_1::LRR_1::LRR_1::LRR_1 | 231-252::254-275::277-298::300-321::323-344::369-390::392-413::440-461 |
| 1051 | CGPG5225.pep | p450 | 37-452 |
| 1052 | CGPG5254.pep | 2OG-FeII_Oxy | 162-279 |
| 1053 | CGPG5257.pep | SpoIIE | 130-374 |
| 1054 | CGPG5262.pep | SH3_1 | 303-359 |
| 1056 | CGPG5282.pep | F-box::Sel1::Sel1::zf-MYND | 17-69::129-167::168-203::273-317 |
| 1058 | CGPG532.pep | Transket_pyr::Transketolase_C | 30-207::222-342 |
| 1059 | CGPG5336.pep | adh_short | 19-188 |
| 1060 | CGPG5350.pep | Aminotran_4 | 107-395 |
| 1061 | CGPG5355.pep | GRAM | 95-173 |
| 1062 | CGPG5376.pep | DUF21::CBS | 14-191::210-326 |
| 1063 | CGPG5377.pep | CBS | 81-226 |
| 1064 | CGPG5382.pep | B56 | 93-416 |
| 1065 | CGPG5385.pep | Pyridoxal_deC | 146-452 |
| 1066 | CGPG539.pep | Citrate_synt | 78-455 |
| 1067 | CGPG5437.pep | IQ | 115-135 |
| 1068 | CGPG5450.pep | DHDPS | 64-341 |
| 1069 | CGPG5473.pep | Xan_ur_permease | 31-438 |
| 1070 | CGPG55.pep | Sugar_tr | 6-719 |
| 1071 | CGPG5505.pep | AlaDh_PNT_N::AlaDh_PNT_C::Saccharop_dh_N::Saccharop_dh | 18-154::194-400::477-583::589-1060 |
| 1073 | CGPG5514.pep | Cyclin_N::Cyclin_C | 165-294::296-422 |
| 1074 | CGPG5541.pep | Pkinase | 316-590 |
| 1075 | CGPG5546.pep | Cyclin | 108-264 |
| 1076 | CGPG5552.pep | Cornichon | 2-125 |
| 1077 | CGPG5556.pep | SAC3_GANP | 20-211 |
| 1078 | CGPG557.pep | Chitin_bind_1::Barwin | 21-62::73-191 |
| 1079 | CGPG5576.pep | zf-PARP::zf-PARP::PADR1::BRCT::WGR::PARP_reg::PARP | 11-88::117-195::290-343::394-471::517-605::633-765::767-979 |
| 1080 | CGPG5596.pep | Response_reg | 9-143 |
| 1081 | CGPG5605.pep | DEAD::Helicase_C | 52-221::290-366 |
| 1082 | CGPG5606.pep | LRRNT_2::LRR_1::LRR_1::LRR_1::LRR_1::LRR_1::LRR_1::LRR_1::LRR_1::LRR_1::LRR_1::LRR_1::LRR_1::LRR_1::LRR_1::LRR_1::LRR_1::LRR_1::LRR_1::LRR_1::LRR_1::Pkinase | 21-62::90-113::115-137::140-162::164-186::188-211::213-235::237-259::261-283::308-330::332-354::356-375::380-402::404-426::428-450::452-474::500-522::524-546::548-570::571-592::683-964 |
| 1083 | CGPG561.pep | XG_FTase | 54-532 |
| 1084 | CGPG5618.pep | Lectin_legB::Pkinase | 20-247::376-651 |
| 1085 | CGPG5642.pep | Aldedh | 18-477 |
| 1086 | CGPG5644.pep | ELFV_dehydrog_N::ELFV_dehydrog | 51-181::197-428 |
| 1087 | CGPG5647.pep | Aldedh | 46-511 |
| 1088 | CGPG5655.pep | Glutaminase | 23-309 |
| 1089 | CGPG5660.pep | Glutaminase | 24-308 |
| 1090 | CGPG5662.pep | Aminotran_3 | 47-381 |
| 1091 | CGPG568.pep | FTHFS | 14-634 |
| 1092 | CGPG5686.pep | Aminotran_3 | 31-387 |
| 1093 | CGPG5702.pep | Gln-synt_N::Gln-synt_C | 28-109::116-397 |
| 1094 | CGPG5712.pep | Pribosyltran | 22-158 |
| 1095 | CGPG5713.pep | Rib_5-P_isom_A | 55-229 |
| 1096 | CGPG5715.pep | Pribosyltran | 27-163 |
| 1097 | CGPG5723.pep | NDK | 4-138 |
| 1098 | CGPG5729.pep | Cyclin_N::Cyclin_C | 210-336::338-457 |

TABLE 17-continued

| PEP SEQ ID | Construct ID | Module | Position |
|---|---|---|---|
| 1099 | CGPG5730.pep | Lung_7-TM_R | 151-444 |
| 1101 | CGPG5741.pep | NIF | 165-344 |
| 1102 | CGPG5752.pep | CAF1 | 161-404 |
| 1103 | CGPG5771.pep | Acyltransferase | 84-277 |
| 1104 | CGPG5778.pep | Aa_trans | 51-498 |
| 1105 | CGPG5782.pep | Sugar_tr | 65-525 |
| 1106 | CGPG5785.pep | Sugar_tr | 69-530 |
| 1107 | CGPG5797.pep | AA_permease | 94-562 |
| 1108 | CGPG580.pep | MGDG_synth::Glyco_tran_28_C | 155-323::349-512 |
| 1109 | CGPG5805.pep | AA_permease | 57-511 |
| 1110 | CGPG5810.pep | Ank::Ank::Pkinase_Tyr | 74-106::107-139::200-468 |
| 1111 | CGPG5822.pep | Pkinase | 131-418 |
| 1112 | CGPG5837.pep | Pkinase | 14-275 |
| 1113 | CGPG5855.pep | Pkinase | 81-363 |
| 1114 | CGPG5868.pep | Pkinase_Tyr | 45-312 |
| 1115 | CGPG587.pep | FKBP_C | 104-208 |
| 1117 | CGPG5893.pep | Pkinase | 52-314 |
| 1118 | CGPG5909.pep | ADH_zinc_N | 163-310 |
| 1119 | CGPG5914.pep | ADH_N::ADH_zinc_N | 54-188::219-362 |
| 1123 | CGPG5930.pep | Mov34 | 328-437 |
| 1124 | CGPG5945.pep | Pyr_redox_2 | 8-305 |
| 1125 | CGPG5958.pep | Pyr_redox_2 | 8-304 |
| 1126 | CGPG5977.pep | Ank::Ank::Ank::Pkinase | 48-80::81-113::114-146::166-424 |
| 1127 | CGPG598.pep | Nramp | 66-429 |
| 1128 | CGPG5986.pep | Pkinase | 43-329 |
| 1129 | CGPG5994.pep | F-box::LRR_2 | 62-108::314-340 |
| 1130 | CGPG5996.pep | Tetraspannin | 4-230 |
| 1131 | CGPG6021.pep | RRM_1::RRM_1 | 8-77::108-178 |
| 1132 | CGPG6027.pep | RRM_1 | 42-113 |
| 1133 | CGPG6035.pep | Pyr_redox_2::efhand | 51-370::376-404 |
| 1134 | CGPG604.pep | PSI_PsaH | 6-145 |
| 1136 | CGPG606.pep | Phytochelatin::DUF1984 | 46-178::179-259 |
| 1137 | CGPG6069.pep | RNA_pol_A_bac | 124-268 |
| 1138 | CGPG608.pep | TB2_DP1_HVA22 | 11-108 |
| 1139 | CGPG6080.pep | Str_synth | 144-232 |
| 1140 | CGPG6082.pep | Ras | 8-179 |
| 1141 | CGPG6089.pep | NicO | 153-372 |
| 1143 | CGPG6128.pep | Reticulon | 22-197 |
| 1144 | CGPG614.pep | cobW | 74-246 |
| 1145 | CGPG6149.pep | Glutaredoxin | 84-148 |
| 1146 | CGPG6172.pep | Ras | 11-173 |
| 1147 | CGPG6174.pep | Ras | 19-180 |
| 1148 | CGPG6176.pep | Ras | 15-177 |
| 1149 | CGPG6197.pep | Phi_1 | 55-334 |
| 1150 | CGPG620.pep | tRNA-synt_1g | 71-430 |
| 1152 | CGPG6204.pep | mTERF | 75-357 |
| 1153 | CGPG621.pep | RRM_1 | 19-90 |
| 1154 | CGPG6210.pep | Sugar_tr | 29-459 |
| 1155 | CGPG6211.pep | Sugar_tr | 24-479 |
| 1156 | CGPG6214.pep | Sugar_tr | 26-487 |
| 1157 | CGPG6215.pep | PTR2 | 93-486 |
| 1158 | CGPG6222.pep | Sugar_tr | 27-490 |
| 1159 | CGPG6229.pep | Sugar_tr | 28-490 |
| 1160 | CGPG6233.pep | MFS_1 | 37-473 |
| 1161 | CGPG6237.pep | Sugar_tr | 25-483 |
| 1162 | CGPG6243.pep | Pkinase | 25-333 |
| 1163 | CGPG6248.pep | Pkinase::NAF | 22-276::306-366 |
| 1164 | CGPG6252.pep | Pkinase::NAF | 12-266::298-358 |
| 1165 | CGPG6267.pep | Pkinase | 68-306 |
| 1166 | CGPG6272.pep | Pkinase | 74-349 |
| 1167 | CGPG6294.pep | Pkinase | 75-352 |
| 1168 | CGPG63.pep | p450 | 44-511 |
| 1170 | CGPG6317.pep | PTR2 | 101-488 |
| 1171 | CGPG6328.pep | Trehalose_PPase | 121-354 |
| 1172 | CGPG6334.pep | Sterol_desat | 34-245 |
| 1173 | CGPG6336.pep | Sterol_desat | 38-247 |
| 1174 | CGPG6349.pep | LRR_1::LRR_1::LRR_1::LRR_1::LRR_1::LRR_1::LRR_1 | 42-62::64-84::108-128::130-151::153-174::176-197::199-219 |
| 1175 | CGPG6352.pep | zf-CCHC | 81-98 |
| 1177 | CGPG6364.pep | Gp_dh_N::Gp_dh_C | 3-152::157-313 |
| 1178 | CGPG6366.pep | Gp_dh_N::Gp_dh_C | 3-153::158-314 |
| 1179 | CGPG6375.pep | Aminotran_1_2 | 36-390 |
| 1180 | CGPG6388.pep | NTP_transferase | 15-285 |
| 1181 | CGPG6391.pep | ADH_N::ADH_zinc_N | 32-143::172-312 |
| 1182 | CGPG6399.pep | ADH_N::ADH_zinc_N | 27-155::186-332 |
| 1183 | CGPG6407.pep | Glucokinase | 5-341 |
| 1184 | CGPG6418.pep | ADH_N::ADH_zinc_N | 28-156::187-333 |
| 1185 | CGPG6430.pep | Iso_dh | 6-355 |

TABLE 17-continued

| PEP SEQ ID | Construct ID | Module | Position |
|---|---|---|---|
| 1186 | CGPG6432.pep | ADH_N::ADH_zinc_N | 25-135::166-305 |
| 1187 | CGPG6437.pep | TPT | 205-388 |
| 1188 | CGPG6445.pep | Aldedh | 45-511 |
| 1189 | CGPG6450.pep | Aldedh | 26-491 |
| 1190 | CGPG6458.pep | Aldedh | 22-480 |
| 1191 | CGPG6465.pep | PfkB | 10-314 |
| 1192 | CGPG6476.pep | PFK | 3-278 |
| 1193 | CGPG6505.pep | Aminotran_3 | 123-449 |
| 1194 | CGPG6507.pep | Gln-synt_N::Gln-synt_C | 105-187::193-446 |
| 1195 | CGPG6509.pep | Glutaminase | 112-396 |
| 1196 | CGPG6510.pep | Aldedh | 17-476 |
| 1197 | CGPG6515.pep | Aldedh | 19-476 |
| 1198 | CGPG6520.pep | Aldedh | 29-491 |
| 1199 | CGPG6531.pep | Enolase_N::Enolase_C | 3-133::138-425 |
| 1200 | CGPG6553.pep | Aldedh | 103-563 |
| 1201 | CGPG6557.pep | ELFV_dehydrog_N::ELFV_dehydrog | 145-275::290-533 |
| 1202 | CGPG6563.pep | Aminotran_1_2 | 120-472 |
| 1203 | CGPG6564.pep | iPGM_N::Metalloenzyme | 90-451::461-576 |
| 1204 | CGPG6572.pep | Gp_dh_N::Gp_dh_C | 91-241::246-402 |
| 1205 | CGPG6577.pep | iPGM_N::Metalloenzyme | 92-451::461-577 |
| 1206 | CGPG6588.pep | Pyr_redox_2::Pyr_redox_dim | 92-409::437-546 |
| 1207 | CGPG6596.pep | Biotin_lipoyl::E3_binding::2-oxoacid_dh | 91-164::228-264::296-521 |
| 1209 | CGPG6619.pep | Transketolase_N::Transket_pyr::Transketolase_C | 101-435::450-627::639-754 |
| 1210 | CGPG6623.pep | PGAM | 96-330 |
| 1211 | CGPG6626.pep | OstA | 109-219 |
| 1212 | CGPG663.pep | Pro_CA | 155-325 |
| 1213 | CGPG6635.pep | Cytochrom_C | 126-204 |
| 1215 | CGPG6641.pep | AstE_AspA | 93-372 |
| 1216 | CGPG6642.pep | Transket_pyr::Transketolase_C | 125-303::319-443 |
| 1217 | CGPG6645.pep | TIM | 95-336 |
| 1218 | CGPG6660.pep | CBS | 97-214 |
| 1219 | CGPG6671.pep | NTP_transferase | 102-374 |
| 1220 | CGPG6697.pep | Transaldolase | 100-400 |
| 1221 | CGPG6706.pep | iPGM_N::Metalloenzyme | 90-451:461-576 |
| 1222 | CGPG6723.pep | Aminotran_1_2 | 124-478 |
| 1223 | CGPG6729.pep | Gln-synt_N::Gln-synt_C | 100-182::189-470 |
| 1224 | CGPG6738.pep | Aminotran_1_2 | 123-473 |
| 1225 | CGPG6742.pep | Aldedh | 105-563 |
| 1226 | CGPG6752.pep | TIM | 92-334 |
| 1227 | CGPG6760.pep | GATase_2::Asn_synthase | 2-164::241-531 |
| 1228 | CGPG6768.pep | PGI | 55-545 |
| 1229 | CGPG6779.pep | Isoamylase_N::Alpha-amylase | 105-182::219-613 |
| 1230 | CGPG6785.pep | Molybdop_Fe4S4::Molybdopterin::Molydop_binding | 44-105::108-660::892-1011 |
| 1231 | CGPG6800.pep | PGI | 52-541 |
| 1232 | CGPG686.pep | RRM_1::zf-CCHC | 9-80::118-135 |
| 1233 | CGPG6898.pep | Hin1 | 28-163 |
| 1234 | CGPG6900.pep | Pkinase | 97-365 |
| 1236 | CGPG6920.pep | Dehydrin | 14-128 |
| 1237 | CGPG6921.pep | CorA | 48-440 |
| 1240 | CGPG6945.pep | SNARE | 37-99 |
| 1241 | CGPG6946.pep | MATH | 13-133 |
| 1242 | CGPG6948.pep | PAP2 | 100-233 |
| 1243 | CGPG6974.pep | DUF538 | 7-146 |
| 1244 | CGPG6976.pep | DUF926 | 293-406 |
| 1245 | CGPG6996.pep | CPDase | 1-179 |
| 1246 | CGPG7002.pep | zf-C3HC4 | 123-157 |
| 1247 | CGPG7013.pep | zf-C3HC4 | 115-156 |
| 1248 | CGPG7021.pep | Invertase_neut | 98-564 |
| 1251 | CGPG7075.pep | DUF1749 | 77-349 |
| 1252 | CGPG7080.pep | Glutaredoxin | 44-106 |
| 1253 | CGPG7094.pep | DUF300 | 6-281 |
| 1254 | CGPG7095.pep | Abhydrolase_3 | 107-321 |
| 1255 | CGPG7104.pep | Saccharop_dh | 13-445 |
| 1256 | CGPG7118.pep | F-box | 25-73 |
| 1257 | CGPG7122.pep | Pkinase | 20-280 |
| 1258 | CGPG713.pep | Cyclin_N | 5-135 |
| 1259 | CGPG7130.pep | CS | 145-220 |
| 1260 | CGPG7145.pep | Transthyretin | 191-310 |
| 1261 | CGPG7166.pep | DnaJ | 79-141 |
| 1262 | CGPG7179.pep | Bystin | 127-423 |
| 1263 | CGPG7184.pep | PBD | 27-127 |
| 1264 | CGPG7185.pep | GAF::HisKA | 190-346::382-445 |
| 1265 | CGPG7192.pep | 2OG-FeII_Oxy | 201-301 |
| 1266 | CGPG7199.pep | RWD | 3-122 |
| 1267 | CGPG72.pep | Amino_oxidase | 66-528 |
| 1268 | CGPG7231.pep | B3_4::B5 | 118-280::305-378 |
| 1269 | CGPG7241.pep | Peptidase_C26 | 58-281 |

TABLE 17-continued

| PEP SEQ ID | Construct ID | Module | Position |
|---|---|---|---|
| 1272 | CGPG7265.pep | ARM_1 | 12-296 |
| 1273 | CGPG7274.pep | DUF640 | 36-168 |
| 1274 | CGPG7291.pep | eIF-1a | 20-91 |
| 1275 | CGPG7303.pep | Aldedh | 20-484 |
| 1276 | CGPG7315.pep | Y_phosphatase2 | 116-280 |
| 1278 | CGPG7327.pep | Actin | 2-470 |
| 1280 | CGPG7347.pep | Tcp11 | 648-1133 |
| 1281 | CGPG7348.pep | CorA | 90-467 |
| 1283 | CGPG7356.pep | Metallophos | 2-120 |
| 1284 | CGPG7359.pep | Methyltransf_12 | 38-133 |
| 1286 | CGPG7372.pep | zf-C3HC4 | 119-160 |
| 1287 | CGPG7379.pep | zf-C3HC4 | 36-76 |
| 1288 | CGPG7398.pep | DUF212 | 22-167 |
| 1289 | CGPG7403.pep | TLD | 203-341 |
| 1290 | CGPG7404.pep | PBP | 25-170 |
| 1291 | CGPG7410.pep | HLH | 36-83 |
| 1292 | CGPG7417.pep | MMR_HSR1 | 131-252 |
| 1293 | CGPG7423.pep | Gln-synt_N::Gln-synt_C | 102-183::190-471 |
| 1294 | CGPG7424.pep | FBPase | 92-424 |
| 1297 | CGPG7443.pep | DUF1001 | 92-274 |
| 1298 | CGPG7449.pep | ScpA_ScpB | 104-347 |
| 1301 | CGPG7459.pep | DUF1350 | 90-360 |
| 1303 | CGPG7481.pep | Abhydrolase_1 | 113-361 |
| 1304 | CGPG7483.pep | GTP_EFTU::GTP_EFTU_D2::EFG_C | 62-260::281-355::461-551 |
| 1306 | CGPG7503.pep | PBP | 19-170 |
| 1307 | CGPG7504.pep | MSF1 | 15-187 |
| 1309 | CGPG7516.pep | DUF783 | 25-229 |
| 1312 | CGPG7524.pep | lsy1 | 1-292 |
| 1313 | CGPG7525.pep | UFD1 | 10-184 |
| 1315 | CGPG7537.pep | KTI12 | 1-291 |
| 1317 | CGPG7575.pep | Efhand | 95-123 |
| 1318 | CGPG7577.pep | TP_methylase | 1-213 |
| 1319 | CGPG7590.pep | Ribonuc_L-PSP | 61-179 |
| 1321 | CGPG7601.pep | CCT | 237-275 |
| 1322 | CGPG7605.pep | RRM_1 | 88-158 |
| 1323 | CGPG7607.pep | Amidohydro_2 | 10-289 |
| 1325 | CGPG7632.pep | zf-Tim10_DDP | 12-77 |
| 1326 | CGPG7673.pep | zf-MYND::UCH | 76-113::468-774 |
| 1327 | CGPG7683.pep | zf-LSD1::zf-LSD1::zf-LSD1 | 28-52::67-91::105-129 |
| 1328 | CGPG773.pep | H_PPase | 64-798 |
| 1329 | CGPG7776.pep | DUF525 | 311-445 |
| 1330 | CGPG7781.pep | SapB_1::SapB_2::SapB_1::SapB_2 | 45-83::86-119::131-169::172-206 |
| 1331 | CGPG7785.pep | LRRNT_2::LRR_1::LRR_1::LRR_1::LRR_1::LRR_1::LRR_1::Pkinase | 24-65::93-115::117-139::141-163::165-187::189-211::213-235::415-682 |
| 1332 | CGPG7787.pep | Aldose_epim | 26-301 |
| 1334 | CGPG7796.pep | WD40::WD40::WD40::WD40::WD40::WD40::WD40::WD40::WD40::WD40::Utp13 | 50-88::92-130::134-174::182-220::391-432::436-475::489-527::531-569::573-611::615-653::674-809 |
| 1335 | CGPG7797.pep | GILT | 35-144 |
| 1336 | CGPG7801.pep | LRR_1::LRR_1::LRR_1::LRR_1::LRR_1::LRR_1::LRR_1::LRR_1::Pkinase | 106-129::132-154::156-178::180-199::201-223::225-246::249-272::273-294::456-716 |
| 1337 | CGPG7813.pep | WD40::WD40::WD40::WD40::PWP2 | 379-417::421-459::507-545::549-587::785-900 |
| 1341 | CGPG7863.pep | zf-CW::MBD | 100-153::162-237 |
| 1342 | CGPG7868.pep | BCNT | 165-244 |
| 1343 | CGPG7881.pep | Aldedh | 99-558 |
| 1344 | CGPG7887.pep | HEAT::Arm::HEAT::Arm | 191-222::262-302::389-424::423-463 |
| 1345 | CGPG7899.pep | RRM_1 | 225-295 |
| 1346 | CGPG7901.pep | IQ::IQ | 107-127::129-149 |
| 1347 | CGPG7909.pep | DUF383::DUF384 | 92-271::272-330 |
| 1348 | CGPG7911.pep | AAA | 245-447 |
| 1349 | CGPG7919.pep | Cullin | 30-191 |
| 1350 | CGPG7935.pep | IQ::IQ | 93-113::115-135 |
| 1351 | CGPG7940.pep | RRM_1 | 96-161 |
| 1352 | CGPG7959.pep | Cyclin_N::Cyclin_C | 180-306::308-428 |
| 1353 | CGPG7967.pep | IQ::IQ | 106-126::128-148 |
| 1354 | CGPG7975.pep | Arm::Arm | 28-68::70-110 |
| 1355 | CGPG7996.pep | efhand | 136-164 |
| 1356 | CGPG8006.pep | AAA | 241-440 |
| 1357 | CGPG801.pep | Cyt-b5 | 74-171 |
| 1358 | CGPG8023.pep | RRM_1 | 11-82 |
| 1359 | CGPG8025.pep | IQ::IQ | 93-113::115-135 |
| 1360 | CGPG8038.pep | MFS_1 | 36-433 |
| 1361 | CGPG8053.pep | DUF246 | 182-525 |
| 1364 | CGPG8070.pep | GILT | 32-136 |
| 1365 | CGPG8073.pep | Dirigent | 17-183 |
| 1366 | CGPG8076.pep | Tryp_alpha_amyl | 32-107 |
| 1369 | CGPG8095.pep | IPK | 16-279 |

TABLE 17-continued

| PEP SEQ ID | Construct ID | Module | Position |
|---|---|---|---|
| 1370 | CGPG8096.pep | 60KD_IMP | 151-348 |
| 1374 | CGPG8129.pep | Ank::Ank::Ank | 49-81::82-114::115-147 |
| 1378 | CGPG8165.pep | Glutaredoxin | 44-106 |
| 1379 | CGPG8169.pep | Nol1_Nop2_Fmu | 226-505 |
| 1380 | CGPG8203.pep | Uricase::Uricase | 11-140::147-300 |
| 1381 | CGPG8205.pep | DZC | 113-148 |
| 1383 | CGPG8213.pep | Phosphoesterase | 27-388 |
| 1384 | CGPG8225.pep | FBPase | 25-348 |
| 1385 | CGPG8227.pep | NIR_SIR_ferr::NIR_SIR::NIR_SIR_ferr::NIR_SIR | 44-111::119-275::331-399::405-553 |
| 1386 | CGPG8235.pep | Aldedh | 12-471 |
| 1387 | CGPG8236.pep | Molybdop_Fe4S4::Molybdopterin::Molydop_binding::Fer2_BFD | 9-63::66-495::593-703::852-903 |
| 1388 | CGPG8244.pep | PAS_2::GAF::Phytochrome::HisKA::HATPase_c | 15-125::152-320::331-513::528-596::637-747 |
| 1389 | CGPG8254.pep | NIR_SIR_ferr::NIR_SIR::NIR_SIR_ferr::NIR_SIR | 66-133::166-347::362-434::443-591 |
| 1390 | CGPG8255.pep | PPDK_N::PEP-utilizers::PEP-utilizers_C | 16-384::439-531::559-914 |
| 1391 | CGPG8262.pep | ELFV_dehydrog_N::ELFV_dehydrog | 33-163::179-420 |
| 1392 | CGPG8264.pep | Aldedh | 17-480 |
| 1393 | CGPG8269.pep | PGK | 1-396 |
| 1394 | CGPG8271.pep | Gln-synt_N::Gln-synt_C | 16-97::104-386 |
| 1395 | CGPG8305.pep | Sulfotransfer_1 | 70-336 |
| 1396 | CGPG8320.pep | DUF1005 | 282-487 |
| 1397 | CGPG8326.pep | Senescence | 35-369 |
| 1398 | CGPG8344.pep | PPR::PPR::PPR::PPR::PPR::PPR::PPR | 173-207::208-242::243-277::279-312::314-348::349-383::384-418 |
| 1399 | CGPG8347.pep | Ribosomal_S8 | 5-130 |
| 1400 | CGPG8359.pep | Tryp_alpha_amyl | 85-167 |
| 1401 | CGPG8370.pep | Tim17 | 40-156 |
| 1402 | CGPG8371.pep | PseudoU_synth_1::PseudoU_synth_1 | 62-167::324-431 |
| 1404 | CGPG8378.pep | LysM | 78-121 |
| 1406 | CGPG841.pep | ArfGap | 4-120 |
| 1408 | CGPG8438.pep | DUF239 | 174-368 |
| 1409 | CGPG8450.pep | DUF793 | 1-390 |
| 1410 | CGPG8451.pep | IQ::IQ | 105-125::127-147 |
| 1411 | CGPG8459.pep | ubiquitin::UBA::XPC-binding::UBA | 6-78::145-187::242-298::322-361 |
| 1412 | CGPG8461.pep | Ribosomal_S8 | 5-130 |
| 1413 | CGPG8463.pep | PI3_PI4_kinase | 163-421 |
| 1414 | CGPG8471.pep | F-box::FBA_1 | 1-46::211-383 |
| 1415 | CGPG8474.pep | Metallothio_PEC | 12-85 |
| 1416 | CGPG8475.pep | DAO | 10-372 |
| 1417 | CGPG8476.pep | IQ::IQ | 84-104::106-126 |
| 1418 | CGPG8490.pep | ACT::ACT | 21-85::110-174 |
| 1419 | CGPG8510.pep | DUF538 | 9-149 |
| 1420 | CGPG8530.pep | Radical_SAM | 119-283 |
| 1421 | CGPG8533.pep | DUF212 | 27-172 |
| 1425 | CGPG8555.pep | NUDIX | 59-196 |
| 1426 | CGPG8561.pep | zf-C3HC4 | 154-191 |
| 1427 | CGPG8569.pep | 2OG-FeII_Oxy | 159-282 |
| 1428 | CGPG8573.pep | DUF617 | 83-242 |
| 1431 | CGPG8607.pep | DUF862 | 69-219 |
| 1432 | CGPG8611.pep | Stig1 | 13-154 |
| 1434 | CGPG8632.pep | Sina | 86-273 |
| 1435 | CGPG8634.pep | FA_desaturase | 55-278 |
| 1436 | CGPG8635.pep | DUF59 | 36-117 |
| 1438 | CGPG8640.pep | DUF581 | 119-176 |
| 1439 | CGPG8642.pep | CRAL_TRIO_N::CRAL_TRIO | 5-80::93-266 |
| 1441 | CGPG8666.pep | PetM | 69-120 |
| 1443 | CGPG8688.pep | Polyketide_cyc | 60-191 |
| 1444 | CGPG8689.pep | DUF506 | 74-282 |
| 1445 | CGPG8704.pep | GHMP_kinases_N::GHMP_kinases_C | 24-93::166-249 |
| 1448 | CGPG8769.pep | Self-incomp_S1 | 35-144 |
| 1449 | CGPG8774.pep | Maf | 1-207 |
| 1450 | CGPG8778.pep | PPR::PPR::PPR::PPR::PPR::PPR | 13-47::115-149::249-283::284-318::320-354::386-420 |
| 1451 | CGPG8784.pep | Snf7 | 16-189 |
| 1452 | CGPG879.pep | ABC_tran::ABC2_membrane::PDR_assoc::ABC_tran::ABC2_membrane | 195-418::520-733::738-812::887-1077::1174-1388 |
| 1453 | CGPG8797.pep | AMP-binding | 67-488 |
| 1454 | CGPG8810.pep | DUF1645 | 80-252 |
| 1455 | CGPG8827.pep | DUF623 | 199-263 |
| 1456 | CGPG8853.pep | DUF1635 | 1-218 |
| 1457 | CGPG8873.pep | p450 | 72-518 |
| 1458 | CGPG8877.pep | Exo_endo_phos | 33-310 |
| 1459 | CGPG8878.pep | Pkinase::efhand::efhand | 79-337::400-428::434-462 |
| 1460 | CGPG8881.pep | DUF1677 | 3-107 |
| 1461 | CGPG8895.pep | RNA_poll_A14 | 1-137 |

TABLE 17-continued

| PEP SEQ ID | Construct ID | Module | Position |
|---|---|---|---|
| 1462 | CGPG8906.pep | MCM | 272-635 |
| 1463 | CGPG8917.pep | Pkinase | 363-697 |
| 1464 | CGPG8919.pep | Usp::Pkinase | 11-141::405-676 |
| 1465 | CGPG8925.pep | DUF617 | 82-260 |
| 1466 | CGPG8930.pep | Lectin_legB::Pkinase | 26-261::347-617 |
| 1467 | CGPG8937.pep | LRR_1::LRR_1::LRR_1::Pkinase | 440-461::463-485::487-510::602-873 |
| 1468 | CGPG8942.pep | RRM_1 | 23-94 |
| 1469 | CGPG8946.pep | Pkinase | 516-786 |
| 1470 | CGPG8990.pep | V-SNARE | 71-221 |
| 1472 | CGPG9008.pep | TPK_catalytic::TPK_B1_binding | 40-180::191-259 |
| 1473 | CGPG9016.pep | ETC_C1_NDUFA4 | 54-156 |
| 1474 | CGPG9036.pep | MSP | 93-329 |
| 1475 | CGPG9060.pep | LSM | 22-101 |
| 1477 | CGPG908.pep | PPR::PPR::PPR::PPR::PPR::PPR::PPR::PPR | 62-96::125-158::187-221::250-284::351-385::386-419::422-456::488-522 |
| 1478 | CGPG9093.pep | AWPM-19 | 15-156 |
| 1479 | CGPG9096.pep | OTU | 11-121 |
| 1482 | CGPG9111.pep | TB2_DP1_HVA22 | 4-101 |
| 1483 | CGPG9112.pep | DUF778 | 10-177 |
| 1484 | CGPG9123.pep | DUF833 | 1-264 |
| 1485 | CGPG9124.pep | Exo_endo_phos | 20-427 |
| 1486 | CGPG9138.pep | ThiC | 165-588 |
| 1488 | CGPG9150.pep | Pkinase | 56-326 |
| 1489 | CGPG9152.pep | eIF2A | 217-410 |
| 1490 | CGPG9162.pep | AAA | 211-398 |
| 1491 | CGPG9165.pep | GATase::GMP_synt_C | 11-201::432-524 |
| 1492 | CGPG9166.pep | GATase::GMP_synt_C | 28-210::447-539 |
| 1493 | CGPG9171.pep | Zip | 5-266 |
| 1494 | CGPG9177.pep | Complex1_30 kDa::Complex1_49 kDa | 113-181::329-600 |
| 1495 | CGPG9178.pep | PRA-CH::PRA-PH | 54-129::142-230 |
| 1496 | CGPG9179.pep | Pkinase | 4-283 |
| 1497 | CGPG9181.pep | P21-Arc | 17-187 |
| 1499 | CGPG9189.pep | SAC3_GANP | 19-164 |
| 1500 | CGPG9201.pep | TPT | 201-350 |
| 1501 | CGPG9222.pep | YjeF_N::Carb_kinase | 34-199::257-496 |
| 1502 | CGPG9234.pep | DUF393 | 65-183 |
| 1503 | CGPG9237.pep | Tim17 | 18-146 |
| 1504 | CGPG9244.pep | TOM20_plant | 9-200 |
| 1506 | CGPG9249.pep | Pkinase | 46-330 |
| 1507 | CGPG9251.pep | Cyclin_N::Cyclin_C | 54-186::188-314 |
| 1508 | CGPG9280.pep | DUF1000 | 53-168 |
| 1510 | CGPG9302.pep | Diphthamide_syn | 30-398 |
| 1511 | CGPG931.pep | Pkinase | 114-398 |
| 1512 | CGPG9313.pep | CN_hydrolase::NAD_synthase | 5-200::338-652 |
| 1514 | CGPG9327.pep | OPT | 74-729 |
| 1515 | CGPG933.pep | WD40:WD40::WD40::WD40::WD40::WD40::WD40 | 46-84::134-173::177-215::222-260::314-353::524-562::568-605 |
| 1516 | CGPG9334.pep | Sugar_tr | 7-720 |
| 1517 | CGPG967.pep | BTB::NPH3 | 38-135::218-460 |
| 1518 | CGPG988.pep | Cystatin | 36-124 |

TABLE 18

| PEP SEQ ID | Construct ID | Pfam domain name | begin | start | score | E-value |
|---|---|---|---|---|---|---|
| 760 | CGPG1022 | RRM_1 | 95 | 165 | 58.4 | 2.40E-14 |
| 761 | CGPG1035 | Peptidase_C54 | 82 | 373 | 558.5 | 6.50E-165 |
| 763 | CGPG105 | AP2 | 48 | 112 | 146.2 | 8.50E-41 |
| 764 | CGPG1060 | DUF788 | 1 | 169 | 339.1 | 7.70E-99 |
| 765 | CGPG1069 | NDUF_B7 | 2 | 81 | 20.4 | 9.50E-08 |
| 766 | CGPG108 | FHA | 208 | 284 | 59.7 | 9.90E-15 |
| 766 | CGPG108 | PP2C | 309 | 570 | 282.3 | 9.50E-82 |
| 771 | CGPG1136 | RRM_1 | 22 | 87 | 32.4 | 1.60E-06 |
| 774 | CGPG1145 | NUDIX | 24 | 160 | 79.2 | 1.30E-20 |
| 776 | CGPG1173 | adh_short | 6 | 181 | −32 | 0.00071 |
| 777 | CGPG1176 | F-box | 2 | 50 | 21.6 | 0.0027 |
| 779 | CGPG122 | PTR2 | 113 | 517 | 661.3 | 7.40E-196 |
| 780 | CGPG126 | Response_reg | 34 | 158 | 86 | 1.10E-22 |
| 781 | CGPG1262 | Gar1 | 51 | 152 | 251.2 | 2.10E-72 |
| 782 | CGPG128 | Response_reg | 25 | 149 | 84.9 | 2.50E-22 |
| 783 | CGPG1280 | DUF676 | 515 | 717 | 301.1 | 2.10E-87 |
| 784 | CGPG1291 | DUF862 | 2 | 156 | 209.3 | 8.70E-60 |
| 785 | CGPG1295 | TMEM14 | 7 | 104 | 166.9 | 5.20E-47 |
| 787 | CGPG1315 | Brix | 60 | 255 | 139.3 | 1.00E-38 |

TABLE 18-continued

| PEP SEQ ID | Construct ID | Pfam domain name | begin | start | score | E-value |
|---|---|---|---|---|---|---|
| 788 | CGPG1335 | LRR_1 | 424 | 447 | 10.1 | 3.6 |
| 789 | CGPG1344 | Pkinase | 496 | 767 | 132.9 | 8.60E−37 |
| 789 | CGPG1344 | Pkinase_Tyr | 497 | 767 | 81.2 | 3.30E−21 |
| 790 | CGPG1352 | Pkinase | 154 | 425 | 140.3 | 5.20E−39 |
| 790 | CGPG1352 | Pkinase_Tyr | 154 | 425 | 142.1 | 1.50E−39 |
| 791 | CGPG1364 | Pkinase | 38 | 416 | 177.6 | 3.00E−50 |
| 793 | CGPG1396 | malic | 106 | 295 | 422.9 | 4.50E−124 |
| 793 | CGPG1396 | Malic_M | 297 | 550 | 466.9 | 2.50E−137 |
| 794 | CGPG1398 | Glycolytic | 11 | 358 | 877.1 | 8.10E−261 |
| 795 | CGPG1399 | Metallophos | 161 | 360 | 87.4 | 4.50E−23 |
| 796 | CGPG1429 | NTP_transferase | 86 | 365 | 444 | 2.00E−130 |
| 796 | CGPG1429 | Hexapep | 413 | 430 | 3.5 | 55 |
| 796 | CGPG1429 | Hexapep | 466 | 483 | 19.6 | 0.011 |
| 797 | CGPG1430 | E1_dh | 89 | 393 | 468.9 | 6.30E−138 |
| 798 | CGPG1445 | Pkinase | 33 | 294 | 257.4 | 2.90E−74 |
| 798 | CGPG1445 | Pkinase_Tyr | 33 | 294 | 99.8 | 8.00E−27 |
| 799 | CGPG146 | p450 | 38 | 482 | 75.2 | 2.00E−19 |
| 800 | CGPG1492 | Aldedh | 29 | 491 | 535.5 | 5.80E−158 |
| 801 | CGPG1528 | ATP_synt_H | 1 | 70 | 128.2 | 2.30E−35 |
| 802 | CGPG1530 | ArfGap | 15 | 137 | 169.4 | 9.00E−48 |
| 802 | CGPG1530 | C2 | 183 | 262 | 103 | 8.90E−28 |
| 803 | CGPG1535 | SPT2 | 230 | 329 | 31.1 | 9.80E−07 |
| 804 | CGPG1546 | CTP_transf_1 | 101 | 300 | 20 | 2.00E−07 |
| 805 | CGPG1567 | Ribosomal_L19 | 107 | 212 | 72.7 | 1.20E−18 |
| 806 | CGPG1568 | FAD_binding_4 | 82 | 221 | 53.1 | 9.10E−13 |
| 807 | CGPG1575 | DUF740 | 24 | 595 | 626.7 | 1.90E−185 |
| 808 | CGPG1619 | Pyr_redox_2 | 27 | 343 | 213.2 | 5.80E−61 |
| 808 | CGPG1619 | Pyr_redox | 205 | 297 | 93.6 | 6.00E−25 |
| 808 | CGPG1619 | Pyr_redox_dim | 373 | 483 | 158.2 | 2.10E−44 |
| 810 | CGPG1641 | Di19 | 11 | 219 | 487.1 | 2.10E−143 |
| 811 | CGPG1651 | DEAD | 69 | 220 | 110.3 | 5.50E−30 |
| 811 | CGPG1651 | Helicase_C | 378 | 462 | 45.3 | 2.00E−10 |
| 811 | CGPG1651 | DSHCT | 800 | 988 | 358.6 | 1.00E−104 |
| 812 | CGPG1656 | Cyt-b5 | 9 | 82 | 94.5 | 3.30E−25 |
| 812 | CGPG1656 | FA_desaturase | 145 | 399 | 256.9 | 4.10E−71 |
| 813 | CGPG1668 | DUF791 | 4 | 358 | 877.2 | 7.80E−261 |
| 813 | CGPG1668 | MFS_1 | 42 | 406 | 33.6 | 6.70E−07 |
| 815 | CGPG1740 | DUF860 | 25 | 364 | 615 | 6.40E−182 |
| 816 | CGPG177 | WD40 | 168 | 205 | 23.2 | 0.00096 |
| 816 | CGPG177 | WD40 | 257 | 296 | 36 | 1.30E−07 |
| 817 | CGPG1785 | PB1 | 179 | 266 | 108.9 | 1.40E−29 |
| 817 | CGPG1785 | Pkinase | 863 | 1126 | 202.7 | 8.80E−58 |
| 817 | CGPG1785 | Pkinase_Tyr | 863 | 1126 | 253 | 6.30E−73 |
| 818 | CGPG182 | LRR_1 | 46 | 67 | 11.1 | 2.3 |
| 818 | CGPG182 | LRR_1 | 69 | 90 | 12.4 | 1.4 |
| 818 | CGPG182 | LRR_1 | 115 | 136 | 11.8 | 1.8 |
| 818 | CGPG182 | LRR_1 | 161 | 183 | 8.6 | 7 |
| 818 | CGPG182 | LRR_1 | 208 | 229 | 12.9 | 1.1 |
| 818 | CGPG182 | LRR_1 | 231 | 252 | 9.4 | 4.9 |
| 818 | CGPG182 | LRR_1 | 276 | 297 | 18.4 | 0.026 |
| 818 | CGPG182 | LRR_1 | 382 | 403 | 8.8 | 6.5 |
| 818 | CGPG182 | LRR_1 | 405 | 427 | 10.2 | 3.5 |
| 818 | CGPG182 | LRR_1 | 429 | 451 | 8.8 | 6.5 |
| 818 | CGPG182 | LRR_1 | 477 | 498 | 9.9 | 3.9 |
| 818 | CGPG182 | LRR_1 | 500 | 521 | 17 | 0.069 |
| 818 | CGPG182 | LRR_1 | 523 | 544 | 20.7 | 0.0052 |
| 819 | CGPG1837 | TFIIS_M | 328 | 445 | 155 | 1.90E−43 |
| 819 | CGPG1837 | SPOC | 656 | 762 | 92.5 | 1.30E−24 |
| 820 | CGPG1873 | Pkinase | 20 | 275 | 323.7 | 3.20E−94 |
| 820 | CGPG1873 | NAF | 314 | 374 | 112 | 1.70E−30 |
| 823 | CGPG1899 | F-box | 18 | 65 | 34.8 | 3.00E−07 |
| 823 | CGPG1899 | Kelch_1 | 139 | 186 | 33.7 | 6.30E−07 |
| 823 | CGPG1899 | Kelch_2 | 188 | 235 | 16.7 | 0.082 |
| 823 | CGPG1899 | Kelch_1 | 189 | 235 | 51.4 | 3.00E−12 |
| 824 | CGPG1913 | F-box | 31 | 78 | 39.4 | 1.20E−08 |
| 824 | CGPG1913 | FBA_1 | 268 | 416 | −16.6 | 6.10E−05 |
| 825 | CGPG1918 | F-box | 30 | 77 | 36 | 1.30E−07 |
| 826 | CGPG1919 | F-box | 65 | 112 | 43.1 | 9.70E−10 |
| 827 | CGPG1922 | F-box | 25 | 72 | 46.6 | 8.30E−11 |
| 827 | CGPG1922 | Kelch_2 | 118 | 163 | 24.4 | 0.0004 |
| 827 | CGPG1922 | Kelch_1 | 118 | 163 | 39.1 | 1.50E−08 |
| 827 | CGPG1922 | Kelch_2 | 165 | 208 | 26.7 | 8.10E−05 |
| 827 | CGPG1922 | Kelch_1 | 165 | 210 | 49.6 | 1.00E−11 |
| 828 | CGPG1929 | F-box | 1 | 44 | 14.8 | 0.31 |
| 829 | CGPG1938 | F-box | 8 | 55 | 35.4 | 2.00E−07 |
| 829 | CGPG1938 | LRR_2 | 159 | 185 | 29.1 | 1.60E−05 |
| 830 | CGPG1956 | Pre-SET | 409 | 558 | 20.9 | 5.60E−06 |

TABLE 18-continued

| PEP SEQ ID | Construct ID | Pfam domain name | begin | start | score | E-value |
|---|---|---|---|---|---|---|
| 830 | CGPG1956 | SET | 560 | 702 | 157.5 | 3.40E-44 |
| 831 | CGPG1964 | zf-C3HC4 | 109 | 147 | 35.2 | 2.30E-07 |
| 831 | CGPG1964 | YDG_SRA | 228 | 345 | 212.8 | 8.10E-61 |
| 832 | CGPG1973 | zf-UBR | 40 | 109 | 73.4 | 7.10E-19 |
| 833 | CGPG1977 | TFIIF_alpha | 18 | 542 | 984.3 | 4.60E-293 |
| 834 | CGPG1996 | Pkinase | 3 | 286 | 373.9 | 2.50E-109 |
| 835 | CGPG2005 | NADPH_Ox | 130 | 229 | 245.7 | 9.80E-71 |
| 835 | CGPG2005 | Ferric_reduct | 352 | 511 | 177.6 | 3.00E-50 |
| 835 | CGPG2005 | FAD_binding_8 | 552 | 671 | 227.3 | 3.40E-65 |
| 835 | CGPG2005 | NAD_binding_6 | 677 | 850 | 271.5 | 1.60E-78 |
| 837 | CGPG2044 | PTR2 | 99 | 507 | 587.7 | 1.10E-173 |
| 838 | CGPG2059 | Nuc_sug_transp | 104 | 340 | 26.5 | 4.50E-15 |
| 839 | CGPG2065 | PEARLI-4 | 342 | 611 | 652.6 | 3.30E-193 |
| 841 | CGPG2072 | DUF1639 | 264 | 300 | 60.4 | 5.90E-15 |
| 842 | CGPG2074 | HMA | 75 | 138 | 46.4 | 9.40E-11 |
| 842 | CGPG2074 | HMA | 173 | 235 | 50.6 | 5.40E-12 |
| 843 | CGPG2116 | NOI | 1 | 67 | 147.8 | 2.80E-41 |
| 845 | CGPG2142 | MATH | 101 | 233 | 5.3 | 0.028 |
| 845 | CGPG2142 | MATH | 258 | 375 | 33 | 1.00E-06 |
| 847 | CGPG2190 | DJ-1_Pfpl | 34 | 174 | 110.4 | 5.10E-30 |
| 847 | CGPG2190 | DJ-1_Pfpl | 240 | 378 | 129.9 | 6.90E-36 |
| 849 | CGPG221 | DnaJ | 35 | 96 | 137.6 | 3.30E-38 |
| 849 | CGPG221 | DnaJ_CXXCXGXG | 160 | 243 | 101 | 3.60E-27 |
| 849 | CGPG221 | DnaJ_C | 256 | 378 | 210.4 | 4.00E-60 |
| 850 | CGPG2213 | RNA_pol_I_A49 | 83 | 441 | 629.1 | 3.80E-186 |
| 851 | CGPG2247 | DUF23 | 256 | 497 | 99.8 | 8.20E-27 |
| 852 | CGPG228 | p450 | 67 | 511 | 252.1 | 1.10E-72 |
| 853 | CGPG2301 | PC_rep | 414 | 447 | 28.8 | 1.90E-05 |
| 853 | CGPG2301 | PC_rep | 448 | 484 | 28 | 3.20E-05 |
| 853 | CGPG2301 | PC_rep | 485 | 519 | 33.7 | 6.30E-07 |
| 853 | CGPG2301 | PC_rep | 523 | 557 | 10.4 | 0.45 |
| 853 | CGPG2301 | PC_rep | 671 | 705 | 11.9 | 0.28 |
| 853 | CGPG2301 | PC_rep | 706 | 740 | 32.7 | 1.30E-06 |
| 854 | CGPG2304 | Phi_1 | 32 | 309 | 680.3 | 1.40E-201 |
| 856 | CGPG2348 | Gal-bind_lectin | 165 | 343 | 143.9 | 4.40E-40 |
| 856 | CGPG2348 | Galactosyl_T | 385 | 580 | 105.4 | 1.60E-28 |
| 857 | CGPG2349 | IQ | 120 | 140 | 33.4 | 7.70E-07 |
| 857 | CGPG2349 | IQ | 142 | 162 | 13.6 | 0.74 |
| 858 | CGPG2354 | ABC1 | 183 | 306 | 132.6 | 1.00E-36 |
| 859 | CGPG2369 | DAGK_cat | 228 | 368 | 129.9 | 7.20E-36 |
| 860 | CGPG2382 | WD40 | 65 | 103 | 48.6 | 2.20E-11 |
| 860 | CGPG2382 | WD40 | 106 | 144 | 32.1 | 2.00E-06 |
| 860 | CGPG2382 | WD40 | 197 | 235 | 34.5 | 3.70E-07 |
| 860 | CGPG2382 | WD40 | 240 | 278 | 47.3 | 5.30E-11 |
| 861 | CGPG2392 | UBX | 311 | 392 | 104 | 4.40E-28 |
| 862 | CGPG2397 | AA_permease | 64 | 510 | 34.5 | 3.70E-07 |
| 863 | CGPG240 | Hydrolase | 22 | 210 | 118.1 | 2.50E-32 |
| 865 | CGPG2433 | DUF23 | 289 | 544 | 209.9 | 6.00E-60 |
| 868 | CGPG2464 | Glyco_transf_8 | 83 | 345 | 341.2 | 1.70E-99 |
| 869 | CGPG2472 | Band_7 | 35 | 227 | 90.6 | 4.80E-24 |
| 870 | CGPG2480 | Prefoldin | 53 | 175 | 140.5 | 4.40E-39 |
| 871 | CGPG253 | HEAT | 82 | 117 | 18.6 | 0.022 |
| 871 | CGPG253 | HEAT | 158 | 194 | 22.9 | 0.0012 |
| 871 | CGPG253 | HEAT | 197 | 233 | 15.3 | 0.22 |
| 871 | CGPG253 | HEAT | 236 | 272 | 31.1 | 3.80E-06 |
| 871 | CGPG253 | HEAT | 275 | 311 | 27.5 | 4.80E-05 |
| 871 | CGPG253 | HEAT | 314 | 350 | 26.6 | 8.60E-05 |
| 871 | CGPG253 | HEAT | 353 | 389 | 27.9 | 3.60E-05 |
| 871 | CGPG253 | HEAT | 392 | 428 | 24.6 | 0.00035 |
| 871 | CGPG253 | HEAT | 431 | 467 | 24.2 | 0.00045 |
| 871 | CGPG253 | HEAT | 470 | 506 | 21.3 | 0.0036 |
| 871 | CGPG253 | HEAT | 509 | 545 | 18.9 | 0.019 |
| 871 | CGPG253 | HEAT | 548 | 584 | 17.9 | 0.036 |
| 872 | CGPG2538 | PfkB | 7 | 297 | 115.2 | 1.40E-31 |
| 873 | CGPG2567 | zf-C3HC4 | 372 | 412 | 42.6 | 1.40E-09 |
| 874 | CGPG2571 | zf-C3HC4 | 146 | 187 | 39.3 | 1.30E-08 |
| 875 | CGPG258 | Cyclin_N | 185 | 310 | 240.4 | 3.70E-69 |
| 875 | CGPG258 | Cyclin_C | 312 | 433 | 188.8 | 1.30E-53 |
| 876 | CGPG268 | PTR2 | 97 | 514 | 458.7 | 7.20E-135 |
| 877 | CGPG274 | WD40 | 259 | 298 | 36.8 | 7.40E-08 |
| 877 | CGPG274 | WD40 | 303 | 342 | 26.9 | 7.30E-05 |
| 877 | CGPG274 | WD40 | 350 | 389 | 26.6 | 9.10E-05 |
| 878 | CGPG275 | PP2C | 32 | 271 | 205.2 | 1.50E-58 |
| 879 | CGPG277 | IGPD | 103 | 247 | 372.6 | 6.20E-109 |
| 880 | CGPG2785 | SIR2 | 52 | 216 | 107.2 | 4.70E-29 |
| 881 | CGPG2832 | Myb_DNA-binding | 195 | 243 | 33.6 | 6.80E-07 |
| 883 | CGPG2865 | SRF-TF | 17 | 67 | 94.4 | 3.50E-25 |

TABLE 18-continued

| PEP SEQ ID | Construct ID | Pfam domain name | begin | start | score | E-value |
|---|---|---|---|---|---|---|
| 884 | CGPG2874 | polyprenyl_synt | 123 | 383 | 275.6 | 9.70E−80 |
| 885 | CGPG2914 | AP2 | 84 | 142 | 18 | 5.20E−06 |
| 886 | CGPG295 | Pro_isomerase | 96 | 256 | 405.8 | 6.30E−119 |
| 888 | CGPG3009 | Arf | 4 | 184 | 165.1 | 1.80E−46 |
| 889 | CGPG3030 | Pkinase | 4 | 301 | 322.2 | 9.20E−94 |
| 890 | CGPG3048 | adh_short | 18 | 186 | 135.3 | 1.60E−37 |
| 890 | CGPG3048 | KR | 18 | 188 | −35.3 | 2.60E−05 |
| 891 | CGPG3056 | PP2C | 76 | 341 | 261.8 | 1.40E−75 |
| 893 | CGPG309 | Cyclin_N | 4 | 143 | 8.9 | 2.50E−05 |
| 894 | CGPG3094 | C2 | 6 | 87 | 73.4 | 7.30E−19 |
| 895 | CGPG3095 | F-box | 5 | 52 | 34.8 | 2.90E−07 |
| 895 | CGPG3095 | LRR_2 | 163 | 188 | 34.7 | 3.30E−07 |
| 895 | CGPG3095 | FBD | 374 | 426 | 83.7 | 5.60E−22 |
| 896 | CGPG3137 | Spermine_synth | 54 | 313 | 429.1 | 6.20E−126 |
| 897 | CGPG3156 | DEAD | 33 | 212 | 223 | 6.80E−64 |
| 897 | CGPG3156 | Helicase_C | 279 | 355 | 131.8 | 1.90E−36 |
| 898 | CGPG3157 | DEAD | 175 | 355 | 231.2 | 2.30E−66 |
| 898 | CGPG3157 | Helicase_C | 427 | 503 | 130.3 | 5.40E−36 |
| 899 | CGPG3205 | F-box | 130 | 177 | 35.8 | 1.50E−07 |
| 899 | CGPG3205 | Kelch_1 | 220 | 269 | 34.4 | 4.00E−07 |
| 899 | CGPG3205 | Kelch_2 | 220 | 269 | 16.3 | 0.11 |
| 899 | CGPG3205 | Kelch_1 | 347 | 389 | 11.8 | 0.18 |
| 900 | CGPG3236 | Thioredoxin | 4 | 108 | 67.2 | 5.20E−17 |
| 901 | CGPG3248 | Copine | 102 | 250 | 294.3 | 2.20E−85 |
| 902 | CGPG3255 | NTP_transferase | 10 | 246 | 50.6 | 2.10E−13 |
| 902 | CGPG3255 | Hexapep | 294 | 311 | 4.4 | 42 |
| 902 | CGPG3255 | Hexapep | 312 | 329 | 16.7 | 0.083 |
| 902 | CGPG3255 | Hexapep | 335 | 352 | 10.7 | 5.2 |
| 902 | CGPG3255 | Hexapep | 379 | 396 | 1.8 | 85 |
| 903 | CGPG3258 | UDPGT | 23 | 484 | −66 | 2.70E−07 |
| 904 | CGPG3261 | Pkinase | 79 | 334 | 261.2 | 2.00E−75 |
| 907 | CGPG3283 | Mo25 | 1 | 339 | 584.5 | 1.00E−172 |
| 908 | CGPG3302 | SRF-TF | 9 | 59 | 118.3 | 2.20E−32 |
| 908 | CGPG3302 | K-box | 76 | 174 | 130.2 | 5.60E−36 |
| 909 | CGPG3334 | GRP | 1 | 113 | 129.8 | 7.40E−36 |
| 910 | CGPG3361 | DUF1644 | 38 | 255 | 215.2 | 1.50E−61 |
| 911 | CGPG337 | Glyco_transf_8 | 19 | 264 | 298.7 | 1.10E−86 |
| 912 | CGPG3400 | IQ | 304 | 324 | 14.7 | 0.33 |
| 914 | CGPG3424 | TFIIS_C | 79 | 117 | 31.8 | 2.40E−06 |
| 915 | CGPG3428 | DUF914 | 136 | 435 | −191.9 | 0.0045 |
| 916 | CGPG3465 | zf-MYND | 57 | 94 | 50.2 | 6.80E−12 |
| 916 | CGPG3465 | UCH | 326 | 630 | 175.9 | 1.00E−49 |
| 917 | CGPG347 | DREPP | 1 | 225 | 483.5 | 2.50E−142 |
| 917 | CGPG347 | PPAK | 172 | 197 | 0.5 | 17 |
| 919 | CGPG3567 | DUF581 | 63 | 121 | 135.5 | 1.40E−37 |
| 920 | CGPG3575 | Mago-bind | 22 | 48 | 58.7 | 2.00E−14 |
| 921 | CGPG3579 | SNARE | 141 | 203 | 59.8 | 8.90E−15 |
| 926 | CGPG365 | MATH | 53 | 182 | 59.9 | 8.30E−15 |
| 926 | CGPG365 | BTB | 206 | 328 | 86.5 | 7.90E−23 |
| 927 | CGPG3665 | BNR | 138 | 149 | 10.5 | 5.1 |
| 927 | CGPG3665 | BNR | 189 | 200 | 8.4 | 9.7 |
| 927 | CGPG3665 | BNR | 239 | 250 | 10.7 | 4.8 |
| 928 | CGPG3684 | Pro_dh | 113 | 464 | 472.8 | 4.30E−139 |
| 929 | CGPG3690 | MtN3_slv | 10 | 97 | 116 | 1.10E−31 |
| 929 | CGPG3690 | MtN3_slv | 131 | 217 | 119 | 1.30E−32 |
| 930 | CGPG3717 | OTU | 219 | 331 | 154.2 | 3.50E−43 |
| 931 | CGPG372 | SET | 83 | 212 | 181.8 | 1.70E−51 |
| 934 | CGPG3781 | SRF-TF | 11 | 65 | 30.5 | 6.00E−06 |
| 935 | CGPG380 | Histone | 25 | 94 | 67.1 | 5.70E−17 |
| 936 | CGPG3821 | F-box | 5 | 52 | 36.5 | 9.50E−08 |
| 936 | CGPG3821 | FBA_3 | 205 | 281 | −0.8 | 0.00013 |
| 937 | CGPG3824 | WRKY | 107 | 169 | 89.8 | 8.20E−24 |
| 938 | CGPG3901 | 2OG-FeII_Oxy | 166 | 271 | 67.5 | 4.30E−17 |
| 939 | CGPG391 | Histone | 58 | 132 | 144.1 | 3.60E−40 |
| 941 | CGPG394 | DUF6 | 11 | 152 | 22.3 | 0.0018 |
| 941 | CGPG394 | TPT | 170 | 319 | 165.1 | 1.80E−46 |
| 942 | CGPG3964 | Pyr_redox | 174 | 248 | 7.9 | 0.0034 |
| 943 | CGPG397 | SOR_SNZ | 24 | 229 | 449.4 | 4.60E−132 |
| 943 | CGPG397 | ThiG | 123 | 290 | −178.1 | 0.0011 |
| 945 | CGPG3983 | DUF6 | 31 | 164 | 50.3 | 6.60E−12 |
| 945 | CGPG3983 | DUF6 | 213 | 342 | 60.5 | 5.40E−15 |
| 946 | CGPG3986 | WD40 | 160 | 197 | 27.3 | 5.50E−05 |
| 946 | CGPG3986 | WD40 | 249 | 288 | 33.1 | 9.60E−07 |
| 947 | CGPG3991 | SNARE_assoc | 111 | 232 | 91.5 | 2.60E−24 |
| 948 | CGPG4050 | PP2C | 49 | 327 | 107 | 5.40E−29 |
| 949 | CGPG4070 | Not3 | 2 | 246 | 527.4 | 1.50E−155 |
| 949 | CGPG4070 | NOT2_3_5 | 693 | 881 | 217 | 4.30E−62 |

TABLE 18-continued

| PEP SEQ ID | Construct ID | Pfam domain name | begin | start | score | E-value |
|---|---|---|---|---|---|---|
| 950 | CGPG4071 | Pkinase_Tyr | 135 | 389 | 256.4 | 5.90E−74 |
| 950 | CGPG4071 | Pkinase | 135 | 389 | 221.3 | 2.20E−63 |
| 951 | CGPG4099 | 14-3-3 | 6 | 243 | 509.5 | 3.80E−150 |
| 952 | CGPG4138 | adh_short | 44 | 217 | 55.7 | 1.60E−13 |
| 953 | CGPG4152 | RRM_1 | 11 | 78 | 44.3 | 4.00E−10 |
| 954 | CGPG4153 | HMG-CoA_red | 190 | 583 | 1044.7 | 0 |
| 955 | CGPG4164 | PP2C | 22 | 322 | 276.7 | 4.60E−80 |
| 956 | CGPG4169 | WD40 | 253 | 291 | 38.4 | 2.40E−08 |
| 956 | CGPG4169 | WD40 | 298 | 336 | 30.8 | 4.80E−06 |
| 956 | CGPG4169 | WD40 | 340 | 378 | 24.8 | 0.00031 |
| 956 | CGPG4169 | WD40 | 510 | 549 | 55.3 | 2.00E−13 |
| 957 | CGPG421 | Pkinase | 22 | 280 | 354.8 | 1.40E−103 |
| 957 | CGPG421 | efhand | 327 | 355 | 39.1 | 1.50E−08 |
| 957 | CGPG421 | efhand | 363 | 391 | 26.9 | 7.30E−05 |
| 957 | CGPG421 | efhand | 399 | 427 | 30.3 | 6.70E−06 |
| 957 | CGPG421 | efhand | 433 | 461 | 37.9 | 3.50E−08 |
| 958 | CGPG422 | Pkinase | 73 | 331 | 363.9 | 2.50E−106 |
| 959 | CGPG4223 | SRF-TF | 23 | 76 | 25.8 | 0.00015 |
| 960 | CGPG4240 | F-box | 8 | 56 | 30.1 | 7.90E−06 |
| 961 | CGPG4242 | PP2C | 58 | 341 | 195.8 | 1.00E−55 |
| 962 | CGPG4248 | efhand | 10 | 38 | 30.5 | 6.00E−06 |
| 962 | CGPG4248 | efhand | 89 | 117 | 37 | 6.70E−08 |
| 962 | CGPG4248 | efhand | 127 | 155 | 27.1 | 6.10E−05 |
| 963 | CGPG425 | Pkinase_Tyr | 8 | 260 | 238.9 | 1.10E−68 |
| 963 | CGPG425 | Pkinase | 8 | 260 | 224.7 | 2.00E−64 |
| 964 | CGPG4265 | Cys_Met_Meta_PP | 42 | 432 | 263.8 | 3.50E−76 |
| 965 | CGPG4283 | Dehydrin | 36 | 183 | 171.1 | 2.70E−48 |
| 966 | CGPG4297 | Globin | 10 | 149 | 102.6 | 1.10E−27 |
| 967 | CGPG43 | Aa_trans | 46 | 481 | 587.5 | 1.30E−173 |
| 968 | CGPG430 | Pkinase_Tyr | 8 | 264 | 127.5 | 3.70E−35 |
| 968 | CGPG430 | Pkinase | 8 | 264 | 297.5 | 2.50E−86 |
| 969 | CGPG4305 | Rib_5-P_isom_A | 85 | 273 | −27.7 | 1.60E−07 |
| 970 | CGPG4307 | Orn_Arg_deC_N | 98 | 348 | 174.8 | 2.20E−49 |
| 970 | CGPG4307 | Orn_DAP_Arg_deC | 351 | 459 | 125.2 | 1.80E−34 |
| 971 | CGPG4315 | PPR | 139 | 173 | 7.5 | 0.97 |
| 971 | CGPG4315 | PPR | 209 | 243 | 26.1 | 0.00013 |
| 971 | CGPG4315 | PPR | 286 | 320 | 36.6 | 8.60E−08 |
| 971 | CGPG4315 | PPR | 321 | 355 | 11.6 | 0.32 |
| 971 | CGPG4315 | PPR | 356 | 390 | 3.1 | 3.2 |
| 971 | CGPG4315 | PPR | 391 | 425 | 11.4 | 0.33 |
| 972 | CGPG4320 | DUF6 | 20 | 153 | 52.8 | 1.20E−12 |
| 972 | CGPG4320 | DUF6 | 190 | 319 | 40.8 | 4.70E−09 |
| 973 | CGPG4344 | Mito_carr | 13 | 98 | 65.1 | 2.30E−16 |
| 973 | CGPG4344 | Mito_carr | 104 | 199 | 103.1 | 8.20E−28 |
| 973 | CGPG4344 | Mito_carr | 203 | 297 | 83.2 | 8.20E−22 |
| 975 | CGPG4349 | Aha1_N | 29 | 165 | 185 | 1.80E−52 |
| 975 | CGPG4349 | AHSA1 | 233 | 291 | 17.7 | 0.0027 |
| 976 | CGPG4365 | CCT | 220 | 258 | 75.3 | 2.00E−19 |
| 978 | CGPG4389 | Aminotran_1_2 | 23 | 376 | 250.1 | 4.70E−72 |
| 979 | CGPG4404 | p450 | 37 | 514 | 135.5 | 1.40E−37 |
| 980 | CGPG4405 | p450 | 69 | 504 | 265.7 | 9.60E−77 |
| 981 | CGPG4419 | p450 | 33 | 477 | 342.6 | 6.60E−100 |
| 982 | CGPG4432 | p450 | 70 | 528 | 261.7 | 1.50E−75 |
| 984 | CGPG4443 | p450 | 32 | 551 | 268.9 | 1.00E−77 |
| 985 | CGPG445 | PLAT | 54 | 159 | 137.1 | 4.70E−38 |
| 985 | CGPG445 | Lipoxygenase | 171 | 843 | 1610.6 | 0 |
| 986 | CGPG4453 | p450 | 40 | 500 | 373.2 | 4.20E−109 |
| 987 | CGPG4481 | Glyco_hydro_17 | 34 | 352 | 365.3 | 9.40E−107 |
| 988 | CGPG4490 | AMP-binding | 42 | 473 | 358 | 1.50E−104 |
| 989 | CGPG4498 | Glyco_hydro_1 | 40 | 516 | 757.2 | 1.10E−224 |
| 990 | CGPG4506 | RRM_1 | 18 | 89 | 95.5 | 1.60E−25 |
| 991 | CGPG4553 | DUF313 | 158 | 265 | 219 | 1.10E−62 |
| 992 | CGPG4583 | HIT | 43 | 142 | 152.5 | 1.10E−42 |
| 993 | CGPG4643 | Pkinase | 400 | 656 | 303.4 | 4.20E−88 |
| 993 | CGPG4643 | Pkinase_Tyr | 400 | 656 | 149.3 | 1.00E−41 |
| 994 | CGPG4650 | Pkinase | 141 | 425 | 320.1 | 4.00E−93 |
| 996 | CGPG468 | Fer4 | 116 | 139 | 30.6 | 5.60E−06 |
| 996 | CGPG468 | Fer4 | 155 | 178 | 38.5 | 2.30E−08 |
| 997 | CGPG4684 | MIP | 11 | 232 | 407.1 | 2.60E−119 |
| 998 | CGPG4689 | LRRNT_2 | 29 | 70 | 63.6 | 6.40E−16 |
| 998 | CGPG4689 | LRR_1 | 120 | 142 | 10.7 | 2.8 |
| 998 | CGPG4689 | LRR_1 | 144 | 165 | 8.2 | 8.5 |
| 998 | CGPG4689 | Pkinase | 261 | 532 | 154.6 | 2.70E−43 |
| 998 | CGPG4689 | Pkinase_Tyr | 261 | 532 | 77.7 | 3.80E−20 |
| 999 | CGPG4691 | PCI | 281 | 385 | 116.6 | 6.90E−32 |
| 1000 | CGPG4702 | UAA | 92 | 388 | −129.1 | 0.00058 |
| 1000 | CGPG4702 | DUF6 | 106 | 231 | 27.4 | 5.10E−05 |

TABLE 18-continued

| PEP SEQ ID | Construct ID | Pfam domain name | begin | start | score | E-value |
|---|---|---|---|---|---|---|
| 1000 | CGPG4702 | TPT | 240 | 385 | 193.4 | 5.60E−55 |
| 1001 | CGPG4703 | UAA | 55 | 355 | −71.5 | 7.60E−07 |
| 1001 | CGPG4703 | TPT | 205 | 349 | 160.4 | 4.80E−45 |
| 1002 | CGPG4710 | CPSase_L_chain | 97 | 217 | 196.1 | 8.20E−56 |
| 1002 | CGPG4710 | CPSase_L_D2 | 219 | 455 | 449.7 | 3.80E−132 |
| 1002 | CGPG4710 | CPSase_L_D3 | 515 | 638 | 255.2 | 1.30E−73 |
| 1002 | CGPG4710 | CPSase_L_chain | 648 | 775 | 68.2 | 2.60E−17 |
| 1002 | CGPG4710 | CPSase_L_D2 | 777 | 989 | 118.2 | 2.40E−32 |
| 1002 | CGPG4710 | MGS | 1061 | 1148 | 105.9 | 1.20E−28 |
| 1003 | CGPG4713 | DUF231 | 241 | 420 | 229.6 | 6.60E−66 |
| 1004 | CGPG4730 | DHquinase_I | 96 | 313 | 281.4 | 1.80E−81 |
| 1004 | CGPG4730 | Shikimate_dh_N | 328 | 408 | 148.1 | 2.40E−41 |
| 1004 | CGPG4730 | Shikimate_DH | 440 | 558 | 118.7 | 1.60E−32 |
| 1005 | CGPG4747 | UQ_con | 8 | 145 | 267.3 | 3.00E−77 |
| 1006 | CGPG4755 | Cpn60_TCP1 | 30 | 520 | 556.6 | 2.60E−164 |
| 1008 | CGPG4779 | Peptidase_M22 | 27 | 305 | 238.7 | 1.20E−68 |
| 1009 | CGPG4848 | PGAM | 77 | 246 | 22.5 | 4.10E−05 |
| 1010 | CGPG4879 | SIS | 64 | 197 | 71.5 | 2.60E−18 |
| 1010 | CGPG4879 | CBS | 229 | 350 | 83.4 | 6.80E−22 |
| 1011 | CGPG4882 | TFIIS | 121 | 206 | 127 | 5.10E−35 |
| 1012 | CGPG4892 | DUF260 | 5 | 105 | 193.4 | 5.60E−55 |
| 1013 | CGPG4903 | DUF260 | 7 | 108 | 237 | 4.20E−68 |
| 1014 | CGPG4925 | WD40 | 74 | 112 | 34.3 | 4.30E−07 |
| 1014 | CGPG4925 | WD40 | 116 | 153 | 27.5 | 4.60E−05 |
| 1014 | CGPG4925 | WD40 | 207 | 245 | 42.3 | 1.60E−09 |
| 1014 | CGPG4925 | WD40 | 249 | 287 | 47.1 | 6.10E−11 |
| 1015 | CGPG4937 | NLE | 11 | 79 | 115.3 | 1.70E−31 |
| 1015 | CGPG4937 | WD40 | 140 | 182 | 33.3 | 8.30E−07 |
| 1015 | CGPG4937 | WD40 | 195 | 233 | 31.2 | 3.50E−06 |
| 1015 | CGPG4937 | WD40 | 262 | 299 | 29.4 | 1.20E−05 |
| 1015 | CGPG4937 | WD40 | 348 | 387 | 34.5 | 3.70E−07 |
| 1016 | CGPG4949 | Pkinase | 208 | 470 | −29.3 | 8.10E−07 |
| 1017 | CGPG4971 | SKI | 11 | 177 | 104 | 4.30E−28 |
| 1018 | CGPG499 | Voltage_CLC | 138 | 560 | 690.2 | 1.50E−204 |
| 1018 | CGPG499 | CBS | 593 | 759 | 42.9 | 1.10E−09 |
| 1019 | CGPG5004 | adh_short | 53 | 224 | 50.1 | 7.30E−12 |
| 1020 | CGPG5028 | adh_short | 42 | 200 | −2.3 | 7.90E−06 |
| 1021 | CGPG5032 | adh_short | 48 | 216 | 81.4 | 2.80E−21 |
| 1022 | CGPG5038 | DUF26 | 74 | 134 | 74.3 | 3.90E−19 |
| 1022 | CGPG5038 | DUF26 | 200 | 254 | 94 | 4.40E−25 |
| 1022 | CGPG5038 | Pkinase | 345 | 620 | 172.1 | 1.40E−48 |
| 1022 | CGPG5038 | Pkinase_Tyr | 345 | 620 | 130.8 | 3.70E−36 |
| 1023 | CGPG5045 | LRRNT_2 | 24 | 67 | 38.3 | 2.70E−08 |
| 1023 | CGPG5045 | LRR_1 | 97 | 119 | 16.6 | 0.092 |
| 1023 | CGPG5045 | LRR_1 | 122 | 144 | 10.9 | 2.6 |
| 1023 | CGPG5045 | LRR_1 | 146 | 168 | 12.9 | 1.1 |
| 1023 | CGPG5045 | LRR_1 | 170 | 192 | 14.8 | 0.31 |
| 1023 | CGPG5045 | Pkinase | 306 | 576 | 6.1 | 6.30E−09 |
| 1024 | CGPG5048 | LRRNT_2 | 22 | 59 | 39.5 | 1.20E−08 |
| 1024 | CGPG5048 | LRR_1 | 89 | 111 | 16.8 | 0.08 |
| 1024 | CGPG5048 | LRR_1 | 113 | 135 | 13.6 | 0.72 |
| 1024 | CGPG5048 | LRR_1 | 137 | 159 | 20.2 | 0.0076 |
| 1024 | CGPG5048 | LRR_1 | 161 | 182 | 14.5 | 0.4 |
| 1024 | CGPG5048 | LRR_1 | 183 | 205 | 14.1 | 0.49 |
| 1024 | CGPG5048 | Pkinase | 307 | 578 | 47.4 | 2.20E−11 |
| 1025 | CGPG5051 | AOX | 45 | 323 | 739.1 | 3.00E−219 |
| 1026 | CGPG5061 | Fibrillarin | 1 | 99 | 56.9 | 6.50E−14 |
| 1027 | CGPG5062 | Skp1_POZ | 6 | 66 | 115.7 | 1.30E−31 |
| 1027 | CGPG5062 | Skp1 | 86 | 163 | 168.3 | 2.00E−47 |
| 1028 | CGPG5069 | Skp1_POZ | 4 | 64 | 108.8 | 1.60E−29 |
| 1028 | CGPG5069 | Skp1 | 89 | 167 | 169.2 | 1.10E−47 |
| 1029 | CGPG5070 | Skp1_POZ | 4 | 64 | 93.5 | 6.40E−25 |
| 1029 | CGPG5070 | Skp1 | 72 | 150 | 113.9 | 4.50E−31 |
| 1030 | CGPG5097 | Pkinase | 295 | 579 | 140.1 | 5.90E−39 |
| 1030 | CGPG5097 | Pkinase_Tyr | 295 | 579 | 68.2 | 2.60E−17 |
| 1031 | CGPG510 | Rho_GDI | 20 | 223 | 44 | 6.20E−12 |
| 1032 | CGPG5100 | Pkinase | 353 | 615 | −2.8 | 2.10E−08 |
| 1033 | CGPG5117 | efhand_like | 25 | 105 | 66.7 | 7.50E−17 |
| 1033 | CGPG5117 | PI-PLC-X | 107 | 251 | 133 | 8.30E−37 |
| 1033 | CGPG5117 | PI-PLC-Y | 294 | 412 | 87.5 | 4.20E−23 |
| 1033 | CGPG5117 | C2 | 430 | 523 | 64.2 | 4.10E−16 |
| 1034 | CGPG5151 | p450 | 1 | 282 | 11.9 | 1.60E−11 |
| 1035 | CGPG5155 | p450 | 27 | 493 | 112.9 | 9.10E−31 |
| 1036 | CGPG5159 | p450 | 26 | 520 | 145.4 | 1.50E−40 |
| 1037 | CGPG516 | HD | 233 | 337 | 53.7 | 6.00E−13 |
| 1037 | CGPG516 | RelA_SpoT | 427 | 537 | 165 | 1.90E−46 |
| 1037 | CGPG516 | p450 | 31 | 503 | 89.9 | 8.00E−24 |

TABLE 18-continued

| PEP SEQ ID | Construct ID | Pfam domain name | begin | start | score | E-value |
|---|---|---|---|---|---|---|
| 1039 | CGPG5186 | Thioredoxin | 70 | 172 | 137.3 | 4.20E−38 |
| 1040 | CGPG519 | Abhydrolase_1 | 59 | 279 | 29.7 | 1.10E−05 |
| 1041 | CGPG5190 | Ribosomal_L37 | 15 | 125 | 143.9 | 4.40E−40 |
| 1042 | CGPG5191 | TPR_2 | 166 | 199 | 22 | 0.0022 |
| 1044 | CGPG521 | Abhydrolase_1 | 65 | 282 | 21 | 0.00018 |
| 1044 | CGPG521 | DUF827 | 16 | 271 | 333.9 | 2.80E−97 |
| 1047 | CGPG5213 | DUF623 | 143 | 203 | 116.7 | 6.40E−32 |
| 1048 | CGPG522 | FA_desaturase | 62 | 277 | 200.7 | 3.50E−57 |
| 1049 | CGPG5223 | PG-M_PMM_I | 79 | 222 | 166.1 | 8.80E−47 |
| 1049 | CGPG5223 | PGM_PMM_II | 251 | 360 | 96.4 | 8.30E−26 |
| 1049 | CGPG5223 | PGM_PMM_III | 362 | 486 | 138.1 | 2.50E−38 |
| 1049 | CGPG5223 | PGM_PMM_IV | 507 | 612 | 75.4 | 1.80E−19 |
| 1050 | CGPG5224 | LRR_1 | 231 | 252 | 9.5 | 4.7 |
| 1050 | CGPG5224 | LRR_1 | 254 | 275 | 15.2 | 0.24 |
| 1050 | CGPG5224 | LRR_1 | 277 | 298 | 18.3 | 0.027 |
| 1050 | CGPG5224 | LRR_1 | 300 | 321 | 17.8 | 0.039 |
| 1050 | CGPG5224 | LRR_1 | 323 | 344 | 12.7 | 1.2 |
| 1050 | CGPG5224 | LRR_1 | 369 | 390 | 7.8 | 10 |
| 1050 | CGPG5224 | LRR_1 | 392 | 413 | 13.5 | 0.75 |
| 1050 | CGPG5224 | LRR_1 | 440 | 461 | 17.7 | 0.041 |
| 1051 | CGPG5225 | p450 | 37 | 452 | 209.6 | 7.00E−60 |
| 1052 | CGPG5254 | 2OG-FeII_Oxy | 162 | 279 | 65.3 | 1.90E−16 |
| 1053 | CGPG5257 | SpoIIE | 130 | 374 | 52.9 | 1.00E−12 |
| 1054 | CGPG5262 | SH3_1 | 303 | 359 | 75.4 | 1.80E−19 |
| 1054 | CGPG5262 | SH3_2 | 304 | 359 | 35.8 | 1.50E−07 |
| 1056 | CGPG5282 | F-box | 17 | 69 | 14.5 | 0.39 |
| 1056 | CGPG5282 | Sel1 | 129 | 167 | 19.9 | 0.0091 |
| 1056 | CGPG5282 | Sel1 | 168 | 203 | 12.2 | 0.47 |
| 1056 | CGPG5282 | zf-MYND | 273 | 317 | 38.2 | 2.80E−08 |
| 1058 | CGPG532 | Transket_pyr | 30 | 207 | 261.4 | 1.90E−75 |
| 1058 | CGPG532 | Transketolase_C | 222 | 342 | 175.3 | 1.50E−49 |
| 1059 | CGPG5336 | adh_short | 19 | 188 | 81.3 | 3.10E−21 |
| 1059 | CGPG5336 | KR | 19 | 205 | −66.7 | 0.0017 |
| 1060 | CGPG5350 | Aminotran_4 | 107 | 395 | 353.2 | 4.30E−103 |
| 1061 | CGPG5355 | GRAM | 95 | 173 | 41.4 | 3.20E−09 |
| 1062 | CGPG5376 | DUF21 | 14 | 191 | 162.9 | 8.00E−46 |
| 1062 | CGPG5376 | CBS | 210 | 326 | 27 | 6.60E−05 |
| 1063 | CGPG5377 | CBS | 81 | 226 | 138.6 | 1.70E−38 |
| 1064 | CGPG5382 | B56 | 93 | 416 | 759.8 | 1.80E−225 |
| 1065 | CGPG5385 | Pyridoxal_deC | 146 | 452 | −54.5 | 1.00E−10 |
| 1065 | CGPG5385 | Aminotran_5 | 150 | 491 | −148.7 | 7.00E−05 |
| 1066 | CGPG539 | Citrate_synt | 78 | 455 | 764.2 | 8.10E−227 |
| 1067 | CGPG5437 | IQ | 115 | 135 | 31.3 | 3.40E−06 |
| 1068 | CGPG5450 | DHDPS | 64 | 341 | 486.2 | 4.00E−143 |
| 1069 | CGPG5473 | Xan_ur_permease | 31 | 438 | 164.5 | 2.70E−46 |
| 1070 | CGPG55 | Sugar_tr | 6 | 719 | 208.1 | 2.10E−59 |
| 1070 | CGPG55 | MFS_1 | 11 | 678 | 137.1 | 4.70E−3B |
| 1071 | CGPG5505 | AlaDh_PNT_N | 18 | 154 | 81.4 | 2.80E−21 |
| 1071 | CGPG5505 | AlaDh_PNT_C | 194 | 400 | 134 | 4.10E−37 |
| 1071 | CGPG5505 | Saccharop_dh_N | 477 | 583 | 228.5 | 1.50E−65 |
| 1071 | CGPG5505 | ThiF | 585 | 714 | −36.3 | 0.0039 |
| 1071 | CGPG5505 | Saccharop_dh | 589 | 1060 | 377.2 | 2.50E−110 |
| 1073 | CGPG5514 | Cyclin_N | 165 | 294 | 211.1 | 2.60E−60 |
| 1073 | CGPG5514 | Cyclin_C | 296 | 422 | 111.3 | 2.70E−30 |
| 1074 | CGPG5541 | Pkinase | 316 | 590 | 319.8 | 4.80E−93 |
| 1075 | CGPG5546 | Cyclin | 108 | 264 | 289.2 | 7.70E−84 |
| 1076 | CGPG5552 | Cornichon | 2 | 125 | 268.7 | 1.20E−77 |
| 1077 | CGPG5556 | SAC3_GANP | 20 | 211 | 214.5 | 2.30E−61 |
| 1078 | CGPG557 | Chitin_bind_1 | 21 | 62 | 72.3 | 1.50E−18 |
| 1078 | CGPG557 | Barwin | 73 | 191 | 311.7 | 1.30E−90 |
| 1079 | CGPG5576 | zf-PARP | 11 | 88 | 88.5 | 2.10E−23 |
| 1079 | CGPG5576 | zf-PARP | 117 | 195 | 65.3 | 2.00E−16 |
| 1079 | CGPG5576 | PADR1 | 290 | 343 | 120.6 | 4.40E−33 |
| 1079 | CGPG5576 | BRCT | 394 | 471 | 47.4 | 4.80E−11 |
| 1079 | CGPG5576 | WGR | 517 | 605 | 153 | 7.90E−43 |
| 1079 | CGPG5576 | PARP_reg | 633 | 765 | 87.7 | 3.60E−23 |
| 1079 | CGPG5576 | PARP | 767 | 979 | 434.2 | 1.80E−127 |
| 1080 | CGPG5596 | Response_reg | 9 | 143 | 77.4 | 4.60E−20 |
| 1081 | CGPG5605 | DEAD | 52 | 221 | 246.1 | 7.20E−71 |
| 1081 | CGPG5605 | Helicase_C | 290 | 366 | 89.9 | 7.50E−24 |
| 1082 | CGPG5606 | LRRNT_2 | 21 | 62 | 49.4 | 1.20E−11 |
| 1082 | CGPG5606 | LRR_1 | 90 | 113 | 14.1 | 0.52 |
| 1082 | CGPG5606 | LRR_1 | 115 | 137 | 14.7 | 0.35 |
| 1082 | CGPG5606 | LRR_1 | 140 | 162 | 19.3 | 0.014 |
| 1082 | CGPG5606 | LRR_1 | 164 | 186 | 17.2 | 0.059 |
| 1082 | CGPG5606 | LRR_1 | 188 | 211 | 11.7 | 1.9 |
| 1082 | CGPG5606 | LRR_1 | 213 | 235 | 14.2 | 0.47 |

TABLE 18-continued

| PEP SEQ ID | Construct ID | Pfam domain name | begin | start | score | E-value |
|---|---|---|---|---|---|---|
| 1082 | CGPG5606 | LRR_1 | 237 | 259 | 16.1 | 0.13 |
| 1082 | CGPG5606 | LRR_1 | 261 | 283 | 8.9 | 6.3 |
| 1082 | CGPG5606 | LRR_1 | 308 | 330 | 12 | 1.6 |
| 1082 | CGPG5606 | LRR_1 | 332 | 354 | 11.1 | 2.4 |
| 1082 | CGPG5606 | LRR_1 | 356 | 375 | 9.3 | 5.1 |
| 1082 | CGPG5606 | LRR_1 | 380 | 402 | 10.8 | 2.7 |
| 1082 | CGPG5606 | LRR_1 | 404 | 426 | 17.1 | 0.065 |
| 1082 | CGPG5606 | LRR_1 | 428 | 450 | 11 | 1.6 |
| 1082 | CGPG5606 | LRR_1 | 452 | 474 | 14.6 | 0.36 |
| 1082 | CGPG5606 | LRR_1 | 500 | 522 | 14.3 | 0.44 |
| 1082 | CGPG5606 | LRR_1 | 524 | 546 | 14.9 | 0.28 |
| 1082 | CGPG5606 | LRR_1 | 548 | 570 | 15.1 | 0.25 |
| 1082 | CGPG5606 | LRR_1 | 571 | 592 | 15.6 | 0.18 |
| 1082 | CGPG5606 | Pkinase | 683 | 964 | 125.6 | 1.40E−34 |
| 1082 | CGPG5606 | Pkinase_Tyr | 683 | 964 | 85 | 2.30E−22 |
| 1083 | CGPG561 | XG_FTase | 54 | 532 | 1264.7 | 0 |
| 1084 | CGPG5618 | Lectin_legB | 20 | 247 | 260.2 | 4.30E−75 |
| 1084 | CGPG5618 | Pkinase | 376 | 651 | 185.1 | 1.70E−52 |
| 1084 | CGPG5618 | Pkinase_Tyr | 376 | 651 | 141.6 | 2.10E−39 |
| 1085 | CGPG5642 | Aldedh | 18 | 477 | 674.3 | 9.50E−200 |
| 1086 | CGPG5644 | ELFV_dehydrog_N | 51 | 181 | 278.1 | 1.80E−80 |
| 1086 | CGPG5644 | ELFV_dehydrog | 197 | 428 | 394.9 | 1.20E−115 |
| 1087 | CGPG5647 | Aldedh | 46 | 511 | 669.6 | 2.50E−198 |
| 1088 | CGPG5655 | Glutaminase | 23 | 309 | 642.2 | 4.30E−190 |
| 1089 | CGPG5660 | Glutaminase | 24 | 308 | 599 | 4.30E−177 |
| 1090 | CGPG5662 | Aminotran_3 | 47 | 381 | 473.1 | 3.30E−139 |
| 1091 | CGPG568 | FTHFS | 14 | 634 | 1422.6 | 0 |
| 1092 | CGPG5686 | Aminotran_3 | 31 | 387 | 365.8 | 7.00E−107 |
| 1093 | CGPG5702 | Gln-synt_N | 28 | 109 | 171.5 | 2.10E−48 |
| 1093 | CGPG5702 | Gln-synt_C | 116 | 397 | 581.1 | 1.10E−171 |
| 1094 | CGPG5712 | Pribosyltran | 22 | 158 | 167.1 | 4.50E−47 |
| 1095 | CGPG5713 | Rib_5-P_isom_A | 55 | 229 | 353.2 | 4.30E−103 |
| 1096 | CGPG5715 | Pribosyltran | 27 | 163 | 131.6 | 2.20E−36 |
| 1097 | CGPG5723 | NDK | 4 | 138 | 304.7 | 1.80E−88 |
| 1098 | CGPG5729 | Cyclin_N | 210 | 336 | 218.9 | 1.20E−62 |
| 1098 | CGPG5729 | Cyclin_C | 338 | 457 | 133.1 | 7.50E−37 |
| 1099 | CGPG5730 | Lung_7-TM_R | 151 | 444 | 474.5 | 1.30E−139 |
| 1101 | CGPG5741 | NIF | 165 | 344 | 184.2 | 3.20E−52 |
| 1102 | CGPG5752 | CAF1 | 161 | 404 | 356.1 | 5.80E−104 |
| 1103 | CGPG5771 | Acyltransferase | 84 | 277 | 123.8 | 4.90E−34 |
| 1104 | CGPG5778 | Aa_trans | 51 | 498 | 498.7 | 6.60E−147 |
| 1105 | CGPG5782 | Sugar_tr | 65 | 525 | 819.5 | 1.80E−243 |
| 1105 | CGPG5782 | MFS_1 | 69 | 485 | 103.5 | 6.40E−28 |
| 1106 | CGPG5785 | Sugar_tr | 69 | 530 | 791.6 | 4.50E−235 |
| 1106 | CGPG5785 | MFS_1 | 73 | 490 | 88.2 | 2.50E−23 |
| 1107 | CGPG5797 | AA_permease | 94 | 562 | 588.2 | 7.60E−174 |
| 1108 | CGPG580 | MGDG_synth | 155 | 323 | 316.4 | 5.00E−92 |
| 1108 | CGPG580 | Glyco_tran_28_C | 349 | 512 | 5.9 | 0.0004 |
| 1109 | CGPG5805 | AA_permease | 57 | 511 | 619.8 | 2.40E−183 |
| 1110 | CGPG5810 | Ank | 74 | 106 | 1.8 | 17 |
| 1110 | CGPG5810 | Ank | 107 | 139 | 51.9 | 2.10E−12 |
| 1110 | CGPG5810 | Pkinase | 197 | 468 | 93.7 | 5.40E−25 |
| 1110 | CGPG5810 | Pkinase_Tyr | 200 | 468 | 100.3 | 5.80E−27 |
| 1111 | CGPG5822 | Pkinase | 131 | 418 | 302.6 | 7.40E−88 |
| 1112 | CGPG5837 | Pkinase | 14 | 275 | 128.1 | 2.50E−35 |
| 1113 | CGPG5855 | Pkinase_Tyr | 81 | 363 | 133.4 | 6.10E−37 |
| 1113 | CGPG5855 | Pkinase | 81 | 363 | 158.3 | 2.00E−44 |
| 1114 | CGPG5868 | Pkinase_Tyr | 45 | 312 | 154.4 | 3.00E−43 |
| 1114 | CGPG5868 | Pkinase | 45 | 312 | 150.1 | 6.00E−42 |
| 1115 | CGPG587 | FKBP_C | 104 | 208 | 138.8 | 1.50E−38 |
| 1117 | CGPG5893 | Pkinase | 52 | 314 | −49.3 | 1.30E−05 |
| 1118 | CGPG5909 | ADH_zinc_N | 163 | 310 | 104.4 | 3.40E−28 |
| 1119 | CGPG5914 | ADH_N | 54 | 188 | 144.5 | 2.80E−40 |
| 1119 | CGPG5914 | ADH_zinc_N | 219 | 362 | 157.2 | 4.30E−44 |
| 1123 | CGPG5930 | Mov34 | 328 | 437 | 81.7 | 2.30E−21 |
| 1124 | CGPG5945 | Pyr_redox_2 | 8 | 305 | 125.3 | 1.70E−34 |
| 1124 | CGPG5945 | Pyr_redox | 167 | 262 | 104.5 | 3.00E−28 |
| 1125 | CGPG5958 | Pyr_redox_2 | 8 | 304 | 126.4 | 8.20E−35 |
| 1125 | CGPG5958 | Pyr_redox | 166 | 261 | 115.1 | 2.00E−31 |
| 1126 | CGPG5977 | Ank | 48 | 80 | 1.7 | 18 |
| 1126 | CGPG5977 | Ank | 81 | 113 | 39.4 | 1.30E−08 |
| 1126 | CGPG5977 | Ank | 114 | 146 | 18.6 | 0.023 |
| 1126 | CGPG5977 | Pkinase | 166 | 424 | 186.4 | 6.90E−53 |
| 1126 | CGPG5977 | Pkinase_Tyr | 166 | 424 | 172.3 | 1.20E−48 |
| 1127 | CGPG598 | Nramp | 66 | 429 | 644.5 | 8.90E−191 |
| 1128 | CGPG5986 | Pkinase | 43 | 329 | 323.5 | 3.60E−94 |
| 1129 | CGPG5994 | F-box | 62 | 108 | 15.1 | 0.26 |

TABLE 18-continued

| PEP SEQ ID | Construct ID | Pfam domain name | begin | start | score | E-value |
|---|---|---|---|---|---|---|
| 1129 | CGPG5994 | LRR_2 | 314 | 340 | 17.1 | 0.063 |
| 1130 | CGPG5996 | Tetraspannin | 4 | 230 | 244.3 | 2.60E−70 |
| 1131 | CGPG6021 | RRM_1 | 8 | 77 | 73.1 | 8.60E−19 |
| 1131 | CGPG6021 | RRM_1 | 108 | 178 | 81.2 | 3.20E−21 |
| 1132 | CGPG6027 | RRM_1 | 42 | 113 | 104.5 | 3.10E−28 |
| 1133 | CGPG6035 | Pyr_redox_2 | 51 | 370 | 86.5 | 8.30E−23 |
| 1133 | CGPG6035 | Pyr_redox | 216 | 323 | 55.5 | 1.80E−13 |
| 1133 | CGPG6035 | efhand | 376 | 404 | 23.3 | 0.00087 |
| 1134 | CGPG604 | PSI_PsaH | 6 | 145 | 342.9 | 5.50E−100 |
| 1136 | CGPG606 | Phytochelatin | 46 | 178 | 381.8 | 1.10E−111 |
| 1136 | CGPG606 | DUF1984 | 179 | 259 | 206.3 | 7.10E−59 |
| 1137 | CGPG6069 | RNA_pol_L | 90 | 382 | 75.5 | 1.60E−19 |
| 1137 | CGPG6069 | RNA_pol_A_bac | 124 | 268 | 113 | 8.80E−31 |
| 1138 | CGPG608 | TB2_DP1_HVA22 | 11 | 108 | 188.4 | 1.70E−53 |
| 1139 | CGPG6080 | Str_synth | 144 | 232 | 164.7 | 2.40E−46 |
| 1140 | CGPG6082 | Miro | 8 | 121 | 62.7 | 1.20E−15 |
| 1140 | CGPG6082 | Ras | 8 | 179 | 254 | 3.00E−73 |
| 1141 | CGPG6089 | NicO | 153 | 372 | 147.1 | 4.70E−41 |
| 1143 | CGPG6128 | Reticulon | 22 | 197 | 303.7 | 3.40E−88 |
| 1144 | CGPG614 | cobW | 74 | 246 | 232.9 | 6.80E−67 |
| 1145 | CGPG6149 | Glutaredoxin | 84 | 148 | 115.9 | 1.10E−31 |
| 1146 | CGPG6172 | Miro | 11 | 126 | 74.1 | 4.60E−19 |
| 1146 | CGPG6172 | Ras | 11 | 173 | 288.8 | 1.00E−83 |
| 1147 | CGPG6174 | Miro | 19 | 133 | 75.8 | 1.30E−19 |
| 1147 | CGPG6174 | Ras | 19 | 180 | 326.5 | 4.80E−95 |
| 1148 | CGPG6176 | Miro | 15 | 130 | 63.8 | 5.50E−16 |
| 1148 | CGPG6176 | Ras | 15 | 177 | 285.5 | 1.00E−82 |
| 1149 | CGPG6197 | Phi_1 | 55 | 334 | 656.6 | 2.00E−194 |
| 1150 | CGPG620 | tRNA-synt_1g | 71 | 430 | 627.4 | 1.20E−185 |
| 1152 | CGPG6204 | mTERF | 75 | 357 | 69.9 | 8.00E−18 |
| 1153 | CGPG621 | RRM_1 | 19 | 90 | 20.7 | 0.0017 |
| 1154 | CGPG6210 | MFS_1 | 26 | 419 | 55.8 | 1.40E−13 |
| 1154 | CGPG6210 | Sugar_tr | 29_ | 459 | 239.3 | 8.30E−69 |
| 1155 | CGPG6211 | Sugar_tr | 24 | 479 | 469.9 | 3.00E−138 |
| 1155 | CGPG6211 | MFS_1 | 30 | 443 | 98.8 | 1.60E−26 |
| 1156 | CGPG6214 | Sugar_tr | 26 | 487 | 541.1 | 1.20E−159 |
| 1156 | CGPG6214 | MFS_1 | 32 | 448 | 89.3 | 1.20E−23 |
| 1157 | CGPG6215 | MFS_1 | 34 | 498 | 52.2 | 1.80E−12 |
| 1157 | CGPG6215 | PTR2 | 93 | 486 | 181.3 | 2.40E−51 |
| 1158 | CGPG6222 | Sugar_tr | 27 | 490 | 523.9 | 1.70E−154 |
| 1158 | CGPG6222 | MFS_1 | 31 | 447 | 92.4 | 1.40E−24 |
| 1159 | CGPG6229 | MFS_1 | 23 | 447 | 97.4 | 4.40E−26 |
| 1159 | CGPG6229 | Sugar_tr | 28 | 490 | 565.7 | 4.40E−167 |
| 1160 | CGPG6233 | Sugar_tr | 22 | 512 | 23.1 | 1.30E−07 |
| 1160 | CGPG6233 | MFS_1 | 37 | 473 | 69.1 | 1.40E−17 |
| 1161 | CGPG6237 | Sugar_tr | 25 | 483 | 398.5 | 1.00E−116 |
| 1161 | CGPG6237 | MFS_1 | 29 | 442 | 110 | 6.80E−30 |
| 1162 | CGPG6243 | Pkinase | 25 | 333 | 289.3 | 7.40E−84 |
| 1163 | CGPG6248 | Pkinase | 22 | 276 | 338.1 | 1.50E−98 |
| 1163 | CGPG6248 | NAF | 306 | 366 | 64.3 | 3.90E−16 |
| 1164 | CGPG6252 | Pkinase | 12 | 266 | 340.3 | 3.20E−99 |
| 1164 | CGPG6252 | NAF | 298 | 358 | 110.9 | 3.70E−30 |
| 1165 | CGPG6267 | Pkinase | 68 | 306 | −7.3 | 4.00E−08 |
| 1166 | CGPG6272 | Pkinase | 74 | 349 | 167.4 | 3.70E−47 |
| 1166 | CGPG6272 | Pkinase_Tyr | 74 | 349 | 134.3 | 3.20E−37 |
| 1167 | CGPG6294 | Pkinase | 75 | 352 | −1.8 | 1.90E−08 |
| 1168 | CGPG63 | p450 | 44 | 511 | 425.2 | 8.90E−125 |
| 1170 | CGPG6317 | MFS_1 | 39 | 504 | 44.5 | 3.50E−10 |
| 1170 | CGPG6317 | PTR2 | 101 | 488 | 297.8 | 2.00E−86 |
| 1171 | CGPG6328 | Trehalose_PPase | 121 | 354 | 380.5 | 2.60E−111 |
| 1172 | CGPG6334 | Sterol_desat | 34 | 245 | 281.2 | 2.00E−81 |
| 1173 | CGPG6336 | Sterol_desat | 38 | 247 | 261.6 | 1.60E−75 |
| 1174 | CGPG6349 | LRR_1 | 42 | 62 | 15.7 | 0.17 |
| 1174 | CGPG6349 | LRR_1 | 64 | 84 | 7.9 | 9.3 |
| 1174 | CGPG6349 | LRR_1 | 108 | 128 | 11.6 | 1.9 |
| 1174 | CGPG6349 | LRR_1 | 130 | 151 | 12.5 | 1.3 |
| 1174 | CGPG6349 | LRR_1 | 153 | 174 | 10.7 | 2.9 |
| 1174 | CGPG6349 | LRR_1 | 176 | 197 | 11.9 | 1.7 |
| 1174 | CGPG6349 | LRR_1 | 199 | 219 | 7.9 | 9.6 |
| 1175 | CGPG6352 | zf-CCHC | 81 | 98 | 18.4 | 0.00091 |
| 1177 | CGPG6364 | Gp_dh_N | 3 | 152 | 341.6 | 1.30E−99 |
| 1177 | CGPG6364 | Gp_dh_C | 157 | 313 | 381.4 | 1.40E−111 |
| 1178 | CGPG6366 | Gp_dh_N | 3 | 153 | 301.7 | 1.40E−87 |
| 1178 | CGPG6366 | Gp_dh_C | 158 | 314 | 334 | 2.60E−97 |
| 1179 | CGPG6375 | Aminotran_1_2 | 36 | 390 | 217 | 4.30E−62 |
| 1180 | CGPG6388 | NTP_transferase | 15 | 285 | 397.9 | 1.50E−116 |
| 1181 | CGPG6391 | ADH_N | 32 | 143 | 172.7 | 9.30E−49 |

TABLE 18-continued

| PEP SEQ ID | Construct ID | Pfam domain name | begin | start | score | E-value |
|---|---|---|---|---|---|---|
| 1181 | CGPG6391 | ADH_zinc_N | 172 | 312 | 193.2 | 6.00E−55 |
| 1182 | CGPG6399 | ADH_N | 27 | 155 | 135.6 | 1.30E−37 |
| 1182 | CGPG6399 | ADH_zinc_N | 186 | 332 | 115.4 | 1.70E−31 |
| 1183 | CGPG6407 | Glucokinase | 5 | 341 | 569.2 | 4.00E−168 |
| 1184 | CGPG6418 | ADH_N | 28 | 156 | 128.2 | 2.40E−35 |
| 1184 | CGPG6418 | ADH_zinc_N | 187 | 333 | 135.1 | 2.00E−37 |
| 1185 | CGPG6430 | Iso_dh | 6 | 355 | 346.2 | 5.40E−101 |
| 1186 | CGPG6432 | ADH_N | 25 | 135 | 157.5 | 3.40E−44 |
| 1186 | CGPG6432 | ADH_zinc_N | 166 | 305 | 114.8 | 2.40E−31 |
| 1187 | CGPG6437 | TPT | 205 | 388 | 167.3 | 4.00E−47 |
| 1188 | CGPG6445 | Aldedh | 45 | 511 | 720.6 | 1.10E−213 |
| 1189 | CGPG6450 | Aldedh | 26 | 491 | 797.6 | 7.00E−237 |
| 1190 | CGPG6458 | Aldedh | 22 | 480 | 796.6 | 1.40E−236 |
| 1191 | CGPG6465 | PfkB | 10 | 314 | 274.5 | 2.10E−79 |
| 1192 | CGPG6476 | PFK | 3 | 278 | 659.8 | 2.20E−195 |
| 1193 | CGPG6505 | Aminotran_3 | 123 | 449 | 321.7 | 1.30E−93 |
| 1194 | CGPG6507 | Gln-synt_N | 105 | 187 | 85.7 | 1.50E−22 |
| 1194 | CGPG6507 | Gln-synt_C | 193 | 446 | 528.1 | 9.40E−156 |
| 1195 | CGPG6509 | Glutaminase | 112 | 396 | 599 | 4.30E−177 |
| 1196 | CGPG6510 | Aldedh | 17 | 476 | 689.2 | 3.10E−204 |
| 1197 | CGPG6515 | Aldedh | 19 | 476 | 789.7 | 1.70E−234 |
| 1198 | CGPG6520 | Aldedh | 29 | 491 | 790.7 | 8.30E−235 |
| 1199 | CGPG6531 | Enolase_N | 3 | 133 | 215.5 | 1.20E−61 |
| 1199 | CGPG6531 | Enolase_C | 138 | 425 | 571.7 | 7.20E−169 |
| 1200 | CGPG6553 | Aldedh | 103 | 563 | 768.4 | 4.40E−228 |
| 1201 | CGPG6557 | ELFV_dehydrog_N | 145 | 275 | 294.9 | 1.50E−85 |
| 1201 | CGPG6557 | ELFV_dehydrog | 290 | 533 | 486.7 | 2.80E−143 |
| 1202 | CGPG6563 | Aminotran_1_2 | 120 | 472 | 403.3 | 3.50E−118 |
| 1203 | CGPG6564 | iPGM_N | 90 | 451 | 876.8 | 1.00E−260 |
| 1203 | CGPG6564 | Metalloenzyme | 461 | 576 | 173.3 | 5.90E−49 |
| 1204 | CGPG6572 | Gp_dh_N | 91 | 241 | 301.7 | 1.40E−87 |
| 1204 | CGPG6572 | Gp_dh_C | 246 | 402 | 334 | 2.60E−97 |
| 1205 | CGPG6577 | iPGM_N | 92 | 451 | 863.6 | 9.30E−257 |
| 1205 | CGPG6577 | Metalloenzyme | 461 | 577 | 195.7 | 1.10E−55 |
| 1206 | CGPG6588 | DAO | 92 | 493 | −24.3 | 0.00021 |
| 1206 | CGPG6588 | FAD_binding_2 | 92 | 421 | −110.2 | 0.0013 |
| 1206 | CGPG6588 | GIDA | 92 | 418 | −223.3 | 0.0021 |
| 1206 | CGPG6588 | Pyr_redox_2 | 92 | 409 | 252.3 | 9.90E−73 |
| 1206 | CGPG6588 | Pyr_redox | 265 | 362 | 125.3 | 1.70E−34 |
| 1206 | CGPG6588 | Pyr_redox_dim | 437 | 546 | 222.4 | 9.80E−64 |
| 1207 | CGPG6596 | Biotin_lipoyl | 91 | 164 | 76 | 1.20E−19 |
| 1207 | CGPG6596 | E3_binding | 228 | 264 | 68.1 | 2.70E−17 |
| 1207 | CGPG6596 | 2-oxoacid_dh | 296 | 521 | 326.6 | 4.20E−95 |
| 1209 | CGPG6619 | Transketolase_N | 101 | 435 | 777.9 | 5.90E−231 |
| 1209 | CGPG6619 | Transket_pyr | 450 | 627 | 245.4 | 1.20E−70 |
| 1209 | CGPG6619 | Transketolase_C | 639 | 754 | 36.1 | 1.30E−07 |
| 1210 | CGPG6623 | PGAM | 96 | 330 | 130.8 | 3.80E−36 |
| 1211 | CGPG6626 | OstA | 109 | 219 | 106.8 | 6.20E−29 |
| 1212 | CGPG663 | Pro_CA | 155 | 325 | 357.7 | 1.90E−104 |
| 1213 | CGPG6635 | Cytochrom_C | 126 | 204 | 55.4 | 1.90E−13 |
| 1215 | CGPG6641 | AstE_AspA | 93 | 372 | 312.6 | 7.00E−91 |
| 1216 | CGPG6642 | Transket_pyr | 125 | 303 | 234.2 | 2.70E−67 |
| 1216 | CGPG6642 | Transketolase_C | 319 | 443 | 196.1 | 8.20E−56 |
| 1217 | CGPG6645 | TIM | 95 | 336 | 398.9 | 7.60E−117 |
| 1218 | CGPG6660 | CBS | 97 | 214 | 118.4 | 2.00E−32 |
| 1219 | CGPG6671 | NTP_transferase | 102 | 374 | 277.3 | 2.90E−80 |
| 1220 | CGPG6697 | Transaldolase | 100 | 400 | 657.9 | 7.90E−195 |
| 1221 | CGPG6706 | iPGM_N | 90 | 451 | 870.1 | 1.00E−258 |
| 1221 | CGPG6706 | Metalloenzyme | 461 | 576 | 191.4 | 2.10E−54 |
| 1222 | CGPG6723 | Aminotran_1_2 | 124 | 478 | 217 | 4.30E−62 |
| 1223 | CGPG6729 | Gln-synt_N | 100 | 182 | 148.3 | 2.00E−41 |
| 1223 | CGPG6729 | Gln-synt_C | 189 | 470 | 568.5 | 6.70E−168 |
| 1224 | CGPG6738 | Aminotran_1_2 | 123 | 473 | 205.6 | 1.10E−58 |
| 1225 | CGPG6742 | Aldedh | 105 | 563 | 730.5 | 1.10E−216 |
| 1226 | CGPG6752 | TIM | 92 | 334 | 465.9 | 5.00E−137 |
| 1227 | CGPG6760 | GATase_2 | 2 | 164 | −6.7 | 1.70E−10 |
| 1227 | CGPG6760 | Asn_synthase | 241 | 531 | 383.2 | 3.80E−112 |
| 1228 | CGPG6768 | PGI | 55 | 545 | 770.6 | 9.60E−229 |
| 1229 | CGPG6779 | Isoamylase_N | 105 | 182 | 91.3 | 2.90E−24 |
| 1229 | CGPG6779 | Alpha-amylase | 219 | 613 | 30.3 | 8.20E−08 |
| 1230 | CGPG6785 | Molybdop_Fe4S4 | 44 | 105 | 86.1 | 1.10E−22 |
| 1230 | CGPG6785 | Molybdopterin | 108 | 660 | 93.7 | 5.70E−25 |
| 1230 | CGPG6785 | Molydop_binding | 892 | 1011 | 60.2 | 6.90E−15 |
| 1231 | CGPG6800 | PGI | 52 | 541 | 1093.7 | 0 |
| 1232 | CGPG686 | RRM_1 | 9 | 80 | 101 | 3.50E−27 |
| 1232 | CGPG686 | zf-CCHC | 118 | 135 | 37.8 | 3.90E−08 |
| 1233 | CGPG6898 | Hin1 | 28 | 163 | 112.4 | 1.30E−30 |

TABLE 18-continued

| PEP SEQ ID | Construct ID | Pfam domain name | begin | start | score | E-value |
|---|---|---|---|---|---|---|
| 1234 | CGPG6900 | Pkinase | 97 | 365 | 172.1 | 1.40E-48 |
| 1236 | CGPG6920 | Dehydrin | 14 | 128 | 165.3 | 1.50E-46 |
| 1237 | CGPG6921 | CorA | 48 | 440 | 576.8 | 2.10E-170 |
| 1240 | CGPG6945 | SNARE | 37 | 99 | 67.1 | 5.60E-17 |
| 1241 | CGPG6946 | MATH | 13 | 133 | 30.7 | 5.10E-06 |
| 1242 | CGPG6948 | PAP2 | 100 | 233 | 71.2 | 3.40E-18 |
| 1243 | CGPG6974 | DUF538 | 7 | 146 | 248.7 | 1.20E-71 |
| 1244 | CGPG6976 | DUF926 | 293 | 406 | 220 | 5.20E-63 |
| 1245 | CGPG6996 | CPDase | 1 | 179 | 275.9 | 7.80E-80 |
| 1246 | CGPG7002 | zf-C3HC4 | 123 | 157 | 25 | 0.00026 |
| 1247 | CGPG7013 | zf-C3HC4 | 115 | 156 | 26.2 | 0.00011 |
| 1248 | CGPG7021 | Invertase_neut | 98 | 564 | 1154 | 0 |
| 1248 | CGPG7021 | GDE_C | 151 | 537 | −212.6 | 0.0022 |
| 1251 | CGPG7075 | DUF1749 | 77 | 349 | 217.1 | 3.80E-62 |
| 1252 | CGPG7080 | Glutaredoxin | 44 | 106 | 97.2 | 5.10E-26 |
| 1253 | CGPG7094 | DUF300 | 6 | 281 | 574.1 | 1.40E-169 |
| 1254 | CGPG7095 | Abhydrolase_3 | 107 | 321 | 295.6 | 9.10E-86 |
| 1255 | CGPG7104 | Saccharop_dh | 13 | 445 | 35.1 | 6.50E-09 |
| 1256 | CGPG7118 | F-box | 25 | 73 | 25 | 0.00026 |
| 1257 | CGPG7122 | Pkinase | 20 | 280 | 206.6 | 5.70E-59 |
| 1257 | CGPG7122 | Pkinase_Tyr | 20 | 280 | 199.1 | 1.10E-56 |
| 1258 | CGPG713 | Cyclin_N | 5 | 135 | 6.2 | 4.30E-05 |
| 1259 | CGPG7130 | CS | 145 | 220 | 109.9 | 7.50E-30 |
| 1260 | CGPG7145 | Transthyretin | 191 | 310 | 185.5 | 1.30E-52 |
| 1261 | CGPG7166 | DnaJ | 79 | 141 | 29.6 | 5.80E-06 |
| 1262 | CGPG7179 | Bystin | 127 | 423 | 795.6 | 2.90E-236 |
| 1263 | CGPG7184 | PBD | 27 | 127 | 24 | 0.0002 |
| 1264 | CGPG7185 | GAF | 190 | 346 | 32.9 | 1.10E-06 |
| 1264 | CGPG7185 | HisKA | 382 | 445 | 24.6 | 0.00036 |
| 1265 | CGPG7192 | 2OG-FeII_Oxy | 201 | 301 | 136.6 | 6.60E-38 |
| 1266 | CGPG7199 | RWD | 3 | 122 | 126.7 | 6.30E-35 |
| 1267 | CGPG72 | Amino_oxidase | 66 | 528 | 217.5 | 3.10E-62 |
| 1268 | CGPG7231 | B3_4 | 118 | 280 | 89.3 | 1.10E-23 |
| 1268 | CGPG7231 | B5 | 305 | 378 | 94.9 | 2.40E-25 |
| 1269 | CGPG7241 | Peptidase_C26 | 58 | 281 | 149 | 1.20E-41 |
| 1272 | CGPG7265 | ARM_1 | 12 | 296 | 531.9 | 6.60E-157 |
| 1273 | CGPG7274 | DUF640 | 36 | 168 | 312.1 | 1.00E-90 |
| 1274 | CGPG7291 | eIF-1a | 20 | 91 | 71.9 | 2.00E-18 |
| 1275 | CGPG7303 | Aldedh | 20 | 484 | 779 | 2.80E-231 |
| 1276 | CGPG7315 | Y_phosphatase2 | 116 | 280 | 346.6 | 4.00E-101 |
| 1278 | CGPG7327 | Actin | 2 | 470 | 33.2 | 5.40E-16 |
| 1280 | CGPG7347 | Tcp11 | 648 | 1133 | 261.8 | 1.40E-75 |
| 1281 | CGPG7348 | CorA | 90 | 467 | 408.2 | 1.20E-119 |
| 1283 | CGPG7356 | Metallophos | 2 | 120 | 28.1 | 3.10E-05 |
| 1284 | CGPG7359 | Methyltransf_11 | 38 | 135 | 43.8 | 5.80E-10 |
| 1284 | CGPG7359 | Methyltransf_12 | 38 | 133 | 46 | 1.30E-10 |
| 1286 | CGPG7372 | zf-C3HC4 | 119 | 160 | 38.8 | 1.90E-08 |
| 1287 | CGPG7379 | zf-C3HC4 | 36 | 76 | 39.6 | 1.10E-08 |
| 1288 | CGPG7398 | DUF212 | 22 | 167 | 141.6 | 2.10E-39 |
| 1289 | CGPG7403 | TLD | 203 | 341 | 176.8 | 5.30E-50 |
| 1290 | CGPG7404 | PBP | 25 | 170 | 217.5 | 2.90E-62 |
| 1291 | CGPG7410 | HLH | 36 | 83 | 14 | 0.0047 |
| 1292 | CGPG7417 | MMR_HSR1 | 131 | 252 | 120.2 | 6.00E-33 |
| 1293 | CGPG7423 | Gln-synt_N | 102 | 183 | 171.5 | 2.10E-48 |
| 1293 | CGPG7423 | Gln-synt_C | 190 | 471 | 581.1 | 1.10E-171 |
| 1294 | CGPG7424 | FBPase | 92 | 424 | 521.2 | 1.20E-153 |
| 1297 | CGPG7443 | DUF1001 | 92 | 274 | 425.2 | 9.10E-125 |
| 1298 | CGPG7449 | ScpA_ScpB | 104 | 347 | 405 | 1.10E-118 |
| 1301 | CGPG7459 | DUF1350 | 90 | 360 | 812.2 | 2.80E-241 |
| 1303 | CGPG7481 | Abhydrolase_1 | 113 | 361 | 29.1 | 1.50E-05 |
| 1304 | CGPG7483 | GTP_EFTU | 62 | 260 | 227.2 | 3.70E-65 |
| 1304 | CGPG7483 | GTP_EFTU_D2 | 281 | 355 | 38.5 | 2.30E-08 |
| 1304 | CGPG7483 | EFG_C | 461 | 551 | 54.5 | 3.60E-13 |
| 1306 | CGPG7503 | PBP | 19 | 170 | 159.9 | 6.70E-45 |
| 1307 | CGPG7504 | MSF1 | 15 | 187 | 125.9 | 1.10E-34 |
| 1309 | CGPG7516 | DUF783 | 25 | 229 | 255.1 | 1.40E-73 |
| 1312 | CGPG7524 | Isy1 | 1 | 292 | 519.5 | 3.70E-153 |
| 1313 | CGPG7525 | UFD1 | 10 | 184 | 417.5 | 1.90E-122 |
| 1315 | CGPG7537 | KTI12 | 1 | 291 | 406.2 | 4.80E-119 |
| 1317 | CGPG7575 | efhand | 95 | 123 | 31.4 | 3.20E-06 |
| 1318 | CGPG7577 | TP_methylase | 1 | 213 | 89.5 | 1.00E-23 |
| 1319 | CGPG7590 | Ribonuc_L-PSP | 61 | 179 | 210.1 | 5.20E-60 |
| 1321 | CGPG7601 | CCT | 237 | 275 | 74 | 4.80E-19 |
| 1322 | CGPG7605 | RRM_1 | 88 | 158 | 65 | 2.40E-16 |
| 1323 | CGPG7607 | Amidohydro_2 | 10 | 289 | 102.2 | 1.50E-271 |
| 1325 | CGPG7632 | zf-Tim10_DDP | 12 | 77 | 105 | 2.30E-28 |
| 1326 | CGPG7673 | zf-MYND | 76 | 113 | 47.5 | 4.40E-11 |

TABLE 18-continued

| PEP SEQ ID | Construct ID | Pfam domain name | begin | start | score | E-value |
|---|---|---|---|---|---|---|
| 1326 | CGPG7673 | UCH | 468 | 774 | 192.5 | 1.00E−54 |
| 1327 | CGPG7683 | zf-LSD1 | 28 | 52 | 40.3 | 6.70E−09 |
| 1327 | CGPG7683 | zf-LSD1 | 67 | 91 | 54.8 | 2.80E−13 |
| 1327 | CGPG7683 | zf-LSD1 | 105 | 129 | 54.1 | 4.70E−13 |
| 1328 | CGPG773 | H_PPase | 64 | 798 | 1699.2 | 0 |
| 1329 | CGPG7776 | DUF525 | 311 | 445 | 155.8 | 1.10E−43 |
| 1330 | CGPG7781 | SapB_1 | 45 | 83 | 37.9 | 3.60E−08 |
| 1330 | CGPG7781 | SapB_2 | 86 | 119 | 18.1 | 0.025 |
| 1330 | CGPG7781 | SapB_1 | 131 | 169 | 27.7 | 4.20E−05 |
| 1330 | CGPG7781 | SapB_2 | 172 | 206 | 20.8 | 0.0049 |
| 1331 | CGPG7785 | LRRNT_2 | 24 | 65 | 39.3 | 1.30E−08 |
| 1331 | CGPG7785 | LRR_1 | 93 | 115 | 11.4 | 2.1 |
| 1331 | CGPG7785 | LRR_1 | 117 | 139 | 8.8 | 6.4 |
| 1331 | CGPG7785 | LRR_1 | 141 | 163 | 12.5 | 1.3 |
| 1331 | CGPG7785 | LRR_1 | 165 | 187 | 15.6 | 0.18 |
| 1331 | CGPG7785 | LRR_1 | 189 | 211 | 8.7 | 6.8 |
| 1331 | CGPG7785 | LRR_1 | 213 | 235 | 16.9 | 0.075 |
| 1331 | CGPG7785 | Pkinase | 415 | 682 | 18.7 | 1.10E−09 |
| 1332 | CGPG7787 | Aldose_epim | 26 | 301 | 257.4 | 3.00E−74 |
| 1334 | CGPG7796 | WD40 | 50 | 88 | 32 | 2.10E−06 |
| 1334 | CGPG7796 | WD40 | 92 | 130 | 43 | 1.00E−09 |
| 1334 | CGPG7796 | WD40 | 134 | 174 | 47.8 | 3.70E−11 |
| 1334 | CGPG7796 | WD40 | 182 | 220 | 37.9 | 3.40E−08 |
| 1334 | CGPG7796 | WD40 | 391 | 432 | 33.3 | 8.40E−07 |
| 1334 | CGPG7796 | WD40 | 436 | 475 | 40.4 | 6.20E−09 |
| 1334 | CGPG7796 | WD40 | 489 | 527 | 28.9 | 1.80E−05 |
| 1334 | CGPG7796 | WD40 | 531 | 569 | 31 | 4.30E−06 |
| 1334 | CGPG7796 | WD40 | 573 | 611 | 43.9 | 5.30E−10 |
| 1334 | CGPG7796 | WD40 | 615 | 653 | 28.6 | 2.20E−05 |
| 1334 | CGPG7796 | Utp13 | 674 | 809 | 231.1 | 2.40E−66 |
| 1335 | CGPG7797 | GILT | 35 | 144 | 133.6 | 5.40E−37 |
| 1336 | CGPG7801 | LRR_1 | 106 | 129 | 8.1 | 8.7 |
| 1336 | CGPG7801 | LRR_1 | 132 | 154 | 16.9 | 0.071 |
| 1336 | CGPG7801 | LRR_1 | 156 | 178 | 10.9 | 2.6 |
| 1336 | CGPG7801 | LRR_1 | 180 | 199 | 9.2 | 5.4 |
| 1336 | CGPG7801 | LRR_1 | 201 | 223 | 9.4 | 4.9 |
| 1336 | CGPG7801 | LRR_1 | 225 | 246 | 17.1 | 0.062 |
| 1336 | CGPG7801 | LRR_1 | 249 | 272 | 12.8 | 1.1 |
| 1336 | CGPG7801 | LRR_1 | 273 | 294 | 10.3 | 3.4 |
| 1336 | CGPG7801 | Pkinase | 456 | 716 | −45.5 | 7.60E−06 |
| 1337 | CGPG7813 | WD40 | 379 | 417 | 43.1 | 9.20E−10 |
| 1337 | CGPG7813 | WD40 | 421 | 459 | 39.8 | 9.60E−09 |
| 1337 | CGPG7813 | WD40 | 507 | 545 | 46.9 | 6.80E−11 |
| 1337 | CGPG7813 | WD40 | 549 | 587 | 29.5 | 1.20E−05 |
| 1337 | CGPG7813 | PWP2 | 785 | 900 | 243.1 | 5.70E−70 |
| 1341 | CGPG7863 | zf-CW | 100 | 153 | 85.7 | 1.40E−22 |
| 1341 | CGPG7863 | MBD | 162 | 237 | 43.4 | 7.80E−10 |
| 1342 | CGPG7868 | BCNT | 165 | 244 | 123.2 | 7.40E−34 |
| 1343 | CGPG7881 | Aldedh | 99 | 558 | 694.8 | 6.40E−206 |
| 1344 | CGPG7887 | HEAT | 191 | 222 | 12 | 1.5 |
| 1344 | CGPG7887 | Arm | 262 | 302 | 27.2 | 6.00E−05 |
| 1344 | CGPG7887 | HEAT | 389 | 424 | 14.1 | 0.52 |
| 1344 | CGPG7887 | Arm | 423 | 463 | 32.8 | 1.20E−06 |
| 1345 | CGPG7899 | RRM_1 | 225 | 295 | 27.8 | 3.80E−05 |
| 1346 | CGPG7901 | IQ | 107 | 127 | 30.9 | 4.40E−06 |
| 1346 | CGPG7901 | IQ | 129 | 149 | 18.8 | 0.02 |
| 1347 | CGPG7909 | DUF383 | 92 | 271 | 353 | 4.90E−103 |
| 1347 | CGPG7909 | DUF384 | 272 | 330 | 107.8 | 3.20E−29 |
| 1348 | CGPG7911 | AAA | 245 | 447 | 58.7 | 1.90E−14 |
| 1349 | CGPG7919 | Cullin | 30 | 191 | −9.6 | 7.00E−09 |
| 1350 | CGPG7935 | IQ | 93 | 113 | 26.3 | 0.00011 |
| 1350 | CGPG7935 | IQ | 115 | 135 | 17.6 | 0.046 |
| 1351 | CGPG7940 | RRM_1 | 96 | 161 | 37.7 | 3.90E−08 |
| 1352 | CGPG7959 | Cyclin_N | 180 | 306 | 218.1 | 2.00E−62 |
| 1352 | CGPG7959 | Cyclin_C | 308 | 428 | 179 | 1.20E−50 |
| 1353 | CGPG7967 | IQ | 106 | 126 | 30.4 | 6.50E−06 |
| 1353 | CGPG7967 | IQ | 128 | 148 | 15.1 | 0.26 |
| 1354 | CGPG7975 | Arm | 28 | 68 | 23.4 | 0.00079 |
| 1354 | CGPG7975 | Arm | 70 | 110 | 17.4 | 0.052 |
| 1355 | CGPG7996 | efhand | 136 | 164 | 22.7 | 0.0013 |
| 1356 | CGPG8006 | AAA | 241 | 440 | 50.9 | 4.10E−12 |
| 1357 | CGPG801 | Cyt-b5 | 74 | 171 | 81.3 | 3.00E−21 |
| 1358 | CGPG8023 | RRM_1 | 11 | 82 | 114.5 | 3.00E−31 |
| 1359 | CGPG8025 | IQ | 93 | 113 | 27 | 6.80E−05 |
| 1359 | CGPG8025 | IQ | 115 | 135 | 20.6 | 0.0056 |
| 1360 | CGPG8038 | MFS_1 | 36 | 433 | 124.8 | 2.40E−34 |
| 1361 | CGPG8053 | DUF246 | 182 | 525 | 691.9 | 4.70E−205 |

TABLE 18-continued

| PEP SEQ ID | Construct ID | Pfam domain name | begin | start | score | E-value |
|---|---|---|---|---|---|---|
| 1364 | CGPG8070 | GILT | 32 | 136 | 193.2 | 6.30E−55 |
| 1365 | CGPG8073 | Dirigent | 17 | 183 | 330.8 | 2.30E−96 |
| 1366 | CGPG8076 | Tryp_alpha_amyl | 32 | 107 | 47.1 | 5.90E−11 |
| 1369 | CGPG8095 | IPK | 16 | 279 | 434.8 | 1.20E−127 |
| 1370 | CGPG8096 | 60KD_IMP | 151 | 348 | 35.5 | 1.70E−13 |
| 1374 | CGPG8129 | Ank | 49 | 81 | 32.1 | 1.90E−06 |
| 1374 | CGPG8129 | Ank | 82 | 114 | 24.1 | 0.00049 |
| 1374 | CGPG8129 | Ank | 115 | 147 | 43.2 | 8.90E−10 |
| 1378 | CGPG8165 | Glutaredoxin | 44 | 106 | 97.2 | 5.10E−26 |
| 1379 | CGPG8169 | Nol1_Nop2_Fmu | 226 | 505 | 21.9 | 3.60E−09 |
| 1380 | CGPG8203 | Uricase | 11 | 140 | 134.3 | 3.40E−37 |
| 1380 | CGPG8203 | Uricase | 147 | 300 | 177.6 | 3.00E−50 |
| 1381 | CGPG8205 | DZC | 113 | 148 | 81 | 3.70E−21 |
| 1383 | CGPG8213 | Phosphoesterase | 27 | 388 | 519.2 | 2.70E−153 |
| 1384 | CGPG8225 | FBPase | 25 | 348 | 464.4 | 1.40E−136 |
| 1385 | CGPG8227 | NIR_SIR_ferr | 44 | 111 | 90.7 | 4.50E−24 |
| 1385 | CGPG8227 | NIR_SIR | 119 | 275 | 207.5 | 3.00E−59 |
| 1385 | CGPG8227 | NIR_SIR_ferr | 331 | 399 | 57.3 | 5.00E−14 |
| 1385 | CGPG8227 | NIR_SIR | 405 | 553 | 28.9 | 1.40E−05 |
| 1386 | CGPG8235 | Aldedh | 12 | 471 | 791.5 | 4.70E−235 |
| 1387 | CGPG8236 | Molybdop_Fe4S4 | 9 | 63 | 76 | 1.20E−19 |
| 1387 | CGPG8236 | Molybdopterin | 66 | 495 | 428.7 | 8.00E−126 |
| 1387 | CGPG8236 | Molydop_binding | 593 | 703 | 111.8 | 2.00E−30 |
| 1387 | CGPG8236 | Fer2_BFD | 852 | 903 | 50.3 | 6.50E−12 |
| 1388 | CGPG8244 | PAS_2 | 15 | 125 | 151.7 | 2.00E−42 |
| 1388 | CGPG8244 | GAF | 152 | 320 | 93.4 | 7.10E−25 |
| 1388 | CGPG8244 | Phytochrome | 331 | 513 | 88.8 | 1.70E−23 |
| 1388 | CGPG8244 | HisKA | 528 | 596 | 43.1 | 9.40E−10 |
| 1388 | CGPG8244 | HATPase_c | 637 | 747 | 127 | 5.20E−35 |
| 1389 | CGPG8254 | NIR_SIR_ferr | 66 | 133 | 48.1 | 2.90E−11 |
| 1389 | CGPG8254 | NIR_SIR | 166 | 347 | 198.6 | 1.40E−56 |
| 1389 | CGPG8254 | NIR_SIR_ferr | 362 | 434 | 77.4 | 4.50E−20 |
| 1389 | CGPG8254 | NIR_SIR | 443 | 591 | 15.1 | 0.00014 |
| 1390 | CGPG8255 | PPDK_N | 16 | 384 | 620.2 | 1.80E−183 |
| 1390 | CGPG8255 | PEP-utilizers | 439 | 531 | 141.1 | 3.00E−39 |
| 1390 | CGPG8255 | PEP-utilizers_C | 559 | 914 | 485.9 | 4.80E−143 |
| 1391 | CGPG8262 | ELFV_dehydrog_N | 33 | 163 | 239.1 | 9.20E−69 |
| 1391 | CGPG8262 | ELFV_dehydrog | 179 | 420 | 400.7 | 2.10E−117 |
| 1392 | CGPG8264 | Aldedh | 17 | 480 | 795.7 | 2.70E−236 |
| 1393 | CGPG8269 | PGK | 1 | 396 | 769.8 | 1.70E−228 |
| 1394 | CGPG8271 | Gln-synt_N | 16 | 97 | 149.9 | 6.70E−42 |
| 1394 | CGPG8271 | Gln-synt_C | 104 | 386 | 584.6 | 9.60E−173 |
| 1395 | CGPG8305 | Sulfotransfer_1 | 70 | 336 | 352.4 | 7.40E−103 |
| 1396 | CGPG8320 | DUF1005 | 282 | 487 | 545.7 | 4.80E−161 |
| 1397 | CGPG8326 | Senescence | 35 | 369 | 791.4 | 5.30E−235 |
| 1398 | CGPG8344 | PPR | 173 | 207 | 17.6 | 0.046 |
| 1398 | CGPG8344 | PPR | 208 | 242 | 19.4 | 0.013 |
| 1398 | CGPG8344 | PPR | 243 | 277 | 10.4 | 0.44 |
| 1398 | CGPG8344 | PPR | 279 | 312 | 13.4 | 0.19 |
| 1398 | CGPG8344 | PPR | 314 | 348 | 2 | 4.3 |
| 1398 | CGPG8344 | PPR | 349 | 383 | 8.3 | 0.79 |
| 1398 | CGPG8344 | PPR | 384 | 418 | 2.3 | 4 |
| 1399 | CGPG8347 | Ribosomal_S8 | 5 | 130 | 214.4 | 2.60E−61 |
| 1400 | CGPG8359 | Tryp_alpha_amyl | 85 | 167 | 93.5 | 6.40E−25 |
| 1401 | CGPG8370 | Tim17 | 40 | 156 | 129.2 | 1.10E−35 |
| 1402 | CGPG8371 | PseudoU_synth_1 | 62 | 167 | 44.3 | 4.10E−10 |
| 1402 | CGPG8371 | PseudoU_synth_1 | 324 | 431 | 18.3 | 0.00016 |
| 1404 | CGPG8378 | LysM | 78 | 121 | 22 | 0.0021 |
| 1406 | CGPG841 | ArfGap | 4 | 120 | 173.8 | 4.20E−49 |
| 1405 | CGPG8383 | DUF239 | 174 | 368 | 401.1 | 1.60E−117 |
| 1409 | CGPG8450 | DUF793 | 1 | 390 | 976.4 | 1.10E−290 |
| 1410 | CGPG8451 | IQ | 105 | 125 | 21.2 | 0.0038 |
| 1410 | CGPG8451 | IQ | 127 | 147 | 21.5 | 0.0031 |
| 1411 | CGPG8459 | ubiquitin | 6 | 78 | 58.1 | 2.90E−14 |
| 1411 | CGPG8459 | UBA | 145 | 187 | 49.6 | 1.10E−11 |
| 1411 | CGPG8459 | XPC-binding | 242 | 298 | 56.4 | 9.40E−14 |
| 1411 | CGPG8459 | UBA | 322 | 361 | 46 | 1.20E−10 |
| 1412 | CGPG8461 | Ribosomal_S8 | 5 | 130 | 219 | 1.10E−62 |
| 1413 | CGPG8463 | PI3_PI4_kinase | 163 | 421 | 280.6 | 3.00E−81 |
| 1414 | CGPG8471 | F-box | 1 | 46 | 36.9 | 6.90E−08 |
| 1414 | CGPG8471 | FBA_1 | 211 | 383 | 295.9 | 7.50E−86 |
| 1415 | CGPG8474 | Metallothio_PEC | 12 | 85 | 150 | 6.10E−42 |
| 1416 | CGPG8475 | DAO | 10 | 372 | 186.6 | 5.80E−53 |
| 1417 | CGPG8476 | IQ | 84 | 104 | 30 | 8.20E−06 |
| 1417 | CGPG8476 | IQ | 106 | 126 | 14.4 | 0.41 |
| 1418 | CGPG8490 | ACT | 21 | 85 | 3.9 | 1.3 |
| 1418 | CGPG8490 | ACT | 110 | 174 | 36.6 | 8.60E−08 |

TABLE 18-continued

| PEP SEQ ID | Construct ID | Pfam domain name | begin | start | score | E-value |
|---|---|---|---|---|---|---|
| 1419 | CGPG8510 | DUF538 | 9 | 149 | 250.2 | 4.20E−72 |
| 1420 | CGPG8530 | Radical_SAM | 119 | 283 | 51.3 | 3.30E−12 |
| 1421 | CGPG8533 | DUF212 | 27 | 172 | 104.1 | 4.20E−28 |
| 1425 | CGPG8555 | NUDIX | 59 | 196 | 82 | 1.90E−21 |
| 1426 | CGPG8561 | zf-C3HC4 | 154 | 191 | 34 | 5.30E−07 |
| 1427 | CGPG8569 | 2OG-FeII_Oxy | 159 | 282 | 61.8 | 2.20E−15 |
| 1428 | CGPG8573 | DUF617 | 83 | 242 | 392.1 | 8.40E−115 |
| 1431 | CGPG8607 | DUF862 | 69 | 219 | 244 | 3.20E−70 |
| 1432 | CGPG8611 | Stig1 | 13 | 154 | 165.9 | 1.00E−46 |
| 1434 | CGPG8632 | Sina | 86 | 273 | −41.1 | 0.00037 |
| 1435 | CGPG8634 | FA_desaturase | 55 | 278 | 132.1 | 1.60E−36 |
| 1436 | CGPG8635 | DUF59 | 36 | 117 | 47 | 6.30E−11 |
| 1438 | CGPG8640 | DUF581 | 119 | 176 | 133.1 | 7.60E−37 |
| 1439 | CGPG8642 | CRAL_TRIO_N | 5 | 80 | 30.8 | 4.60E−06 |
| 1439 | CGPG8642 | CRAL_TRIO | 93 | 266 | 84.7 | 2.80E−22 |
| 1441 | CGPG8666 | PetM | 69 | 120 | 81.9 | 2.00E−21 |
| 1443 | CGPG8688 | Bet_v_I | 55 | 192 | −31.7 | 0.0014 |
| 1443 | CGPG8688 | Polyketide_cyc | 60 | 191 | 28.7 | 2.00E−05 |
| 1444 | CGPG8689 | DUF506 | 74 | 282 | 436 | 5.20E−128 |
| 1445 | CGPG8704 | GHMP_kinases_N | 24 | 93 | 39.2 | 1.40E−08 |
| 1445 | CGPG8704 | GHMP_kinases_C | 166 | 249 | 32.3 | 1.70E−06 |
| 1448 | CGPG8769 | Self-incomp_S1 | 35 | 144 | 175.9 | 9.80E−50 |
| 1449 | CGPG8774 | Maf | 1 | 207 | −0.7 | 4.20E−09 |
| 1450 | CGPG8778 | PPR | 13 | 47 | 5.4 | 1.7 |
| 1450 | CGPG8778 | PPR | 115 | 149 | 24.7 | 0.00032 |
| 1450 | CGPG8778 | PPR | 249 | 283 | 40.8 | 4.70E−09 |
| 1450 | CGPG8778 | PPR | 284 | 318 | 12.2 | 0.27 |
| 1450 | CGPG8778 | PPR | 320 | 354 | 16.7 | 0.078 |
| 1450 | CGPG8778 | PPR | 386 | 420 | 9.5 | 0.56 |
| 1451 | CGPG8784 | Snf7 | 16 | 189 | 208.6 | 1.50E−59 |
| 1452 | CGPG879 | ABC_tran | 195 | 418 | 49.2 | 7.50E−12 |
| 1452 | CGPG879 | ABC2_membrane | 520 | 733 | 231.7 | 1.60E−66 |
| 1452 | CGPG879 | PDR_assoc | 738 | 812 | 107.4 | 4.30E−29 |
| 1452 | CGPG879 | ABC_tran | 887 | 1077 | 109 | 1.40E−29 |
| 1452 | CGPG879 | ABC2_membrane | 1174 | 1388 | 249.2 | 8.80E−72 |
| 1453 | CGPG8797 | AMP-binding | 67 | 488 | 430.1 | 3.10E−126 |
| 1454 | CGPG8810 | DUF1645 | 80 | 252 | 310.1 | 4.00E−90 |
| 1455 | CGPG8827 | DUF623 | 199 | 263 | 128.8 | 1.50E−35 |
| 1456 | CGPG8853 | DUF1635 | 1 | 218 | 517 | 2.10E−152 |
| 1457 | CGPG8873 | p450 | 72 | 518 | 236.2 | 6.90E−68 |
| 1458 | CGPG8877 | Exo_endo_phos | 33 | 310 | 121.7 | 2.10E−33 |
| 1459 | CGPG8878 | Pkinase | 79 | 337 | 343.8 | 2.80E−100 |
| 1459 | CGPG8878 | efhand | 400 | 428 | 24.9 | 0.00028 |
| 1459 | CGPG8878 | efhand | 434 | 462 | 34.5 | 3.60E−07 |
| 1460 | CGPG8881 | DUF1677 | 3 | 107 | 192.2 | 1.30E−54 |
| 1461 | CGPG8895 | RNA_polI_A14 | 1 | 137 | 277.8 | 2.20E−80 |
| 1462 | CGPG8906 | MCM | 272 | 635 | 641.9 | 5.40E−190 |
| 1463 | CGPG8917 | Pkinase | 363 | 697 | 244 | 3.20E−70 |
| 1464 | CGPG8919 | Usp | 11 | 141 | 43.4 | 8.00E−10 |
| 1464 | CGPG8919 | Pkinase_Tyr | 405 | 676 | 88.6 | 1.90E−23 |
| 1464 | CGPG8919 | Pkinase | 405 | 676 | 138.8 | 1.50E−38 |
| 1465 | CGPG8925 | DUF617 | 82 | 260 | 262.9 | 6.60E−76 |
| 1466 | CGPG8930 | Lectin_legB | 26 | 261 | 232.7 | 8.20E−67 |
| 1466 | CGPG8930 | Pkinase | 347 | 617 | 166.9 | 5.30E−47 |
| 1466 | CGPG8930 | Pkinase_Tyr | 347 | 617 | 115.3 | 1.80E−31 |
| 1467 | CGPG8937 | LRR_1 | 440 | 461 | 13.9 | 0.57 |
| 1467 | CGPG8937 | LRR_1 | 463 | 485 | 18.7 | 0.022 |
| 1467 | CGPG8937 | LRR_1 | 487 | 510 | 14.6 | 0.36 |
| 1467 | CGPG8937 | Pkinase | 602 | 873 | 111.2 | 3.00E−30 |
| 1467 | CGPG8937 | Pkinase_Tyr | 603 | 873 | 110.1 | 6.30E−30 |
| 1468 | CGPG8942 | RRM_1 | 23 | 94 | 105.3 | 1.80E−28 |
| 1469 | CGPG8946 | Pkinase | 516 | 786 | 150.8 | 3.60E−42 |
| 1469 | CGPG8946 | Pkinase_Tyr | 516 | 786 | 129.6 | 8.70E−36 |
| 1470 | CGPG8990 | V-SNARE | 71 | 221 | 154.1 | 3.70E−43 |
| 1472 | CGPG9008 | TPK_catalytic | 40 | 180 | 114.5 | 3.00E−31 |
| 1472 | CGPG9008 | TPK_B1_binding | 191 | 259 | 94.4 | 3.40E−25 |
| 1473 | CGPG9016 | ETC_C1_NDUFA4 | 54 | 156 | 176.6 | 6.20E−50 |
| 1474 | CGPG9036 | MSP | 93 | 329 | 549 | 4.70E−162 |
| 1475 | CGPG9060 | LSM | 22 | 101 | 66.3 | 1.00E−16 |
| 1477 | CGPG908 | PPR | 62 | 96 | 9.9 | 0.5 |
| 1477 | CGPG908 | PPR | 125 | 158 | 20.9 | 0.0047 |
| 1477 | CGPG908 | PPR | 187 | 221 | 27 | 6.50E−05 |
| 1477 | CGPG908 | PPR | 250 | 284 | 50.4 | 6.20E−12 |
| 1477 | CGPG908 | PPR | 351 | 385 | 53.9 | 5.30E−13 |
| 1477 | CGPG908 | PPR | 386 | 419 | 2.2 | 4 |
| 1477 | CGPG908 | PPR | 422 | 456 | 17.9 | 0.035 |
| 1477 | CGPG908 | PPR | 488 | 522 | 3.4 | 3 |

TABLE 18-continued

| PEP SEQ ID | Construct ID | Pfam domain name | begin | start | score | E-value |
|---|---|---|---|---|---|---|
| 1478 | CGPG9093 | AWPM-19 | 15 | 156 | 325.5 | 9.00E−95 |
| 1479 | CGPG9096 | OTU | 11 | 121 | 104.8 | 2.50E−28 |
| 1482 | CGPG9111 | TB2_DP1_HVA22 | 4 | 101 | 157 | 5.10E−44 |
| 1483 | CGPG9112 | DUF778 | 10 | 177 | 350.3 | 3.20E−102 |
| 1484 | CGPG9123 | DUF833 | 1 | 264 | 236.7 | 4.90E−68 |
| 1485 | CGPG9124 | Exo_endo_phos | 20 | 427 | 39.2 | 1.40E−08 |
| 1485 | CGPG9124 | efhand | 337 | 365 | 31.2 | 3.70E−06 |
| 1486 | CGPG9138 | ThiC | 165 | 588 | 1118.5 | 0 |
| 1488 | CGPG9150 | Pkinase | 56 | 326 | 144.9 | 2.20E−40 |
| 1488 | CGPG9150 | Pkinase_Tyr | 56 | 326 | 129.9 | 6.90E−36 |
| 1489 | CGPG9152 | eIF2A | 217 | 410 | 382.7 | 5.60E−112 |
| 1490 | CGPG9162 | AAA_5 | 211 | 346 | 6.5 | 0.00057 |
| 1490 | CGPG9162 | AAA | 211 | 398 | 309.1 | 8.00E−90 |
| 1491 | CGPG9165 | GATase | 11 | 201 | 185.4 | 1.40E−52 |
| 1491 | CGPG9165 | GMP_synt_C | 432 | 524 | 210.5 | 3.80E−60 |
| 1492 | CGPG9166 | GATase | 28 | 210 | 194.9 | 1.90E−55 |
| 1492 | CGPG9166 | GMP_synt_C | 447 | 539 | 211.2 | 2.30E−60 |
| 1493 | CGPG9171 | Zip | 5 | 266 | 60.5 | 5.40E−15 |
| 1494 | CGPG9177 | Complex1_30kDa | 113 | 181 | 146.8 | 5.60E−41 |
| 1494 | CGPG9177 | Complex1_49kDa | 329 | 600 | 639.1 | 3.70E−189 |
| 1495 | CGPG9178 | PRA-CH | 54 | 129 | 201 | 2.90E−57 |
| 1495 | CGPG9178 | PRA-PH | 142 | 230 | 175.7 | 1.20E−49 |
| 1496 | CGPG9179 | Pkinase | 4 | 283 | 341.9 | 1.10E−99 |
| 1496 | CGPG9179 | Pkinase_Tyr | 4 | 283 | 96.5 | 7.90E−26 |
| 1497 | CGPG9181 | P21-Arc | 17 | 187 | 370.6 | 2.40E−108 |
| 1499 | CGPG9189 | SAC3_GANP | 19 | 164 | 152.8 | 9.30E−43 |
| 1500 | CGPG9201 | TPT | 201 | 350 | 168.8 | 1.40E−47 |
| 1501 | CGPG9222 | YjeF_N | 34 | 199 | 271.5 | 1.70E−78 |
| 1501 | CGPG9222 | Carb_kinase | 257 | 496 | 426.9 | 2.70E−125 |
| 1502 | CGPG9234 | DUF393 | 65 | 183 | 109.6 | 9.00E−30 |
| 1503 | CGPG9237 | Tim17 | 18 | 146 | 112.4 | 1.30E−30 |
| 1504 | CGPG9244 | TOM20_plant | 9 | 200 | 435.3 | 8.30E−128 |
| 1506 | CGPG9249 | Pkinase | 46 | 330 | 137.7 | 3.20E−38 |
| 1506 | CGPG9249 | Pkinase_Tyr | 46 | 330 | 94.3 | 3.60E−25 |
| 1507 | CGPG9251 | Cyclin_N | 54 | 186 | 115.8 | 1.30E−31 |
| 1507 | CGPG9251 | Cyclin_C | 188 | 314 | 23.7 | 0.00055 |
| 1508 | CGPG9280 | DUF1000 | 53 | 168 | 192 | 1.40E−54 |
| 1510 | CGPG9302 | Diphthamide_syn | 30 | 398 | 118.1 | 2.50E−32 |
| 1511 | CGPG931 | Pkinase | 114 | 398 | 303.3 | 4.30E−88 |
| 1512 | CGPG9313 | CN_hydrolase | 5 | 200 | 75.3 | 2.00E−19 |
| 1512 | CGPG9313 | NAD_synthase | 338 | 652 | −11.3 | 1.20E−11 |
| 1514 | CGPG9327 | OPT | 74 | 729 | 779.8 | 1.60E−231 |
| 1515 | CGPG933 | WD40 | 46 | 84 | 23.2 | 0.00093 |
| 1515 | CGPG933 | WD40 | 134 | 173 | 22.9 | 0.0012 |
| 1515 | CGPG933 | WD40 | 177 | 215 | 33.6 | 7.00E−07 |
| 1515 | CGPG933 | WD40 | 222 | 260 | 42.8 | 1.10E−09 |
| 1515 | CGPG933 | WD40 | 314 | 353 | 21.7 | 0.0026 |
| 1515 | CGPG933 | WD40 | 524 | 562 | 31.5 | 3.00E−06 |
| 1515 | CGPG933 | WD40 | 568 | 605 | 23.3 | 0.00085 |
| 1516 | CGPG9334 | Sugar_tr | 7 | 720 | 205.2 | 1.50E−58 |
| 1516 | CGPG9334 | MFS_1 | 11 | 679 | 116.5 | 7.90E−32 |
| 1517 | CGPG967 | BTB | 38 | 135 | 7.2 | 0.00091 |
| 1517 | CGPG967 | NPH3 | 218 | 460 | 370.2 | 3.20E−108 |
| 1518 | CGPG988 | Cystatin | 36 | 124 | 86.1 | 1.10E−22 |

TABLE 19

| Pfam domain name | accession number | gathering cutoff | domain description |
|---|---|---|---|
| 14-3-3 | PF00244.10 | 25 | 14-3-3 protein |
| 2-oxoacid_dh | PF00198.13 | −112 | 2-oxoacid dehydrogenases acyltransferase (catalytic domain) |
| 2OG-FeII_Oxy | PF03171.10 | 11.5 | 2OG-Fe(II) oxygenase superfamily |
| 60KD_IMP | PF02096.11 | −95 | 60 Kd inner membrane protein |
| AAA | PF00004.19 | 12.3 | ATPase family associated with various cellular activities (AAA) |
| AAA_5 | PF07728.4 | 4 | ATPase family associated with various cellular activities (AAA) |
| AA_permease | PF00324.11 | −120.8 | Amino acid permease |
| ABC1 | PF03109.7 | −27.6 | ABC1 family |
| ABC2_membrane | PF01061.14 | −17.9 | ABC-2 type transporter |
| ABC_tran | PF00005.17 | 9.5 | ABC transporter |
| ACT | PF01842.15 | 0 | ACT domain |
| ADH_N | PF08240.2 | −14.5 | Alcohol dehydrogenase GroES-like domain |
| ADH_zinc_N | PF00107.16 | 23.8 | Zinc-binding dehydrogenase |
| AHSA1 | PF08327.1 | 16.3 | Activator of Hsp90 ATPase homolog 1-like protein |

TABLE 19-continued

| Pfam domain name | accession number | gathering cutoff | domain description |
|---|---|---|---|
| AMP-binding | PF00501.18 | 0 | AMP-binding enzyme |
| AOX | PF01786.8 | 25 | Alternative oxidase |
| AP2 | PF00847.10 | 0 | AP2 domain |
| ARM_1 | PF04683.4 | 25 | Adhesion regulating molecule conserved region |
| ATP_synt_H | PF05493.3 | 25 | ATP synthase subunit H |
| AWPM-19 | PF05512.2 | 25 | AWPM-19-like family |
| Aa_trans | PF01490.8 | −128.4 | Transmembrane amino acid transporter protein |
| Abhydrolase_1 | PF00561.10 | 10.3 | alpha/beta hydrolase fold |
| Abhydrolase_3 | PF07859.3 | 25.8 | alpha/beta hydrolase fold |
| Actin | PF00022.9 | −144 | Actin |
| Acyltransferase | PF01553.11 | −0.4 | Acyltransferase |
| Aha1_N | PF09229.1 | −19.7 | Activator of Hsp90 ATPase, N-terminal |
| AlaDh_PNT_C | PF01262.12 | −43.4 | Alanine dehydrogenase/PNT, C-terminal domain |
| AlaDh_PNT_N | PF05222.5 | 25 | Alanine dehydrogenase/PNT, N-terminal domain |
| Aldedh | PF00171.12 | −209.3 | Aldehyde dehydrogenase family |
| Aldose_epim | PF01263.10 | −70.5 | Aldose 1-epimerase |
| Alpha-amylase | PF00128.14 | −92.6 | Alpha amylase, catalytic domain |
| Amidohydro_2 | PF04909.4 | −1.7 | Amidohydrolase |
| Amino_oxidase | PF01593.14 | −11.4 | Flavin containing amine oxidoreductase |
| Aminotran_1_2 | PF00155.11 | −57.5 | Aminotransferase class I and II |
| Aminotran_3 | PF00202.11 | −206.1 | Aminotransferase class-III |
| Aminotran_4 | PF01063.9 | −50 | Aminotransferase class IV |
| Aminotran_5 | PF00266.9 | −164.4 | Aminotransferase class-V |
| Ank | PF00023.20 | 0 | Ankyrin repeat |
| Arf | PF00025.11 | 40 | ADP-ribosylation factor family |
| ArfGap | PF01412.9 | −17 | Putative GTPase activating protein for Arf |
| Arm | PF00514.13 | 17 | Armadillo/beta-catenin-like repeat |
| Asn_synthase | PF00733.11 | −52.8 | Asparagine synthase |
| AstE_AspA | PF04952.5 | −36.8 | Succinylglutamate desuccinylase/Aspartoacylase family |
| B3_4 | PF03483.7 | 10 | B3/4 domain |
| B5 | PF03484.5 | 25 | tRNA synthetase B5 domain |
| B56 | PF01603.10 | −210 | Protein phosphatase 2A regulatory B subunit (B56 family) |
| BCNT | PF07572.3 | 25 | Bucentaur or craniofacial development |
| BNR | PF02012.10 | 0.7 | BNR/Asp-box repeat |
| BRCT | PF00533.16 | 27.8 | BRCA1 C Terminus (BRCT) domain |
| BTB | PF00651.21 | 6.2 | BTB/POZ domain |
| Band_7 | PF01145.15 | −5 | SPFH domain/Band 7 family |
| Barwin | PF00967.8 | 25 | Barwin family |
| Bet_v_I | PF00407.9 | −33 | Pathogenesis-related protein Bet v I family |
| Biotin_lipoyl | PF00364.12 | −2.3 | Biotin-requiring enzyme |
| Brix | PF04427.8 | 11.4 | Brix domain |
| Bystin | PF05291.2 | 25 | Bystin |
| C2 | PF00168.20 | 3.7 | C2 domain |
| CAF1 | PF04857.10 | −100.5 | CAF1 family ribonuclease |
| CBS | PF00571.18 | 17.5 | CBS domain pair |
| CCT | PF06203.4 | 25 | CCT motif |
| CN_hydrolase | PF00795.12 | −13.9 | Carbon-nitrogen hydrolase |
| CPDase | PF07823.2 | −14.5 | Cyclic phosphodiesterase-like protein |
| CPSase_L_D2 | PF02786.7 | −48.9 | Carbamoyl-phosphate synthase L chain, ATP binding domain |
| CPSase_L_D3 | PF02787.9 | −56 | Carbamoyl-phosphate synthetase large chain, oligomerisation domain |
| CPSase_L_chain | PF00289.12 | 14 | Carbamoyl-phosphate synthase L chain, N-terminal domain |
| CRAL_TRIO | PF00650.10 | −26 | CRAL/TRIO domain |
| CRAL_TRIO_N | PF03765.5 | 16 | CRAL/TRIO, N-terminus |
| CS | PF04969.6 | 8.6 | CS domain |
| CTP_transf_1 | PF01148.10 | −38.5 | Cytidylyltransferase family |
| Carb_kinase | PF01256.8 | −66.3 | Carbohydrate kinase |
| Chitin_bind_1 | PF00187.9 | 25.1 | Chitin recognition protein |
| Citrate_synt | PF00285.11 | −101.5 | Citrate synthase |
| Complex1_30 kDa | PF00329.9 | −3 | Respiratory-chain NADH dehydrogenase, 30 Kd subunit |
| Complex1_49 kDa | PF00346.9 | −108 | Respiratory-chain NADH dehydrogenase, 49 Kd subunit |
| Copine | PF07002.6 | −36.5 | Copine |
| CorA | PF01544.9 | −61.3 | CorA-like Mg2+ transporter protein |
| Cornichon | PF03311.4 | 25 | Cornichon protein |
| Cpn60_TCP1 | PF00118.14 | −223.4 | TCP-1/cpn60 chaperonin family |
| Cullin | PF00888.12 | −33.3 | Cullin family |
| Cyclin | PF08613.1 | −34.2 | Cyclin |
| Cyclin_C | PF02984.9 | −13 | Cyclin, C-terminal domain |
| Cyclin_N | PF00134.13 | −14.7 | Cyclin, N-terminal domain |
| Cys_Met_Meta_PP | PF01053.10 | −278.4 | Cys/Met metabolism PLP-dependent enzyme |
| Cystatin | PF00031.11 | 17.5 | Cystatin domain |
| Cyt-b5 | PF00173.18 | 4 | Cytochrome b5-like Heme/Steroid binding domain |
| Cytochrom_C | PF00034.11 | 11.7 | Cytochrome c |
| DAGK_cat | PF00781.14 | −5.7 | Diacylglycerol kinase catalytic domain (presumed) |
| DAO | PF01266.14 | −35 | FAD dependent oxidoreductase |
| DEAD | PF00270.19 | 7.2 | DEAD/DEAH box helicase |
| DHDPS | PF00701.12 | −90 | Dihydrodipicolinate synthetase family |

TABLE 19-continued

| Pfam domain name | accession number | gathering cutoff | domain description |
|---|---|---|---|
| DHquinase_I | PF01487.6 | 25 | Type I 3-dehydroquinase |
| DJ-1_PfpI | PF01965.14 | −7 | DJ-1/PfpI family |
| DREPP | PF05558.3 | 25 | DREPP plasma membrane polypeptide |
| DSHCT | PF08148.2 | −86.9 | DSHCT (NUC185) domain |
| DUF1000 | PF06201.4 | −20.8 | Domain of Unknown Function (DUF1000) |
| DUF1001 | PF06206.2 | −63.3 | Protein of unknown function (DUF1001) |
| DUF1005 | PF06219.3 | 25 | Protein of unknown function (DUF1005) |
| DUF1350 | PF07082.2 | −145.7 | Protein of unknown function (DUF1350) |
| DUF1635 | PF07795.2 | −27.2 | Protein of unknown function (DUF1635) |
| DUF1639 | PF07797.4 | 25 | Protein of unknown function (DUF1639) |
| DUF1644 | PF07800.3 | 25 | Protein of unknown function (DUF1644) |
| DUF1645 | PF07816.2 | −35.3 | Protein of unknown function (DUF1645) |
| DUF1677 | PF07911.4 | 25 | Protein of unknown function (DUF1677) |
| DUF1749 | PF08538.1 | −181.1 | Protein of unknown function (DUF1749) |
| DUF1984 | PF09328.1 | 12.8 | Domain of unknown function (DUF1984) |
| DUF21 | PF01595.10 | −28.2 | Domain of unknown function DUF21 |
| DUF212 | PF02681.5 | −30 | Divergent PAP2 family |
| DUF23 | PF01697.17 | −18.5 | Domain of unknown function |
| DUF231 | PF03005.6 | −58 | *Arabidopsis* proteins of unknown function |
| DUF239 | PF03080.5 | 25 | *Arabidopsis* proteins of unknown function |
| DUF246 | PF03138.5 | −15 | Plant protein family |
| DUF26 | PF01657.8 | 0 | Domain of unknown function DUF26 |
| DUF260 | PF03195.5 | 0.8 | Protein of unknown function DUF260 |
| DUF300 | PF03619.7 | 25 | Domain of unknown function |
| DUF313 | PF03754.4 | 25 | Domain of unknown function (DUF313) |
| DUF383 | PF04063.4 | 25 | Domain of unknown function (DUF383) |
| DUF384 | PF04064.4 | 25 | Domain of unknown function (DUF384) |
| DUF393 | PF04134.3 | 25 | Protein of unknown function, DUF393 |
| DUF506 | PF04720.3 | 25 | Protein of unknown function (DUF506) |
| DUF525 | PF04379.5 | 25 | Protein of unknown function (DUF525) |
| DUF538 | PF04398.3 | 25 | Protein of unknown function, DUF538 |
| DUF581 | PF04570.5 | −3.1 | Protein of unknown function (DUF581) |
| DUF59 | PF01883.9 | −7.9 | Domain of unknown function DUF59 |
| DUF6 | PF00892.11 | 20.8 | Integral membrane protein DUF6 |
| DUF617 | PF04759.4 | 25 | Protein of unknown function, DUF617 |
| DUF623 | PF04844.4 | 25 | Protein of unknown function, DUF623 |
| DUF640 | PF04852.3 | 2.4 | Protein of unknown function (DUF640) |
| DUF676 | PF05057.5 | −60.7 | Putative serine esterase (DUF676) |
| DUF740 | PF05340.3 | 25 | Protein of unknown function (DUF740) |
| DUF778 | PF05608.2 | 25 | Protein of unknown function (DUF778) |
| DUF783 | PF05615.3 | 25 | Protein of unknown function (DUF783) |
| DUF788 | PF05620.2 | 25 | Protein of unknown function (DUF788) |
| DUF791 | PF05631.4 | −136.8 | Protein of unknown function (DUF791) |
| DUF793 | PF05633.2 | 25 | Protein of unknown function (DUF793) |
| DUF827 | PF05701.2 | 25 | Plant protein of unknown function (DUF827) |
| DUF833 | PF05742.2 | −63.1 | Protein of unknown function (DUF833) |
| DUF860 | PF05898.4 | 25 | Plant specific of unknown function (DUF860) |
| DUF862 | PF05903.5 | −21.4 | PPPDE putative peptidase domain |
| DUF914 | PF06027.3 | −193 | Eukaryotic protein of unknown function (DUF914) |
| DUF926 | PF06047.2 | 25 | Domain of Unknown Function (DUF926) |
| DZC | PF08381.1 | 15.3 | Disease resistance/zinc finger/chromosome condensation-like region |
| Dehydrin | PF00257.10 | −4.4 | Dehydrin |
| Di19 | PF05605.3 | 25 | Drought induced 19 protein (Di19) |
| Diphthamide_syn | PF01866.8 | 25 | Putative diphthamide synthesis protein |
| Dirigent | PF03018.5 | 25 | Dirigent-like protein |
| DnaJ | PF00226.21 | −8 | DnaJ domain |
| DnaJ_C | PF01556.9 | −24 | DnaJ C terminal region |
| DnaJ_CXXCXGXG | PF00684.9 | 1 | DnaJ central domain (4 repeats) |
| E1_dh | PF00676.10 | −90 | Dehydrogenase E1 component |
| E3_binding | PF02817.7 | 10 | e3 binding domain |
| EFG_C | PF00679.14 | 6 | Elongation factor G C-terminus |
| ELFV_dehydrog | PF00208.11 | −27 | Glutamate/Leucine/Phenylalanine/Valine dehydrogenase |
| ELFV_dehydrog_N | PF02812.8 | 31.8 | Glu/Leu/Phe/Val dehydrogenase, dimerisation domain |
| ETC_C1_NDUFA4 | PF04800.3 | 25 | ETC complex I subunit conserved region |
| Enolase_C | PF00113.12 | −71.2 | Enolase, C-terminal TIM barrel domain |
| Enolase_N | PF03952.6 | 11.3 | Enolase, N-terminal domain |
| Exo_endo_phos | PF03372.13 | 11 | Endonuclease/Exonuclease/phosphatase family |
| F-box | PF00646.23 | 13.9 | F-box domain |
| FAD_binding_2 | PF00890.14 | −124.8 | FAD binding domain |
| FAD_binding_4 | PF01565.13 | −8.1 | FAD binding domain |
| FAD_binding_8 | PF08022.2 | −10.4 | FAD-binding domain |
| FA_desaturase | PF00487.14 | −46 | Fatty acid desaturase |
| FBA_1 | PF07734.3 | −39.4 | F-box associated |
| FBA_3 | PF08268.2 | −17.1 | F-box associated |
| FBD | PF08387.1 | 25 | FBD |
| FBPase | PF00316.10 | −170.3 | Fructose-1-6-bisphosphatase |

TABLE 19-continued

| Pfam domain name | accession number | gathering cutoff | domain description |
|---|---|---|---|
| FHA | PF00498.16 | 25 | FHA domain |
| FKBP_C | PF00254.18 | −7.6 | FKBP-type peptidyl-prolyl cis-trans isomerase |
| FTHFS | PF01268.9 | −167 | Formate--tetrahydrofolate ligase |
| Fer2_BFD | PF04324.5 | 25 | BFD-like [2Fe—2S] binding domain |
| Fer4 | PF00037.17 | 9.3 | 4Fe—4S binding domain |
| Ferric_reduct | PF01794.9 | −7 | Ferric reductase like transmembrane component |
| Fibrillarin | PF01269.8 | −86.6 | Fibrillarin |
| GAF | PF01590.16 | 23 | GAF domain |
| GATase | PF00117.18 | −38.1 | Glutamine amidotransferase class-I |
| GATase_2 | PF00310.11 | −95.1 | Glutamine amidotransferases class-II |
| GDE_C | PF06202.4 | −218.8 | Amylo-alpha-1,6-glucosidase |
| GHMP_kinases_C | PF08544.3 | 20.8 | GHMP kinases C terminal |
| GHMP_kinases_N | PF00288.16 | 17.1 | GHMP kinases N terminal domain |
| GIDA | PF01134.12 | −226.7 | Glucose inhibited division protein A |
| GILT | PF03227.6 | 25 | Gamma interferon inducible lysosomal thiol reductase (GILT) |
| GMP_synt_C | PF00958.12 | 25 | GMP synthase C terminal domain |
| GRAM | PF02893.10 | 24.4 | GRAM domain |
| GRP | PF07172.2 | 16.8 | Glycine rich protein family |
| GTP_EFTU | PF00009.17 | 8 | Elongation factor Tu GTP binding domain |
| GTP_EFTU_D2 | PF03144.15 | 25 | Elongation factor Tu domain 2 |
| Gal-bind_lectin | PF00337.12 | −30 | Galactoside-binding lectin |
| Galactosyl_T | PF01762.12 | −46 | Galactosyltransferase |
| Gar1 | PF04410.5 | 25 | Gar1 protein RNA binding region |
| Gln-synt_C | PF00120.14 | −124 | Glutamine synthetase, catalytic domain |
| Gln-synt_N | PF03951.9 | 9 | Glutamine synthetase, beta-Grasp domain |
| Globin | PF00042.12 | −8.8 | Globin |
| Glucokinase | PF02685.6 | −157.6 | Glucokinase |
| Glutaminase | PF04960.6 | −143.6 | Glutaminase |
| Glutaredoxin | PF00462.14 | 17.2 | Glutaredoxin |
| Glyco_hydro_1 | PF00232.9 | −301.8 | Glycosyl hydrolase family 1 |
| Glyco_hydro_17 | PF00332.9 | −152.3 | Glycosyl hydrolases family 17 |
| Glyco_tran_28_C | PF04101.6 | −10.4 | Glycosyltransferase family 28 C-terminal domain |
| Glyco_transf_8 | PF01501.10 | −43.2 | Glycosyl transferase family 8 |
| Glycolytic | PF00274.9 | −174.5 | Fructose-bisphosphate aldolase class-I |
| Gp_dh_C | PF02800.10 | −64.1 | Glyceraldehyde 3-phosphate dehydrogenase, C-terminal domain |
| Gp_dh_N | PF00044.14 | −74.2 | Glyceraldehyde 3-phosphate dehydrogenase, NAD binding domain |
| HATPase_c | PF02518.16 | 22.4 | Histidine kinase-, DNA gyrase B-, and HSP90-like ATPase |
| HD | PF01966.12 | 15.3 | HD domain |
| HEAT | PF02985.12 | 11.5 | HEAT repeat |
| HIT | PF01230.13 | −4.5 | HIT domain |
| HLH | PF00010.16 | 8.3 | Helix-loop-helix DNA-binding domain |
| HMA | PF00403.16 | 19.5 | Heavy-metal-associated domain |
| HMG-CoA_red | PF00368.9 | −242 | Hydroxymethylglutaryl-coenzyme A reductase |
| H_PPase | PF03030.7 | −377 | Inorganic H+ pyrophosphatase |
| Helicase_C | PF00271.21 | 2.1 | Helicase conserved C-terminal domain |
| Hexapep | PF00132.14 | 0.3 | Bacterial transferase hexapeptide (three repeats) |
| Hin1 | PF07320.4 | 25 | Harpin-induced protein 1 (Hin1) |
| HisKA | PF00512.15 | 10.3 | His Kinase A (phosphoacceptor) domain |
| Histone | PF00125.14 | 17.4 | Core histone H2A/H2B/H3/H4 |
| Hydrolase | PF00702.16 | 13.6 | haloacid dehalogenase-like hydrolase |
| IGPD | PF00475.9 | 25 | Imidazoleglycerol-phosphate dehydratase |
| IPK | PF03770.7 | 25 | Inositol polyphosphate kinase |
| IQ | PF00612.17 | 11.9 | IQ calmodulin-binding motif |
| Invertase_neut | PF04853.3 | −233.6 | Plant neutral invertase |
| Iso_dh | PF00180.10 | −97 | Isocitrate/isopropylmalate dehydrogenase |
| Isoamylase_N | PF02922.8 | −6.5 | Isoamylase N-terminal domain |
| Isy1 | PF06246.3 | 25 | Isy1-like splicing family |
| K-box | PF01486.8 | 0 | K-box region |
| KR | PF08659.1 | −74.3 | KR domain |
| KTI12 | PF08433.1 | −109.1 | Chromatin associated protein KTI12 |
| Kelch_1 | PF01344.15 | 7.8 | Kelch motif |
| Kelch_2 | PF07646.5 | 14 | Kelch motif |
| LRRNT_2 | PF08263.3 | 18.6 | Leucine rich repeat N-terminal domain |
| LRR_1 | PF00560.23 | 7.7 | Leucine Rich Repeat |
| LRR_2 | PF07723.3 | 6 | Leucine Rich Repeat |
| LSM | PF01423.12 | 13.7 | LSM domain |
| Lectin_legB | PF00139.10 | −110.1 | Legume lectin domain |
| Lipoxygenase | PF00305.9 | −211 | Lipoxygenase |
| Lung_7-TM_R | PF06814.3 | 25 | Lung seven transmembrane receptor |
| LysM | PF01476.10 | 20 | LysM domain |
| MATH | PF00917.16 | 0.5 | MATH domain |
| MBD | PF01429.10 | 12.9 | Methyl-CpG binding domain |
| MCM | PF00493.13 | 25 | MCM2/3/5 family |
| MFS_1 | PF07690.6 | 23.5 | Major Facilitator Superfamily |
| MGDG_synth | PF06925.2 | 25 | Monogalactosyldiacylglycerol (MGDG) synthase |

TABLE 19-continued

| Pfam domain name | accession number | gathering cutoff | domain description |
|---|---|---|---|
| MGS | PF02142.12 | 3 | MGS-like domain |
| MIP | PF00230.10 | −62 | Major intrinsic protein |
| MMR_HSR1 | PF01926.13 | 31.2 | GTPase of unknown function |
| MSF1 | PF04707.4 | 25 | MSF1-like conserved region |
| MSP | PF01716.9 | −71 | Manganese-stabilising protein/photosystem II polypeptide |
| Maf | PF02545.5 | −42 | Maf-like protein |
| Mago-bind | PF09282.1 | 25 | Mago binding |
| Malic_M | PF03949.5 | −143.9 | Malic enzyme, NAD binding domain |
| Metalloenzyme | PF01676.8 | −14.4 | Metalloenzyme superfamily |
| Metallophos | PF00149.18 | 22 | Calcineurin-like phosphoesterase |
| Metallothio_PEC | PF02068.6 | 25 | Plant PEC family metallothionein |
| Methyltransf_11 | PF08241.2 | 20.9 | Methyltransferase domain |
| Methyltransf_12 | PF08242.2 | 23 | Methyltransferase domain |
| Miro | PF08477.3 | 10.8 | Miro-like protein |
| Mito_carr | PF00153.17 | 0 | Mitochondrial carrier protein |
| Mo25 | PF08569.1 | −73.5 | Mo25-like |
| Molybdop_Fe4S4 | PF04879.6 | 13.6 | Molybdopterin oxidoreductase Fe4S4 domain |
| Molybdopterin | PF00384.12 | −50 | Molybdopterin oxidoreductase |
| Molydop_binding | PF01568.11 | 1.1 | Molydopterin dinucleotide binding domain |
| Mov34 | PF01398.11 | −4 | Mov34/MPN/PAD-1 family |
| MtN3_slv | PF03083.6 | 9.7 | MtN3/saliva family |
| Myb_DNA-binding | PF00249.21 | 14 | Myb-like DNA-binding domain |
| NADPH_Ox | PF08414.1 | 25 | Respiratory burst NADPH oxidase |
| NAD_binding_6 | PF08030.2 | −23.6 | Ferric reductase NAD binding domain |
| NAD_synthase | PF02540.7 | −93.3 | NAD synthase |
| NAF | PF03822.5 | 4.5 | NAF domain |
| NDK | PF00334.9 | −59.9 | Nucleoside diphosphate kinase |
| NDUF_B7 | PF05676.3 | −25.7 | NADH-ubiquinone oxidoreductase B18 subunit (NDUFB7) |
| NIF | PF03031.8 | −77.9 | NLI interacting factor-like phosphatase |
| NIR_SIR | PF01077.12 | −19.6 | Nitrite and sulphite reductase 4Fe—4S domain |
| NIR_SIR_ferr | PF03460.7 | 2.4 | Nitrite/Sulfite reductase ferredoxin-like half domain |
| NLE | PF08154.2 | 14 | NLE (NUC135) domain |
| NOI | PF05627.2 | 0.3 | Nitrate-induced NOI protein |
| NOT2_3_5 | PF04153.8 | 25 | NOT2/NOT3/NOT5 family |
| NPH3 | PF03000.5 | 25 | NPH3 family |
| NTP_transferase | PF00483.13 | −90.5 | Nucleotidyl transferase |
| NUDIX | PF00293.18 | 0.2 | NUDIX domain |
| NicO | PF03824.6 | −17 | High-affinity nickel-transport protein |
| Nol1_Nop2_Fmu | PF01189.6 | −68.2 | NOL1/NOP2/sun family |
| Not3 | PF04065.5 | 25 | Not1 N-terminal domain, CCR4-Not complex component |
| Nramp | PF01566.9 | −217 | Natural resistance-associated macrophage protein |
| Nuc_sug_transp | PF04142.6 | −158.6 | Nucleotide-sugar transporter |
| OPT | PF03169.6 | −238.6 | OPT oligopeptide transporter protein |
| OUT | PF02338.9 | 10 | OTU-like cysteine protease |
| Orn_Arg_deC_N | PF02784.7 | −76 | Pyridoxal-dependent decarboxylase, pyridoxal binding domain |
| Orn_DAP_Arg_deC | PF00278.12 | 6.7 | Pyridoxal-dependent decarboxylase, C-terminal sheet domain |
| OstA | PF03968.5 | −12.1 | OstA-like protein |
| P21-Arc | PF04062.5 | −74.5 | P21-ARC (ARP2/3 complex 21 kDa subunit) |
| PADR1 | PF08063.2 | 25 | PADR1 (NUC008) domain |
| PAP2 | PF01569.12 | 8.3 | PAP2 superfamily |
| PARP | PF00644.10 | −55.5 | Poly(ADP-ribose) polymerase catalytic domain |
| PARP_reg | PF02877.5 | 52.8 | Poly(ADP-ribose) polymerase, regulatory domain |
| PAS_2 | PF08446.1 | −2.1 | PAS fold |
| PB1 | PF00564.15 | 12.3 | PB1 domain |
| PBD | PF00786.18 | 12.2 | P21-Rho-binding domain |
| PBP | PF01161.10 | −20.6 | Phosphatidylethanolamine-binding protein |
| PCI | PF01399.17 | 25 | PCI domain |
| PC_rep | PF01851.12 | 0 | Proteasome/cyclosome repeat |
| PDR_assoc | PF08370.2 | 25 | Plant PDR ABC transporter associated |
| PEARLI-4 | PF05278.3 | 25 | *Arabidopsis* phospholipase-like protein (PEARLI 4) |
| PEP-utilizers | PF00391.13 | 0.6 | PEP-utilising enzyme, mobile domain |
| PEP-utilizers_C | PF02896.8 | −173 | PEP-utilising enzyme, TIM barrel domain |
| PFK | PF00365.10 | −132 | Phosphofructokinase |
| PGAM | PF00300.12 | −3 | Phosphoglycerate mutase family |
| PGI | PF00342.9 | −168.9 | Phosphoglucose isomerase |
| PGK | PF00162.9 | −39.9 | Phosphoglycerate kinase |
| PGM_PMM_I | PF02878.6 | −37.5 | Phosphoglucomutase/phosphomannomutase, alpha/beta/alpha domain I |
| PGM_PMM_II | PF02879.6 | −20 | Phosphoglucomutase/phosphomannomutase, alpha/beta/alpha domain II |
| PGM_PMM_III | PF02880.6 | −7.1 | Phosphoglucomutase/phosphomannomutase, alpha/beta/alpha domain III |
| PGM_PMM_IV | PF00408.10 | 7.4 | Phosphoglucomutase/phosphomannomutase, C-terminal domain |
| PI-PLC-X | PF00388.9 | 18.8 | Phosphatidylinositol-specific phospholipase C, X domain |
| PI-PLC-Y | PF00387.9 | −11 | Phosphatidylinositol-specific phospholipase C, Y domain |
| PI3_PI4_kinase | PF00454.17 | 14.8 | Phosphatidylinositol 3- and 4-kinase |
| PLAT | PF01477.13 | 36.3 | PLAT/LH2 domain |

TABLE 19-continued

| Pfam domain name | accession number | gathering cutoff | domain description |
|---|---|---|---|
| PP2C | PF00481.12 | −44 | Protein phosphatase 2C |
| PPAK | PF02818.5 | 0 | PPAK motif |
| PPDK_N | PF01326.9 | −150.2 | Pyruvate phosphate dikinase, PEP/pyruvate binding domain |
| PPR | PF01535.11 | 0 | PPR repeat |
| PRA-CH | PF01502.9 | 25 | Phosphoribosyl-AMP cyclohydrolase |
| PRA-PH | PF01503.8 | −18.3 | Phosphoribosyl-ATP pyrophosphohydrolase |
| PSI_PsaH | PF03244.4 | 25 | Photosystem I reaction centre subunit VI |
| PTR2 | PF00854.12 | −50 | POT family |
| PWP2 | PF04047.4 | 25 | Periodic tryptophan protein 2 WD repeat associated presumed domain |
| Peptidase_C26 | PF07722.3 | 25 | Peptidase C26 |
| Peptidase_C54 | PF03416.9 | −153.2 | Peptidase family C54 |
| Peptidase_M22 | PF00814.15 | −53 | Glycoprotease family |
| PetM | PF08041.2 | 25 | PetM family of cytochrome b6f complex subunit 7 |
| PfkB | PF00294.14 | −67.8 | pfkB family carbohydrate kinase |
| Phi_1 | PF04674.3 | 25 | Phosphate-induced protein 1 conserved region |
| Phosphoesterase | PF04185.5 | −71.5 | Phosphoesterase family |
| Phytochelatin | PF05023.5 | 25 | Phytochelatin synthase |
| Phytochrome | PF00360.10 | 13 | Phytochrome region |
| Pkinase | PF00069.15 | −70.3 | Protein kinase domain |
| Pkinase_Tyr | PF07714.7 | 65 | Protein tyrosine kinase |
| Polyketide_cyc | PF03364.10 | 20.6 | Polyketide cyclase/dehydrase and lipid transport |
| Pre-SET | PF05033.6 | 3.9 | Pre-SET motif |
| Prefoldin | PF02996.8 | 9.3 | Prefoldin subunit |
| Pribosyltran | PF00156.17 | 2 | Phosphoribosyl transferase domain |
| Pro_CA | PF00484.9 | −45 | Carbonic anhydrase |
| Pro_dh | PF01619.8 | −120.5 | Proline dehydrogenase |
| Pro_isomerase | PF00160.11 | −37 | Cyclophilin type peptidyl-prolyl cis-trans isomerase/CLD |
| PseudoU_synth_1 | PF01416.10 | 11 | tRNA pseudouridine synthase |
| Pyr_redox | PF00070.17 | 5 | Pyridine nucleotide-disulphide oxidoreductase |
| Pyr_redox_2 | PF07992.4 | −20 | Pyridine nucleotide-disulphide oxidoreductase |
| Pyr_redox_dim | PF02852.12 | −13 | Pyridine nucleotide-disulphide oxidoreductase, dimerisation domain |
| Pyridoxal_deC | PF00282.9 | −158.6 | Pyridoxal-dependent decarboxylase conserved domain |
| RNA_polI_A14 | PF08203.2 | 25 | Yeast RNA polymerase I subunit RPA14 |
| RNA_pol_A_bac | PF01000.16 | 10 | RNA polymerase Rpb3/RpoA insert domain |
| RNA_pol_I_A49 | PF06870.3 | 25 | A49-like RNA polymerase I associated factor |
| RNA_pol_L | PF01193.14 | 16.9 | RNA polymerase Rpb3/Rpb11 dimerisation domain |
| RRM_1 | PF00076.12 | 17.7 | RNA recognition motif. (a.k.a. RRM, RBD, or RNP domain) |
| RWD | PF05773.12 | 18.4 | RWD domain |
| Radical_SAM | PF04055.11 | 8.5 | Radical SAM superfamily |
| Ras | PF00071.12 | −69.9 | Ras family |
| RelA_SpoT | PF04607.7 | −6.7 | Region found in RelA/SpoT proteins |
| Response_reg | PF00072.14 | 4 | Response regulator receiver domain |
| Reticulon | PF02453.8 | −40 | Reticulon |
| Rho_GDI | PF02115.7 | −55 | RHO protein GDP dissociation inhibitor |
| Rib_5-P_isom_A | PF06026.5 | −84.5 | Ribose 5-phosphate isomerase A (phosphoriboisomerase A) |
| Ribonuc_L-PSP | PF01042.11 | −25 | Endoribonuclease L-PSP |
| Ribosomal_L19 | PF01245.10 | −31 | Ribosomal protein L19 |
| Ribosomal_L37 | PF08561.1 | 25 | Mitochondrial ribosomal protein L37 |
| Ribosomal_S8 | PF00410.9 | −27 | Ribosomal protein S8 |
| SAC3_GANP | PF03399.6 | −15.2 | SAC3/GANP/Nin1/mts/eIF-3 p25 family |
| SET | PF00856.18 | 23.5 | SET domain |
| SH3_1 | PF00018.18 | −8 | SH3 domain |
| SH3_2 | PF07653.7 | 0 | Variant SH3 domain |
| SIR2 | PF02146.8 | −95 | Sir2 family |
| SIS | PF01380.12 | 0 | SIS domain |
| SKI | PF01202.12 | −9.2 | Shikimate kinase |
| SNARE | PF05739.9 | 23.8 | SNARE domain |
| SNARE_assoc | PF09335.1 | −12.1 | SNARE associated Golgi protein |
| SOR_SNZ | PF01680.7 | 25 | SOR/SNZ family |
| SPOC | PF07744.3 | 12.3 | SPOC domain |
| SPT2 | PF08243.2 | 25 | SPT2 chromatin protein |
| SRF-TF | PF00319.9 | 11 | SRF-type transcription factor (DNA-binding and dimerisation domain) |
| Saccharop_dh | PF03435.8 | −77.9 | Saccharopine dehydrogenase |
| Saccharop_dh_N | PF04455.3 | 25 | LOR/SDH bifunctional enzyme conserved region |
| SapB_1 | PF05184.5 | 3 | Saposin-like type B, region 1 |
| SapB_2 | PF03489.7 | 10.8 | Saposin-like type B, region 2 |
| ScpA_ScpB | PF02616.5 | −39 | ScpA/B protein |
| Sel1 | PF08238.2 | 6.2 | Sel1 repeat |
| Self-incomp_S1 | PF05938.2 | −12.7 | Plant self-incompatibility protein S1 |
| Senescence | PF06911.3 | −53.5 | Senescence-associated protein |
| Shikimate_DH | PF01488.10 | −4.4 | Shikimate/quinate 5-dehydrogenase |
| Shikimate_dh_N | PF08501.1 | −12.2 | Shikimate dehydrogenase substrate binding domain |
| Sina | PF03145.7 | −48.4 | Seven in absentia protein family |
| Skp1 | PF01466.9 | −2 | Skp1 family, dimerisation domain |

TABLE 19-continued

| Pfam domain name | accession number | gathering cutoff | domain description |
|---|---|---|---|
| Skp1_POZ | PF03931.5 | 14.9 | Skp1 family, tetramerisation domain |
| Snf7 | PF03357.11 | −22.9 | Snf7 |
| Spermine_synth | PF01564.7 | −93.8 | Spermine/spermidine synthase |
| SpoIIE | PF07228.3 | −13.7 | Stage II sporulation protein E (SpoIIE) |
| Sterol_desat | PF01598.8 | −13 | Sterol desaturase |
| Stig1 | PF04885.4 | 25 | Stigma-specific protein, Stig1 |
| Str_synth | PF03088.7 | 4.7 | Strictosidine synthase |
| Sugar_tr | PF00083.14 | −85 | Sugar (and other) transporter |
| Sulfotransfer_1 | PF00685.17 | −53.1 | Sulfotransferase domain |
| TB2_DP1_HVA22 | PF03134.9 | −25.1 | TB2/DP1, HVA22 family |
| TFIIF_alpha | PF05793.3 | 25 | Transcription initiation factor IIF, alpha subunit (TFIIF-alpha) |
| TFIIS | PF08711.1 | 3 | Transcription elongation factor S-II protein N terminal |
| TFIIS_C | PF01096.9 | 15 | Transcription factor S-II (TFIIS) |
| TFIIS_M | PF07500.4 | 7.4 | Transcription factor S-II (TFIIS), central domain |
| TIM | PF00121.9 | −97 | Triosephosphate isomerase |
| TLD | PF07534.6 | 25 | TLD |
| TMEM14 | PF03647.4 | −1 | Transmembrane proteins 14C |
| TOM20_plant | PF06552.5 | 25 | Plant specific mitochondrial import receptor subunit TOM20 |
| TPK_B1_binding | PF04265.5 | 25 | Thiamin pyrophosphokinase, vitamin B1 binding domain |
| TPK_catalytic | PF04263.7 | −23.8 | Thiamin pyrophosphokinase, catalytic domain |
| TPR_2 | PF07719.7 | 20.1 | Tetratricopeptide repeat |
| TPT | PF03151.7 | −15.3 | Triose-phosphate Transporter family |
| TP_methylase | PF00590.10 | −38 | Tetrapyrrole (Corrin/Porphyrin) Methylases |
| Tcp11 | PF05794.4 | 25 | T-complex protein 11 |
| Tetraspannin | PF00335.10 | −15.4 | Tetraspanin family |
| ThiC | PF01964.9 | 25 | ThiC family |
| ThiF | PF00899.11 | −38.4 | ThiF family |
| ThiG | PF05690.4 | −186.9 | Thiazole biosynthesis protein ThiG |
| Thioredoxin | PF00085.10 | −25.7 | Thioredoxin |
| Tim17 | PF02466.9 | 2.7 | Tim17/Tim22/Tim23 family |
| Transaldolase | PF00923.9 | −49 | Transaldolase |
| Transket_pyr | PF02779.14 | −49 | Transketolase, pyrimidine binding domain |
| Transketolase_C | PF02780.10 | −15.5 | Transketolase, C-terminal domain |
| Transketolase_N | PF00456.11 | −98 | Transketolase, thiamine diphosphate binding domain |
| Transthyretin | PF00576.11 | 25 | Transthyretin precursor (formerly prealbumin) |
| Trehalose_PPase | PF02358.7 | −49.4 | Trehalose-phosphatase |
| Tryp_alpha_amyl | PF00234.12 | −4 | Protease inhibitor/seed storage/LTP family |
| UAA | PF08449.2 | −146.2 | UAA transporter family |
| UBA | PF00627.21 | 20.7 | UBA/TS-N domain |
| UBX | PF00789.11 | 10 | UBX domain |
| UCH | PF00443.19 | −8.6 | Ubiquitin carboxyl-terminal hydrolase |
| UDPGT | PF00201.9 | −151 | UDP-glucoronosyl and UDP-glucosyl transferase |
| UFD1 | PF03152.5 | 25 | Ubiquitin fusion degradation protein UFD1 |
| UQ_con | PF00179.16 | −30 | Ubiquitin-conjugating enzyme |
| Uricase | PF01014.9 | −10.6 | Uricase |
| Usp | PF00582.16 | 21.6 | Universal stress protein family |
| Utp13 | PF08625.1 | −12.4 | Utp13 specific WD40 associated domain |
| V-SNARE | PF05008.5 | −16 | Vesicle transport v-SNARE protein |
| Voltage_CLC | PF00654.10 | −148 | Voltage gated chloride channel |
| WD40 | PF00400.22 | 21.5 | WD domain, G-beta repeat |
| WGR | PF05406.5 | 5.8 | WGR domain |
| WRKY | PF03106.6 | 25 | WRKY DNA-binding domain |
| XG_FTase | PF03254.4 | 25 | Xyloglucan fucosyltransferase |
| XPC-binding | PF09280.1 | 27.6 | XPC-binding domain |
| Xan_ur_permease | PF00860.11 | −151.2 | Permease family |
| YDG_SRA | PF02182.8 | 25 | YDG/SRA domain |
| Y_phosphatase2 | PF03162.4 | −47.6 | Tyrosine phosphatase family |
| YjeF_N | PF03853.5 | 25 | YjeF-related protein N-terminus |
| Zip | PF02535.12 | −25.6 | ZIP Zinc transporter |
| adh_short | PF00106.15 | −40.2 | short chain dehydrogenase |
| cobW | PF02492.9 | −10 | CobW/HypB/UreG, nucleotide-binding domain |
| eIF-1a | PF01176.9 | 20 | Translation initiation factor 1A/IF-1 |
| eIF2A | PF08662.1 | 0 | Eukaryotic translation initiation factor eIF2A |
| efhand | PF00036.22 | 21.7 | EF hand |
| efhand_like | PF09279.1 | 17.8 | Phosphoinositide-specific phospholipase C, efhand-like |
| iPGM_N | PF06415.4 | −263.4 | BPG-independent PGAM N-terminus (iPGM_N) |
| mTERF | PF02536.5 | −60 | mTERF |
| malic | PF00390.9 | 25 | Malic enzyme, N-terminal domain |
| p450 | PF00067.12 | −105 | Cytochrome P450 |
| polyprenyl_synt | PF00348.8 | −43 | Polyprenyl synthetase |
| tRNA-synt_1g | PF09334.1 | −272.5 | tRNA synthetases class I (M) |
| ubiquitin | PF00240.13 | 19.4 | Ubiquitin family |
| zf-C3HC4 | PF00097.15 | 16 | Zinc finger, C3HC4 type (RING finger) |
| zf-CCHC | PF00098.13 | 17.9 | Zinc knuckle |
| zf-CW | PF07496.5 | 25 | CW-type Zinc Finger |
| zf-LSD1 | PF06943.3 | 25 | LSD1 zinc finger |
| zf-MYND | PF01753.9 | 11 | MYND finger |

TABLE 19-continued

| Pfam domain name | accession number | gathering cutoff | domain description |
|---|---|---|---|
| zf-PARP | PF00645.8 | 25 | Poly(ADP-ribose) polymerase and DNA-Ligase Zn-finger region |
| zf-Tim10_DDP | PF02953.6 | −5 | Tim10/DDP family zinc finger |
| zf-UBR | PF02207.10 | 25 | Putative zinc finger in N-recognin (UBR box) |

Example 5

Plasmid Contruction for Transferring Recombinant DNA

This example illustrates the construction of plasmids for transferring recombinant DNA into the nucleus of a plant cell which can be regenerated into a transgenic crop plant of this invention. Primers for PCR amplification of protein coding nucleotides of recombinant DNA are designed at or near the start and stop codons of the coding sequence, in order to eliminate most of the 5' and 3' untranslated regions. DNA of interest, i.e. each DNA identified in Table 2 and the DNA for the identified homologous genes, are cloned and amplified by PCR prior to insertion into the insertion site the base vector.

A. Plant Expression Constructs for Corn Transformation

Elements of an exemplary common expression vector, pMON93039 are illustrated in Table 20. The exemplary base vector which is especially useful for corn transformation is illustrated in FIG. 1 and assembled using technology known in the art.

TABLE 20 pMON93039

| function | name | annotation | Coordinates of SEQ ID NO: 67779 |
|---|---|---|---|
| *Agrobacterium* T-DNA trabsfer | B-AGRtu.right border | Agro right border sequence, essential for transfer of T-DNA. | 11364-11720 |
| Gene of interest expression cassette | E-Os.Act1 | upstream promoter region of the rice actin 1 gene | 19-775 |
| | E-CaMV.35S.2xA1-B3 | duplicated35S A1-B3 domain without TATA box | 788-1120 |
| | P-Os.Act1 | promoter region of the rice actin 1 gene | 1125-1204 |
| | L-Ta.Lhcb1 | 5' untranslated leader of wheat major chlorophyll a/b binding protein | 1210-1270 |
| | I-Os.Act1 | first intron and flanking UTR exon sequences from the rice actin 1 gene | 1287-1766 |
| | T-St.Pis4 | 3' non-translated region of the potato proteinase inhibitor II gene which functions to direct polyadenylation of the mRNA | 1838-2780 |
| Plant selectable marker expression cassette | P-Os.Act1 | Promoter from the rice actin 1 gene | 2830-3670 |
| | L-Os.Act1 | first exon of the rice actin 1 gene | 3671-3750 |
| | I-Os.Act1 | first intron and flanking UTR exon sequences from the rice actin 1 gene | 3751-4228 |
| | TS-At.ShkG-CTP2 | Transit peptide region of *Arabidopsis* EPSPS | 4238-4465 |
| | CR-AGRtu.aroA-CP4.nat | coding region for bacterial strain CP4 native arogA gene | 4466-5833 |
| | T-AGRtu.nos | A 3' non-translated region of the nopaline synthase gene of *Agrobacterium tumefaciens* Ti plasmid which functions to direct polyadenylation of the mRNA. | 5849-6101 |
| *Agrobacterium* T-DNA transfer | B-AGRtu.left border | Agro left border sequence, essential for transfer of T-DNA. | 6168-6609 |

TABLE 20-continued pMON93039

| function | name | annotation | Coordinates of SEQ ID NO: 67779 |
|---|---|---|---|
| Maintenance in E. coli | OR-Ec.oriV-RK2 | The vegetative origin of replication from plasmid RK2. | 6696-7092 |
| | CR-Ec.rop | Coding region for repressor of primer from the ColE1 plasmid. Expression of this gene product interferes with primer binding at the origin of replication, keeping plasmid copy number low. | 8601-8792 |
| | OR-Ec.ori-ColE1 | The minimal origin of replication from the E. coli plasmid ColE1. | 9220-9808 |
| | P-Ec.aadA-SPC/STR | romoter for Tn7 adenylyltransferase (AAD(3")) | 10339-10380 |
| | CR-Ec.aadA-SPC/STR | Coding region for Tn7 adenylyltransferase (AAD(3")) conferring spectinomycin and streptomycin resistance. | 10381-11169 |
| | T-Ec.aadA-SPC/STR | 3' UTR from the Tn7 adenylyltransferase (AAD(3")) gene of E. coli. | 11170-11227 |

B. Plant Expression Constructs for Soybean or Canola Transformation

Figure 2:
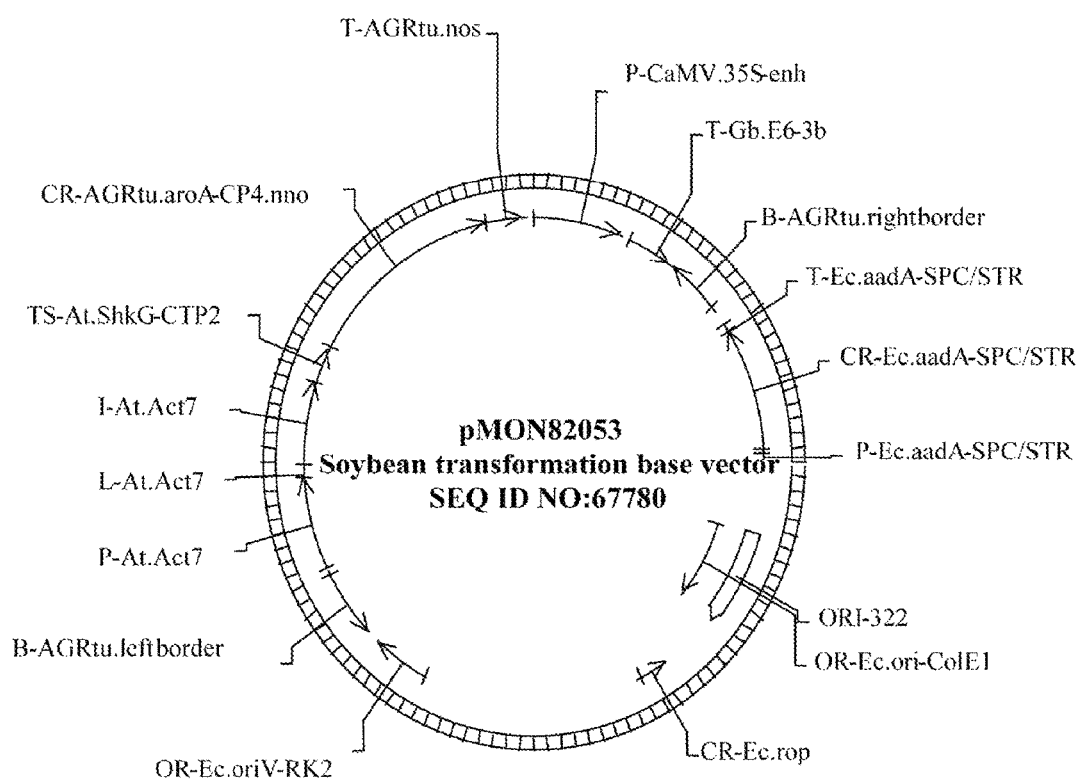

Plasmids for use in transformation of soybean are also prepared. Elements of an exemplary common expression vector plasmid pMON82053 are shown in Table 21 below. This exemplary soybean transformation base vector illustrated in FIG. 2 is assembled using the technology known in the art. DNA of interest, i.e. each DNA identified in Table 2 and the DNA for the identified homologous genes, is cloned and amplified by PCR prior to insertion into the insertion site the base vector at the insertion site between the enhanced 35S CaMV promoter and the termination sequence of cotton E6 gene.

TABLE 21 pMON82053

| function | name | annotation | Coordinates of SEQ ID NO: 67780 |
|---|---|---|---|
| Agrobacterium T-DNA transfer | B-AGRtu.left border | Agro left border sequence, essential for transfer of T-DNA. | 6144-6585 |
| Plant selectable marker expression cassette | P-At.Act7 | Promoter from the arabidopsis actin 7 gene | 6624-7861 |
| | L-At.Act7 | 5'UTR of Arabidopsis Act7 gene | |
| | I-At.Act7 | Intron from the Arabidopsis actin7 gene | |
| | TS-At.ShkG-CTP2 | Transit peptide region of Arabidopsis EPSPS | 7864-8091 |
| | CR-AGRtu.aroA-CP4.nno__At | Synthetic CP4 coding region with dicot preferred codon usage. | 8092-9459 |
| | T-AGRtu.nos | A 3' non-translated region of the nopaline synthase gene of Agrobacterium tumefaciens Ti plasmid which functions to direct polyadenylation of the mRNA. | 9466-9718 |
| Gene of interest expression cassette | P-CaMV.35S-enh | Promoter for 35S RNA from CaMV containing a duplication of the −90 to −350 region. | 1-613 |
| | T-Gb.E6-3b | 3' untranslated region from the fiber protein E6 gene of sea-island cotton; | 688-1002 |
| Agrobaterium T-DNA transfer | B-AGRtu.right border | Agro right border sequence, essential for transfer of T-DNA. | 1033-1389 |

TABLE 21-continued pMON82053

| function | name | annotation | Coordinates of SEQ ID NO: 67780 |
|---|---|---|---|
| Maintenance in E. coli | OR-Ec.oriV-RK2 | The vegetative origin of replication from plasmid RK2. | 5661-6057 |
| | CR-Ec.rop | Coding region for repressor of primer from the ColE1 plasmid. Expression of this gene product interferes with primer binding at the origin of replication, keeping plasmid copy number low. | 3961-4152 |
| | OR-Ec.ori-ColE1 | The minimal origin of replication from the E. coli plasmid ColE1. | 2945-3533 |
| | P-Ec.aadA-SPC/STR | romoter for Tn7 adenylyltransferase (AAD(3")) | 2373-2414 |
| | CR-Ec.aadA-SPC/STR | Coding region for Tn7 adenylyltransferase (AAD(3")) conferring spectinomycin and streptomycin resistance. | 1584-2372 |
| | T-Ec.aadA-SPC/STR | 3' UTR from the Tn7 adenylyltransferase (AAD(3")) gene of E. coli. | 1526-1583 |

C. Plant Expression Constructs for Cotton Transformation

Figure 3:
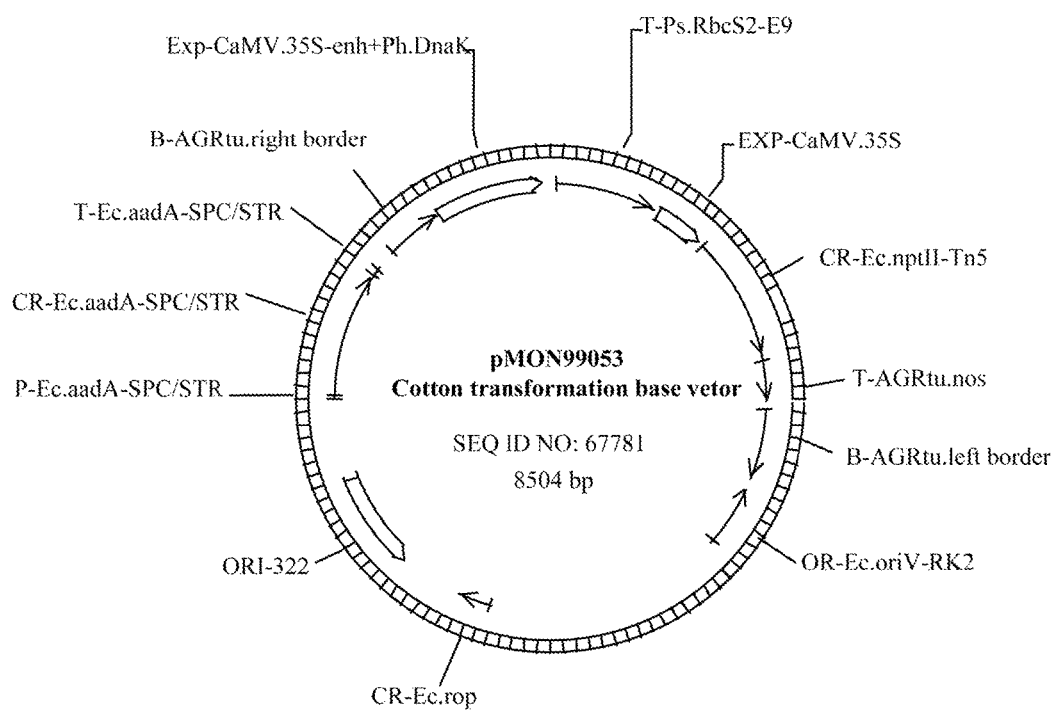

Plasmids for use in transformation of cotton are also prepared. Elements of an exemplary common expression vector plasmid pMON99053 are shown in Table 22 below and FIG. 3. Primers for PCR amplification of protein coding nucleotides of recombinant DNA are designed at or near the start and stop codons of the coding sequence, in order to eliminate most of the 5' and 3' untranslated regions. Each recombinant DNA coding for a protein identified in Table 2 is amplified by PCR prior to insertion into the insertion site within the gene of interest expression cassette of one of the base.

TABLE 22 pMON99053

| function | name | annotation | Coordinates of SEQ ID NO: 67781 |
|---|---|---|---|
| Agrobacterium T-DNA transfer | B-AGRtu.right border | Agro right border sequence, essential for transfer of T-DNA. | 11364-11720 |
| Gene of interest expression cassette | Exp-CaMV.35S-enh + ph.DnaK | Enhanced version of the 35S RNA promoter from CaMV plus the petunia hsp70 5' untranslated region | 7794-8497 |
| | T-Ps.RbcS2-E9 | The 3' non-translated region of the pea RbcS2 gene which functions to direct polyadenylation of the mRNA. | 67-699 |
| Plant selectable marker expression cassette | Exp-CaMV.35S | Promoter and 5' untranslated region of the 35S RNA from CaMV | 730-1053 |
| | CR-Ec.nptII-Tn5 | Neomycin Phosphotransferase II gene that confers resistance to neomycin and kanamycin | 1087-1881 |
| | T-AGRtu.nos | A 3' non-translated region of the nopaline synthase gene of Agrobacterium tumefaciens Ti plasmid which functions to direct polyadenylation of the mRNA. | 1913-2165 |
| Agrobacterium T-DNA transfer | B-AGRtu.left border | Agro left border sequence, essential for transfer of T-DNA. | 2211-2652 |
| Maintenance in E. coli | OR-Ec.oriV-RK2 | The vegetative origin of replication from plasmid RK2. | 2739-3135 |
| | CR-Ec.rop | Coding region for repressor of primer from the ColE1 plasmid. Expression of this gene product interferes with primer binding at the origin of replication, keeping plasmid copy number low. | 4644-4835 |

TABLE 22-continued pMON99053

| function | name | annotation | Coordinates of SEQ ID NO: 67781 |
|---|---|---|---|
| | OR-Ec.ori-ColE1 | The minimal origin of replication from the *E. coli* plasmid ColE1. | 5263-5851 |
| | P-Ec.aadA-SPC/STR | romoter for Tn7 adenylyltransferase (AAD(3")) | 6382-6423 |
| | CR-Ec.aadA-SPC/STR | Coding region for Tn7 adenylyltransferase (AAD(3")) conferring spectinomycin and streptomycin resistance. | 6424-7212 |
| | T-Ec.aadA-SPC/STR | 3' UTR from the Tn7 adenylyltransferase (AAD(3")) gene of *E. coli*. | 7213-7270 |

Example 6

Corn Plant Tranformation

This example illustrates the production and identification of transgenic corn cells in seed of transgenic corn plants having an enhanced agronomic trait, i.e. enhanced nitrogen use efficiency, increased yield, enhanced water use efficiency, enhanced tolerance to cold and/or enhanced seed compositions as compared to control plants. Transgenic corn cells are prepared with recombinant DNA expressing each of the protein encoding DNAs listed in Table 2 by *Agrobacterium*-mediated transformation using the corn transformation constructs as disclosed in Example 5.

Corn transformation is effected using methods disclosed in U.S. Patent Application Publication 2004/0344075 A1 where corn embryos are inoculated and co-cultured with the *Agrobacterium tumefaciens* strain ABI and the corn transformation vector. To regenerate transgenic corn plants the transgenic callus resulting from transformation is placed on media to initiate shoot development in plantlets which are transferred to potting soil for initial growth in a growth chamber followed by a mist bench before transplanting to pots where plants are grown to maturity. The plants are self fertilized and seed is harvested for screening as seed, seedlings or progeny R2 plants or hybrids, e.g., for yield trials in the screens indicated above.

Many transgenic events which survive to fertile transgenic plants that produce seeds and progeny plants do not exhibit an enhanced agronomic trait. The transgenic plants and seeds having the transgenic cells of this invention which have recombinant DNA imparting the enhanced agronomic traits are identified by screening for nitrogen use efficiency, yield, water use efficiency, cold tolerance and enhanced seed composition.

Example 7

Soybean Plant Transformation

This example illustrates the production and identification of transgenic soybean cells in seed of transgenic soybean plants having an enhanced agronomic trait, i.e. enhanced nitrogen use efficiency, increased yield, enhanced water use efficiency, enhanced tolerance to cold and/or enhanced seed compositions as compared to control plants. Transgenic soybean cells are prepared with recombinant DNA expressing each of the protein encoding DNAs listed in Table 1 by *Agrobacterium*-mediated transformation using the soybean transformation constructs disclosed in Example 5. Soybean transformation is effected using methods disclosed in U.S. Pat. No. 6,384,301 where soybean meristem explants are wounded then inoculated and co-cultured with the soybean transformation vector, then transferred to selection media for 6-8 weeks to allow selection and growth of transgenic shoots.

The transformation is repeated for each of the protein encoding DNAs identified in Table 2.

Transgenic shoots producing roots are transferred to the greenhouse and potted in soil. Many transgenic events which survive to fertile transgenic plants that produce seeds and progeny plants do not exhibit an enhanced agronomic trait. The transgenic plants and seeds having the transgenic cells of this invention which have recombinant DNA imparting the enhanced agronomic traits are identified by screening for nitrogen use efficiency, yield, water use efficiency, cold tolerance and enhanced seed composition.

Example 8

Selection of Transgenic Plants with Enhanced Agronomic Trait(s)

This example illustrates identification of plant cells of the invention by screening derived plants and seeds for enhanced trait. Transgenic seed and plants in corn, soybean, cotton or canola with recombinant DNA identified in Table 2 are prepared by plant cells transformed with DNA that is stably integrated into the genome of the corn cell. Transgenic corn plant cells are transformed with recombinant DNA from each of the genes identified in Table 2. Progeny transgenic plants and seed of the transformed plant cells are screened for enhanced water usciefficiency, enhanced cold tolerance, increased yield, enhanced nitrogen use efficiency, enhanced seed protein and enhanced seed oil as compared to control plants A. Selection for Enhanced Nitrogen Use Efficiency Transgenic corn seeds provided by the present invention are planted in fields with three levels of nitrogen (N) fertilizer being applied, i.e. low level (0 N), medium level (80 lb/ac) and high level (180 lb/ac). A variety of physiological traits are monitored. Plants with enhanced NUE provide higher yield as compared to control plants.

B. Selection for Increased Yield

Effective selection of enhanced yielding transgenic plants uses hybrid progeny of the transgenic plants for corn, cotton, and canola, or inbred progeny of transgenic plants for soybeanplants plant such as corn, cotton, canola, or inbred plant such as soy, canola and cottoncotton over multiple locations with plants grown under optimal production management practices, and maximum pest control. A useful target for improved yield is a 5% to 10% increase in yield as compared to yield produced by plants grown from seed for a control plant. Selection methods may he applied in multiple and diverse geographic locations, for example up to 16 or more locations, over one or more planting seasons, for example at least two planting seasons, to statistically distinguish yield improvement from natural environmental effects C. Selection for Enhanced Water Use Efficiency (WUE)

The selection process imposes a water withholding period to induce stressdrought followed by watering. For for example, for corn, a useful selection process imposes 3 drought/re-water cycles on plants over a total period of 15 days after an initial stress free growth period of 11 days. Each cycle consists of 5 days, with no water being applied for the first four days and a water quenching on the 5th day of the cycle. The primary phenotypes analyzed by the selection method are the changes in plant growth rate as determined by height and biomass during a vegetative drought treatment.

D. Selection for Growth Under Cold Stress (1) Cold germination assay—Trays of transgenic and control seeds are placed in a growth chamber at 9.7° C. for 24 days (no light). Seeds having higher germination rates as compared to the control are identified.

(2) Cold field efficacy trial—A cold field efficacy trial is used to identify gene constructs that confer enhanced cold vigor at germination and early seedling growth under early spring planting field conditions in conventional-till and simulated no-till environments. Seeds are planted into the ground around two weeks before local farmers begin to plant corn so that a significant cold stress is exerted onto the crop, named as cold treatment. Seeds also are planted under local optimal planting conditions such that the crop has little or no exposure to cold condition, named as normal treatment. At each location, seeds are planted under both cold and normal conditions with 3 repetitions per treatment. Two temperature monitors are set up at each location to monitor both air and soil temperature daily.

Seed emergence is defined as the point when the growing shoot breaks the soil surface. The number of emerged seedlings in each plot is counted everyday from the day the earliest plot begins to emerge until no significant changes in emergence occur. In addition, for each planting date, the latest date when emergence is 0 in all plots is also recorded. Seedling vigor is also rated at V3-V4 stage before the average of corn plant height reaches 10 inches, with 1=excellent early growth, 5=Average growth and 9=poor growth. Days to 50% emergence, maximum percent emergence and seedling vigor are used to determine plants with enhanced cold tolerance.

E. Screens for Transgenic Plant Seeds with Increased Protein and/or Oil Levels

This example sets forth a high-throughput selection for identifying plant seeds with improvement in seed composition using the Infratec 1200 series Grain Analyzer, which is a near-infrared transmittance spectrometer used to determine the composition of a bulk seed sample (Table 23). Near infrared analysis is a non-destructive, high-throughput method that can analyze multiple traits in a single sample scan. An NIR calibration for the analytes of interest is used to predict the values of an unknown sample. The NIR spectrum is obtained for the sample and compared to the calibration using a complex chemometric software package that provides predicted values as well as information on how well the sample fits in the calibration.

Infratec Model 1221, 1225, or 1227 with transport module by Foss North America is used with cuvette, item #1000-4033, Foss North America or for small samples with small cell cuvette, Foss standard cuvette modified by Leon Girard Co. Corn and soy check samples of varying composition maintained in check cell cuvettes are supplied by Leon Girard Co. NIT collection software is provided by Maximum Consulting Inc.Software. Calculations are performed automatically by the software. Seed samples are received in packets or containers with barcode labels from the customer. The seed is poured into the cuvettes and analyzed as received.

TABLE 23

| | |
|---|---|
| Typical sample(s): | Whole grain corn and soybean seeds |
| Analytical time to run method: | Less than 0.75 min per sample |
| Total elapsed time per run: | 1.5 minute per sample |
| Typical and minimum sample size: | Corn typical: 50 cc; minimum 30 cc |
| | Soybean typical: 50 cc; minimum 5 cc |
| Typical analytical range: | Determined in part by the specific calibration. |
| | Corn - moisture 5-15%, oil 5-20%, protein 5-30%, starch 50-75%, and density 1.0-1.3%. |
| | Soybean - moisture 5-15%, oil 15-25%, and protein 35-50%. |

Example 9

Cotton Transgenic Plants with Enhanced Agronomic Traits

Cotton transformation is performed as generally described in WO0036911 and in U.S. Pat. No. 5,846,797. Transgenic cotton plants containing each of the recombinant DNA having a sequence of SEQ ID NO: 1 through SEQ ID NO: 759 are obtained by transforming with recombinant DNA from each of the genes identified in Table 1. Progeny transgenic plants are selected from a population of transgenic cotton events under specified growing conditions and are compared with control cotton plants. Control cotton plants are substantially the same cotton genotype but without the recombinant DNA, for example, either a parental cotton plant of the same genotype that was not transformed with the identical recombinant DNA or a negative isoline of the transformed plant. Additionally, a commercial cotton cultivar adapted to the geographical region and cultivation conditions, i.e. cotton variety ST474, cotton variety FM 958, and cotton variety Siokra L-23, are used to compare the relative performance of the transgenic cotton plants containing the recombinant DNA. The specified culture conditions are growing a first set of transgenic and control plants under "wet" conditions, i.e. irrigated in the range of 85 to 100 percent of evapotranspiration to provide leaf water potential of −14 to −18 bars, and growing a second set of transgenic and control plants under "dry" conditions, i.e. irrigated in the range of 40 to 60 percent of evapotranspiration to provide a leaf water potential of −21 to −25 bars. Pest to control, such as weed and insect control is applied equally to both wet and dry treatments as needed. Data gathered during the trial includes weather records throughout the growing season including detailed records of rainfall; soil characterization information; any herbicide or insecticide applications; any gross agronomic differences observed such as leaf morphology, branching habit, leaf color, time to flowering, and fruiting pattern; plant height at various points during the trial; stand density; node and fruit number including node above white flower and node above crack boll measurements; and visual wilt scoring. Cotton boll samples are taken and analyzed for lint fraction and fiber quality. The cotton is harvested at the normal harvest timeframe for the trial area. Enhanced water use efficiency is indicated by increased yield, improved relative water content, enhanced leaf water potential, increased biomass, enhanced leaf extension rates, and improved fiber parameters.

The transgenic cotton plants of this invention are identified from among the transgenic cotton plants by agronomic trait screening as having increased yield and enhanced water use efficiency.

Example 10

Canola Plants with Enhanced Agrominic Traits

This example illustrates plant transformation useful in producing the transgenic canola plants of this invention and the production and identification of transgenic seed for transgenic canola having enhanced water use efficiency, enhanced cold tolerance, increased yield, enhanced nitrogen use efficiency, enhanced seed protein and enhanced seed oil.

Tissues from in vitro grown canola seedlings are prepared and inoculated with a suspension of overnight grown *Agrobacterium* containing plasmid DNA with the gene of interest cassette and a plant selectable marker cassette. Following co-cultivation with *Agrobacterium*, the infected tissues are allowed to grow on selection to promote growth of transgenic shoots, followed by growth of roots from the transgenic shoots. The selected plantlets are then transferred to the greenhouse and potted in soil. Molecular characterization are performed to confirm the presence of the gene of interest, and its expression in transgenic plants and progenies. Progeny transgenic plants are selected from a population of transgenic canola events under specified growing conditions and are compared with control canola plants. Control canola plants are substantially the same canola genotype but without the recombinant DNA, for example, either a parental canola plant of the same genotype that is not transformed with the identical recombinant DNA or a negative isoline of the transformed plant Transgenic canola plant cells are transformed with recombinant DNA from each of the genes identified in Table 2. Transgenic progeny plants and seed of the transformed plant cells are screened for enhanced water use efficiency, enhanced cold tolerance, increased is yield, enhanced nitrogen use efficiency, enhanced seed protein and enhanced seed oil.

Example 11

Selection of Transgenic Plants with Enhanced Agronomic Trait(s)

This example illustrates the preparation and identification by selection of transgenic seeds and plants derived from transgenic plant cells of this invention where the plants and seed are identified by screening for a transgenic plant having an enhanced agronomic trait imparted by expression or suppression of a protein selected from the group including the homologous proteins identified in Example 2. Transgenic plant cells of corn, soybean, cotton, canola, alfalfa, wheat and rice are transformed with recombinant DNA for expressing or suppressing each of the homologs identified in Example 2. Plants are regenerated from the transformed plant cells and used to produce progeny plants and seed that are screened for enhanced water use efficiency, enhanced cold tolerance, increased yield, enhanced nitrogen use efficiency, enhanced seed protein and enhanced seed oil. Plants are identified exhibiting enhanced traits imparted by expression or suppression of the homologous proteins.

Example 12

Monocot and Dicot Plant Transformation for the Suppression of Endogeneous Protein This example illustrates monocot and dicot plant transformation to produce nuclei of this invention in cells.of a transgenic plant by transformation where the recombinant DNA suppresses the expression of an endogenous protein identified in Table 24.

Corn, soybean, cotton, or canola tissue are transformed as described in Examples 2-5 using recombinant DNA in the nucleus with DNA that is transcribed into RNA that forms double-stranded RNA targeted to an endogenous gene with DNA encoding the protein. The genes for which the double-stranded RNAs are targeted are the native gene in corn, soybean, cotton or canola that are homologs of the genes encoding the protein that has the function of the protein in *Arabidopsis* as identified in table 24.

Populations of transgenic plants prepared in Examples 6, 7, 9, 10 or 11 with DNA for suppressing a gene identified in Table 2 as providing an enhanced trait by gene suppression are screened to identify an event from those plants with a nucleus of the invention by selecting the trait identified in this specification.

TABLE 24

| PEP SEQ ID | Gene_id | Construct ID | Traits | |
|---|---|---|---|---|
| 760 | CGPG1022.pep | RRM_1 | DS | |
| 761 | CGPG1035.pep | Peptidase_C54 | SS | |
| 763 | CGPG105.pep | AP2 | HS | PEG |
| 764 | CGPG1060.pep | DUF788 | LN | |
| 771 | CGPG1136.pep | RRM_1 | DS | |
| 774 | CGPG1145.pep | LNDIX | LN | |
| 776 | CGPG1173.pep | adh_short | LN | |
| 779 | CGPG122.pep | PTR2 | LN | |
| 781 | CGPG1262.pep | Gar1 | CK | |
| 782 | CGPG128.pep | Response_reg | LN | |

TABLE 24-continued

| PEP SEQ ID | Gene_id | Construct ID | Traits | | | | |
|---|---|---|---|---|---|---|---|
| 784 | CGPG1291.pep | DUF862 | DS | | | | |
| 794 | CGPG1398.pep | Glycolytic | LN | | | | |
| 795 | CGPG1399.pep | Metallophos | LN | | | | |
| 799 | CGPG146.pep | p450 | CS | PP | SS | | |
| 801 | CGPG1528.pep | ATP_synt_H | LN | | | | |
| 803 | CGPG1535.pep | SPT2 | LN | | | | |
| 804 | CGPG1546.pep | CTP_transf_1 | LN | | | | |
| 805 | CGPG1567.pep | Ribosomal_L19 | LN | | | | |
| 807 | CGPG1575.pep | DUF740 | DS | | | | |
| 810 | CGPG1641.pep | Di19 | SP | | | | |
| 812 | CGPG1656.pep | Cyt-b5::FA_desaturase | CS | | | | |
| 813 | CGPG1668.pep | DUF791::MFS_1 | SS | | | | |
| 817 | CGPG1785.pep | PB1::Pkinase_Tyr | CK | | | | |
| 829 | CGPG1938.pep | F-box::LRR_2 | CS | | | | |
| 835 | CGPG2005.pep | NADPH_Ox::Ferric_reduct::FAD_binding_8::NAD_binding_6 | CS | PP | HS | SS | PEG |
| 838 | CGPG2059.pep | LNc_sug_transp | SS | | | | |
| 842 | CGPG2074.pep | HMA::HMA | CK | | | | |
| 845 | CGPG2142.pep | MATH::MATH | DS | | | | |
| 850 | CGPG2213.pep | RNA_pol_I_A49 | CK | PEG | | | |
| 851 | CGPG2247.pep | DUF23 | CK | | | | |
| 852 | CGPG228.pep | p450 | SP | | | | |
| 858 | CGPG2354.pep | ABC1 | PP | | | | |
| 863 | CGPG240.pep | Hydrolase | DS | | | | |
| 869 | CGPG2472.pep | Band_7 | LN | | | | |
| 877 | CGPG274.pep | WD40::WD40::WD40 | PP | LL | | | |
| 879 | CGPG277.pep | IGPD | LN | | | | |
| 893 | CGPG309.pep | Cyclin_N | LN | | | | |
| 911 | CGPG337.pep | Glyco_transt_8 | LN | | | | |
| 917 | CGPG347.pep | DREPP | LN | | | | |
| 931 | CGPG372.pep | SET | LN | | | | |
| 941 | CGPG394.pep | DUF6::TPT | LN | | | | |
| 943 | CGPG397.pep | SOR_SNZ::ThiG | CK | | | | |
| 957 | CGPG421.pep | Pkinase::efhand::efhand::ethand::efhand | LN | | | | |
| 958 | CGPG422.pep | Pkinase | IN | | | | |
| 968 | CGPG430.pep | Pkinase | DS | | | | |
| 996 | CGPG468.pep | Fer4::Fer4 | LN | | | | |
| 1031 | CGPG510.pep | Rho_GDI | SS | | | | |
| 1040 | CGPG519.pep | Abhydrolase_1 | PEG | | | | |
| 1058 | CGPG532.pep | Transket_pyr::Transketolase_C | LN | | | | |
| 1078 | CGPG557.pep | Chitin_bind_1::Barwin | LN | | | | |
| 1083 | CGPG561.pep | XG_FTase | PP | | | | |
| 1091 | CGPG568.pep | FTHFS | LN | | | | |
| 1108 | CGPG580.pep | MGDG_synth::Glyco_tran_28_C | LN | | | | |
| 1134 | CGPG604.pep | PSI_PsaH | LN | | | | |
| 1144 | CGPG614.pep | cobW | LN | | | | |
| 1150 | CGPG620.pep | tRNA-synt_1g | DS | | | | |
| 1212 | CGPG663.pep | Pro_CA | LN | | | | |
| 1232 | CGPG686.pep | RRM_1::zf-CCHC | LN | | | | |
| 1258 | CGPG713.pep | Cyclin_N | LN | | | | |
| 1267 | CGPG72.pep | Amino_oxidase | LN | | | | |
| 1328 | CGPG773.pep | H_PPase | PP | | | | |
| 1357 | CGPG801.pep | Cyt-b5 | LN | | | | |
| 1406 | CGPG841.pep | ArfGap | LN | | | | |
| 1452 | CGPG879.pep | ABC_tran::ABC2_membrane::PDR_assoc::ABC_tran::ABC2_membrane | LN | | | | |
| 1477 | CGPG908.pep | PPR::PPR::PPR::PPR::PPR::PPR::PPR | LN | | | | |
| 1515 | CGPG933.pep | WD40::WD40::WD40::WD40::WD40::WD40::WD40 | SP | | | | |
| 1517 | CGPG967.pep | BTB::NPH3 | CS | | | | |

SEQUENCE LISTING (67778 sequences)

SEQ ID NO: 1 - DNA, 867 bp, Arabidopsis thaliana
atgtctggagcattgaatatgactcttgatgagattgttaagaggggtaaaactgcaaggtctgggggaagagggatttctcgtgggcgtggtcgtggacgtggtggtggtggaagaggagctggacctgctagaagaggtcctcttgctgtgaatgctcgtccatcatctttcaccattaacaagcctgtccgtagggtcaggagcttgccatggcaaagcggtttgtttgaagatggcctaagagctgccggggcatcaggagttgaagttggaaccaggctccatgttacaaatctggaccagggtgtgacaaatgaagatataagggaactcttctctgagattggggaggtagagcgttatgcgattcattatgacaaaaatgggcgtccaagtggcacagctgaagtggtgtatccaagaagaagtgatgcatttcaagctctgaagaaatataacaatgtgctattggatggaaggccaatgagacttgagattttgggtggcaacaattcttccgaggctcctttatctggtcgtgtgaatgtgaatgtcactggactcaatggaaggctgaagaggacggttgttatccaacaaggaggaggagggagaggaagagttagaggtgggagaggaggaagaggtccagctcctactgtcagtcgccgccttccaattcataaccagcagggaggagggatgagaggaggaagaggcgggtttcgtgctagagggcgtggtaatggtggccgtggtcgtggtggtggaagaggaaatggaaagaagccagtggagaagtcagctgctgatcttgacaaagatcttgagagctatcacgctgatgccatgaacacctcttaa

SEQ ID NO: 2 - DNA, 1255 bp, Arabidopsis thaliana
atgtctagtttctcaaccgtatagggagtcttcaacttctgggcataagcaagtttgcaccactcgtaatggttggacagcatttgtaaaaagagtctctatggctagtggagcaattaggagattccaggagcgtgttttagggcctaataggaccggtcttccgagcacaactagtgacgtatggctcttgggtgtctgctataaaatatctgcggatgagaactcaggggaaaccgatactggcactgtattggctgcattgcaactagatttttcatccaaaatactgatgacatatcgtaaaggttttgaaccctttagagacacaacttataccagcgatgtgaactggggttgcatgattcgaagtagccagatgctttttgctcaggcgttgcttttccataggctggggagggcttggactaagaaatctgagcttcctgaacaggaatacttagagaccttggaaccttttggtgattccgagccttcagctttctccatccacaatcttataatagctggagcgtcctatggtctcgctgctgggtcatgggtaggaccgtatgccatttgtcgagcgtgggagtcattagcgtgcaagaagagaaaacaaactgattctaaaaaccagacgcttcctatggctgttcatatcgtttctggcagcgaagatggagagagaggtggggctccaattctctgtatagaagatgctaccaaatcttgtctagaattctcaaaaggacagtctgagtggacaccgattatccttttggttccactggttcttgggcttgacagtgtgaatcccaggtacattccatctctcgtagccacattcacttttcctcagagcgtggggattttgggtggcaaaccaggtgcctcaacttacatagttggtgttcaagaagacaaaggtttctaccttgatccgcatgaagttcaacaggtggtcacagtcaacaaggaaacaccagatgttgacacatcctcctatcattgcaatgtccttcgttatgttcctttggaatcactcgacccatctctagctctaggattctattgccgcgacaaagatgatttcgacgatttctgtctccgagcattgaaactagctgaggaatcaaacggtgctccattgttcacagtgactcaaacccacacagcgataaaccaaagcaactacgggtttgcggatgacgacagcgaggatgaacgtgaagatgactggcaaatgctctga

SEQ ID NO: 3 - DNA, 375 bp, Arabidopsis thaliana
atgtctctacaacaaagaaggatgggttgcaagtatactttttctatcaacgaaacatcagggctcaggatgcagaggggacctctctctgcactcgagacccttgtctttccactaaatgcagatcccggtgtaggttgcatctcgttcaattttccgggatagtttgtggttagaggccatatcgttcaattttccgggatacttggtggttagtggcaatcatcttccgcgcatatggttctcaatgcatcctatgaatatctagctcttagtttccaaccaattcctcaaatcgtggcatccccgacgtggtgtgatcgtgttgtgatctcgttgaatccgggggatcatacgatcaatcttgtcggttaa

SEQ ID NO: 4 - DNA, 908 bp, Arabidopsis thaliana
  misc_feature (851)..(851): n is a, c, g, or t
  unsure (1)..(908): unsure at all n locations
cctgaactagaacagaaagagagagaaactattatttcagcaaaccataccaacaaaaaagacagagatcttttagttaccttatccagtttcttgaaacagagtactcttctgatcaatgaactcattttctgctttttctgaaatgtttggctccgattacgagtcttcggtttcctcaggcggtgattatattccgacgcttgcgagcagctgccccaagaaaccggcgggtcgtaagaagtttcgtgagactcgtcacccaatatacagaggagttcgtcggagaaactccggtaagtgggtttgtgaggttagagaaccaaacaagaaaacaaggatttggctcggaacatttcaaaccgctgagatggcagctcgagctcacgacgttgccgctttagcccttcgtggccgatcagcctgtctcaatttcgctgactcggcttggagactccgaatcccggaatcaacttgcgctaaggacatccaaaaggcggcggctgaagctgcgttggcgtttcaggatgagatgtgtgatgcgacgacggatcatggcttcgacatggaggagacgttggtggaggctatttacacggcggaacagagcgaaaatgcgttttatatgcacgatgaggcgatgtttgagatgccgagtttgttggctaatatggcagaagggatgcttttgccgcttccgtccgtacagtggaatcataatcatgaagtcgacggcgatgatgacgacgtatcgttatggagttattaaaactcagattattatttccatttttagtacgatactttttattttattattatttttagatccttttttagaatggaatctncattatgtttgtaaaactgagaaacgagtgtaaattaaattgattcagtttcagtat

SEQ ID NO: 5 - DNA, 522 bp, Arabidopsis thaliana
atggcgaatcaaggagcgaagaaacgaaaggaagagaacgccaaacacatggctaagctccgtcgtatcatcatcgcttccaatgctgtgtatttcgttgtgaggatgttgattttctactcaagctttacttggaaacattggatcggtttagtgataacttcgctggcttacgcgtttccttataagcagcttgatcaaatggctaaacctagtgttactgatgatggtgagcttattgatggtggatttgacatgaccactggtggaatctgcggatatttgcacgatgtcatctatatcacttgctttgttcagctagcttccatcatcactgggaagttttggtacacgtatcttgtgattcctgcgtttggagtgtataaagcttctggtcttattcgaggattcatgtcacaaggttcagagggaggtgtggaagatgaaaagtctcgtaaaaagagagagaagatggagaggaaagcttcgagagggcaagtcgtcaagacgagaacaagatga

SEQ ID NO: 6 - DNA, 312 bp, Arabidopsis thaliana
atggaggttccaggttcatcgaagaagatgatcgcaacgcaagaagagatgtctgcagctaaaatagcacttggatctagagatatgtgcgctcatctcttgattccgctcaacaaatgtcgtcaggctgagttttaccttccatggaaatgtgaagacgagcgtcacgtttatgagaagtgtgaatacgagcttgttatggagagaatgcttgcgatgaagaagatccgtgaagaagaagctttggctaaacagaataaactacaaggaaacgctgctgttcctcttatccctaaaactgctaatgcttag

SEQ ID NO: 7 - DNA, 1746 bp, Arabidopsis thaliana
atggcgatgatagggatgaacattattgggctattcatggttcttatgttgcttctcatctccctcatcatccttttcgcctgcaagccatggcgatatttttctcgtttccgatcctcctctcgtttttcttctaccttcaaggtgggggatttgcagagaccacttatttctgatgatggaaatttgatccaaggacaaaccagtgaggtaacaagggaatatgatttagagggagcttgctaccaaaatgatggacttttgcattcatctctgactgagggacggttttacaaacaaaggcttccttcgtcatctccccatttctcccaaggtgaaagctttgttctagaagtaatttctgaaccttctgacaatgctttggtgggccaaacgcttaaacttccagctgaaaaaggttccttggcagaagtgcaaacatatgactggcagaataacagaaatgaaaacttgcaatataatctggaaaaggatcgacttattaatctttctccgaggctcgtggaagatcaaagaagttggctgttcctggaagtcatcgcgggtcctgccattgggcttcaacatgctgtgaactccacaagttcctccaagctgccagtgaaacttggaagggtttctccttctgatttggcattgaaggactcagaagtctctgggaaacatgcacagataacatggaactctactaaatttaaatgggagctggtagatatgggtagcctaaatggaactctcgtaaactctcattcaataagtcatcctgatttaggcagccggaagtggggtaaccctgtcgagcttgcaagtgatgatataataactttgggaacaacaacaaaggtctatgtccgtatctcctctcagaatgagtttcagatacccttcaaaattggtgtggcctcagatcccatggctatgcgtcgaggaggcaggaaacttccgatggaagatgtttgtcattacaagtggccgcttcctggggctaataagtttggactgttttgtgtttgtgatggacatgggggatcaggggctgctcaatccgcaatcaaaattattccggaggttctagcgaatattttatcagactcgctgaggaaggagaaagtgttatcaaaaagggatgcttcggacgtccttagggacatgtttgctaaaacagaagctcgcctcgaagaacaccaatatgagggttgtacagctactgttctcttggtttggaaagacaatgaagaaaacttcttcgcacaatgtgccaatcttggggattcagcatgtgttatccatcttggtggcagatatatacaaatgactgaagatcatcgagtggttagcttgagcgagagaaaacgattccaagaagcaggactagccttgagagatggagagactcggctttttggtataaaccttgcgaggatgcttggagacaagtttccaaagcaacaagacagccgtttcagtgcagagccatatataagtgagcctttgcgtatcgatcaatctagtaaagacgtatttgctgtattggctagtgacgggttatgggacgtggtaagtccgaagaaagctgtgcagcttgtacttcagatgagagataaagagagagggagagagagtagtgcggagaagatagcaaacggtctgctgaatgaagctagagcgatgcgtacaaaggacaacacctccattatttacttagatttcgatacttccctgtaa

SEQ ID NO: 8 - DNA, 808 bp, Arabidopsis thaliana
atgggagatctctacgctttggacttcgatggagttctctgtgatagttgtggagaaagctctctatctgctgttaaggcagccaaagtgagatggcctgatttgttcgaaggagttgattccgctttagaggaatggatcgtcgatcaaatgcatattgtgagacctgtggttgaaactggctatgaaaatcttctacttgtgcggctgttattggagaccaagataccgtctattcgaaaatcttcagttgcagaggggttgacggttgatgggatactggagagctgggcaaagtttaagcccgtgatcatggaagcttgggatgaagatagagatgctttggtagatttgtttggaaaagttagagatgattggattaacaaggacttgacaacttggattggtgccaatagattctacccaggagtttcagatgcactgaaatttgccagctcaaagatttatatcgttaccacgaaacagggccgctttgcagaagcgttactgcgtgaaatagcaggtgtaatcataccatcagaaaggatttatggtttgggttcagggccaaaggtggaagttctaaagctacttcaagataaaccagaacatcagggcttgacgctgcatttcgtggaagacagactcgcaacgctgaaaaatgtcataaaagagcctgaattagacaaatggagtttatacctaggaacctggggatacaacactgagaaagagagagctgaagcagcaggcattcccaggattcaggttattgagctctccacgtttagcaataagcttaaatgag

SEQ ID NO: 9 - DNA, 765 bp, Arabidopsis thaliana
atgggtttaatcaagaacacagttcattactgttgtgtctcaagagacaatcagattctttactcttacaacggtggagaccaaaccaacgagagtcttgctgctctgtgtttagaaaagtctcctccttttcatacttggtactttgaaactattggtaaaagaagatttgggtttttaattggagatgggtttgtttatttcgccattgttgatgaggttttgaagagatctagtgttcttaagtttcttgaacatttgagagatgaatttaagaaagctgctagggagaattctagaggaagttttactgctatgattggttctattaatgttgaagatcagcttgttcctgttgttactagacttatagcttctcttgaacgtgttgctgagagtagtagtaacaatgaattgaagagtagtaatcttggtgaacaaagcgaaggttcgaattctactaaagctccgttgttggggaggttaagtaagcaagagaagaagaaagggaaagatcatgtgattgagcttgaggaacacaggaagtctaatgatagagggaacataaccgatgattcagcgggagctggaacgtcgttggagaaggagtgtgtgtcgagtagtggacgttctgttactcaaagctttgaatggaaatggcggcggttagttcagattgttcttgctattgatgcagctatttgcttgacactgtttggtatttggttggctatatgtcggggtatcgagtgtacacgttcgtga

SEQ ID NO: 10 - DNA, 584 bp, Arabidopsis thaliana
atgtgtagtttgtcggcgattatgttgttaccaacgaagctgaaaccagcttattcagacaaacggagtaacagtagcagcagcagctcactcttcttcaacaatagaagatccaagaagaagaaccaatcgattgttcccgttgcaaggttgtttggaccggcgattttcgaatcatccaaattgaaagtactcttcttaggggttgatgagaagaagcatccttcaacgctccctaggacttacacactcactcacagtgacattacagctaaactaaccttagctatttctcaatccataaacaactctcagttgcaaggatgggcaaataggctataccgggatgaagttgtggcagaatggaagaaagtgaaagggaaaatgtcgcttcacgttcattgtcacataagcggtggccatttccttttagatctctttgcaaagtttcgatatttcatcttttgcaaagaactacctgtggtgttgaaggcttttgtgcatggagatgggaacttgttgaacaactatcctgagctacaagaagctcttgtttgggtctatttccattctaatgtcaatga

SEQ ID NO: 11 - DNA, 443 bp, Arabidopsis thaliana
atggctaacaaagctctcattcatctcctcgtcatcttcttcttggctctatcacacatcttcttcttcccttcccatgcttcgagtaaaatcttcatctctcttaaaatcgtattttatgtatttacatcatatgttttaacttatatcatctatattttgtacgtatacaggacttgggagtttgatggagaagccaaaaattgttcgacctcaacaagatacactaatggttagttatttagctatttatctgtgttcttgagaggttaaaattaggttattaaagattttaatttggttttgttttacataatcaatgctattaggatgtgaagaaggaggtcgaagaaaggatggtgatggagttaaacgactatccaggttcgggtgcaaacaatcgccatttgccacgacaacgaggctgcgtcgttgattgctga

SEQ ID NO: 12 - DNA, 306 bp, Arabidopsis thaliana
atgcctcctcgcacgggaaaggataaacaaaaccccaggctcccaccggaggtgactcgcctactctacatttgtaaccttccctttagcataacaagcgaagatacgtacgatcttttcggaaggtacagtacgattcgtcaggttcgaatcggttgtgaaaagggcacaaaaggtacggctttcgtcgtatacgaggatatctacgatgctaagaaagctgtcgaccatctctggcttcaacatagcgaaccggtaccttatcgtgcactattaccaacatgcgaagatgagcaagaagtttga

SEQ ID NO: 13 - DNA, 471 bp, Arabidopsis thaliana
atgggtttctccgacgctggaatttacctctccgacccaaacaatctctgccaaaccgaactaggtttctttcatgaaccatctctagggttttcagaccagagcgatccacaaaacgagttccacatcactcctcctatatatcaagaattacaagatcaggatcttgaacctaaatcccaagagacgaataattgctcacgcaaagaaggagcaaccgtcaagaaagaagaagaagaagaagacgattattgtaaaactccgactcgttcagaccagattctctcggcgatgccaagaatttgtccaccggcgcctaggaaacctaaaagagtcccgtcgagaagccttaaggttagaaattcatatagaagcaagagaatgatcattctaaatgtttctagagagattgattgtttgtttaatccaacatcactatgtaacaaaattaagaaagccagatacatctaa

SEQ ID NO: 14 - DNA, 1002 bp, Arabidopsis thaliana
atggagtctctagggaagctacagcttcatcagcaaccaaatcacctctctttcactcatttctcttcatctttccccaaaaagccttcgtctttctctctcagatccttacccagatcaacatcatccttcaaatgcatttcaatcaaagcttcctcatccaagtctcaagactcgaagctctcaatcctcaaatccacatgcgtcagcttcactgcggcagcagcactgttccttgtgaatctccagctcaaaccttcaccggcgattgcggctcctgtggcggcgacgccgttaatggaatctctcaaacaaagtaacggaaacgtttcatttgaagaagaagagagatcactcgaagagtatcttgcttctcaccctgatgatgttgaagctctacgatctttaatggaggtaaggatcaaatctcgaaagcttctagaagctatagaattgattgataggttgattgaattggaaccagaggagaaggaatggccaatgttgaaagctaatatctttagttacagtggagatttagagtctgctaaaactggttttgaagagattctagtcaaagatccgcttcgtgtcgaggcttatcacggtttagttatggcttattctgattctggtgatgatttgaatgctgtggagaagagaattgaggaggcaatggttaggtgcaagaaggagaagaatcgtaaggacttgagagattttaagctactagtggcgcaaattcgggttattgaagggaagcataatgaagcattgaagttgtatgaggagcttgtgaaggaagagccgagagatttcaggccgtatctatgtcaagggattatatacacagtgttgaagaaggagaatgaggcggagaaacagtttgagaagtttaggagacttgtcccgaagaatcatccttatagagagtattttatggataatatggttgcttcgaagctctttgccgagaaggtacagcgagagatggctgaatga

SEQ ID NO: 15 - DNA, 549 bp, Arabidopsis thaliana
atgggtgttgagaaaatggtgtgtttagcttctcgtacgggtcgtcagtttcagagatacaacaaaggtcgtcgtcaagtcgttggatgtgttccttacagattcaagctatctaatgatggtaaaataagtgatgaagtagaagttcttgttatctcttcccaaaaaggccacgccttaatgttccccaagggtggttgggagcttgatgaatctgtagaagaagctgcatcaagagaatgtcttgaagaagctggagttcttggcaacgttgagcaccaacttggaaaatgggattttttaagcaaaagcagaggaacatactatgaaggactaatgttccctatgcttgttacagaacaacttgagctttggcctgaacaacatgttaggcaaagaatctggatgaatgtaaccgaagcaagagaagcttgtagagattggtggatgaaagaagcattagatgttttggttgagagactttcatcaccaatgaatcaaccaaaggaagagaagactatgtcaatctctattgaaacaatgtgttga

SEQ ID NO: 16 - DNA, 201 bp, Arabidopsis thaliana
atggtgataaagaaaatcgagctatgcatagagattacgaagataacaatggagttcttggtggtggtggctgacgccgtcacaatcttcttaaggcaatcttctccacctcctccggctctactccgccatggtctctactcatactctgcctcccctaatcctccttcttcccattacatcatcggctttcttccctaa

SEQ ID NO: 17 - DNA, 801 bp, Arabidopsis thaliana
atggaaaatccggcgaagagagtgttgatgacatccaacggcgacgaggtgtcccgaaacatcgctttccatctagccaaacacggttgcaagttggtaatgatgggaaatgagggttccctaaggagcattgtagacaagattagagattccattgagggagccttccctgccgatgttatagcactcgacatggaatctgactctgaagttgcttttcatgccgctgtccaaaaggcatgggaactttccggccatttcgatgcttttctcaactcttatacctaccaaggaaaggtgcaggacattcttcaagtctctcaagatgagttccacagaatcacaaagatcaatctcaccgctccatggtttctcttgaaggctgtagccacaaggatgaaggaccatggatcaggaggctccattgtcttcatggccactatcgccagcggagagagggcgctttaccctggcgctgatgcctacgcttcaacttctgccgctattcaccagctcgtccgggcatcagccatgagtctcgggaagcacaagatacgggtcaacatgatctctagagggctgcatctggatgatgagtatacagcttctgtgggaagagaccgagcgcagaagctggtcaaggacgctgcacccctcggccagtggctcaacccggacacagacctctactccactgttatctacttgatcagcgatggctcacgcttcatgacaggcaccactgtcttggtggatggagcgcagtcccttacgcgaccccgtctcaaatcctacatgtga

SEQ ID NO: 18 - DNA, 1005 bp, Arabidopsis thaliana
atggacgcttttgatgcgattccagatcctgtggtcatcgacattttgaacagagtcggtgacgtcaaaacgttaatacgatgtcgttccgtttctaaacgattcaactcgttagccactcagtctgagtcgctccttctccaactcgatcagatcctcggagccaccgaatctgactccgagatcgattctcctatcgctagcttcttccgatctctcttcaaatccattcacggtctccttcctcctatcttctccaaaccagctaactctgacgaaatcctaacccgatctccgaaaactccggctcagattctctccggatttgaacggatccggaatctggaggtggaattatacggtggtgatgtcaagcttgagaaaggcgccgccgttaagtggaaggctgagttcgggaaaactctcaagagctgcgtcatcgtcgctttccgttccgcgacggttaatacttcagcagctacggaagctgccgccgtcgtcgacggtgttgttgagtcagattcggagtttgtttgtggattgaagacgcgcgtggtgtggacgatcagcgcgttgatggcggcttccacgcgtcattacttgatgagagatttggtgaaagatcacaaggagatggagaaattgattgtgcgtgacagtgatggtgaaggtacggtggtgatggacgcggcggggatgaaagaatacagagagacggaggtgcgtggggataataaagaatcagagcgcgtgggggaacgaactgtggtacctagcgtgaggatgagtatgagacacgcgccgtcgctgatgctgaagagcgggatttgtctcgaagcagcgacgctggtggtcgtaaggccgactggtgtggcttccgatgataacgatgttgagctggtgacggaggcgttcgccggagatggcgacgattgtatgtacggagaagctgttacggcgttgcttaagcgtaggagaaatgtgttagagatgaattctttctaa

SEQ ID NO: 19 - DNA, 861 bp, Arabidopsis thaliana
atattttaaaataaaacccaaaagagccgttaccaaagagcctcaataaagtccgcatctttttttctctgcgattcacaaatctacacttctctctctctctctaaccacaaagcttccatggcgtcagatcagagcacgaatccaccgatcatggaggcaaagacaagacatcctcttcaccagatcgcagatacaccaacacacaagcttctcctgaaacaatggttaaaagaagaagagctaattctaagccgtgtctctcacaaagaatctcagatcgattctgttcgaagagaaatcactcagctctacatcttcttctttctcttccactccatttctctgctacttctcttccacgcttcttcatcctcatcttcctctgcttcttccagtgcttgtaaaagatcatggatcccttcactctgcgctctgctatcttccttggggatcatttgggcggtacggtacaaatctgaagtggaatcgcatcttgagaagttgttggagagggagaaagaagatgcgaagctgttgcgtaaatgtgttgaagagttgaagaagaaaggtatcgaatttgatttgcttaaggaagtggatgcgcttcgtagagccaagagtttaagagttgagtcgaagcctgtgaagaaatggtctgctagggattttgtgacgctcttcttcttctctgtttcgtgtttggttcttgccatgattagactcattctctgcgattgattcttttgctcttttgttgctatgctttagcagaattctctggtttctgcaattttagtgataataaagaaaaacaacatgtttgattcatctccttcaatccttttttgtaatgttaat

SEQ ID NO: 20 - DNA, 1939 bp, Arabidopsis thaliana
gcggccgccagtgtgagtaatttagcgaaaacgatgggttccatcgaagaagaagcaagacctctcatcgaagaaggtttaattttacaggaagtgaaattgtatgctgaagatggttcagtggactttaatggaaacccaccattgaaggagaaaacaggaaactggaaagcttgtccttttattcttggtaatgaatgttgtgagaggctagcttactatggtattgctgggaatttaatcacttacctcaccactaagcttcaccaaggaaatgtttctgctgctacaaacgttaccacatggcaagggacttgttatctcactcctctcattggagctgttctggctgatgcttactggggacgttactggaccatcgcttgtttctccgggatttatttcatcgggatgtctgcgttaactctttcagcttcagttccggcattgaagccagcggaatgtattggtgacttttgtccatctgcaacgccagctcagtatgcgatgttctttggtgggctttacctgatcgctcttggaactggaggtatcaaaccgtgtgtctcatccttcggtgccgatcagtttgatgacacggactctcgggaacgagttagaaaagcttcgttctttaactggttttacttctccatcaatattggagcacttgtgtcatctagtcttctagtttggattcaagagaatcgggggtggggtttagggtttgggataccaacagtgttcatgggactagccattgcaagtttcttctttggcacacctctttataggtttcagaaacctggaggaagccctataactcggatttcccaagtcgtggttgcttcgttccggaaatcgtctgtcaaagtccctgaagacgccacacttctgtatgaaactcaagacaagaactctgctattgctggaagtagaaaaatcgagcataccgatgattgccagtatcttgacaaagccgctgttatctcagaagaagaatcgaaatccggagattattccaactcgtggagactatgcacggttacgcaagtcgaagaactcaagattctgatccgaatgttcccaatctgggcttctggtatcattttctcagctgtatacgcacaaatgtccacaatgtttgttcaacaaggccgagccatgaactgcaaaattggatcattccagcttcctcctgcagcactcgggacattcgacacagcaagcgtcatcatctgggtgccgctctacgaccggttcatcgttcccttagcaagaaagttcacaggagtagacaaaggattcactgagatacaaagaatgggaattggtctgtttgtctctgttctctgtatggcagctgcagctatcgtcgaaatcatccgtctccatatggccaacgatcttggattagtcgagtcaggagccccagttcccatatccgtcttgtggcagattccacagtacttcattctcggtgcagccgaagtattctacttcatcggtcagctcgagttcttctacgaccaatctccagatgcaatgagaagcttgtgcagtgccttagctcttttgaccaatgcacttggtaactacttgagctcgttgatcctcacgctcgtgacttattttacaacaagaaatgggcaagaaggttggatttcggataatctcaattcaggtcatctcgattacttcttctggctcttggctggtcttagccttgtgaacatggcggtttacttcttctctgctgctaggtataagcaaaagaaagcttcgtcgtagtaatgctgttatctatctactttcattacatacaaaagtttgtttctttcaactgtaactgtctctgtatcaataacaacattgctgtgtacttttcctttcaatttcaaaagtttaagtcgcctaaattactcacactggcggccgc

SEQ ID NO: 21 - DNA, 874 bp, Arabidopsis thaliana
ttaattaattttattctcatcctctcctcacagttactataagctcgtctatggccagagacggtggtgtttcttgtttacgaaggtcggagatgatgagcgtcggtggtatcggaggaattgaatctgcgccgttggatttagatgaagttcatgtcttagccgttgatgacagtctcgttgatcgtattgtcatcgagagattgcttcgtattacttcctgcaaagttacggcggtagatagtggatggcgtgctctggaatttctagggttagataatgagaaagcttctgctgaattcgatagattgaaagttgatttgatcatcactgattactgtatgcctggaatgactggttatgagcttctcaagaagattaaggaatcgtccaatttcagagaagttccggttgtaatcatgtcgtcggagaatgtattgaccagaatcgacagatgccttgaggaaggtgctcaagatttcttattgaaaccggtgaaactcgccgacgtgaaacgtctgagaagtcatttaactaaagacgttaaactttccaacggaaacaaacggaagcttccggaagattctagttccgttaactcttcgcttcctccaccgtcacctccgttgactatctcgcctgaatcgtcgccgccgttgactgtttcgactgaatcgtcggattcgtctccgccgttatctccggtggagatcttttccacctcgccactttcatctccgatagacgatgaagatgatgacgtgttgacgtcgtcgtcggaggaatcgccgattcgacggcagaagatgaggagtcccggattagattagtggaactattctgggatgccgtgtaatattatctatatttaaat

SEQ ID NO: 22 - DNA, 609 bp, Arabidopsis thaliana
atgagaccaccaatgagaggcggcgggggtttccgtggaaggggaggacgagacggtggtggtggcggtaggttcggtggaggaggcggtagattcggtggaggaggaggacgctttggtggtggaggcggtcgctttggtggttttagagacgaaggtcctcctagcgaagtcgtggaggttgcaactttcgttcatgcttgcgagggagatgctgtgaccaaactctcacaggagaagattcctcattttaacgctccgatctacctagagaacaagactcagattgggaaagtagatgaaatctttggcccaattaatgaatctttgttttctatcaaaatgatggaaggtattgtagccacctcgtattctccaggagataagttcttcatcgacccttacaagcttttgccactcgctcgattccttcctcagccaaagggtcagtcaacgggtggacgtggaggtgcaggtcgtggaagaggtgatagtagaggtcgtggaagaggtggatcatttagtagaggtagaggtgctccaagaggtggtagatttccaccacgcggtggctctcgtggaagctttagaggccgaggaagattttag

SEQ ID NO: 23 - DNA, 633 bp, Arabidopsis thaliana
atcctccaacattcgttgatcaatggctgaagttatgctaccgaggaagatggagattctcaaccattcttcaaagtttggatcaccggatcctcttcatgttcttgccgtcgacgacagtcacgttgatcgtaaattcatcgagcgtttgctcagagtatcttcttgcaaagttactgttgttgatagtgcaacaagagctctccaataccttggtttggatgttgaggaaaaatcagtcggttttgaggatttgaaggttaatttaattatgactgattactcaatgcccggtatgactggatatgaactcttgaagaagatcaaagaatcctcagcttttagagaagtaccggtggtaattatgtcctccgagaacattttgcctcgtattgatagatgtcttgaagaaggggctgaagatttcttactgaagccggtaaaactctcggatgtaaaaagattaagagattctctaatgaaggttgaagatttgtctttcacaaagagtattcagaagagagagctagaaacagagaatgtctaccctgttcactcgcagctcaaacgcgcaaagatctgagctctccgatgcaaattccgtgactggatcttagaaaaagccatttaaat

SEQ ID NO: 24 - DNA, 2406 bp, Arabidopsis thaliana
atgttacgccgtcttggatggttaattggactgagccaaagaagtaggcaaacaaagtcgattgatgctgagccttacgtagccagggttaagccagtgctaatgatcgacactgttcaggagattgctatctatatccataggtttcataaccttgatcttttccagcaaggatggtatcaaataaaaatcagcatgagatgggaggatggtgacaacaactcctgtggaattccttcacgagttgttcagtatgaagcgcttgattcaacctcaaacgactcatatggagtgtggaagatagatgataaggatagtagtttcttaacacagcccttccgcattaaatatgcaaggcaggatgttcgtctctgcatgatggtctcatttactatgcctctggaaagatatgaggggtcagctacatcggctgttatattgaagtttgagcttttgtattctccaatcatggaggatatacctgtgacacattcagatgcttgtgctgcggcagtgcatgaatttcgtattcctcctaaagctctttcaggcgtgcattcttactgtccagtgcactttgatacctttcacgcggttcttatcgatgtaagtgtccacgtcagcgtcatgaaatccgctgcttacaaacggcctgcaattttatcaagtgatgcgagtaatggtaaaaatttgaccagtggcaatattcagtcttccaaaaaagcctttactcaaatcgcttctgctgacaagaagctggtgtcatttgtaaaagccttactcggagctcgtgacactttgcttgaagaaatgcaaaggcttagcaaagcagttggtcaaacagttgacttgtctgagtttgtatccagtatggacaatgctcttttatctgactcaggttcaacgggaaaatctgttgaagttgaaggttcaggacaaggcaagctacaaaacaatcttgagttgaatggcccatttgatttagcaagtgatgactggcttcacaacttctcaaaggagcatctatctcgcacattccacttactgggcacccagctccattatctatggaatacctttctgacattgcaccgggataattacacaaaaatcttggaatatcttcgcgatatctggactaaagatcgaagagcggaatggtcaatatggatggtgtactccaaggttgaaatgccacatcattttataagtggaatggaggacatttcaaaccatagttcacacaaaagagtctcgactgggttgaagctgaatgatcctgcacaagttgcatccacccgcgctgaacttcaccgtcgaagtattgcacaaatgcggataaacaaccgggcaatacaagacatgcatatatttggtgatcctatgcgggttcctatagttataattgaacgtgtttggaatgcaccaaggcgtacgttcagtgataattcgtacatgagacatgttgatagaatcgattctagcttacttaatgggcatgatgatgagagtgggacgaaaaaacatattaacccacagcatactgggcgtgagctgaagattgttgtttttgttcatggtttccaggggcatcacttagacctaaggcttatccggaatcagtggctcctaattgatccaaagatagagtttctcatgtctgaggcaaatgaggagagaacacatggcgattttagggaaatgggtcagaggcttgcgcaggaagttgtttcttttttcaagaggaaaaaggataaacatgcgagatacgggcgcttgaaaaacatcaagctgagttttgttggacattcaattggtaacgtcatcatcagagctgcaatagctgatagtttgatggatccatacaggaagtattttcatacatatatatcgctttcgggtccacacttgggttatctatacagttcaaattccttgtttaattctggactttggctcctgaagaagttaaagagtactcaggttattcatcagcttacactcacagatgatcctgatctccagaatactttcttttacaagctctgcaagcaaaagacgttgtgcagtttcaagaatataattctcctgtcttcgcctcaggatgggtatgttccatatcactcagctaggattgagtcatgccaaccagcttctttcgacaactcaaaaagaggtgttgctttcttggagatgcttaataactgtatggaccaaatacgtgggccatcccctgaaactccgcaccaccagagagtgttcatgcgctgtgatgtcaacttcgacacaaccttgtatggtcgtaacctgaactcattcatcggccgtgctgctcacatcgagtttttggagtctgatgtctttgcaagattcataatgtggtcattccaagatctattccgctga

SEQ ID NO: 25 - DNA, 1768 bp, Arabidopsis thaliana
aagtggatttggtacgagtctttaggtttccttcttcaccaaaagctctatatagagagaatctgcgagctctttttggtaggaaattagggttcgtgttgcttggtaaatatagaatcaatgacggaggttgttctgcatatatacgatgtgacgaacagtggatcggagaagactaacaacaccattgttcagatcaataggttcttcaaagacgggatcggtcttggcggtatattccacagcgctattcaggtactactcttcgtctatattctatgaatctacatttatgtacaattatcgatgatgtctaagcttggttttggtctactttatgtagatttggtttttgtttctgtgtatgtatgtggaaattaagaagttgacggcatgatacttttcttttgatatgtgaggctttagtttaatggtttatggtcctaaaggtctggagctgaagtctctcttttgctcaggatcttgtgtttcctagtacttttggtaactttccatatgataatgattgcgatatattgaccaagtgctctctggagacttgttaaatccaatgatggcttacgtttacttctgtgatctttgacctgggcaaatataattgcatataccactttcccatttgagtcgtgacaatttggtgtattccaacaaaactaccagaatttaggttttcaagttagtgctaatcattctatgttcttaggtctgtatatctatgcaatatcatttgattattcttgttcatggttttgttatttttttgtgtcttgtagatgactattgattcgcagggaagagtgattgaatagaatattttatgacctttgtgcaggtatatggaaacgatgaatggtcttacgggtattgtgaactaggaactggtgtattcagctgcccgagtggaaagaatccaatgtacacataccgtgagaaaatcgtccttggcaaaacagattgcacaatcttcatggtgaatcagatgttgcgtgaactcagcagggaatggcctggacacacttatgatttgttgtcaaaaaattgcaatcacttctgcgatgtactctgtgaccggcttggtgtgccaaagatcccaggtaaagccattttttgggaatctggtgtgtgtgtgtgtgtgttttgtcttcaaggcttatgtgacggcttgggttctgtctcttaacaggttgggttaatcgctttgctaatgctggggacacagccttggaagtggcaggaaacacagcaatgcgggtgggttcccttttgtttagcttctctacaacgtaaatgcaacattatgggtgttcaaaacttgtaaattgggattttgcagatgaagcaagccaaaactgaacttgtgtcagctagtaaagtggcttatcgcttcctctcgaatgttacttcgaacgtaaccaatggctccaatggctctccacaacgaccgggaactctcaacaattcagacagcgggaacttgagattgcaaggtagttggctcaaaggcttacttaacacagccaaaccctccactagtacagagatagggaacaaagatgaagatgcaaatcatgcagtcaccaatcagaagaaacaaagccgtgactctgatgttctactgtttcagtagcaaccgtaccgatccaccacaatgcattcggttagctgtatatccaccggtctaagagtcacgcactattctcctcgtctgtacccattactctgtatcaacgttggaacctgtcatttt

SEQ ID NO: 26 - DNA, 327 bp, Arabidopsis thaliana
atggactcatctttgtcgcagaagttcactcttgcttatgcttctctcctcggagttggtgggttgatgggttacctgaaacgcggaagcaaaatatcacttgtcgcaggaggaggttcagctgcgttgttctattatgtatacacggagctcccaggaaatccagtcttagcatcctccattggcattgtggggtcggcggcactgacagggatgatgggatcacgttacctaaggacgaggaaagtggtaccggctggacttgtgtcggtggtgtcactcgtcatgactggagcttacttgcacggcctcattcgctcaagttga

SEQ ID NO: 27 - DNA, 729 bp, Arabidopsis thaliana
atgctggaagctccggtgaacaagtcaagcatcctcaatggaggaggaggaggattctctcagctacagagttgcttcggcgattgcagtagcgaagaagaattgtcagtgttgccacgtcataccaaagttgtcgttactggaaacaaccgtaccaaatctgttctcgtcggtcttcaaggcgtcgttaagaaagccgtcggactcggtggttggcattggctggttttgactaatggaattgaagtgaagttgcagaggaatgcgcttagtgttcttgaacatcctacagggaacgaagaagacaatgatcttgaagtcgaccattctacacagtggaatcatccctccgacatgacaactgaggacactttgaagcctcataagtcgaagaagagaggacacagatcatcgcggttatctcaaaaggctttgtacagggaagtttcttgtgactcacactcaaaaatctcgagtattactcctcgtctgaacatgaaggttgatcttaccaagttggatatggctgcattactgagatattggcgacattttaacctcgtggatgctcttccgaatcccacaaaggagcaactaattgacattattcagagacacttcatgtctcagcaaatggatgagcttcaggttattgtgggattcgttcaggctgcaacaggaatgaagaaggcttgccaagtggaagaccaaagaagccagaaacactga

SEQ ID NO: 28 - DNA, 963 bp, Arabidopsis thaliana
atggggaggaagcggaagcacagtgagacggaagctccggcgccggtgaaaaagagcgatgagcctgctccggatagacccaaaaggactctattgggatggaaagataagagtgaaggtgaagctgagaaagctaaagctttgacttcatctggattcaagaacaaagagaaggttttggtgacttgttctcgtcgtatcagtttcaggtatcggagtttgatgttgaacattgtttcacttctaccacactgtaagaaagacagtaaagttgaagcaaagagtagcaaaggcgcgactttgaatgagctcattgagcttaagaattctaattcctgcttgttcttcgagtgtaggaaacataaagatctttacatgtggatggtcaaatcccctaatggaccatctgtgaagtttttggttaaagctgtgcacgcaatggaagagatgaaactcactggaaatcatctcaaagggtcacgtccacttttgacattctcatccaattttgataaagatgcgcactggaaactcttgaaggagatgcttactcaggtcttcggaattcctaaggaacacaggaaatctaagccttaccatgaccatgtatttgtcttttcaattgttgatgagcatatatggttccgaaattaccagatttcggttcctcacaatgagtcagataaaattgcaaaaggtggcctggataaaatgacccttatcgaggttggtccaaggttttgtctgaatccaatcaagatattcgcgggcagctttggaggtcctactctttatgagaacccgttatacgtatctccaaaccagattcgagcattggagaagagaaataaagctgggaaatttgctaagaagatcaaggcgaagacgaggaaaaagatgcatgagctctcaaacccgttggagcctgatgagtttgcagatatgtggaaagatgatgaatga

SEQ ID NO: 29 - DNA, 1804 bp, Arabidopsis thaliana
acaagtttgtacaaaaaagcaggctcctgcaggaccatggatttacctgaagaatgttgggaattaatctgcaaagctatcgatgaagacgattatcgattcctggaatctgtttcactcgtatcaaccttgttcctctcaatcaccaatcgcgttcgctctactttcgtcgtcaccgatcgagctgttcctttactcaatcgtcatctccttcgattccgcaacttgaagcgaatcaggttctctgatttcactcaggatctcaattcgattcttctccaggtttctcgttccggtttggatttcgaatcggtagatgtctcgcaaacgcgctatttcccagattttgagatgaagaatgtcaaggaattgaaatgttatggagttggaggttttagtgatagcgatctggtttccatcggagtgaattttccgttgctagagaagctggacattagctatcctaattcaagtccgagtcgagtctctgattctggtgttatcgagctttcctcgaatctcaaaggtttgttgaagattaacatttctggtaatagtttcatcacagataaatctttgattgctctctcgcagaattgtcttctcttgagagagataatcttccgtgactgtgatttcatttcgtcggattgcatcaaattcgttcttcgcaattcccgtaacttggagtctcttgcgatcaacggaatcggattgagaccgagggagtctttgttaaccgatgcgttcttgtttgctcgttgtttgactgagcttgatctttcggattcgtttttgtctgatgacttgctctgtttgattgctagtgctaagttacctctaaagaagcttcttctctccgattgccacggttttacttttgatgggatcttgtatctgctggacaagtaccaatcactagttcacttgaacctcaaaggagcaaatttcctctctgatgagatggttatgaaattagggatgttctttcggcgtttaacctttttgaatctgagtttctgttccaagttaactggtctagcattctttagtattattgaaagatgtgtttccctgaggtgcatgataatggtagggacgaactttggagtggaagaatataccaaggatacgaaggatttcaagtcaggggtcaagtttttgtacttatctagaaaccacaatttgctcgatgagtgtctcgaaaagatatcacggcattgcccttttatagaaagtcttgacgtagctcagtgtcctggcatcacgagagatgggattcttgaagtttggaggaattgtggcaagctaagatctttggacatcagcagatgtacgggcataaagagtcttggtgtagtagactttgagcttccaaagttggagtctttgcgagcatgtggaacttggatcgacgatgaagccttagatatgatcagcaaaaagtgtcgagggttgttgcatcttgatctgcaaggatgcttgaatgtgagttcaagaggggtgaaggaagttgtgcagagctgcatacgtttaagagagattaacctcaagtattgtgaagctgataagaaaatgtacacttggatggtttttgcaaatccatctcttaggaaaatcgtaccgccatgtgggttttctccaactaaagcactcaagaacttctttctgcgtcatggatgtgtagtctcccaggattcttctgagttgctttctatagcataccgtgccaatggaagagatgatgacacattgactagactgattatttgactcgagacccagctttcttgtacaaagtggt

SEQ ID NO: 30 - DNA, 2458 bp, Arabidopsis thaliana
ttaattaaatgaactgtaacgttttgtttcttctctctgttctcgtctctgttacggctggagttacggcggcgtaccatcctaccgatgtctttctcttcaactgcggcgatacttccaacaacgtcgacaacagtggccggaactggacggtggaaagtcgtcaaattctgtcgtcgaatttagtcaacgcttcattcacttcagaagcgtcataccaaaaagcaggggtctctcggattccgtacatgaaagctcgaatattccgatctgagttcacctacagtttcccagtcactcccggttcgatatttctccggttatacttttacccgactcagtacaaatccggttttgacgcggttaactccttcttctccgtcaaagtcaacggtttcactctcttgcgaaacttcaacgctgactcaacggtacaagcttcaataccgttgtcaaattctctaatcaaagagtttatcattccggttcaccagactctgaatctcaccttcactccctccaagaatttgttagctttcgttaacggaatcgaaatcgtctccatgcctgaccggttttactcaaagggaggatttgacaacgttttaagaaacgttagtagcgacgttgacttccagatagacaactcgacggctttcgagtccgttcaccggttaaacgtcggcggacaaatagtcaacgaggtcgacgattcaggaatgttccggcggtggctttctgatgattcttttggaaactctggatccattgtgaatgttccgggtgtaaagatcaactacacggagaagactccggcgtatgttgcgccgtatgatgtgtatgctactagtcgcttaatggggaactccagcaacttgatgttcaatctaacgggtatgttcctcacagttgatgctgggtataactaccttgtgaggctacatttctgtgagactcttccacaagttaccaaagcaggccaacgtgtcttctccatattcgtcgaagataagatggctaagaaagagacggacgtgattcggttgagcggtggtcctcggattccaatgtatttagatttcagtgtgtatgttggtttcgaaagtgggatgatacaacctgagctacgacttgacttggttcctctcaaggacactaatcaaacgtattacgacgctattctgagtggtgtggagattctcaagctgaatgattctgatggtaatcttgcaagaccaaatccagaacttctagtatctacggactcaacaccagatgattctaatgttacaccaccaataaaaggtaagccacatgttttggtgataatcctcatagtcgttggttctgtaattgggctagcgactttcattgttatcatcatgttgttgatccgtcagatgaagaggaagaagaataaaaaggagaatagtgtcattatgttcaagttactactgaaacagtacatttatgcagaattgaagaagattacaaagtcgttttcccacactgttgggaaaggagggtttggaactgtatatagaggaaacctttctaatggacgtacggttgcagtaaaggtcttgaaggatttgaagggaaacggtgacgatttcatcaacgaagtcaccagcatgagccaaacatctcatgtaaacattgtttctctgctaggtttttgctatgaagggtccaaaagagcgattatatcagagtttctggagcatgggtctttggatcagttcatctctagaaataaatcattgactccgaacgtgacaacactatatggaatcgcgctaggcatcgctcggggattggagtatttgcactatggctgcaaaacaagaattgtgcatttcgatattaaacctcaaaatattctgctcgatgacaatttttgtcctaaagtcgccgactttggccttgctaagctttgtgagaaaagagaaagcattttgtcattaatagacacaagaggaactataggttacattgcaccagaggtggtctcaagaatgtacggtggaatctcccataaatctgatgtgtatagctatggaatgttggtcctcgacatgataggagcaagaaataaagttgaaaccacaacttgcaatggtagtacagcctattttcctgattggatctataaagatcttgaaaatggagatcaaacgtggataattggagatgaaataaatgaagaggacaacaagattgtgaagaagatgatattggtgagtctttggtgtattcgaccatgcccatcagatcgtccaccgatgaacaaagttgtcgagatgatagagggcagtttggatgctcttgaactcccccctaagccttctaggcatatttccaccgagttagttcttgaatcttcttcgctttctgatggccaagaagctgaaaaacaaactcaaaccttagattctacaattatttagggcgcgcc

SEQ ID NO: 31 - DNA, 1620 bp, Arabidopsis thaliana
ttcttgtttgttgattaacccttaattaatccgggcgcgcctgatttatcacaagtttgtacaaaaaagcaggctcctgcaggaccgttaaagtacgatgtcggtgtacgacgctgctttccttaatacagagctttcgaaaccgacatcgatttttggtctccggctatgggtcgtgatcggaatcttacttggatctctaattgtcatcgcactctttcttctctccctctgcttaacttctcgccggaaaaatcgaaagccgagagccgatttcgcctccgccgccatcgctacaccgccgatttcaaaggagattaaagagatcgttccggcgcagaatcagtctgttccggcggagatccaggtcgatatcgggaagatcgagcatcgagtggtgttttcagatcgagtgtcgagtggtgagagtagaggaacagcgagtgcaagtgaaacggcgtcgtattccggtagcgggaattgtgggccggaggtgtcgcatcttggatggggccgatggtatactctgagagagcttgaagcggccacgaatgggctttgtgaagagaatgtaatcggagaaggtggttacgggattgtgtatcgtggcattttaactgatggaaccaaagtcgccgtcaagaacttgcttaacaataggggtcaagcagagaaggaattcaaagtagaagtggaagtcattgggcgagtacgacacaagaatcttgttaggcttttagggtattgcgtggaaggtgcatacaggatgctcgtgtatgactttgtcgacaatggtaatttggagcaatggattcacggtgatgttggcgatgtcagcccgctaacttgggatatacgtatgaatattatactggggatggccaaaggattggcgtatctacacgagggtcttgagccaaaagttgttcatcgggatattaaatcaagcaatatcttacttgatcgccaatggaatgctaaggtttcggattttggacttgctaagctcttggggtctgagagcagttatgtgactactcgtgtgatgggaactttcggttatgtagcaccagaatacgcttgcaccggaatgttaaacgagaagagtgatatctatagcttcggaatactaatcatggagataatcactggaagaaacccggttgattatagtcggcctcaaggagagacaaatctagtggattggcttaaatcaatggtgggaaaccgaagatcagaagaagttgttgatccgaaaatacccgaaccaccatcctcaaaggctcttaaacgagtgttgcttgtagctttgcgttgtgtggatcctgatgcgaacaagagacctaaaatgggtcatatcatacatatgcttgaagccgaagatctactctatcgcgatgaacgccgaacaacaagggaccatggaagccgcgagagacaagagacagctgtggttgctgccggtagtgaaagtggtgagagcggttcacggcatcatcagcaaaagcaaagatgaaaaaagagagtcacttgggttaagtgatttccacctcgagacccagctttcttgtataaagtggtgataaattggagctctgcagagctttcgttcgtatcatc

SEQ ID NO: 32 - DNA, 1317 bp, Arabidopsis thaliana
atgtcttgttcatcttcttccggatcagaaggagaagaagagggtttcgatgcttaccgtaaaggtggttatcacgccgtcaggatcggcgatcctttttccggtggtcgttacatcgctcagagaaagcttggttggggtcaattctccaccgtttggcttgcctacgatacgctcacctctacttatgttgctttgaagattcagaagagtgcacaacaatttgctcaagctgcacttcacgaaatcgaatttctttcagctgctgctgatggggatctcgacaagacgaaatgtgttgttcgtcttattgaccatttcaagcatagtggtccaaatgggcagcatttatgcatggtgcttgagtttctcggcgatagcttgctccgtttaatcagatacaaccagtacaaaggtctgaaactgaataaagtccgggagatttgcagatgtatactgactggtttagattatttgcaccgtgagctcggtatgattcactccgacttaaaacctgaaaacattcttctttgttccaccattgaccctgccaaagatcccgttagatctggactcaccccactattagaaaaaccagagggaaacgcaaacggtggcgcatcaacaatgaatctgattgagaagaaactaaagagaagagcgaaaagagcggttgctaaaatatcagaaagaagagtctcaatggttacaggtgaagaagcatcatcgaaaacggaaaaaagtctagatgggattgatatgagatgcaaagtggttgactttggtaacgcttgttgggctgataaacagtttgctgaagagatacaaacaagacagtatcgagctcctgaagtaatactaaagtcaggatactctttctctgttgatatgtggtcttttggttgtacggctttcgagcttgtcacaggagatatgctatttgcacctaaagatggaaatggttatggggaagacgaggatcaccttgctcttatgatggaactcctaggaaagatgcctcgaaagattgccattggaggggcgaaatcgaaagactactttgacagacacggggacttaaagagaatccgacggttgaaatattggccacttgatcgcttgctgattgataaatataagcttccggaagcagaagcaaaggagtttgctgagtttctgactccgattcttgagtttgcgccggagaaacgaccaactgctcaacagtgcttggatcatccatggatgaatgtaacaacacagaacgatgcagaaaatgtagatgaccaaatgaacaacttgcatatcaaagggtga

SEQ ID NO: 33 - DNA, 417 bp, Arabidopsis thaliana
atggcgggtcttcagagatccaccatctctttccgtcgacagggctcttcgggtatagtctgggacgatcgtctcatcgccgagctaagccaacaagcggccaacgaccggaaaggcgagactctacaacaggacgaacaggccaagctgattacgtcggaagtacaggatcagacaaccaaacctatcgccggagaaggactcaaacctatcagaactgacggaggtatggagaggagtcgatccaacggaggaggagccatccgccaccatcgaaacacagggagagtgtctccggcggtggacccgccgtcgccgagactgtcggcgtttgggtgctgctctgccttcgggaagaaacagccggggaagaaggttaatcagaggaaaaggccagcgaagcgtagatccagatag

SEQ ID NO: 34 - DNA, 1825 bp, Arabidopsis thaliana
acaagtttgtacaaaaaagcaggctcctgcaggaccgatcctttcaagatggagaaagtgaccaactcagacttgaaatcctctgttgatggtggcgttgttgatgtgtatggagaagattcagccaccattgagcacaacataactccttggtctctctctgtttctagtggatattcattgctgagagatcctcgctacaacaaaggacttgctttcactgagaaagagagagacactcattacttgcgtggtcttctccctccagttgttcttgatcaaaagcttcaggagaagaggctgttgaacaatatccgacaatatcaattcccattacaaaagtacatggctctgacagaacttcaggaaagaaacgagagactgttttacaagctattgatagataatgttgaggagctacttcctattgtttatactccaactgttggtgaagcttgtcagaaatttggaagtattttcaggcgacctcagggtttattcatcagtttaaaagacaagggaaagattctagatgtgttaaagaactggcctgaaaggaacatacaggttattgttgttactgacggtgaaaggattttaggattaggagatcttggatgtcaggggatgggtataccggttggtaagttggcgttatattcagcacttggaggtgttcgtccttcagcgtgtttacctgtcaccattgatgtgggaacaaacaatgagaaactgttgaatgatgagttctacataggactcaggcaaaagagagcaacgggacaggaatatagtgaactcttgaatgaattcatgagtgctgtgaaacagaactatggtgaaaaagttcttattcagtttgaagattttgctaatcataatgcctttgagttgcttgcaaaatacagcgatactcatctcgtcttcaacgatgatatacaggggacagcatcagttgttttagcaggattagtttccgcacagaagttaacgaatagcccacttgcagagcataccttcctctttcttggtgctggtgaagctggaactggaatagcagaactcatagctctctatatgtcaaaacagatgaatgcttcggtagaggaaagccgcaagaaaatctggcttgttgattccaagggattgattgttaactcccgcaaagattcacttcaagactttaagaaaccatgggctcatgaacatgaaccagtcaaagacctcttaggtgctatcaaggcaataaaaccgactgttctgattggatcttctggcgttggacggtcttttacaaaagaagtgatagaagccatgtcctccattaatgagagaccactgataatggctctctctaaccccacaacacaatctgaatgtacagccgaagaagcttatacttggagtaagggccgtgccatttttgctagtggaagcccttttgatccagttgagtatgaaggaaaggtgtttgtatctacacaggcgaacaatgcgtacatattcccgggctttggacttggtttggttatctctggagcaatacgggtacatgacgatatgcttctagctgctgctgaggcattagctggacaagtaagcaaagagaactatgagaaaggaatgatatatccttcattctcttccatccggaaaatatcagctcagattgcagccaatgtagcaactaaggcgtatgaactaggattggcagggcggcttccacggccgaaagatattgtcaaatgtgcagagagtagcatgtacagccccacataccgtctctaccgttgactcgagacccagctttcttgtacaaagtggt

SEQ ID NO: 35 - DNA, 1077 bp, Arabidopsis thaliana
atgtcttccttcacctccaaattcgccgatgagctgattgctaacgctgcttacatcggaacacctggaaaaggtatccttgcggcagatgaatcaactggtactattgggaaacgtctcgctagcatcaacgttgagaacgttgaatccaacagacgtgctcttcgtgagcttctcttcactactcctggagctcttccttgcctcagtggtgttatcctctttgaagaaactctttaccagaagagctctgatggtacgccttttgttgatatgttgaagagtgcaggagttttgcctggtattaaggttgataagggtaccgttgagcttgctggaaccaatggtgagactactactcaaggtcttgatggtcttggtgaccgttgcaagaaatactacgaggctggtgctcgtttcgccaagtggcgtgcggttcttaagattggtgttaatgagccatctcagttagctatccatgagaacgcttatggattggctaggtatgctgtcatttgtcaggagaacggtcttgtgccgattgtggagcctgagattcttgttgatggctctcatgacattcagaagtgtgccgcggtgacagagcgtgttcttgcagcttgctacaaggctctgagtgatcaccatgtcttgctagaaggaacactcttgaaacctaacatggttactccaggatcagagagtgcgaaggttgcaccagaggtgattgctgagcacactgtccgtgctcttcagaggacagttccagctgctgttccagccatagtgttcttgtctggtggacagagcgaggaagaggcgacaagaaaccttaacgcgatgaaccagttgaagacaaagaagccttggtcgttgtctttctcctttggaagggcgttgcagcagagcactttgaagacttggggaggaaaagaggagaatgtgaagaaggctcaagaagcgttcttggtcagatgcaaagctaactctgaagcaacacttggtgcttacaagggtgatgctaagctcggtgaaggtgcagctgagagccttcacgttaaggattacaagtactga

SEQ ID NO: 36 - DNA, 2279 bp, Arabidopsis thaliana
aaaaaaaaaaaaatcatatgattgtgtctggccagacaagctagctatctcatttaatttcccaaaaagaaaatataaagcacgttcttcgtctcggattcagagaaactaatcttgaagatgagttcaagatctgacctcaaaatcaaacgagtttctttgataatcttcttgctaagtgttcttgttgagttttgctatggagggttcacaagtgaatatgtcagaggaagtgatttaccagatgacatgccactagacagcgatgtttttgaagttcctcctggtcataattcacctcaacaggttcatgtaacgcaagggaaccatgaaggtaatggagtgatcatttcttgggtgactccggttaagcccggttctaagactgttcaatattggtgtgagaatgagaaatcgaggaaacaagcagaagcaacagttaatacttaccggttctttaattacacgtctggttatattcaccattgcctcatcgatgatttggaagtaagtcttatcactttaaagccgtttttttctttggatttttggttaattttatccttattgtcagtattgatagttgggttttggttttgtgttttagtcgaatatccttaatttagaagtgttcttttacttttacttgttatatatggtcgtgtacagtttgatacgaaatactactacgaaattgggagtggcaagtggtccagacggttctggttctttatcccgcctaaatcaggccctgacgtaccttacacatttggattaattggtatgttaaatgttgtctttaagtttcatatcaaaccttacacatttgaataaaacctcaaacaactttcctatgtgtgactttttgttacgttccaggggatctaggacaaacttatgactcaaatagtacgttaagccattatgagatgaatccgggaaaaggacaagcggttctgtttgtaggagacttgtcttacgcggatcgctaccctaaccacgacaacaatagatgggatacttggggaaggttcgttgagcgaagtgttgcttatcaaccttggatatggactgctggcaaccacgaaatcgacttcgttcctgacattgtaatatttaaatttcttcctttcttttatcacttctagggtaattacttaaacttaacatgaagagtctgttttgtagggtgaaatagaaccattcaagccttttatgaatcggtatcatacgccacataaggcatcaggaagtatctctccattgtggtattccatcaaaagggcgtcagcttatattattgttatgtcatgttactcatcttatggtaaggaattaattttgaagaaacaataactatttagtagcttgttgattagttttgcatattatgattagggatatacacacctcaatacaaatggctggaaaaggagttacaaggagtgaatcgaacagagacgccatggcttatagtcttagtgcatagcccgttttacagtagctatgtgcatcattacatggaaggtgaaacattgagagtcatgtacgaacaatggtttgtcaaatacaaggttgatgttgtgtttgcaggtcatgttcatgcctatgagagatcggtatattcaatttacttgtcccgaataatattgatatttatctaaaccttccttgtcccccaattgatcctaaaatattgacgcaggaacgtgtttctaatattgcttacaacattgtcaatggattgtgtgagccaatatcggatgagtcagctcctatatacatcacaatcggggatggcggaaactcggaaggcttgcttaccgagtaagttttaccatattctgcaatcaataatagagtgactaacttgtaaccgactctgtaactaactctgttattgataatactcttcactttctttgaatatgtatgtgactggcttttgctatatctgtagcatgatgcagccacaaccaaaatactccgcgtttcgagaagctagctttgggcacgggttgctagagattaaaaacagaactcatgcttacttcagctggaatcggaaccaagatgggaacgccgtggcagcagattctgtgtggttgcttaatcggttttggcgagctcaaaagaagacatggcttgatgcattttaaagacaaattgaagaaggttttatttttgcagcaattctaaacgaataaatcagttagtgactgttttacgagggttgttattgagatttgattaaaacctcctctcatacagaaaaaagt

SEQ ID NO: 37 - DNA, 1557 bp, Arabidopsis thaliana
atggagtcttgctttcctgccatgaagctgaatcagtgtacctttggtctcaacaacgaaattgtctctgagagagttagtgcgttctggggaacccaagttgtcaagcccaatcatttgaggacaacgaaacttaggagtgcacctcagaagaagattcagacaaacctcattcgctccgttcttactccatttgttgatcaagagtctcatgaacctctgttgagaactcaaaatgcagaccctaagaatgtagcgtctatcatactaggtggtggtgctgggactcgcttgttccctcttacaagcaagagagctaaacctgcggtgccaattggagggtgttacaggctgatagatataccgatgagcaattgcatcaacagtggtattagaaagatcttcatcttaactcagttcaactcattttctctcaatcgccacttgtctcgtacttacaactttggcaatggagtcaattttggtgatgggtttgttgaggtccttgctgcaacccaaacttccggagatgcaggaaagaaatggtttcagggaactgctgatgctgttaggcagtttatatgggtctttgaggatgccaagacaaagaatgtggaacatgtcttgatcttgtctggggatcatctctatcggatggattacatgaactttgtgcagaagcacattgagtccaatgctgatatcacagtttcttgtcttcccatggatgagagccgtgcttcggactttgggctgcttaaaattgaccagtctggtaaaatcattcaattctcggaaaaaccaaagggagatgacttaaaggcaatgcaagttgacacttccattcttggtttaccaccgaaagaagctgcggagtccccatacattgcatcgatgggtgtttacgtatttagaaaagaggttttgctaaagcttctaaggtcaagttatcctacatccaatgactttggttctgaaattatcccgttggccgtaggggagcataatgttcaggcatttttgttcaatgactattgggaggatattggaaccataggatcattctttgatgccaatttagccctcacggaacagcctcctaaattccaattctacgatcaaaaaacacccttcttcacttctccaagattcttgccacctaccaaagttgataaatgcaggatacttgattccatagtttcacatggatgcttcttgagagaatgcagtgtgcagcactcaatcgttggcatacgatcacgtctcgagtctggagtagagcttcaggatacaatgatgatgggagctgatttctaccaaacggaagctgagatcgcgtctcttttggcggaagggaaagttccggtaggggttggccagaacacaaaaatcaagaactgtatcattgacaagaacgccaagatcgggaagaacgtggtcatagcgaatgcagatggcgtggaagaaggcgatagaccagaggaagggtttcacataagatcaggcatcaccgttgtgctgaagaacgccaccattagagatggtctgcatatttaa

SEQ ID NO: 38 - DNA, 1287 bp, Arabidopsis thaliana
atggcgacggctttcgctcccactaagctcactgccacggttcctctgcatggatcccatgagaatcgtctcttgctcccgatccgattggctcctccttcttctttcctcggatccacccgttccctctcccttcgcagactcaatcactccaacgccacccgtcgatctcccgtcgtctctgtccaggaagttgtcaaggagaagcaatccaccaataataccagcctgttgataaccaaagaggaaggattggagttgtatgaagatatgatactaggtagatctttcgaagacatgtgtgctcaaatgtattaccgaggcaagatgtttggttttgttcacttgtacaatggccaagaggctgtttctactggctttatcaagctccttaccaagtctgactctgtcgttagtacctaccgtgaccatgtccatgccctcagcaaaggtgtctctgctcgtgctgttatgagcgagctcttcggcaaggttactggatgctgcagaggccaaggtggatccatgcacatgttctccaaagaacacaacatgcttggtggctttgcttttattggtgaaggcattcctgtcgccactggtgctgcctttagctccaagtacaggagggaagtcttgaaacaggattgtgatgatgtcactgtcgcctttttcggagatggaacttgtaacaacggacagttcttcgagtgtctcaacatggctgctctctataaactgcctattatctttgttgtcgagaataacttgtgggccattgggatgtctcacttgagagccacttctgaccccgagatttggaagaaaggtcctgcatttgggatgcctggtgttcatgttgacggtatggatgtcttgaaggtcagggaagtcgctaaagaagctgtcactagagctagaagaggagaaggtccaaccttggttgaatgtgagacttatagattcagaggacactccttggctgatcccgatgagctccgtgatgctgctgagaaagccaaatacgcggctagagacccaatcgcagcattgaagaagtatttgatagagaacaagcttgcaaaggaagcagagctaaagtcaatagagaaaaagatagacgagttggtggaggaagcggttgagtttgcagacgctagtccacagcccggtcgcagtcagttgctagagaatgtgtttgctgatccaaaaggatttggaattggacctgatggacggtacagatgtgaggaccccaagtttaccgaaggcacagctcaagtctga

SEQ ID NO: 39 - DNA, 2432 bp, Arabidopsis thaliana
ttcttgtttgttgattaacccttaattaatccgggcgcgcctgatttatcacaagtttgtacaaaaaagcaggctcctgcaggaccgttttaaagcgacggaagaagatggtgggaggaggaggaggtagtagtggtcgtggtggtggtagtggtagtggtagtagtaagcagcagagaggtttctctatgaatcctaaagactataagctaatggaagaaataggccatggagctagcgctgttgtctatcgagcgatctatctccctactaatgaagtcgtcgccatcaagtgtttggatctcgatcgctgcaatagcaatctggatgatattaggagggaatctcagactatgagtttgatagaccatcccaacgttataaagtcgttttgttcattctctgtcgaccatagtctttgggttgttatgccattcatggctcaaggttcgtgtttgcatcttatgaagactgcgtattcagacggatttgaagagtctgctatatgttgtgtattaaaagaaactcttaaagctcttgattatcttcatagacaaggccatatccatcgggatgttaaggctggaaacatacttcttgatgacaatggtgagattaagcttggcgattttggtgtctctgcttgcttgtttgataacggtgataggcaacgtgctagaaacacatttgttggtactccttgctggatggcaccggaagttttgcagccgggaaatggatacaattccaaggctgatatctggtcatttggtataacagcacttgaattggcccatggtcatgcacctttctcaaaatatcctcccatgaaggtgctcctaatgactattcaaaacgcacctcctggccttgattatgaccgtgataagaaattttctaagtcctttaaagaaatggttgcaatgtgtttggtgaaagatcaaacaaaaaggccaactgctgaaaaactgctgaagcactcctgtttcaaacacacgaagcctccagagcaaactgtgaaaattttattttccgatttaccacctctttggacacgtgtaaaatctcttcaggataaggatgctcaacagcttgcattaaagagaatggccactgctgacgaggaagctatatcacagagcgaataccaaagaggagtgagcgcttggaactttgacgtcagagacttgaaaacacaagcatctttgttaattgatgatgatgatctagaagagagtaaggaagatgaagaaatattatgtgcacagtttaataaggtgaatgacagagagcaagtatttgatagtctgcaactatatgaaaacatgaacggaaaagaaaaggtttccaatactgaggtggaagaaccaacctgcaaagagaaattcactttcgttacaactacttcttctttagaacgaatgtcaccaaattcagagcatgacattcccgaggccaaggttaagccattaagacgccaaagtcagagtggaccacttacaagcaggactgtattaagccactcggcttcagagaaaagtcatatctttgaaagatccgagagtgaaccgcagacggcaccaacagtccgaagagcacccagctttagtggtcctttgaatctttcaacccgtgcttcttcaaacagtttgtctgctcccatcaaatactcaggaggattccgtgattctctggatgataagtcaaaggctaatctggttcagaaaggacgattttcagtaacatcaggaaatgtagatcttgcgaaggatgttccattaagtatagtccctcgtcgatctccacaggcgacccccctgagaaaatctgcaagtgtgggtaactggatacttgagcccaaaatgccaacagctcagcctcagacgatcaaggagcatagtagccatcctacgtcttcctcacccatcatgcctcaacttcaacatctattccagcaaaactcaatacaacaggatcttattatgaatttactaaatagcttacaacccgtggaggcaacagaaggttctcaatctgggaagttaccacctttgcctcgctcagacagtaatggaaacgttgaacctgtggcttcagagagggagaggttacttcttagcagtatctccgacctccgtgctaggctggacgacttaacggaggaactcgatatagagaaatcaaaatacagccaactgcaacagaaattgaaagcattcacgggtcgcgaacactaagtgtaaccagagggaaagcgacactggaaacactgaactgcacagaacctgtaggagaaagagtgaagtctcttttggttataacagtaataaccagacaagagcttagagacagtgaggcatagctcgagacccagctttcttgtacaaagtggtgataaattggagctctgcagagctttcgttcgtatcatc

SEQ ID NO: 40 - DNA, 1485 bp, Arabidopsis thaliana
atggttttctctgtttctatatttgcctctcttgcaccatacttaatctcagcatttcttcttttccttctcgtcgagcaactctcttaccttttcaagaaacgaaacatccctggccctttcttcgtccctccaatcaccggaaacgccgttgcactcgttcgcgaccccacttccttctgggacaagcaatcctccacggcgaacatctcaggcctctccgccaactacctcatcggaaaattcatcgtctatatcagagacactgagctttcccatcaaatcttctcaaacgttcgtcccgatgccttccaccttatcggacatccctttggtaagaagctcttcggtgaccacaaccttatatacatgttcggcgaggatcacaaatccgttcgccgtcagctagcacctaacttcactcccaaggcactgtccacttactctgccctccagcaattagttattctccgtcatctacggcagtgggaggggagtacctccggcggatctcgtccagtgtcactgcgacagcttgtccgtgaactcaacctagaaacttcgcagacggtttttgttggaccctaccttgacaaggaagccaagaacaggttccgtactgattataatttgttcaatctcggatccatggctctccccatagacctccctggctttgcgttcggcgaggctcgcagggctgtaaagaggctaggggagacgctcggcatttgcgcgggaaaatccaaagcgaggatggcagcaggagaagaaccagcatgcctaatcgatttctggatgcaggcgatcgtcgcggagaatccgcagccaccgcactcgggagacgaagagatcggtggtttgctcttcgattttctctttgccgctcaagacgcgtccacgtcatcactcctctgggccgtgacgcttcttgattcagagccagaggtgctgaacagagtaagagaagaagtagccaagatctggtcacctgagtccaacgccttgatcaccgttgatcagctcgcagagatgaagtatacacgctccgtggcgcgtgaggtcattagatacaggcctcctgcaactatggtcccacacgtcgctgctatagacttccctctcacggaaacgtacactatcccaaaaggtacaattgtctttccttcggttttcgactcctcgttccaagggtttactgaaccggaccggtttgatcctgaccggtttagcgagacaagacaagaggaccaggtgttcaaacgcaacttcctagcttttggatgggggcctcaccaatgcgtaggccagcgttacgcgttgaaccacctcgtacttttcattgcaatgttctcgtcgttgttggatttcaagaggcttcgatcagacggttgtgatgagatcgtgtactgccctactatatcgcccaaggatgggtgcaccgtgttcttgtctaggcgcgtcgcaaagtatcccaacttttcc

SEQ ID NO: 41 - DNA, 1561 bp, Arabidopsis thaliana
ttaattaagatgggttcggcgaacaacgagtacgagtttctgagtgagattgggctgacttctcacaacttgggatcttacgttgctggcaaatggcaagccaacggacctcttgtttcaactctcaatcctgctaacaatcagccaattgctcaagttgtggaagcttctctagaggattacgagcaaggtttgaaagcttgcgaggaagcagctaaaatatggatgcaggttacggctcctaagagaggtgatatcgtcagacagattggggatgcactaagatccaaacttgactatcttggtcgtcttctttctcttgaaatgggaaagatccttgctgaaggtattggagaagttcaggaagtaattgacatgtgtgattttgctgttggtttgagccgacaactcaatggatcggttataccttcagaacgccctaaccacatgatgttggagatgtggaatcctcttggcattgttggtgttatcacagcgtttaattttccctgtgcagttcttggttggaatgcttgtattgctcttgtctgtggaaactgtgtagtctggaaaggtgctccaactacaccgttaataactatcgcaatgaccaagctagtagctgaagttttagagaaaaacaacttacccggtgccatttttacggccatgtgtggtggtgctgaaattggtgaagcaatagccaaagacacacgcattcccttagtatcctttactggaagctccagggtgggctcaatggtacaacaaacagtgaatgcgagatctgggaaaactttgcttgagttgagtggaaacaatgcaatcatagtcatggacgatgctgatatacagttagcggctcgatctgttctattcgctgcggttggaactgctggtcaacgttgcacaacttgccgtaggctgcttttgcatgagagtgtctatgacaaagtactcgagcaactgcttacctcatacaaacaagtcaaaatcggcaatcctcttgagaaagggacattgttaggaccattacatactcctgaatcaaaaaagaactttgagaaaggaattgaagtcatcaaatcccagggtggtaaaatactaacgggaggtaaagcagtcgaaggtgaaggaaactttgtggagcctacgataatcgagatatcagcagatgctgctgtcgtcaaagaagagctatttgctccggttctatatgttctaaagtttaagtcatttggagaggctgttgcgataaacaactcggttcctcaaggtctaagcagctcgatattcactcggaaccctgaaaacatcttcaggtggatcggaccactgggaagtgactgtggcattgtgaatgtgaacataccgacgaatggagctgagattggtggagcttttggaggcgagaaagcgactggtggtggtcgtgaagctggaagcgactcatggaaacagtacatgcgtcgatcgacttgtaccatcaactatggaaacgagttacctctagcgcaaggaattaacttcggttagatttaaatacccagcaaattggagc

SEQ ID NO: 42 - DNA, 213 bp, Arabidopsis thaliana
atggcttttgttgtaacatccctgatattcgctgtcgtaggcatcattgcttcgatatgcactagaatctgcttcaacaaaggcccctccaccaatctgttacatcttacattggtcatcaccgcaactgtctgctgttggatgatgtgggcaattgtatacattgcgcagatgaaccctctcattgtccctatcttaagcgaggtggagtag

SEQ ID NO: 43 - DNA, 1014 bp, Arabidopsis thaliana
atgagttattctggagccggactcggaaagcctggctcaggtaaaaggagaataagggatcttttaactcaatctgataaccgagtctgcgctgattgtggcgctccagatcctaagtgggcgtcagctaatattggagtgtttatatgcttaaaatgttgtggtgtccacagaagccttggcagtcatatctcaaaggtcttatccgtgacattggatgaatggtcagatgaagaagtcgattcgatgattgaaattggaggaaatgcctctgcaaattcaatttacgaggcgtttattcctgaaggtagctctaagcctggacctgatgctagtcatgaccagcgtatgaggttcattaggtcgaaatatgagcaccaagagtttctgaaaccaagcttgcggatcacatccgtgaggggctctagtacaaagactccagcatttctttcatcgagtctatctaaaaagattgttgatagctttcgcactaattcatcatcgcaacagccgcaacttgaaggcatggttgagtttattggattgttgaaggtgactattaaaaagggtaccaatatggccatccgagatatgatgtcaagtgatccctatgttgtgttgactctaggacaacagaaggctcaatctactgtagtgaagagcaacttaaaccctgtctggaatgaggaactcatgctctctgttcctcataactatggctcagtgaaattgcaagtgtttgactatgacacattttctgctgatgacataatgggagaagctgagattgatatccagcctctgattacatctgcaatggcttttggagaccctgaaatgtttggagatatgcagattggaaaatggctgaaatcgcacgacaatgctcttatagaagatagcatcatcaacattgcagatggtaaagtgaagcaagaggttcaaatcaagcttcagaatgttgaatctggtgaactagaactagaaatggagtggctacctcttgagcaataa

SEQ ID NO: 44 - DNA, 1319 bp, Arabidopsis thaliana
atgcaatcagaatttcttgaattgcgtcaacggattaaggaatcgattaggacgaagatgcaaagcggagatactattattgctccaacctcacagacacagttacatcagagcaaaagtaatcttccgtacgagtaagttttattttctagttttgattgtgtatttgtgttgtgttcaaagagattagcatgaattgaatattctaactctgcttttacaaacaaaaaaaaaactctgtttttgcagctttggttccttttttggtccttctcagactgttattgcttcaagagtcttacaagaaagcaagcctcttttagaaaacgagacatcagcagctaaaatgttaaactctattcaaaacgtatgtctcatcagatccttctttttcacatttttgacgttgcaagtgtttttttttcttactctttttaaaactgttttgtgtcttgtgtacagaagaaaagttctgttctaatgaatgatgcttcagggactaagaatgcgaatgaggtcaaacgaaaagctgaaaaacttaaggatggaagagactactcattccttttctctgatgatgctcagcttcctgtttccatcaaggaaccacctacttctagaccaagttccacagagagccaaatgcagccaagaccaggttcatcaaataatgtacaagctcacacgagggaggattcggcaattaactctcaaaagcggaaatcaatgaacaagaagggccaaccaagttccaaattaggccatcagagaccactgtcctcaacaaagccattgagacatgattctaaacaacaaagggtagaacagagaaatgtttccttggaactcacaaggtcgcaactgcctcctgcgaaacaccagttgattagcaaaccaccattgaagcgagtgaagaaaaagcctgtgaaaatgtcagaagatgatttggccttgcaaatggttagaaagatgtgcaagactgatcgttttgcagggcgtgacgaagactatgatgataggtgcatggaagccaactttgatgatatcatgagggaagagaaacggaggtatgttattatttattcagatgttttcaatgtagttttagaatcttcccgggacaccaatgttcttgtttgtttgttgtttgatacagtgagagacttgcgaagaaagaagacgcggaacaactgcggttggtagaggaagaagaaagagtgagaaggcagaagaagcagaaacttagccatttgaagaattgtggtttagggttaaagaatctacgcgtttctaatttcaaagttacttttcttctttga

SEQ ID NO: 45 - DNA, 915 bp, Arabidopsis thaliana
atggcagcaaccttacctctatctccgatcaatcatcagttgtgtcggttcgggaacaactctttgacgactcaccggttctgttctcctggcttcttgatttcttctccttgtttcattggtttgaccggaatgggctctgctactcagttacgtgctcgtcgttctctgatctcttcagcagttgcgacgaattcgctgttgcatgacgtcggagccaccgtggcagtgcttggtggagcatacgcgcttgtcttaagcttcgagagtctcaccaagcgaaacgtcattcaacagagtttgagcagaaagcttgtgcatatactctcaggtctgcttttcgtacttgcgtggccaatcttcagcggatcgaccgaggctcgatactttgctgcttttgttccgttagtgaatggcttaaggcttgttattaacggactatccatttccccaaattcgatgctaatcaaatccgtcacaagagaagggagagcagaagagttgcttaaaggtcctttgttctacgttctagctcttcttttctctgcggttttcttctggagagagtctcctatcggtatgatctcgttagcaatgatgtgtggtggcgatggaatagctgatataatgggacgtaagtttgggtcaactaagataccttacaacccaagaaagagttgggcaggaagcatctccatgttcatcttcggcttcttcatctccatcgcattactttactattactcaagccttgggtaccttcacatgaactgggaaacgaccttgcagagagtagcaatggtctcaatggtcgccacggtagtcgagtcgctacccatcaccgatcaattagacgacaatatttcggttcctctggctactattttagctgcttatttaagtttcggatattag

SEQ ID NO: 46 - DNA, 677 bp, Arabidopsis thaliana
atgatacccagaaaccctacgcaatcatcgaagaatttagggttttcttcgtttctatcgtgtgcaccatcgatggattctcgtatatcagtttctaggctttctctgaatcatcccggctcgaaatttgggttctcactcgatactagggtgagaaatgagtttatcgttagagcagaagaaggtaacacagaagctgaatctgaagaatttgttgctgaaatcgctgatacggaaggaaatgtagaggaagtggtcgaagctaaacctacaagaaaacctaggatcaagctcggagatgtcatggggatactgaaccagaaagcaattgaggtagcagagaaagtgagacctgttccagaaatcaggacaggagatattgtagaaatcaaattggaagttcctgagaacaaacgtaggctatctatctacaaaggcatagtgatgtcgagacaaaatgcaggcatacacactaccattcgtattcggagaattattgcgggtatcggtgttgaaattgtgtttcccatatactctcccaacatcaaagagataaaagtggtgagtcacaggaaagtaagaagagcaaggctttactatctgagggacaagcttcctcgtctgtccactttcaagtgaacaccatccaccgtgctgtgtttgacctccagaggtag

SEQ ID NO: 47 - DNA, 1930 bp, Arabidopsis thaliana
ttcttgtttgttgattaacccttaattaatccgggcgcgcctgatttatcacaagtttgtacaaaaaagcaggctcctgcaggaccatggcattacttttctccttcgtatcgcacgctagtcgggttatattatatatttacacttatgcacacggctgtctcaacaccacccgatgatcctgtcaaatgtgtgtcaggaaacacgaactgtacagtcactaactcatacggagccttcccagacaggtccacatgtcgagccgccaacgtggcatacccaaaaactgaagccgagcttgtctctgtcgtggctgcagccactcaagccggacggaaaatgcgtgtaacaactcgatattcccatagcattactaagctcgtgtgtaccgacggaaccgaaggtttgttcataagcacaaagtttctaaaccatacggtacaagccgatgcaacagccatgaccatgacggttgagagtggcatgacgcttaggcagttaatcgttgaagcggctaaagttggattggcgttaccttatgcaccgtattggtgggggctgaccgttggtggtatgatgggaaccggtgctcacgggagctcattgtggggtaaaggaagtgcagtccatgattatgtgaccgagatcaggatggttagtcctggttcggtcaacgaagggtttgcaaagattagaattttaagcgagactacgactcctaacgagtttaacgcggctaaggtttctcttggcgtccttggcgttatctctcaggtaacttttgaattgcaaccgatgttcaagagatcgctgacatatactatgagaaacgattcggattttgaagatcaagccgttacttttggaaagaaacacgagtttgcggatttcatatggttaccaagccaaggaaaagtggtgtatcgaagagatgaccgagtagcggtcaacacatcgggcaatggtttgttcgatttcttgccattccgttcacaactctctgcggcaatagccatcatacgaacatcagaggagacgcaagagaggttcagagatgcgaatgggaagtgtgtgggagccacaataatttcatctacactgtttgctccctcatacggtttgaccaacaatggcattatattcactggttatcctgtcgttggaagccaaaaccgtatgatgtcgtcaggatcgtgtctagacagccttcaagatggattgatcacggcgtgtgcatgggactcacgtataaaaggcgaattttttcatcaaacaactttgagtgtccctctcacccaagttaaaagttttatcagcgacatcaaatcacttgtaaagatcgaacaaaaatctctgtgtggccttgagcttcactatggtattctaatgcgctatgtcacatcatctcccgcttatctagggaaagaaaccgaagccctagactttgacataacatattaccgagctaaagacccgttaacaccgcgactctacgaagatttcatcgaagaaatcgagcaaattgcattgttcaaatataacgcattgccacattggggtaagaacagaaacttggcgtttgatggagtgattagaaagtacaacaacgcacccgcattcttgaaagtaaaagatagttatgatccaaaaggtttattctcgagcgaatggacagatcagatcctaggaattaaaggaaacgcgtcaatagtaaaagatgggtgtgcattggagggtttgtgtatatgttcgaaggatgctcattgtgctccggcgaaaggctatttgtgtcgaccgggaaaagtgtacaaagaggctagggtttgtacacgtgttgatgggataataagtgttatttaactcgagacccagctttcttgtacaaagtggtgataaattggagctctgcagagctttcgttcgtatcatc

SEQ ID NO: 48 - DNA, 2100 bp, Arabidopsis thaliana
gaacccaaacggctctctctcttgtctgactctctctctctctctctctctcgatcggtcgaaattttctctgtaactctcttctctctttacgaatcccgatatgagccacgggtggttatggttatgaataatcctgcaaacaacaacccagtagcagcgtcttcagcgtcagccgtagctttagctccgccgccacatccgccgcagcctcaccgtccttctacttcctgtgatcgtcacccggatgagcgtttcaccggattttgcccttcttgtctctttgaccgtctctctgttctagacatcaccggaaaaaacaacaacgccgtcgcgtcttcttctaagaaaccaccgtcttcttccgccgctcttaaagcaatcttcaaaccctcttcctcctccggttcgttcttcccggaacttcggaggacgaaatcgttttcagcatcaaaggctgaagctttttctctaggtgcgtttgagccacagagaagatcctgtgatgttagggttaggaacactctttggtctctgtttcacgaagacgccgagcataattctcaaaccaaagagggtttatcagtaaattgcagtgagattgatctcgaacgcatcaattcaatagtaaagtctcctgttttcgaggaggaaactgaaattgaaagtgagcaagacaacgagaaagacataaagtttgagactttcaaggaacccagaagtgtaatcgacgaaatcgttgaagaagaagaagaagaggaaacgaagaaagttgaggactttacaatggagtttaatccacagacaacggcgaagaagacgaacagagacttcaaagagattgcagggagtttctggtcagcggcgtcagtattcagcaagaaattgcagaaatggagacaaaagcagaagcttaagaagcatagaaccggaaatctcggagccggatcctctgctttaccggtggagaaggcaatcgggagacaacttagagatactcaatctgaaatcgctgagtatggttacggaaggagatcgtgtgatacagatccaagattctcaattgacgctggaagattctcgcttgatgctggtagggtttcggttgatgaccctcgttactcttttgaggagccacgcgcttcgtgggatggatatttgattggaagagctgctgctccgatgcgaatgccgtcgatgttatctgtagtggaagattctccggttcggaatcatgttcaccggtcagatactcacattccggtggaaaagtcaccacaagtatcagaagctgtgattgatgagattgttcctggtggatctgcacagaccagagagtattacttagactcatcatcttcacgaaggaggaagagccttgaccgttctagctccactaggaagttatcagcctctgtcatggctgaaattgatgaactaaagctgactcaagacagagaggctaaagacttggtttcacattcgaattcactgagagacgattgttgctctgttgagaacaactatgagatgggtgttagagaaaatgtagggactatagaatgcaacaagaagaggacgaagaaatctcgatggagttggaacatattcgggttgcttcatcgaaaaaacgggaacaaatacgaggaagaagaaagaagaagcggtgtggatagaacgttttcggggtcgtggaatgtagaaccgaggaacgggtttgatccgaagatgattaggagcaatagtagtgtgagttggagaagttccggaaccactggaggagggttgcaacggaatagtgtggatggatacattagtgggaagaagaaagttagtaaggctgagaatggaatgctcaagttttacttgacaccgggtaaaggaaggcgaagaggaagcggcaattcgaccgcaccgacaagccggcctgttccggcttctcaaccttttggtagtagaaatgttatgaacttttactaacaacattgtaatgagctcgagtcttctttttagatgtagttggaataatgtgtgatgaagttgcattgacagaaaatgttcaaagatttacatattttttttgggttcaatctgattctt

SEQ ID NO: 49 - DNA, 1634 bp, Arabidopsis thaliana
cagctttcaaactctttgtttcttgtttgttgattaacccttaattaagtctgcataatcatggcgaggaagatgcttgttgatggtgagattgataaggtggcggctgatgaagccaacgcgacgcactatgattttgatttgtttgtcatcggtgccgggagtggcggtgttcgtgctgctaggttttcggctaatcatggcgctaaggttggtatttgtgagcttccatttcaccctattagctctgaggagattggaggcgttggtggaacctgtgttatccgtggttgtgttcctaaaaagattctcgtctatggagctacttacggtggtgaacttgaggatgctaaaaattatgggtgggaaataaatgagaaagtcgacttcacatggaagaagcttttgcaaaagaagactgatgagatactaagactgaataatatctacaagcggttattggcaaatgctgcggtgaaattgtatgaaggtgaaggaagagtagttggtcccaacgaagtggaggtgagacaaatagatggcacaaaaataagttataccgcaaagcacatattgattgccactggcagtcgggcgcaaaagcctaatattcctggacatgagctggctattacatctgatgaagctttgagcttggaagaatttcccaagcgtgctatagtgcttggaggagggtatattgctgtggagtttgcatcaatatggcgtggaatgggtgctactgtagatttattcttcaggaaggaacttccgctaaggggttttgatgacgaaatgagggcactagttgctagaaatcttgaaggaaggggcgttaatctgcatccacaaacaagtttgactcagttgacaaaaacagaccaggggatcaaagtcatatcgtcccatggggaggaattcgtggcagatgtcgtcctatttgctactggcaggagtcctaataccaaaagattgaatttagaagctgttggtgttgaacttgatcaggctggagctgtgaaggttgacgagtattcacgaactaatatacctagcatatgggctgtaggagatgccacaaaccgaattaaccttacacctgttgcgttaatggaggccacctgttttgcgaacactgcttttggtggaaagcctactaaagcagaatacagcaatgtcgcctgtgctgtattttgcataccaccactagctgtagtgggtctcagcgaagaagaagcagtagaacaagcaaccggtgatattctggtcttcacctcaggctttaatccaatgaagaacaccatttctggacgccaggaaaagacattgatgaagctaatagttgatgagaagagtgataaggttattggagcatccatgtgcggtcctgatgcagctgagatcatgcaggggattgcaattgcgctcaagtgtggagcaaccaaagcacaatttgatagcacggttgggatacatccatcttctgcagaggaatttgtgacaatgcgcagtgtgaccagacgcattgcccacaaacccaaacctaagacaaatctatgaaccgcaaaatataaagagctatatagcatgaaaactcggtacacttaatttggcgcgccaaaaattggagctct

SEQ ID NO: 50 - DNA, 612 bp, Arabidopsis thaliana
atggagttttggggtatcgagattaagccagggaagccatttaaggtgatacaaaaagatggattcatggtccatgcctctcaggttacccttggtgacgttgagaaggttaaaaaagatgagacttttgccgtttatgtgaagattggtgatgatgagaatgggtttatgattggaaatctctcacagaagtttcctcaattttctattgatctctacttagggcacgagtttgagatttctcacaacagtacaagcagtgtctatcttattggttacaggacctttgatgcttttgacgaactggatgaggagattgattctgattctgagttagatgaatatatggaacaacaaattgctgctttgcctcaaaatgagatcaatcctgaagaagatgatgaatccgactcagatgagatgggtttggacgaggatgatgactcttcagatgaagaagatgtagaggctgaagcacctttaaaggtggctcctccgagcaaaaagatgccaaatggtgcatttgagatagctaaaggtggaaagaagaacaagtcatcaggagggaagaagagatgcccattcccttgtggtccctcttgcaaaaagtag

SEQ ID NO: 51 - DNA, 675 bp, Arabidopsis thaliana
atggattccaattggatcaattgtccctctgttttctcctcatcctcttcttcttccagacgctgtcaatcccgatcagacttgtatttaggaggagggtacgaggatcttgaaggagaagacgatttgaaggcagagtttatatgccctttttgcgctgaagattttgacattgttgggctttgttgtcacattgatgaagaacatcctgttgaagccaagaatggggtctgtcctgtatgcactaagagggtgggattggatatcgttggccatattacgacgcaacatgcgaatttctttaaggtacagcgaaggagaaggttgcgaagaggaggatatagctctacctatctcgccttgaaaaaggaactccgggaagcaaacctacagtctcttcttggtggatcttcaagtttcacttcttcaaccaatatcgattctgatccgttgctgtcatcctttatgtttaattctccttcagtgaaccagtctgcaaacaaatctgctacacctgtgactgtaggaaacgcggctacaaaagtctcgattaaggaatctctcaaaagagacattcaagaagctccactttcaggtgaagatcaggagaaggcgaaaaagagtgagtttgtgcgaggcttgttgttgtcaaccatgcttgaagacgatttctaa

SEQ ID NO: 52 - DNA, 3054 bp, Arabidopsis thaliana
tattattcatttatttgtcagctttcaaactctttgtttcttgtttgttgattaacccttaattaaatgggttccgtgaagagaaaatcagtggaggaatcttctgattctgctccgccgcaaaaggttcagagagaagacgattccacccaaatcatcaacgaagagctagttggttgcgttcacgatgtttccttccctgaaaattacgttcctcttgctccctccgttcacaataaaccaccagctaaagatttcccctttacacttgactccttccaatctgaagctatcaagtgtctcgataatggcgagtcagtcatggtttcagctcatacatcagctggtaaaactgttgtggcgtcgtatgctattgccatgtctttgaaggaaaaccagagagttatttacacttctcctataaaggcacttagtaatcagaagtacagagattttaaagaagagttttctgatgttggtttgatgactggggatgtgactatcgatcctaatgcctcttgtcttgtcatgactacggagattttgcgtagtatgcagtataaagggtcagagattatgcgggaggttgcgtggattatttttgatgaggtgcattacatgcgtgatagcgaaagaggtgtggtttgggaagagagtattgtaatggctccgaagaattctcgttttgtgtttctatcggcaacagttcccaatgccaaggagtttgctgattgggttgcaaaggttcaccaacaaccatgtcacattgtttacaccgattatcggccaactccacttcagcactatgtctttcctgctggaggtaatggactttacttggttgtggacgaaaaatctaaatttcatgaggatagcttccagaaatctctcaacgcactggttccgactaatgagagtgacaagaaaagagataatggaaagtttcaaaagggattagtgattggaaaacttggtgaagaaagtgatattttcaaattggtgaaaatgataattcagcggcaatatgatcccgtgattttgttcagtttcagcaaaaaggaatgcgaggcacttgctatgcagatgtctaagatggttttgaacagcgatgatgagaaagacgctgtggagacaatctttgctagtgcaattgatatgctttcagatgatgataaaaagctacctcaggtgtcaaatattttacccatcttgaaacgtggtataggcgttcatcattcaggactgcttccaattttgaaagaagtaattgagatattatttcaggaaggtcttattaagtgtttgtttgcaacagagacatttagtattggattgaacatgccggcaaagacggttgtatttaccaatgtacgtaagtttgatggagacaagttccggtggctatcaagtggagagtacatacagatgagtggtcgtgccgggcgccgaggtattgacaaacgaggtatctgcatcctcatggttgacgagaagatggaacccgctgttgctaaatcaatgctcaaaggaagtgctgattctttgaacagtgccttccatttgagctataacatgcttctaaatcaattgcggtgtgaagaaggtgatcctgagaatcttctgcgaaattcgttctttcagtttcaagctgatcgtgctatacctgatctcgagaagcaaataaaatctctggaagaagagagagactctttggtgattgaagaagaagaaagcttaaaaaattactataacctgattttgcaatataagagtctgaagaaggatatacgtgaaattgtgttcactccaaagtactgcttaccctttttgctgccaaacagagctgtttgtcccgattgcacaaatgatgatgaagagccacaatcattcagcattgaagaccaggatacatggggagtgatcatgaaatttaacaaagtcaaaagtttatctgaagatgatgatagtagaagaccagaggatgcaaactacaccgtagatgtgttgactagatgtatggttagcaaagatggcgttggcaaaaagaaagttaaggctgtgccaattaaggaacgtggtgagcctgttgtggtcactgttcctttatcgcagataaagagtttaagcagtgcaatcatgaatataccaaaagatcctgtacctttggaagctcgagagaatgctctgaagaaggtttctgagttactctctagacatcccgatggaatacccctagatcctgaagttgatatgaagattaagagcagctcttacaaaaagacagttcggcggctggaggctctggaaaacctatttgaaaaacacaaaattgcaaaatctccactcataacagaaaagttgaaagttctacagatgaaggaagagctaatagccaagatcaagtcacttaagaaaactgtccgatcgtcaacagcattggcgtttaaagatgaactcaaggccagaaagcgtgttttacgaaggctaggatacatcactagtgataatgtcgtggagttgaagggtaaggttgcatgtgaaatcagtagtgcagaagaattgacattaacggagttaatgttcagtggtatcttcaaggatgcaaaggtggaggagttggtttcgctcctctcttgctttgtatggcgagagagactccccgacgctgctaaacccagaaaagaactcgacttgctcttcatacagttacaagacacagccaggcgtgtagctgaagttcagcttgactgcaaggtcgaaatagacgtggagagttttgtgcagtctttcagacctgatataatggaggcggtgtatgcttgggcaaaagggtccaaattctatgaggtcatggagattgctcgtgttttcgaagggagcttgatcagagcgataaggagaatggaggaagttctgcaacagctcatagtagctgcaaaatctataggagaaacacagcttgaagctaaactagaagaagctgtttccaagatcaaaagagacattgtattcgcggcgtctctctacttgtgaggcgcgccaaaattgagctct

SEQ ID NO: 53 - DNA, 1590 bp, Arabidopsis thaliana
ctgtgaattacgaatccatagagagaaaggttttgcatttgcaacctttctcaaattgggttctgtgcatttccttgcactttggataataggaactaaatctctttctctggttcatcaatggcggatcaaacgaagaagagatacgttacaagcgaggatttgaaaaaacacaacaaacctggagatttatggatttcgattcaaggtaaagtttacgacgtttccgattgggttaaatctcatcccggaggcgaagcagcgattctcaatctcgccggccaagacgtcaccgacgcgttcatcgcttaccatcccggaaccgcatggcaccacttagaaaagcttcacaatggctatcacgtgagagaccaccacgtgtcagacgtctcacgtgactaccgtcgtttagccgccgagttctccaaacgcggcctcttcgacaaaaaaggtcacgtgactctttacacactcacgtgcgtcggcgtcatgctcgcggcggttctctacggcgttttggcgtgtaccagcatctgggctcacctcatctccgccgttttactcggtctcctctggatccaaagcgcttacgtcggccacgattccggtcactacacggtgacgtcaaccaaaccgtgtaacaaactaatccagcttctctccggtaactgtctcaccggcatctcaatcgcgtggtggaaatggacgcacaacgctcaccacatcgcttgtaacagccttgaccacgatccggatctacaacacatcccgatcttcgccgtctctacaaaattcttcaattcgatgacgtcacgtttctatggcaggaaattaacattcgatcctctagctcgattcttaatcagctaccaacactggacattttacccagtaatgtgcgtcggaagaatcaacctcttcatccaaacattcctattgctattctcgaaacgccacgtcccagatcgggccttgaacatcgccggaattttagttttctggacatggttccctctcttagtctcgttccttccgaattggcaagagagattcatcttcgtcttcgtgagcttcgccgtcacggcgattcaacatgttcagttctgtttaaaccatttcgcagcagatgtgtataccggtccaccaaacggaaacgattggtttgagaaacaaaccgccggtacgcttgatatatcgtgtagatcgtttatggattggttctttggtggattgcagtttcagttagagcatcatttgtttcctcggcttcctcgttgtcatctccggacagtatcgccggtggttaaggagctttgtaagaagcataatctaccgtataggagtctttcgtggtgggaagctaatgtgtggacgattaggactttgaagaacgcggcgattcaagctagagatgcgactaatcctgtgttgaagaacttgctttgggaagctgtgaacacgcatggctaaaaaggtgtttcgtttgtcgagtactttttaattagattgaactgttttaggtgtaactctaccgtgataaaaaactacatatttattttgattttctgctgagtttataattttctaatc

SEQ ID NO: 54 - DNA, 1389 bp, Arabidopsis thaliana
atggagatcttctacttcgtggtgttcggtggcctggctgcgatcgtcgccggcttggagctgagcaaatcgaacaaagaccgcattaacacctcctccgccttcaactccttcaagaacaactatctcctcgtctactctctcatgatggctggggactggttgcagggtccgtatgtgtactatctctacagcacttatggctttggaaagggagagatcggtcagctctttattgctggttttggatcttccatgttgtttggcaccattgttggatctcttgccgacaaacagggtcgcaagagagcttctatcacctactgtatcacctacattctcagctgtatcaccaaacattctccccagtacaaagttttgatggtcggtcgtgttcttggtggtatcgctacttctctccttttctctgccttcgaatcctggctcgtcgctgagcacaacaagagaggcttcgagcagcagtggctttctgtcactttctccaaggctattttcctcggtaatggattagtcgccatcattgctggcctctttggcaattaccttgtcgattctctctccctcggtcctgttgctcctttcgatgctgctgcttgcttccttgctattggtatggccgttattatctcatcttggtccgaaaactatggagatccatctgaaaacaaagaccttcttacccagttcaagaacgctgcatctgccattgcttctgatgagaagatcgcattactcggtgctattcagtctctgtttgaagggtccatgtacacctttgtgtttctctggactcctgctttgagcccaaacgaagaggacattccacatggtttcatatttgcaacattcatgctggcttcgatgcttggtagctccattgcctctcgtttgttggcacattcgtctccaaaagtagagagctatatgcagatcgtatttgtgatatcttctgctgctctaatgcttcctgttgtaacaagcttcttggtggcgccctcaggtgtaaaaggtggaagcatatccttctctggatgcattcagttaatgggtttctgcacatttgaagcgtgtgtaggaatcttctggccatctataatgaagatgagatcgcaatacattccagaggaagctagaagcaccatcatgaattttttccgcatcccactcaacatctttgtctgccttgtattatacaatgttgacgcgtttccaatgaccgtgatgtttggaatgtgctctgtattcctttttgtggcctctatattgcagaggaggttgatgaatgtagccgagatccacaagtcaagatcacaagagtggtcagcagaaaaggagatgacctcagaagctgaccctctaaacccataa

SEQ ID NO: 55 - DNA, 1004 bp, Arabidopsis thaliana
ttaattaagcaagaagaacaacatcatcaacaaacaagaataataagatgacactttatattcgtcgtgaatcttccaagctatggaagagattttgctctgagatatcgacggagattggtcttcttgctgagaactggaaatatcttctcgctggtcttatctgtcagtacattcatggtttagctgctaaaggagttcattatattcatcgcccgggaccgacacttcaggatcttggcttctttcttcttccggagcttggtcaagagagaagctacataagtgaaaccgtgttcactagtgtgtttctttcgtttttcctgtggactttccatccattcattctgaaaaccaaaaagatatacaccgttttgatatggtgcagagttctagcattcttagttgcctgccagtttctccgtgttataactttctattcaactcagcttcctggccctaactatcactgccgtgagggctctaaagtttctaggttgccatggcccaaaagcgctcttgaggttctcgagattaaccctcatggggtgatgtatggatgcggagacctgattttctcatcgcacatgatattcactctagtctttgtccgtacttaccagaaatatggcactaaaaggttcataaagctgtttgggtggctcactgcaattgtgcagagcctcttgatcattgcctctcgtaaacattacagtgtcgatgtagttgttgcatggtatactgtgaatttggtggtgttctgtctagacaagaaattaccagaattaccagatcggactgctgtgttgctcccagtaatctcaaaagacagaacaaaagaagagaaccacaagctgttgaatggaaacggtgttgaccctgctgattggagaccgagggctcaggtgaacgggaagattgacagcaacggagttcacacggataacacaatgaatggcgcgtgaaaagatctaattatatgaaaagatggacagcaacagtga

SEQ ID NO: 56 - DNA, 1344 bp, Arabidopsis thaliana
ttcttgtttgttgattaacccttaattaatccgggcgcgcctgatttatcacaagtttgtacaaaaaagcaggctcctgcaggaccatggcagctgcaacaacaaagctagcgagagctctgcaacaaagacgcaccttcgtaaacgccagagtcaaatgggtcagtgaccattacctcgacgaagctgttcaacgagagaaaaacctaaagcaagttatctctctcaaggatcgaatcgtatcatctccgtcgaaatcactccctctctcttctctttcacttctcaaacctctcgtcaatcttcacataaccgccgccgcgtttttccagaaatacccttctgtcttcaccacttttcagccttctccttctcatcctctccatgttcgtctcactccccaagctctcactctccacaaagaagaagagacgattcatctctcgccgcctcaacgcaacgtcactgttcaacggttgactaaattcttgatgctaacgggagctggaagtcttcctctctatgtcctcgatcgtttcaggttcgatttgggtctccctcgcgattacattacttcgttgatcggcgattacccggaatactttgaagtaactgagatcaaagatcggttaacgggtgaaaagacgcttgctttgacgatatcttcgcggcggaacaaccttcctgtgtcggaaatggagagaagagaagccaccattgatgggtctcgtgtgaaaaaagggttgcgcataaggtattcgatgaatttccccaaagggtacgaattgcataaaagggtgaagaattgggtggagcaatggcaaaatctcccatacatttcgccttatgaaaatgcttttcacttggggtcgtacagtgatcaggctgagaagtgggctgtcgcagtacttcatgagcttttgttccttttagtatctaagaagactgagacagacaatgtgatttgcttaggggagtatttagggttcgggatgaggttcaagaaggctttggtgcaccacccgggtatattttacatgtcgcacaagattcggacccagactgttgttctaagggaagcttaccacaaagttttcttgctggagaagcatccattgatggggatcagacatcagtacatttatcttatgagcaaatcagggagagggaagaaacgagactatgttcatggagttgagagaagcaaccgaaaaaagagagtaatcaaagcttgtgaagatggtgaaatttatgcacataacagcagtctttgactcgagacccagctttcttgtacaaagtggtgataaattggagctctgcagagctttcgttcgtatcatc

SEQ ID NO: 57 - DNA, 1131 bp, Arabidopsis thaliana
aagcggaggcgattttctagggtttttgctcggaatcgatttcacgatgggaacgagcagcgatccgattcaagatggttccgatgagcagcagaagcgatcagagatctatacatacgaagcgccatggcacatctacgcaatgaattggagcgttcgtcgcgataagaagtatcgtctcgccatcactagcctcctcgagcaatacccgaaccgtgtcgagattgtgcagctcgatgaatccaatggtgagatccgttccgatcctaacctctcctttgagcatccttatccaccaacgaagaccattttcatacctgacaaggaatgccaaagacctgatcttctcgctacttcaagtgatttccttcgtttatggagaatcgctgatgatcattcccgtgttgagctcaaatcttgtctcaatagcaataagaacagtgagttttgtggtcctcttacttcttttgattggaatgaagctgagccacgtcgaattggaacatctagtactgatacgacttgtactatctgggacattgagcgtgaagctgttgatactcagcttattgctcatgataaggaagtttttgatattgcttggggtggtgttggtgtttttgcatctgtttcagctgatggctccgttagggtgtttgatcttcgtgataaggaacattcgacgattatctatgagagctccgagcctgatactcctttagtgcgtcttggttggaacaaacaggatcctaggtacatggctactattatcatggacagtgctaaagttgtggtgcttgacattcgttttccggctcttcctgtggttgagcttcaacgacatcaagctagtgtcaatgccattgcttgggctcctcatagctcttgtcacatttgtactgctggagatgattctcaagctttgatttgggatatttcatccatgggacagcatgttgaaggtggtcttgaccctattctagcttacactgctggtgctgagattgagcagcttcagtggtcctcttctcagcctgattgggtcgcaattgctttctctactaagctgcaaattctcagggtttgatcttttcaaagaatttctcatctcttgtcagattagatttaaat

SEQ ID NO: 58 - DNA, 4496 bp, Arabidopsis thaliana
gcatctttaaagttttagcagtgattctttatagttcagtatgtcagattcttgttacaggtcttgtcagttagaataatttgaaggactgttgttgttgttgttgttgttgttgttgtgatggatagaaacagaccaccacatccgttccagcaacatgctatggaacctggatatgtgaatgactctgtcccacaaggatttacgcctgatcaaacgggtctctcgaatgcaaatgtccgacctaatcctgcagatgttaagccggggcttcattactccatacaaacaggagaggaattttctcttgagtttctgcgtgatcgtgtcatttctcaaaggtctgcaaatcccattgcagctggagatatcaattatcccacaggttataacgggcacgcagggtctgaatttggttcagatgtttccaggatgagcatggtgggaaatggcatcaggcagtatgagagaacaaaccccccggttcacgagtttggaaataaactcgggcatatccattcagcaccagaagcttcattatgtcaagatagaagtttaggaaatttccatggatatgcatcttcttcagcctcaggtagtttaacagcaaaggttaaagtcctttgtagctttggtgggaaaatacttccacgtccaggtgattcaaagcttagatatgttggaggtgaaacacacattatttccataagaaaggacatttcttggcaggagctcaggcaaaaagttcttgaaatctactatcggactcatgttgtcaagtatcaacttcctggtgaagatcttgatgccttggtgtctgtatcatgtgacgaagatctactgaatatgatggaggagtataatgagatggaaaaccgtgggggttcgcaaaagcttagaatgtttctgttctctgtgagtgatttggatggtgctcttttgggggttaacaaaagtgatgttgactctgagttccagtatgttgtagctgtaaatgacatggaccttggatcaagaagcaactcaacccttaatggactggacagctcttctgcaaacaatttagctgagctggatgtcaggaacaccgagggaatcaatggtgttggcccttcgcagttaacagggatagattttcaacaatcctctatgcagtattctgagtctgctccaccaacctcctttgctcagtatcctcaatctatcccacacaatggtgcatttcagtttcagcaagctgttcccccaaatgctactcttcagtatgccccgtccaatccaccaagttcgtctgtccactatcctcaatctattctaccaaattccactctccagtatccacaatcgatctcatccagctcgtatggattatacccacaatattatggagaaaccgagcaatttccaatgcagtatcatgatcacaattcttctaattactctattcccatacctttcccagggcagccataccctcaccctggcatcacacagcaaaacgcacctgttcaggtagaggagccaaacataaaacctgagacgaaagttcgtgattatgtggagcctgaaaatcgtcatattctggcaactaatcaccagaatccccctcaagctgatgatactgaggttaagaatcgggagccatcagttgcaacaactgtacccagccaggatgctgcacatatgttgcccccaagaagagacacacggcagaacactcctgtgaagccttctacttaccgtgatgctgttataactgagcaggtcccagtatccggtgaagatgatcagctttcaacatcaagtggtacctgtggtcttgttcataccgactctgagtcgaatctaattgatcttgattatccagaacctttacagcccacccggagagtatatcgttcggagaggatacctcgtgaacagttagaaatgctaaatcgcttgtccaagtctgatgactcacttggttctcagttcttaatgtctcatccacaagctagcactggacagcaagaaccagcaaaagaagcagcaggtatatcacatgaagattcacatattgtaaatgatgtggaaaacatctctggaaatgtagtggcatcaaatgaaaccttggacaaaagaacggtctctggtggaggtattgagacggaagctcgtaacttgagccatgtagacacagaaaggagtcatgatatccctgaaaagcaaacttcttcaggtgttcttattgatatcaatgacaggttccctcaggacttcctttctgaaatattcgcaaaggcactctctgatgatatgccgtcaggtgccaatccatatcagcatgatggagctggtgttagcttgaatgtagagaatcatgatcctaaaaattggtcttattttcggaatctggccgatgaacagtttagcgatagggatgttgcttatattgaccgaacccctggctttccatctgacatggaagatggtggagaaattgccagattgcatcaggttgctccgttgacagaaaaccgtgtggatcctcagatgaaggtcacagagagtgaggaatttgatgctatggttgagaatttaaggacctcagactgtgaacaagaggtataagtttctggtatatttgattttacgattccaaaaccatgagtatactaatgaggatggacttggtaggatgaaaagtcagaaacaaggaacgctggacttcccccagttggcccgtctctggcagattacgacacgagtggcttgcaggtatgatggactatcaattcttacacctgatagaagttttatttattctgcattagataaaggattgtaagtttcagattgttagaagaatcaaacatagtatagcccttgtttgtcatataaaataaatgtctgcttctaatctcctcttgtgatctttctattcttaaatgtttctagatcattatgaatgacgatctcgaggagctaaaggagcttggttctggcacattcggtacagtgtatcatggtaaatggagaggatcagatgttgccatcaaaaggataaagaagagttgctttgctggccgatcatctgagcaagaaagattagtgagtgtttctgcattttcttttggaaaattttcctttgtgcatatgttaaaaggattagagagtgataacacttgtcgattgctcatcatggaaagcttatgaatacctttcttgttcgctagactggtgaattctggggagaagctgaaattctttcaaagcttcatcatccaaatgtggttgcattttatggtgttgtaaaagatggacctggtgcaacattggctactgtaacagagtacatggttgatggttctctgagacatgttctagtcaggaaagataggtacaaatctctcttataacgtttctgcattttcctatctgatgaacggtttaagactacttgcttttcattttaatattgttacttgctatacattttaatattgtcagacacctggatcgtcgtaagagactaatcattgccatggatgctgcctttggaatggaatacttgcacgccaaaaacattgttcacttcgatttgaaatgtgacaatttacttgtgaacctcaaagatccttctcgcccaatctgcaaggtaaaagctgattcatatgatgtctttgaacaaaatttattcatactcttcactcatttgttcttcctcaaggttggtgatttcggtttgtcgaaaatcaaaagaaatacattggtatctggtggtgtacgcggaaccttaccatggatggcaccagagcttctcaatggtagcagcagcaaagtttcagagaaggtaaaattaaatacttcatagtgaatataaagaatgggaacaaattgagttataactgtttttcctgcaggtcgatgtcttctcttttggtatagtcttgtgggagattctaaccggcgaggaaccatatgctaatatgcactacggtgctataataggtgtgtgttttggttgggtttgagttttactttgaaggattttcagaaaacatgaggttatagtcagcttattttctttcccatctcggtttcggttctggtgtcttctggcctggaattggtaaaatcggatgggacacgacttgttcttatcttactcataaattaatggtttaaacgcaggtgggatagtgaacaacacactgaggccgaccataccgagctactgtgactcggactggcgaatattaatggaggagtgttgggcgcctaacccaacagcaaggccatccttcacggagatagctggtcggttacgtgttatgtcaactgcagctacttcgaaccaatccaaaccaccagctcacaaggcttcaaagtgaaacagattcgatattttataggtttctctttactctttccaagtgttttggggtcaggagggagatatttgttgacccttttctcctttccccctttttttaccaaaacaaaacaaaaaa

SEQ ID NO: 59 - DNA, 1765 bp, Arabidopsis thaliana
ttaattaaaatggatcggattctgaaagcagctcgaacatctggttcgctgaatctttccaatcgttctctcaaggatgtacctactgaggtatatcaatgtttggaaacgaccggagaaggagaaaactggtgggaggctgttgatttgcagaagttgattttggctcataatgacattgaggttttaagagaagatctgaagaaccttgcctgtttggttgtgctaaatgtcagtcacaataaactctctcaacttccagcagctattggggagcttactgcgatgaagtctttggatgtgtcctttaactcaatatcagaacttcctgagcaaattggttcagcaatttctcttgtcaagcttgactgttcaagcaatcggcttaaagaattgccagattctattgggagatgtttagacttatccgatttaaaggccacaaataatcaaatttccagtttgccagaagacatggtgaactgttcgaaattatctaaactggatgtggagggaaacaagctcacagctctctctgagaaccacatagcatcatggaccatgcttgcagaacttaatgcatgtaagaatatgctgggtgttctgccacaaaacatcggaagtctttcgcgtcttatccggcttgaccttcatcagaacaaaatttcgtctgttccaccatcaataggcggttgctcctctcttgtggagttctatttgggaataaactcactatcaacattaccagcagagattggagatctatcacgtctaggaacattggatcttcgttctaatcagctcaaggaatatccagttggggcatgtaaattgaagctctcgtacctagatctttcaaataattccttgacaggattgcatcctgagctcggaaacatgactactctgagaaagcttgtgcttgttggcaatcctttgagaacccttagaagctcattagtaaatggtcctacagctgctctattgaagtatcttaggagccgcctttctaatagtgaagaaacaagtgcaagcactccaacaaaggaaaatgtgattgcttcagcagctcgtatgtccatttcttcaaaggaactttctctggaaggtctcaacttgagtgatgtcccttcagaagtttgggaatctggtgagatcacgaaagttaatctttctaagaactctatcgaggaattgcctgctcaactttctacatctgtttcccttcagacattaattttgtcaaggaacaaaattaaagattggccaggtgcaatcttgaaatcacttcccaatcttatgtgcttgaagctggataataatcccctgaatcagattccactggatgggttccaagtagtctctgggcttcagattctagacctaagtgttaatgcagtttccttcagagagcatcctaagttttgccacttgccacaactgcgagagctttatttgagtcgaatccagctatctgaagtccctgaagatatcctcaacttatctaacctgattattcttgacttgaaccagaattcacttcaatcgattcccaagggtatcaagaacatgacttcactcaaacatctagacatatccaacaacaacatttcaagtcttcctccagaactgggtttgcttgagcctacacttgaggttctacgacttgacgggaacccattaagaagtatcaggaggccaattctagaaagaggaacaaaagctgtgttgaactacctgaaagacagacttccagatcagtagc

SEQ ID NO: 60 - DNA, 3033 bp, Arabidopsis thaliana
cccttaattaagcatgtccagtaatatgggaacagagcttattgatctggagactgtgaaagcggattcagatgcttttggagaaacgaatttgatggagttagttggatcaaatgatcctccttctcttcagcatatctcagtttcagagattgagcaagagcctatggaaatatctgtctctggtcctttgtcattccaatttgagccagaggctgtctcttttcaatcatctatgttggttgatactcagtctttgatgcctcagttgcaacttccatattctgtagagaggtcagtagctgcatgtagtaactcagtgacagggaagcggaaatcgccaccagagtctactctcagtggttctgctacttccgagaagttagatgcatctaacaagcgagtagagccagtgcaccacagaccatggctagaacaattttattcagaatgtattcagcggggtcatatgccaccacctgctactctttctaccaagacagaacatctaccaacgcctgctaagaaagtaaggcaaatggaacctgcttcccaaaaatctgggaagcaagtgatgaacaagaaacaagcaggcttgtcacaagggtcggtgaaaacactgaatgatggtaacgagtctttgaggtctaaaatgaaggaatcattagcagctgccttggctttggttcacgagcatgaggagtctccgaaagagaaaaagaattcagaaactgaagaagcaagtgttccagtagctgatagtaatgagcctgcgtcagcctgtggtaccagtgttacagtaggtgaagacatcacgccagcaatgtccacaagggatgaaagttttgagcagaagaacggcaatggaagaactttgtcgcaagagagttccaaggacaccaagatgaattatgttaatcaatctgatgtacagaaaactcaatttgacgaggttttcccctgtgatgatgttcgttttagtgatagtatttttactggcgatgaacttttacagggtaatggcctctcatgggttttggaacctgtttcagattttggggagaatgaaactcaaaagtcgtttgaggatccagagctcttggcatctaaaattgagttggaactttttaagctatttggaggtgtgaacaagaagtacaaagagaagggaaggtctctcttattcaatttgaaggataagaacaatcctgagctaagagaaagtgtcatgtccggaaagatatctccagagagattatgtaatatgacagctgaggaacttgcttctaaggagctttctcagtggcgacaagcaaaagcagaagagatggcggagatggttgtcctacgggacacagacattgatgtcagaaatctggtgaggaaaacgcataaaggtgagttccaggtagaaattgatcccgttgacagtgggacagtggatgtctctgctgagattacatcaaatagtaaacctcgagccaaagcaaaatcctcgaaatcatctaccaaagccactttaaagaaaaatgactctaatgataagaacataaaatccaaccagggaacatcatctgctgtgactctgcccccaacagaggagattgatccgatgcaaggtctgtcaatggatgatgagatgaaggatgtgggatttcttcctccaattgtatcccttgatgagttcatggaatccctgaactcagaacctccatttggcagtccacatgaacatcctcctggaaaggaagatcctgcatctgagaagagtgactctaaagatgggtcacattcaaaatcaccttcaagatctcctaagcagtctccaaaggaaccgagtgagagcgtctcttctaaaacagaactcgaaaagactaatgtaatttccccaaaacctgatgctggtgaccaactcgacggtgatgtctccaaacctgaaaatacatctttggttgatagcattaaagaggatcgaatatgggatggtatattgcagcttagttccgcttcagttgtctcagtcactggaattttcaagagtggtgagaaagcaaagacaagcgagtggccaacaatggtggaggtaaagggtagagtgagactcagtgcgtttgggaagtttgtaaaagagcttccgttgtctcgaagccgtgtcttaatggtaatgaacgtggtttgcaagaatggtatctctcagagccaacgtgatagcctaattgaggttgctaagtcatacgtagctgaccaaagagttggttacgcagaaccaacctcgggcgttgagctttacctctgtccaacactgggtgaaaccttggatttgttgagcaaaatcatctccaaggattatcttgatgaggtcaagtgttcagaagatatcgggttgattggtgttgttgtgtggaggcgtgcagttgtcgcgtctcctggctcacgccataagccgggattcaaacgtcagcattcttctacaggcactaagaggtctgtattggctccagaaaaccaaaagtctagaagtgtgagtgttacgaatccttctgttgtaaatgttgaatccatgaggaatcatggtttggttggttgtgatgatgatgatgaagacatgcctcctggatttggtcctgtagctgcgaaagatgacgatgatttaccggaatttaactttaattcctccagtggaccggttacttcttctcctcgaccaccgttgcagtcccggtctttggatcaagtaagggagctcatactcaagtatggaaattcaacaggtagtggtagtaaacgaccatgggatggtcatgatgatgatgatgacgacgacattcctgaatggcaaccgcaactgccaccaccacctcctgacttgagtcctcaatttcatagcggaaccatggccagaccaccagcacaacgacctgttgcgggaccaccgagtggatggaaggccaatcaaaacgcacctaggcaacaacagtacagtgcacgtaggaacagaggattttgatctttgtgaatacgtttgatttaaat

SEQ ID NO: 61 - DNA, 1470 bp, Arabidopsis thaliana
ttaattaaggttgtctgttaatttgttgggaaataaattgaaataggagattgattggatggtgagaaggcaagaggaggagaagaaggcggagaagggaatgcgtctggggaaatacgagctagggaggacgctcggcgagggtaatttcggtaaagttaaattcgctaaagataccgtctccggtcattccttcgccgttaaaatcatcgacaagtctcgtatcgccgatctcaacttctccttacagataaaaagagagatccggactctgaaaatgttgaaacatccccacattgttagattacatgaggtcttggctagcaaaacgaaaattaatatggtaatggaacttgttaccggaggagaattgttcgacagaattgtttccaacggaaaattaacagaaactgatggaagaaaaatgtttcagcagcttatcgatggaatcagctactgtcatagcaaaggtgttttccacagggatctcaagctagagaatgttcttcttgatgcaaagggacatataaagatcactgattttggcctcagtgctctgcctcagcattttagggatgacggattgttgcatacaacctgtggaagtcctaattacgttgcgcctgaggttttagctaacagaggctacgatggtgcagcatcagacatatggtcctgtggtgtaatcttgtatgtgattctaaccggatgtcttcctttcgacgacagaaaccttgcagttctttaccagaagatatgtaaaggagacccaccaataccaagatggttatccccgggtgcaagaaccatgattaagagaatgcttgatccaaatccagtcacgaggatcacagttgtgggtattaaagccagcgagtggttcaaacttgagtacattccttcaattcccgatgatgatgacgaagaagaagttgacacagacgatgatgctttctcaatccaagaactcggatcagaagaagggaagggcagtgattcaccgaccattatcaatgcgtttcagttaatcggaatgtcttcctttcttgacctgtccggtttctttgaacaagagaatgtatcagagaggagaataagattcacttcaaatagctcagcaaaagatttactggagaaaatcgaaacagccgttacagaaatgggattcagtgtacaaaagaaacatgccaagttaagagtaaaacaagaagaaagaaaccagaaaggtcaagttggtttatcagtaacagctgaggttttcgagataaagccgtcactgaacgtggttgagctaagaaaatcttatggcgattcatgtttatatagacagttgtacgagagactattaaaagacgtgggcacatcctcgccggagcaagagatagtaacttaggtgttggtgttttcggctgaagagatatacatagctctaataatttatcatatggaacacaccatccatggcgcgcc

SEQ ID NO: 62 - DNA, 391 bp, Arabidopsis thaliana
tattattcatttatttgtcagctttcaaactctttgtttcttgtttgttgattaacccttaattaaatggcttctaaagcgttattgttatttgttatgctcacctttctattggtaattgaaatggaagggaggatacttcgggtgaattcaaagactaaagatggtgagagcaacgatcttttgaaacggttaggttacaatgtttctgaactaaagcgtattggccgagagctttccgtccaaaacgaagtagataggttttctccaggagggcctgaccctcaacatcactcttatcctctgtcttcaaaacctagaatttgaggcgcgccaaaaattggagctctgcagagctttcgttcgtatcatcggtttcgacaacgttcgt

SEQ ID NO: 63 - DNA, 2124 bp, Arabidopsis thaliana
atggctattgcacgaactggagtttatgttgatgattaccttgagtgtaagatccataatttctctctttatttgataaattttctctaattagttcgaattttagggttttaattgtacaattcggaaattcaatttcatgtagatgcaagcactttccctgcagagctacaaagattactaaacacagttcgcgaactagacgagagatctcaatgtaaatttttgttattacattgttctcttgcgtatgtttctttgtgtgtttcgtgaattgattatgtttgtgttttgtttgtcgttggaagcgcttataaatcagacaagacagcaaactaagtattgcttagggcttgcttcacagagttctaaaaagggtaatggtaatcattacaataatggtggtcttgatgaagaggaaacgattgagaaaatgcgtaaagagattgagtctagtcaggaaaatgcgttaagtttgtgtaccgagaaggttttattggcccgacaagcgtatgatcttgtaagttatatattcctctaaggcttcctcttgctatttaagtatatttgctgctgtgaatgttttgttgtctgtcacgaaaacattgatggatgtgtatgtattaattcaatcagaatctttgttgctaaagtctgaatatagctcctttggttgtttcagccagttttggtgttgtggtaattattatgtttattctggttgtagatagatagtcatgtaaaacgacttgatgaagatctgaataattttgcagaagatttaaagcaaggtatgtgattttagctcaggagctgtctagttactgttatcttaagggaattgattagaactatatttttcatattctaatgcttattcatgctaattattccaagagttttgttaatatgtgtgtcaaaattgatcgattgaggttattaagttcgtaattgattgagcatgtatccttacggcaagagtcaatctcttgtgtggaatccttgtatacgtcttgttttatcaataaaagggtcacatgtgcttataactcttttaaacttcctcttgaacaaccccttaagggttggtaaaaacatgcgtttcacctgcataaactttagtcagtgcacatcgattagtgtcaagcttcagagacacataaaatgtttatcttcagtcttgtcaaatcattagtggcattactttcatttttctatcgtggtcatatgataaacttttcaatgatgcattgatgaagtagttaaacgttttcagtattggcgttctctgtatttatcatgtttgttcttctctatcagagggaaaaattccaccagacgagccctctgttcttcctccactacctatagttcctaaagcggaaaagcgtaagtccttctatggcacacctcagcccaagaagattgattatagagatagagactgggatcgtgacagggattttgagctcatgcctcctccaggaagcaatcggaaagaccttatgccaattgaagagcagccaatcgatccaaacgaaccaacttactgtgtctgccatcaggtcctgaatacataaattttgcaaaatctgtaagttgcctgatcctgttgtgatctttggttaacattttcgttatttgtttcaggtgtcctttggagacatgattgcctgtgacaatgagaatgtgagcctgctctcccagcatcttattatttattttttaatgtatagctgttatgatgaaaccttttgttcctgtttcgacagtgccaaggaggtgaatggtttcactatacatgcgttggcctcacacctgagaccagattcaaagggaaatggtactgccccacctgcagactcctcccacagtcacactaatatcatttgtacctgtgagaaggtattgctttactatcatcagaactaagctctcctcctgcaatttccatgcattctgtagctaatataatacgtatggagatttgcacgtacttatgatattaattctcataggtgccactggcatcttctttggcaccttcccttcatgaccaatgccaccaaactcatctttcttgttacccaacatctagcaagtgcaagtagaagcaaactttag

SEQ ID NO: 64 - DNA, 1230 bp, Arabidopsis thaliana
atgactatggaagtgtcgaaaaagaaaggtggagattttcagcaatgtcacgaattgattcccggtttaccttccgaactagctttggagtgtttggtcagagttccgttccaattccaatccgccatgagatccgtttgccgttcttggcgtagcttactctccgactcttcttttatccaagaacggcggagatgcggcaaaacagagcttctcctctgcctcgttcaaccgctaacgccgccaattccagcgtctaaatcggttgacgagacattaatggttgacgagaaaaaatcagaggatgagtcacacccgcgcgttttctgcacgccgcgttttggattgagcgtttacaacgctgcgatgtccacgtggcatcgcgttgcgtttccagaggaggagcagatcccgcttttctgcgagtgcgtcgtgcttcaggacgccgggaagattctgctcatcggcggttgggatccggagacgttacagccgacgagagacgtttacgttctggaattcgccggaaggaagtggagacgaggtgcgccaatgaaggaatcacgatcattcttcgcctgcgcctccgtaagtccaacgaaggtatacgtcgccggaggtcacgacgatcagaaaaacgctttacgctcggcggaggtgtacgacgtcgagaaagacgagtggtcgtcggttactccgatgacggaaggaagagacgaatgtcaaggattcgccgttggtatgggtctaaggttttgcgtgctgagcggttacggaacggaatctcaaggaagattccgatctgacggagaaatttacgatccagcgacagattcatggtcgagaatcgacaacgtctggcgatttccagatactagcccgagaggtcgcaccgccggagactttagaagctcctctacgttatggtgtttcacagacactgatttacagagtgaacgtcgatgggaaactaacgatgattcgagaaatttgaaactggatcttcaatctatacagcttccgatgacaggaagctcagttttcgccggaagcttaggaggtgaatcggtggtaatgattggcggtaaaagagagagtgaaggtgaaggtgaaggaggagtgatgatgaagatgacgactgagaagaaaatgggaaaatggagtcatcatgttcatataccttgtgatttctctactcttccattttcgcatgcttcaatctatgtttga

SEQ ID NO: 65 - DNA, 1284 bp, Arabidopsis thaliana
atgaaagcgatccagttgctgtgggaagcgataatggaggcgacgaagagagaaagacggagagaagatgacgacggcgaaaaagcttcaccggaatcactcgttcttccaccagagatcattacagaaattcttctccgattaccagccaaatcgatcgggcgattcaggtgcgtatcaaagctcttttgcactttatcgtcagatccagggttcgcgaagattcacctcgatctgatccttcgaaacgaatccgtaagatcgctccaccgtaagctcattgtgtcttcacataatctgtactcgttagatttcaattcgatcggtgacggaattagggatttagcggctgtggaacacaattatcctcttaaagacgatccaagcattttctctgagatgattaggaattacgtgggggaccatctgtacgatgatcgtcgcgtgatgcttaagctgaatgcgaaatcgtatcgaagaaactgggttgagatcgttggatcttccaatggtttagtgtgtatctctcctggtgaaggagctgttttcttgtataatccaactaccggagattccaagagattacctgaaaattttcgtcccaaatctgtagaatacgaaagagataatttccaaacttatggatttggtttcgatggtctcactgatgattacaaattggtgaagcttgttgctaccagtgaagatattctcgatgctagtgtctattccttgaaggctgactcatggagacggatctgcaatttgaattatgagcacaacgatggctcctacacgtccggtgtgcatttcaacggtgcgattcactgggtgttcacagagagtaggcacaaccaaagagtggttgtagcatttgatattcaaaccgaggagtttcgagagatgccagtgcctgatgaagctgaagattgttcccataggtttagcaactttgtggtcggaagtctcaatggacgtctctgtgtggtcaatagttgctacgatgtgcatgatgatatatgggtgatgagtgagtacggtgaagctaaatcctggagcagaattcgaatcaacttgttgtataggtcgatgaaaccgctctgttcgactaagaacgatgaagaggttcttctggagcttgatggagacctggtgttgtacaactttgaaaccaatgcatcgagtaatctaggaatttgtggggttaagctcagtgacgggttcgaggcaaatacatacgtagagagcctcatatcacccaactcttatggtatagagagctga

SEQ ID NO: 66 - DNA, 456 bp, Arabidopsis thaliana
atgaagcgcagtactaccgactctgatttggccggtgatgctcacaacgagacaaacaagaagatgaagagtacagaggaagaagaaatcggattctccaatttagacgagaatctagtgtacgaggtgttgaaacacgtcgacgcaaagaccttagctatgtcatcttgcgtgagcaagatctggcacaaaacggcacaagacgagcggctttgggagctgatctgtactcgtcactggactaacatcggctgcgggcagaaccagctcagatctgttgtgttggcgcttggtggcttccgaagactccactctctttacctctggcctctctctaaacccaatccgcgtgctaggttcggtaaggacgagcttaaactcactctttctcttctctcaattcgatactacgagaagatgagtttcactaagagacctcttccagaatccaaataa

SEQ ID NO: 67 - DNA, 1374 bp, Arabidopsis thaliana
atgccctcctctgctactagcacatatctcctctctttaaaacaagtctctctcacagcttcttcaccactccttctccagctcaaagaccgtttctttcaccagccaaagctccttaacatgggattctcaactgggaaaagaaaatcaagagatgaagaagaagatagagtgagcttcttcgcttctgaattccccatggatgacctcaacgatgacgttctcgagagagtcctctcatggctaccaacttcttgcttctttcgtatgagctctgtttgcaaaagatggaaatcaagccaaacctcgaaaagcttcaagcttgcttgctctcaaatccctactcgagatccttggttcttcatgatcgacaacgattccaattcttcctccttcgttttcgactccactgagaactcctggaaaaatctcaaccgccgcgatttcctccaccaccaccgtcaagatttcatccccgtcgcttcttccggcggcttgctctgttaccgctgctccatctccggcgacttcctcctccgtaatccactcactggatcttctcgtgacattccttctcaagataacaacaacaacaaacctctccaagccgtagccatgaccaccactactgttactccctccagctatacgctcgttaccatctccggtgaaatcccaaatctcagtttcaagatctacgaatcaaacgcagattcttggagcaaagaccaagaactggaatcagtcaagaacaatgattcatcattacatgatgattatgatactgacagtggcacagtctactttcttagcaaacaaggaaacgttgtcgtggcgagtaacaatcttcagagaagtccgtcgaagcaatactcttccgttattaccgttacagatgaagccgaaatcgtctattttctcagctcttacggaacaattgtagcttgtgatctcactaaacgatgcttcaccgagctaccaaagcttcttcctccgttcctagagtactccatcgacttggtggaatgtgaaggaacaatgtatgtgattcttctctctgagttctttgaaagcgcaagtttaaggatctggagacttgacaataaccgggaatgggttcaagtcgggatgttgcctcccgcgttgtctcatgagttatacggtaagaaaggcgacataaactgcgttggaggagctggaaacaagatactcgtgtgcttcaatgctagtcctccagaagtgtattgtagatactttgtgtatgatttagttgcagaagagtggaacgagttgccgaaatgcttcaaggatggagaagctgtggattttgtttccgctctttctttccagcctaggatcgaggctacagtttga

SEQ ID NO: 68 - DNA, 1133 bp, Arabidopsis thaliana
atgtcatcgccggtgaagaagatgaagaagaagacgacgacgtcgccgatactctcaccgacgccgcattcgacccagattttatcacttcctgttgatttgctaataagtatcctcgcccgcgtctcgagattggactacccaattctctctctcgtctccaagagctttcgatctctcattgcttcaccggagctttacgagactcggtcactcttaggccgcacagagagctgtctctatctgtgcttagggatcccttctgactttaaccctcgctggttcactctctgccgaaaacctaagccaagtgggcatgttatggcggcaatctcaatccccaattctcgtcctgtacattgctctggtctcgttgctgttggttctgatatatacaacattggcggatccatcatcaatgaacactcctctagtgtctcgatattggactgccggtatcacacgtggcgtgatgctccaaacatgctggtggagcggaattcacatgcagccaatgttattgatgggaagatatatgttgcaggaggcagcagagactccaattcctccaattggatggaagttttcgatataaaaacccaaacttgggagcctgtgctaaaccctatcgcagatggatgtgacagacgtatacgcaagagcgcagtgattgaagaagctatctgcttgtttgggtataagggtgtgggtgttgcttacaacccaagaatagataaatgggaagcgataggagaagtgaattatttggatttaggatgggtatggcttcttgttgcgtgatagataatgtgctgtattgttacagtaatatagacggaatcaaattgtatgactctaagataggatgctggatgaagctcaagggtttggaaggattgcctgagtttgctagttattcttatgttagattagcggattatggtgggaagatggcggttttgtgggacaagttacctactactggcaataataacatggtgatttggtgtgcggtaatcacacttgaaaagcgccacaatgaaaacatttgggggagggttgagtggtttgatgctgtgcttacagtccctgagccttatgaattcgtgtgtgctcgttccgctaatgtttga

SEQ ID NO: 69 - DNA, 759 bp, Arabidopsis thaliana
atgtttagtgaagaagtattgaagaatgtgtttccattgctagaaggcgaagatctcgcgtcatgtatgggtgtttgcaaacaatggagagatatcgcaagagacgatttctactggaaatgtcaatgtgcaaagaaatggccatcggtttgcaaacggcacaaacctcctactgaaacatactacaaaatgtatcaaacgtttagtaagcggcggttaaaccgcgcgcttcctcctccgcgattgtcgttcgaaaacttggagtttttcatcgatatttggtcggaagagaggctcgtgttctcggggttaatacccggtgttgcgttggaaaatggtatcgaaacgttaccgttagggatcagtaatgttcttagaactcatcttggtagacctgattacaagatggttgttcctgctgagcctaggttcactattccgttaaaccagtctgttagtgtctctgttcttgtggcgaggaatgattctgataaggtcgctcggataatcaaccggtctgtgttcgattatatagaccggtcatcgtatagagcgcttgcgtttgagtatcttgacttgtctccttgttatccttttatctccggtatacgagcttggatctctttgctgtttatggatgttgaggatatgaatgatgatgggttactcgatgttttcgggattcagttggatttcaatgatgttgctgacactaaagaagaggttttgtggcttctagatatgcttgattggaagtga

SEQ ID NO: 70 - DNA, 1597 bp, Arabidopsis thaliana
atggatcttagtggttgtagagatataatcagtagtttaccagaagccattagttgccatatcctatccttccttcccactaaagaagctgcttccacttcggttctttcgaaaaaatggcggtatctctttgcttttgtccctaatcttgatttagatgaatctgtttatctgaatcctgagaatgagacggaagtttcttcaagttttatggattttgtggatagagtgttggcattgcaaggcaattctccattacataagttctctctaaagatcggagatggcgttgaaccagaccgtatcattccttggataaataatgtgttggaacgcggtgtatccgatcttgatctacacgtgtatatggaaacggaatttgtgtttccttcagagatgttcttgagcaagacactggttaggctgaagctaatgctatatcctctcttggaatttgaagatgtttatctcccgaagcttaagacgctttatattgactcatgctattttgaaaagtatggtattgggcttaccaagcttctttctggttgtcccatacttgaggatttagttcttgatgatataccttggtgcacttgggattttgcctcggtgtctgtcccaactctcaagagactaacgtttagcacgcaagtgcgagatgagtttccaaagagtgtgtctattgatactccgaatcttgtctacttgaagtttactgacactgttgcaggcaagtatccgaaagtgaatttcgattcgcttgttgaagctcatatcgatcttagattgttacagggccatcaaggttatggtgaaaatgatatggttggcaatgcaacagattttataatgcgtatatgcaatgtgaagactctctatctatcttccaacactcttcaggtttgttttcatcatgaaaaacaacttgtaatctttttaacattgttcaaggatttgagttagtgattgcaattgagtgatgataatctagttgttgtggttgtgtttcaggtacttacttacagttgtgatgctataccaatattcaacaacctgactcatttaaccatcgagagtaatcccgaagtaggatggcagtcattgccaggtttgctcaagaattctccaaatcttgaaactcttatcttccaagtaagaaacaaaacccttggaaagcatttgttgactcaatttttcaaagtttaagaatatttcactatgtatgtttcagggcctcatccacaaagccaccgataaatgtggagacgtgtgcttgtgcaaacctcgtgaggagattcgcagttgcttagcatcaagtccggtgaaggttataaagatactgaaatttggtgaaatcagtgatgacatggagaagcagagagagcagatcaagtatttcttggagacaatgccgaatcttgagaagatgattttgtactacaatacaacaagtgttgaagatgtaactgaagtttcaagccgacttcagaggctagtttctaaattagcttcatcgacgtgcattgtccaactaatctctgataacctcagcttgtcatctactgtatcgacaaatgggctcctctgtttctaa

SEQ ID NO: 71 - DNA, 3346 bp, Arabidopsis thaliana
ctcttattggtggggcaggaagatgaaagtttccacttttgttactttgctatgtttatttctgaagttttttgaggttggtgagtgattcagctttgttattgcagaaacttgttgaaaatggcaccgaatcttaggattaagaaagcctgtgacgcgatgaagcttttaggaatatcagagacgaaaacaagggcctttctcaggaaacttctcaagacctatgagaataactgggatttcattgaagaggatgcttataaggtccttcttgatgcaatcttcgacgaggctgatgcccaggtctgttttttctgcttaatcactttttattttctttatttgattgtttacatattctcacttagtcagttctctttctttgatatgtcatatggtagtccactgaaaaaaataagaaggaagaggaaaagaagaagaaggaagaggaaaagaagtccagagtaagttaactttctttaatttgatgacaattttctggtgttttttgatgttgtttcttctcaaggttttgatgatctttttttgtttctttagagtgtagcaacgagcaggggaaggaggaaagctcctgaggtatacgacctaaatatctttgttgttttagaatttgttatcatcatgaaacattaacttgtttttttttttggttaaaccaaactcagcctttggtacaagatgaagaggacgatatggatgaagatgaatttccattgaaaaggaggttgcgcagtagacgtggaagagcttcatcttcatcttcatcttcatcttcctataacaacgaggatctcaaggtatgtttagtatctgtttttcgggtttcttggtcatattatatagcctgtgtttattttgttttcggtgaaacagacacagcctgaagaggaagatgaagatgatggtgtgactgaattacctccgttaaagaggtacgtacgcagaaatggtgaacgagggttggcaatgactgtttataacaatgcaagtcctagctccagcagtcgcttgtcaatggagcccgaagaagtaccaccaatggttctattgccagctcatcctatggaaacgaaggtttctgaagccagtgcacttgttatcctcaatgatgaacccaatatcgatcataagcctgtgatttcaggtattgttacatgaactcaagataaaacttagtaatctttcttttattgctttttatgtggttgtgatgagatgttgaaacctttgcattttaacctgatctgtcttttgtgatgtttccttctgacacttcttttcattatttagatacaggaaactgttcagctcccatgcttgagatggggaaatcaaatatacatgtgcaagaatgggattgggaaaccaaagatattctcaatgatactactgccatggatgtgtctccttcttcagctattggggaatcaagtgagcataaggttgctgctgcttcagttgaattagcttcttcgacttctggtgaggcaaagatttgtctaagtttcgcgcctgcaactggagaaacaacgaatttgcatttgccttctatggaggatcttcggagagcaatggaggagaagtgcctcaagtcgtacaaaattgttcaccccgagttttcggtccttgggttcatgaaggacatgtgtagctgttacatagacttggcaaagaattcaaccagccagttgcttgaaacagaaaccgtatgtgacatgagtaaggcgggtgatgaaagtggtgcagttggcatttcgatgccgttggtggttgttcctgaatgcgagatctcgggagatggctggaaagcaattagcaacatgaaggacattacggctggtgaagaaaacgttgagattccatgggtgaatgagatcaacgagaaggttccttcccgtttccgttacatgcctcacagctttgtgtttcaagatgctccagtgatattctcgctctcaagtttctctgatgagcaaagctgctccacttcttgtatcgaagactgcctggcttcagaaatgtcgtgcaattgtgcaattggtgttgataacgggtttgcgtacacattagatgggttactcaaagaagaattcttggaagctcggatctctgaggctcgtgatcaacggaaacaggtgctgcgattctgtgaagagtgcccattggagagagctaaaaaggttgagattttggaaccatgtaaagggcatctaaagaggggagccattaaagagtgttggttcaaatgtggttgcactaagagatgcggtaaccgagtggtgcaaagaggaatgcacaacaaattacaggtaaaacattcaccttaactaacaatcttttacgtgtttttctttcatcttgttatataaatcaattagtttccatttttgatcagtcatctttttttcttaatatcaggtgtttttcacgccaaatgggaaaggctggggacttaggactttagagaaactgcctaaaggggcatttatttgtgagtacattggagagatattgacaattccggagttataccaacgtagctttgaagataaacccactttgcctgtgatattggatgcacattggggttctgaagaaaggttagagggtgacaaagctctgtgtcttgatgggatgttttatggaaatatctcaaggttccttaaccacaggtaatggcttcccctaaaactcagaacaccaatggtgtttctctctattttaaactgatgtttctttctgtcctttgatgtatgtagatgtcttgatgcaaacttgatcgagattccagttcaagtcgagactccggatcagcattattatcatgtaatgatacaatgacggtctcatatataatcttttgctcatatgtttcttctgttttggggaaattgtttaaactgtaatcttttccagcttgcattcttcacaacaagagacatcgaggcaatggaggaactcgcatgggtgtgtataatttcgcatatccattttatattaggctgagaagtttctataccgatgaaaatgattgtatattcctaatgcttactgatatcttgatatacattgatctgatgtaaccctttcacattctcaggattatggcattgacttcaacgataatgactctctaatgaaaccctttgattgtctgtgtggtagcagattctgcaggaacaagaagcgatcaacgagtgagtaatatcatcagagtttgttgattctgttacatgggactgagtaatatcaatcctgcatctcactgactgaattttttttacctttgttatgttccagagaccatgcagattttgaacaaagc

SEQ ID NO: 72 - DNA, 2567 bp, Arabidopsis thaliana
ttaattaaatgacgcgtgtcaaccagcttccatgcgactgtgtatctacggcggaggaatctctcacttccggcacgtgcattacccctacgcacgtgacttccctttcgtctcctcttgatcgctccggcgatgttgatcctcttcctgtttccgacgaatctggtggctcgaaggccgatgaatctatgactgacgcagatgagactaaaaagaggaaacggatactcagtggtgattgtgaagccgatgagaataataagagtgacggagaaatcgcgagtctcaatgacggtgttgatgcgtttactgcgatttgtgaagacttgaattgttctctgtgtaatcaattgcctgataggcccgtcacggttcgttctctctctctctctcgctttgtgttttgcctcttatacttgttaatgttagtgtatatgattgtttacacttgagttactaatttcacacaattttggagtagattccttctttttgtgcttaccatttatgatgaactacatttatagataacagaattgctaagttcaattaagttaatacttattatatacctgtttttgtatctctttttggttggatttgacattagttagttttgagttacttctcaaggtaacaaatctattgtgtagatgaaatttattagttaagagtagtagtatatgggttgtttctttatcatgttgaaattatgtgtgttggacaagttggtgttgttaaattttgtagtatatgggctgtttctttataagagtagtagtatagtagtatagtagcctaacttatatgtgtagttgaaatttatcatgttggtgttgttaaagtttgtgattgtttacagttttttaagtattaacttcttcttttcaaaataagtatttcagaaaaagatgaagactattacgttaggctgatggataatcttgtatgtgtatttttcttttcagatattatgtggacataacttttgcttgaaatgttttgacaagtggattgatcaagggaatcaaatttgtgctacatgtcgtagcacaattcctgacaaaatggctgccaatcctcgtgttaactcgtctcttgtgtctgttatccgttatgtaaaagttgctaaaactgctggtgttggtactgcaaatttttttccttttacaagcaaccaagacggcccagagaatgcctttagaaccaagcgcgctaaaatcggggaggagaatgctgcaaggatatatgttaccgtaccatttgatcactttggtcctataccagctgaacatgatcctgtcaggaaccaaggtgttttagttggagaatcctgggagaatcgagtagagtgtcggcagtggggggttcacttgccacatgtttcttgcattgctggacaagaagactatggagctcagtctgtagtaatatctggaggttataaggatgacgaggatcatggagaatggtttctatacacaggaaggaggtttgcttttctttactcctagcttttggtccatttgactcatgtagattttacttctctcatgtgtttagaagtatctattgtcctgtttgttgacatacttttgtttgttttcgtcttgaatatatgtggatgtgtcacccagtagagggagacatttcgctaacgaggatcaggagtttgaagacttgaatgaagctttaagagttagttgcgaaatggggtatccagttcgagttgtcaggttagcagaacaaaactccattgctctctcacattctcattttttcgttaagtttccgatatcgaaagttgtaccacaaaggtgaaatgtattgcttttctttgcattgaatgaagaatagagttatgctaagttccatagatacaactcttaatatcagtttccataatctaggtcttacaaggataggtattctgcatatgcccctaaggaaggagtgagatatgatggtgtatacaggatcgagaaatgctggcgaaaagctagattcccggtacacacatatagtgaaacaagcttgtaattttttccctgccctttatatgcattgacatgttcttctcattccataggattcatttaaggtctgtcgttacctgtttgtaagatgtgacaatgagccagctccatggaacaggtttggtctacttcttagaagcaccttttcgatattctgagtttaacactgtgataatattgcagtgatgagagtggagatcgtccaagacctttgcctaatattccagagcttgaaacggcctcagacctgtttgagagaaaggaaagtccatcatgggattttgatgtaagttccaattataacagttagcgagtgagacgtgagcagatctcgaattttctgtattgtgctgataataatatacgcttatattatcaggaagccgagggccgttggagatggatgaagcctccacctgcaaatcatgagcagagggagagaatgaagatggctatgacatgtcttctcctttttgtccttatcattctcgttggttcatcatctatcttatatcagtattagggcgcgcc

SEQ ID NO: 73 - DNA, 1359 bp, Arabidopsis thaliana
atggcatctggtgttttcgaggatgaagctgaaggaactataacgatcaatgaatatatcgaaaggcttgacgcagaagagctggcagcggatttggtgttgggtggagatgaaggagatgagtgtactttcccaaagggttacatgaaaaggcaagcaattttctcatgcattacatgtacaccagaggggaatgctggaatttgcactgcttgttgcttatcttgtcatgatggccatgagcttttggagctgtggactaagagaaattttcgatgtgattgcgggaactcaaagtttggaactttggcttgtaagcttctcccgagcaaagatatagaaaactctgaaaattcttacaaccataatttcaaaggcttgtactgcacttgcgaccgaccttaccctgacccaaatgtggaagaacaagtagagatgattcagtgttgtctctgtgaggattggtttcatgaggagcatctcggtctcacaccttcagacagtgttggtagccagattccaagggatgaggaaagtgagccgatctatgaagatttcatttgtcaaaactgctccccagcatgttcgtttctgacactttatcctgagaacttgtgggttgttgctaaagtagattccactggttctgctaatgcttgttcagagacaattgagttagacaaaaaccacatggattctgaacccggccagccagagaacggtactgatgctgagaaatctgttgtaggaaaatgttctgagacgatcagtgactcagaacctggccagcctgagaacggcactgaagccgagaaatctgttgtgcaaaaatgttctgagaagatcgatgaatctgaagccggccagcctgagaacagtactgaagccgagaaattcgttgtgcggaaatgttctgagaagatcgatggctctgaaaatgttcctgcagctggttgtgttattaggactgatctaaactcgtgtcctgagtttgagaagaaacctttgtttttgaccaaaaactggaggaacatcctatgcagatgcgaaaagtgccttgagatgtataagcagagaaaggtaagctatctacttgatgcagaggacacaattgttgaatacgagaagaaggcgaaggaaaaaagaacagagaaactggagaaacaagaaggtgaagcacttgatcttctgaataatctagaccacgtatccaaagttgagctccttcacggaatcaaagacttccaagacggactccagggtttaatggagtctgctgggccatcaaaggcgataacttctgcagatatcgagcaaatgttttcaaaactgaaaaacaaacgtaaaaggatggagtga

SEQ ID NO: 74 - DNA, 2512 bp, Arabidopsis thaliana
ttaattaaatgtcgaactgtttgcaattgaatacgtcttgtgttggttgcggatcacaatccgatttatatggaagctcttgtagacacatgacgttgtgtttgaagtgtggtagaaccatggcgcagaataaatctaagtgtcacgagtgtggaaccgtcgttacacgtttgattcgggttagattttgtgtgtttcttcaaacaattttgagtttctgaagaaaattttgataaaattgttgtttgggtgaaattgtttaggagtataacgttcgtgctgcggcacctacggataagaactacttcattggtagatttgtgactggtcttcctaatttcaagaaaggttctgagaataaatggtctcttcgtaaagatataccgcaaggtcgtcagtttacagatgcacaacgggtaattttgtgtttgttttggatcataccaatcattttgatggtttttacaatgagttttgtgtggattctaatttttgtaggagaagttaaagaacaaaccttggatcttggaagatgaaactggacagtttcagtaccagggacatcttgaaggctctcagtctgctacttactatctcttagtgatgcagaacaaagagtttgttgcgattcctgctggttcttggtatggagaatcaaattaccgttgcttcttctgttgttgtattatccgaattctgattatttttgtgctgtgttaggtataacttcaacaaggttgcacagtataagcaacttacattggaagaagcggaagagaagatgaagaatcggagaaaaacggctgatggttatcaaaggtggatgatgaaagctgcgaataatggtccagcgttgtttggagaagtggataatgaaaaggagagcggtggaaccagtggaggtggtggtaggggtcgtaagaagtcatcaggcggtgatgaagaggaaggaaatgtttctgacagaggggatgaagatgaagaggaagaggcgtcacggaaaagtagacttggacttaatagaaagagtaatgatgatgatgatgaagaaggtccaaggggtggtgatcttgacatggatgatgatgacattgagaagggtgagtgatctattaccaaatgatcgtcaagaagcttaagaatgactttagcattttcgtcaatagattgacatgattgttcttcattgtctatttaacaaaactgctgaaatgtctgtaaattataatgcattcaggggatgactgggagcacgaggaaattttcacggatgatgatgaagcagtcggtaatgatcctgaggaacgtgaagaccttctggctcctgaaattcctgctcctccagaaataaagcaggtctgtacttactatagtgctttacttccaatgtacaattttctgtgaaactaactgtagtaatttctgttggtaatcccatttatatgttatccaagtttcaatgtttactaattacaggattgttgtgcctttacttcctatgaggtcgtaactttcttttgacatcccttgcaggatgaggatgatgaagaaaatgaagaagaggagggaggtttgagcaaatctggtaaagagttgaagaaactgcttggtaaggctaatggtttggacgaatctgatgaagacgatgatgatgattctgatgatgtaagccctcttttgacatattttacttcttaaaaaattgttaaattttcaatcaaactcattttatctggtttggatacacgcaaatcatcatgaatgtcattcttaggaggaggagacaaactacggtacagttacgaactcaaaacagaaggaggcggcgaaagaagaacctgttgataatgcacctgcaaaacctgcaccatctggacctcctcgtggaacacctcctgcaaaaccatccaagggaaagagaaaactaaacgacggcgattctaaaaagcctagcagctctgttcaaaagaaagtgaagactgaaaatgtaagatacttgatttctatgtttgagaaagagttgatcgtttgtgctggatttgatttctaacaaacaggtttctgtaatctttgtaagcaggatccgaaatcttctttgaaagaagagagagcaaacacagtttccaaatccaacacaccaacaaaagctgtgaaagctgaaccagcttcagctcctgcatcatcatcctcagctgcgactgggcctgtgactgaagatgaaatccgcgctgttctgatggaaaagaagcaagtcactacacaggatcttgtttccaggtttaaggcaagacttaagaccaaagaggtaatatttagtctaatattccttcttgaagtgaccatatggtttttatctgagcttattctggacaaatcaatcgtttgtgttatataactgtgtctttttacaggacaagaatgcctttgccaatattctgaggaagatctcaaagatacagaagaacgctggttctcaaaacttcgtcgttttgagagaaaagtgaggcgcgcc

SEQ ID NO: 75 - DNA, 2075 bp, Arabidopsis thaliana
ttaattaaatggatcaggttggtgtaaatagttgtttcagttcttactcttttgacgagagtctctgttaatgtgctcttattaatgcagtacgagaaagttgagaagattggtgaaggaacttacggtgtggtttataaggcacgtgacaaagtgactaatgagacaattgctttgaagaagatcaggctagagcaggaggatgaaggtgttcctagcacagcaatcagagaaatctccctcttgaaagaaatgcagcacagcaacattgtcaagtatgatgttaataccattgttgaaaactgattcagcatgatgactctggtaaacaattttgattgatgttttttgctacacagattgcaggatgtggtgcacagcgagaaacgtttgtatctggtttttgagtatcttgacttggatctcaaaaagcacatggattctactcctgatttctccaaggatctacatatgatcaaagtgagtgctaagaaactttaggcattgttttatatatgtgcttaaactcaatactcaatataagctgatcagagctgttcatccactattttcagacatatctttaccagattctccgtggaattgcgtattgccactctcatagggttctccatcgtgatctgaagccacagaatttgttgattgatcgccgcacaaactcactgaagcttgctgattttggactggccagagcattcggtatccctgtcaggacatttactcatgaggtaccaaagagctttattccttgttcatatgttcccgttatgaaatcttttggctggctgcattccttatgagtgtaatgtaaattaagtattataccacttatgtgtctgataaatgtgatgaaaaggactaagccatttcacatagacggttgaagtaagctagttcaagatactgtaaaatatttcaatgctacatccagatttcagatctcttcctggttattcacacaatttttgcatattgttcctttaggttgttactctctggtaccgagcaccagagatactcctaggatctcatcattactctacacctgttgatatttggtctgtggggtgcatatttgctgagatgatcagccaaaagcccttatttcctggagactccgagattgatcaactcttcaagattttcaggtttaattgctaacttccccagtccaatattcctctatatattacaagtgcaaagacttgtctgcaatgatatcacaagggattgtggaaacattttcaacttgatatcacattttggagaagtagtaaaggacacagaaattgaattgttaactgattataaatctgttactgccttgttttgttgtcttcttctagaatcatgggaactccgtacgaggatacatggcgtggggtaacttctctaccggattataaatctgctttccctaaatggaaaccaacggtacttcaaatgtctttattcgcttgtacatcttgtcttcagtagtcaagagttcacaacatatattaattcttgcccttgtttttttttcttataccacaggacctagaaacttttgtccccaatctagatcccgatggagtcgatctcctttctgtaagttcactgagctagatatatacacacacatatatagacacactacttctgctattagagacctgtatgcttgattgtgatggatctggtctcatgtttcttactaaaaaccttttaaccatttgaggttttagatgtcttataaagtcatcaagagccggcgtactaaaaccaattcgattaggcttcatagtttcaaaaccacatgaagccaaaaccaaacttgtttgaaatatgaacaatcttcaaaaaccaggattcttgaaattcctaaccaaaccagacatctggatagaaatctaagattttgagctcctgtgaaagcaaagatgataatatatctctctgcttgatttgtttcagaaaatgctgttaatggatccgaccaaaagaatcaacgcaagagccgccctggagcatgaatacttcaaggatcttggaggcatgccttagggcgcgcc

SEQ ID NO: 76 - DNA, 4932 bp, Arabidopsis thaliana
gagattccataagaccataaccagtagacaacaaattcttcatcattttgtgtctcttgtttgagatcccggtgaaatttagcggcgacgagaaaattttcaggtagagtgtgttaaaaaatgtctagagtgagttttgaagtgtcaggaggctatcactctgatgcagaagccggaaacagcggaccaatgagcggtggtcaattaccaccgatctataaaaaaccggggaactccagattcactgctgagaacagtcagagaacacgtacggcaccatacgtggacctcacggtagatgtacaagacgatacagtctctgtacatagcttgaaaatggaaggtggatctagcgttgaagagagtccggagcttactttgctgaaacgaaaccgtcttgagaagaaaacaacggtggtgaaacgtttggcgtctgtttctcacgagcttaagcgtttgacatctgtttctggtggtattggtggaagaaagccgcctcgaccggctaagttagaccggactaaatccgccgcgagtcaagcgttgaagggacttaagttcattagtaaaaccgacggtggcgccggttggtctgccgtggagaagcggtttaatcagattaccgcgactaccggtggactacttcttcggacaaagttcggtgaatgcataggtaaagactaatgttataatcttgaaaagtgattagaatgttttttttttgtactgattgaatgaaaatttggtattgtaggaatgacttcaaaggattttgctttggaactgtttgatgcattggctagaagaaggaatataacaggggaagtgattgatggagatcaactaaaggagttttgggaacaaattaatgatcaaagttttgattctcggcttaagacattctttgacatgtatggttttcggttactgatttttgtttcttttactttttctttctctagaatgtgaatctgaaagtgatgataatgcagggtggataaagatgctgatggtagacttacagaagacgaagttagagaggtaagaaatacagagtgttataagttatatctgctctgtttcagtgttaactctgttttggtcttgttgttgtgtgtttacagattatcagtcttagtgcttctgcgaataatctatctacaatacagaagagagctgatgaatatgcagcattgatcatggaagagttggatccagacaatataggatacatcatggtaagtaattatcagctgtcttgacgatttgccatattatgtttgagacttgaagcatttgtggtgaatcttgaaacagttggagagtcttgagactctgcttttgcaagcggcaacacagtctgtgataacaagtactggggagagaaagaatctgagtcatatgatgagtcagaggcttaagcctacgtttaaccgcaacccgttgaagcgatggtaccgtggtcttagattcttcttgttagacaactggcaaagatgttgggttatagtgctatggttcatagttatggctatactcttcacctacaaatatatccaatacaggcgtagccctgtgtatccagtgatgggtgattgtgtgtgcatggctaaaggtgctgcagaaacagtgaagctgaacatggctttgattctcttacctgtttgtagaaacaccatcacatggcttagaaataagaccaggttgggtcgtgttgtcccatttgatgacaatctcaacttccacaaggtaaacaaacagacatattctaaaaccttctctgttttaggaatttcttataatatactgatgcttacaaaattaggttatagcggtggggattatagttggagtaacgatgcacgccggggcacatttagcgtgtgatttcccgcggttactacatgcaactccagaggcatataggcctttaagacagttttttggggatgagcaaccaaagagctactggcattttgtaaactcggtagaaggtataaccggacttgtgatggttttgttaatggcgattgcattcacactagccacgccttggttcagaagagggaagctaaactatcttccaggaccattaaagaaactagctagcttcaatgccttctggtacactcatcatttgtttgtcatagtctacattcttcttgttgctcatggatactacttgtatctcaccagagactggcacaataaaacggtacattaaatttagctcctttggatcacaaggtacatatataagctagttcgatcataatcatttggtcataaaaattgttgcagacttggatgtatttggtggtaccagtggttctatacgcgtgtgaaaggttgataagagcattcaggtcgagcatcaaggcggtgactattaggaaagtagcagtttatccaggaaacgtgctggcaattcacttgtcaaggcctcaaaacttcaaatacaagagtggtcaatacatgtttgttaactgtgctgctgtttctccatttgaatggtatgaaccaaaccgctaacttcacatagtgcatcatccgaacatacatctaataagtgttcatcatgatgcaatgcaggcatccattttcaatcacatctgcaccacaagatgattacctaagtgttcacattagagttcttggggattggacacgagctctcaaaggagtcttctctgaggttattactataatgtctctatttaaccgatctgtgttgaatttaaagagtttgatatgaatgtttttgcttaatgtgttgtttcaggtgtgtaagccaccaccggcaggagttagtggtctgcttagagccgacatgttgcatggtgcaaataatcccgagtaagtaaaaatcctaaccactctatcttgaaaaatgtaatccatgcgtcgttatctttcatctacacgtaaatgactaaatcatgctaagtggttctagaaggtttttgagaggatgcatcatgactcgtgaatcgtgatatccacttaggaaaagcattgttgagtatataagggtaacaaattcaaacaatgtacctaattcattataataaagcggtgtgggagaccacaactaaaacaaactatgtacctaaccaaaatatcactattctatttaggtgattgagacgcattatttggttatatcatgcaagcacgatgttttttagcttctccatgtgaccgcgtaaatctttgggttgcaatatcttatttctcaaccttttccttgaaaaacctttgcaaggtgatcggataattaattaggctaggtcaacattctacgtttttaaaaaatattttgcatcacgtcaattcatattttattgtcgatttactttataaagttcctttttctaaataaaaataaaataaagagatgctgactttttaaatggtcttcgtagtttcctatcttatagcttgggttatatgggcacatcacatgtagatataatatagatccagctcatctaggtgtacgaatatacttgcaagtgttcacatgccaaattaatatgtttcgttaggcatatgatttttcaattcatttacttctacttaatcttggttttgattgttcacatgccaaaataatttgttttggataagcatatgattattctattcatttatccaatttgaaactgtttttggttttataggttttatctttgggtgccattaatagtgttaactatctagctagcaatacaaaatgtaatcattacttatagtttgtacgtacctaatatcttatttggagtcgcaagagatacttaattaacatggcaataactagaaagatggtatgtgtatatacgtaattaagaaatagtcttacattatttgatccaactaacgctgcaagatgtatcagattttaaaagatgttagttaatagttaatatgacgagttatgtttagaacttttacttataccaaaatagatgtttaaatttttacttaatatttggctacaaccaagatattttgttatctgaacaattccatctacgtttagtctctttcttttgctttggctaatggcaatgacactgattccacagcttcccgaaagtcttgattgatggtccatatggtgcaccagcacaagactacaagaagtacgaggtggttctactagttggtctcgggattggagccacaccaatgatcagtatcgtcaaagacattgttaataacatcaaggccaaggaacaagcccaactaaaccgaatggagaatggaacaagcgaaccacaacgaagtaagaaagagagtttcaggacccgtagagcttacttctattgggttacgcgtgagcaaggctctttcgattggttcaagaacataatgaacgaagtcgcggaacgagatgccaaccgcgtcatcgaaatgcataactattgtacaagtgtctatgaagaaggtgacgctcgttccgcacttatacatatgcttcaatcactaaaccatgcaaagaacggcgtcgacattgtctctggaacaagagttatgtcccatttcgctaaacctaattggagaaatgtttacaagcgtatagctatggatcatcctaacaccaaagttggtaagctcacatctctcttctctactatgttcgcggttatatagaaatgaaaagtgattggattaaagaatcttgattttgtatgtgcaggagtgttttactgtggagcaccagcattgacaaaggagctaaggcatctagctttagatttcacccacaaaacaagcaccagattctccttccacaaagagaatttctaaaggacacacagagttaaaaggcctaaacaaaaaaaataaaagaaagaagcatgagttattatgtttttcgtaattttacttcccttactattttttaaaacattaatatttgtatacata

SEQ ID NO: 77 - DNA, 810 bp, Arabidopsis thaliana
atgaaaatgaagaagaaaggaaaagtttatccatctcctcctcctcctcctcaatcttcatcatcttcttcttcttcgaaccatctcaacgaagaagatgatgattctctctctgtgttgaagcttcttccagcgacgattttggttcttgtttctgttctctcctctgaagaaagagaggttcttgcttacttaatcacaagaggaaccaccatttccgatagaggaaactcttcttcaaagaataagacgaagaagaagagcaacaaatctagcaaaaatcacaagccaccagttttcgattgtgagtgtttcgattgttacactaactactggtttcgttgggattcttcgccgaatcgtgagcttatccatgaaatcatcgaagctttcgagaatcatcacggtgaagaaaactctgcttctcggagcaaatctaagagaggtaagaagaaagagaaaccgggtcgtcgggtcactgattcggatagtaaaccggctcttcgggtcacggataatggtgataaggattctaaacccgtcgtggagccaatgaacgagaccactgtttccgagagtagccacgtgtcgtcaccagttagattgagtgaagctgaggtggcagaaggagaaccggaggatgagattgttgttgaagaagatggacaagaagaagaatcgacggtggtggtttttccggcggcggcgagtaatgtgacgggacacaaagggttggcgaggaaggtattaccggacgtgttgggtttgttccattccaatttttggaggctttggaatccgaacgcgtaa

SEQ ID NO: 78 - DNA, 1929 bp, Arabidopsis thaliana
ttcttgtttgttgattaacccttaattaatccgggcgcgcctgatttatcacaagtttgtacaaaaaagcaggctcctgcaggaccatgtctcttcctgaaactaaatctgatgatatccttcttgatgcttgggacttccaaggccgtcccgccgatcgctcaaaaaccggcggctgggccagcgccgccatgattctttgtattgaggccgtggagaggctgacgacgttaggtatcggagttaatctggtgacgtatttgacgggaactatgcatttaggcaatgcaactgcggctaacaccgttaccaatttcctcggaacttctttcatgctctgtctcctcggtggcttcatcgccgatacctttctcggcaggtacctaacgattgctatattcgccgcaatccaagccacgggtgtttcaatcttaactctatcaacaatcataccgggacttcgaccaccaagatgcaatccaacaacgtcgtctcactgcgaacaagcaagtggaatacaactgacggtcctatacttagccttatacctcaccgctctaggaacgggaggcgtgaaggctagtgtctcgggtttcgggtcggaccaattcgatgagaccgaaccaaaagaacgatcgaaaatgacatatttcttcaaccgtttcttcttttgtatcaacgttggctctcttttagctgtgacggtccttgtctacgtacaagacgatgttggacgcaaatggggctatggaatttgcgcgtttgcgatcgtgcttgcactcagcgttttcttggccggaacaaaccgctaccgtttcaagaagttgatcggtagcccgatgacgcaggttgctgcggttatcgtggcggcgtggaggaataggaagctcgagctgccggcagatccgtcctatctctacgatgtggatgatattattgcggcggaaggttcgatgaagggtaaacaaaagctgccacacactgaacaattccgttcattagataaggcagcaataagggatcaggaagcgggagttacctcgaatgtattcaacaagtggacactctcaacactaacagatgttgaggaagtgaaacaaatcgtgcgaatgttaccaatttgggcaacatgcatcctcttctggaccgtccacgctcaattaacgacattatcagtcgcacaatccgagacattggaccgttccatcgggagcttcgagatccctccagcatcgatggcagtcttctacgtcggtggcctcctcctaaccaccgccgtctatgaccgcgtcgccattcgtctatgcaaaaagctattcaactacccccatggtctaagaccgcttcaacggatcggtttggggcttttcttcggatcaatggctatggctgtggctgctttggtcgagctcaaacgtcttagaactgcacacgctcatggtccaacagtcaaaacgcttcctctagggttttatctactcatcccacaatatcttattgtcggtatcggcgaagcgttaatctacacaggacagttagatttcttcttgagagagtgccctaaaggtatgaaagggatgagcacgggtctattgttgagcacattggcattaggctttttcttcagctcggttctcgtgacaatcgtcgagaaattcaccgggaaagctcatccatggattgccgatgatctcaacaagggccgtctttacaatttctactggcttgtggccgtacttgttgccttgaacttcctcattttcctagttttctccaagtggtacgtttacaaggaaaaaagactagctgaggtggggattgagttggatgatgagccgagtattccaatgggtcattgactcgagacccagctttcttgtacaaagtggtgataaattggagctctgcagagctttcgttcgtatcatc

SEQ ID NO: 79 - DNA, 1218 bp, Arabidopsis thaliana
atgaagaacggtatagctgagtgccctgcatgtcattcaaaattggtctctcctggtagcaaaactatttctagggcttatgacgaccacaagattagggtatcctcaaaacaacgtgtcctcaatgtccttttggttgtaggtgattgcatgcttgttggtctccagcctgtcttggtgtatatgtcgaaggtggatgggaaattcaacttcagtcctattagcgtcaacttcttgacagaaatcgcaaaagttatttttgcgattgtgatgcttttaatccaggccaggcaccaaaaagttggagagaagcctcttctatccgtttccacatttgtccaggcagcccgaaataatgtgcttcttgctgttccagccctgttgtatgcaattaataactatctgaagttcacaatgcagctatatttcaatcctgctactgtaaagatgcttagcaacctaaaggttctggtcatcgctgttctattaaagatggtaatgaagcggcggttttctatcatacagtgggaggcacttgctctgttgctgatagggattagtgtaaaccaattacgttctcttcctgaaggtgctacagccattggaattcctcttgctacgggtgcatacgtctgcaccgttatctttgtcactgtcccgtcaatggcatctgtcttcaacgagtatgctctaaagagtcagtatgacacaagcatatatcttcagaatttattcctctatggttatggtgcaatattcaactttcttggaatactaggaactgttatatataaaggtcctggcagctttgacatcctacaaggacattctagggctaccatgtttttgatactgaacaacgcagcacaagggattttatcgtcctttttcttcaaatatgcagatacaatcttgaagaaatattcatcgacagttgccacaatatttactggcatagcatctgctgcgctctttggacatgttataaccatgaacttccttctcggaatttctatcgttttcatttcgatgcaccagttcttttcaccacttgccaaagcgagagacgagcaacaacagaatgggaacctagaactaggcaacacaaaggatactcacagggctaatgaatcattcatcaacatggccgcaggagcaaatgaagaggctagtcaccgcggtgaatcagacgacaggactccactgcttcccagatga

SEQ ID NO: 80 - DNA, 1914 bp, Arabidopsis thaliana
ttaattaacatcctttgcctcaacccaatatggacttcttcacttcaagcaaagctaagaaagatagcaaaaaatcatcaggactctttggcaagaaaactgtcagcaagagcactccgggcagccctgctcatccccccggcgctagatccccgcccccatcgtatctttcaaacaaaagagccgaaacagagtacgatttccccatgtccaatgaacaaagaccatactggaaacagcctgcctctgaacgcgtccccaactcccaccctaggcctcccgtgtatggatacggcacgcccgaccatcgtcgagaccacggtagagaaagaatggaggccatgagttatgagccagagaccaacgctccttccagcccatatcatccagctggaaaccgcacgcctgaacgtcctaggaaatcaaccgagtatcgtcgagaacaccaggatcgaatgtatgaagcagatacccgaagcaatgcgagcccatttcacccattcagaagcccttctccatctccattccacacgcctgatcgccgcagagaccactacgacatgtatgagcctgaggccaacaccatgctgcagaatagcgctccagggagcccattccatccagctggaagccgctctccaccaccatacagaacgcctgatcgtcgtagtaactatgataaagagcaatttgaggacctgtacgagcaagatggtgatgtcacaccgcgaaacagctctccaccgagcccgtttcatccagcagcatacaaaacgtctgatcaacgtagtaaccatggtaaagagcaaattgaggacttttatgagcaagatgacgatgtaacaccacgaaacagctctccacctagcccattgcatccagcagcaagccattcaccaccaccaccacaaccatacagaacgcctgaccatcgtagaagccaccaggataacgaggatttcgaggcaatgtatgagctagatggcgacttaatacaccagaagagcgctcctccgagtcccgttcatggaccatactattcatccagcgacgacgataatcactccacctacctctatccagaaatccgcagcccacttcgttccaggatcgtatccgagaacagcacgcctgttcaccacaactaccagatagttgcggccgagacctatgagcaagacaagcagttcgagccgccggagctgcctgacgagtcacaaagcttcacaatgcaggagattaccaaaatgcgaggactcaagaactacgaaagcggcaaggaagagagtcaatcaatgatatccgaggcttacgtatccgtcgcgaattacagagtgaggcagagcgtgtcggaaaccctgcaggcgatcatcgacaagcacggcgacatcgcagcctcctcgaagctgcaagcaatggcaactcggtcttattacctggaatccctagccgctgtggtgatggagctgaaaaagacggttctgagggatttgacgaaaacgcgcgtggcggagatcgcggcggtggtgaaagacatggagtcggtgaaaatcaacgtgtcgtggctaaagacagcggtaacggaactggcggaggcggtggagtatttcgggcagtacgacacggcgaaggtggagaaagaggtgtgcgagagagatctgacggcgaaaaagggggagatggaggagatgacggcggagctggtgaagagggagaaggaaatcaaagaatgcagagagaaggtgacggtggtcgcagggaggctagggcagctggagatgaaaggttcgaaattgaacaagaatctcgacctcttccagtccaaagtccacaaattccaaggagaagccgtccttctccacctttagctccgtctccaatttcttccgttttggatctcattattggcgcgcc

SEQ ID NO: 81 - DNA, 1532 bp, Arabidopsis thaliana
atggtggtgacgtctttctcttcagcgccgcctatcttcttcttacctggagctgatgctcagttttcttcttccaatggaaggtttgctattccttcctcttctctcgtgtaagtctttctctgaaactctgtttttcaaattacagttctctgttctcttattctggttgaagttttgaattttcggaatgaaaagcgtatgtagtgttctgcctcgtaatttttgtaattcgtgatctgggtttgtgatttttgttgttactcgccaccaaagtctctgtttttcctctgaacttctaaaatcagaatccattttgggtaattgagatttctccaattgtgactttgatttcttctctgttgattgggttaagatgctttctatgagtaatgtttgaaattcaaatcctttattcatcatcgtgtttaagatccaaatgtaatcagtgaactgtttatagtttggaagcggtttagttcctattggatctgtttcatttcacataatcacacttgtgttgtgaatatttgctcttgcgttttggataagtttacttattggtaccgaattgatagttattctatacatgagataagcattcctcttattctgcttctcttctcttacttacttacataccctgtgtttgttccattgccagctttatttcttcttttcttttatgacatttgttaatctaagttggtaataagatcatgaagaagaagcattggttttatccaatttaggagtcattgatcagttgttatcattacgtttgataaatagacaacttctcattcattataaacatgtatttttcatcagaaagggactaagaagacaccaagatgcaaagttggtgggcaacagagccagagttggagtagtacgagtcctagcgaacccaaatgtataacattaacctttttttgcagttatagattttgctatcttagtagtgttttcgttcaggacaccaagtcatactcatgtcatgtttgatcttcttgttggttgatatgatatgaccattggtttaaacttactgacatgctgagtgttcttgtaggtatctcctcctcctcctccaggaaaagcaaaggtaaaaaaagaggtaatcatggtagaccctcttgaggctaagcggttagctagtaagcaaatggaagagattaaaggcagagaaaagcaacaggtgaggaaataaaccctctggacgaatgatgataaattgtatacaagatttgtggagatagcacagaagtttattctctcgtttgctttacagagaaggcgtgaaatagaggctattaacggagcatgggcaatcataggactcatgatagggctggtgatcgaagctcaaacggggaagggtattctggctcaggtatggtttacttatacttcctcagtgttgttgataaatgaaaggcttttttactaaatcgtgaggttgctatttataactgcagttggctggttattggtctgcagttgtccatttgttcactccatcaacttag

SEQ ID NO: 82 - DNA, 1054 bp, Arabidopsis thaliana
atggcgtttcctccaccgatccatggttccgatgcaccgccgccgccacagccgccgtcggtggtgaacgggattgaaacctctagacggcagcagcaacagattgcagcagcttcttcttcgccggtgaaatctcatccgcttcataacttccctttgtctgatctcagatgggctatgaatcacgccaatacacaccggctccgcaaagcatcgagtagatctccgcttcgtgaagctaatactgggaaaggaaatctggtgattgaggaggtgaacgaagcttcaggttcttcgtttgaattgagaccggagaagaagaagggaaacgcgtctggtgttagcgattccgccgcagatagatccgcgacgaagtcaacgacgccggacggtagatcgaagatctttatacggatccgcacgaagaacaacgaagaaacagctgtatcgactgatatcgccacctccgtcgccgcctctgttcaagtgactgatgattcagctggtccggcgatcgatgctgaaggtgaacggatctccgatggtggtggtcaggaagcagacgagtttggaccgaagacttggaatctgaggccgaggagaccaccgccgacgaagaagcggtcaattggacacggcggtggggtattgaagagctgtaacggtgctttaccggagaataaatctctgggaacggtaagaacagagtcaatacgatcgaggaacggtgtagatgctaagatggcgacgacggaaagaaaggagaagaaaccgaggttatcgatatcgctctcaaagctggagatagatgaagatatctacgcgttgactggatcaaaacctagtagaagaccaaagaagagagccaagaacgtgcagaagcagctcgatgtaagattttcacgttgaatcagaatcttacctttgttttactcaaacctgacctaacaatattggcttgaattgttgtatgatcgtttttcaggttcttttccctggtttgtggatgggtaacgtttcttcagaagcatataaggtctcagaacatgcttga

SEQ ID NO: 83 - DNA, 1068 bp, Arabidopsis thaliana
atgggagaggaagagaagaaaccagaagcagcagaggaaaagaaaatggaagagaagaaaccagaagagaaaaaagaaggagaagacaagaaagtggatgctgagaaaaaaggagaagattctgacaagaagcctcaagaaggagaatctaacaaagattccaaagaagattctgctccggcggcgcctgaggctccagcaccgcctcctccgccgcaagaggttgttcttaaggtttacatgcactgtgaaggatgtgctagaaaagtccgccgttgtctcaaaggcttcgaaggagtggaagatgtgatgactgattgtaaaacggggaaagtggtggtgaaaggtgagaaagctgatccattgaaagtattagctagagttcagaggaagacccaccgtcaagttcagcttctgtctccgattcctcctccgcctccgccgccggagaagaaagcagaggaggataaacccattgtggaagagaagaaagtggagcctccggtggttgtgacggtggttcttaaggttcacatgcactgtgaagcttgtgcgacagagatcaagaaacggatcatgagaatgaaaggagtggaatctgctgaatccgacttaaagagttctcaagtgacggtgaaaggagtttttgaaccacaaaagcttgtagaatacgtttataagcgaaccggaaaacatgctgcgatcatgaaaatcgacccaccgcctccaccaccacctgaggaggcggctgcggcagcggaaggagagaagaaggaagaagaaaagggagaaggagaatccaaaggcgaagaagggaaggatgataaggcgaagacggacgaagaaaagaaagaaggggatggtggtaaaggggaaggcgaagcagcggataatggcggtggggaggaagaaggcaaagttgtggaggtgagaaagatagagaatccttattactactactattaccaaccaccgcgtgtggcgattccgcctatggaaatgccgccacacgcttatccgcctcaattgttcagcgacgagaatccaaatgcatgtactgtaatgtaa

SEQ ID NO: 84 - DNA, 418 bp, Arabidopsis thaliana
ttcttgtttgttgattaacccttaattaatccgggcgcgcctgatttatcacaagtttgtacaaaaaagcaggctcctgcaggacccaacaagaggacgaagaagaagaagaagattgttactttcttgatcgataatggcgtcgaatgaagctggaagggcattgccgaaattcggggaatgggatgtgaatgatccagcgacggcggatggattcacggtgatattcagcaaagccggtgaagataaaaagacgggacggagttcgacgaagacgaattcacagaggaaacaagatggtgataaaccagcggtcaagaaatggctctgtttcacttttgcttaatcctcgagacccagctttcttgtacaaagtggtgataaattggagctctgcagagctttcgttcgtatcatc

SEQ ID NO: 85 - DNA, 557 bp, Arabidopsis thaliana
atggctgaaaaagtaaagtctggtcaagtttttaacctattatgcatattctcgatctttttcttcctctttgtgttatcagtgaatgtttcggctgatgtcgattctgagagagcggtgccatctgaagataaaacgacgactgtttggctaactaaaatcaaacggtccggtaaaaattattgggctaaagttagagagactttggatcgtggacagtcccacttctttcctccgaacacatagtaagtatatatactcaatctttgcttggtcggggaatcttttgttttgaactcaacgagccattttttgtttttaaatttcctctctttttgaatagttttaccggaaagaatgatgcgccgatgggagccggtgaaaatatgaaagaggcggcgacgaggagctttgagcatagcaaagcgacggtggaggaagctgctagatcagcggcagaagtggtgagtgatacggcggaagctgtgaaagaaaaggtgaagaggagcgtttccggtggagtgacgcagccgtcggagggatctgaggagctataa

SEQ ID NO: 86 - DNA, 1719 bp, Arabidopsis thaliana
atgtattcagaggaaaagaaaagcagaaattatggttcaatctttgtctactgcttcttctgtttcgtactcattgtggaggttgcaagattcgcaaaaccttatatcaaccttcaaaacctaattgagacggaagcagtagtagaagaaggtttcatggcggtggggaactcagggaatcttccgtgtggctcgtcaaaacctagctctgcctctgttcgtgctcatgatgaacagaagctctcgcaagcagtaacaacagatacgagaactcgtcctccaaattcgtactgcgtgaagttccagtcttttgtcactatggcaaagcaggtcaaagaaaacggtggcaagtatgagtcacgtcctttctccgtcggtggatacaattggtacgtacgcgttgacttccatttcaaaaatgttgagaaaccataccttatacatagaagatatacatttttttttgtcaaagggtattcatttatatactagtgttttgatcatctccactttctatgtgaaagattttaacttattgctctgaatctcacccaaattttaatttgtatataatttgacatatttctacttaaaatgttataaggacgctcctaatctacccagtcatatacattccaacggactcgggtgggtacgtttcgatttacgtaagagtcgataactcaagcctcatcaccaatccaaaagatgtgtatgcagagatcacattcctcgcttataaaagcagtacagacaagtaccaaataagccagggtactaattaactaatctagagcaagtaaatatatatgtttaaatcttttgtggtttgttcagactagttatttaagtttgatccgtttgcagagactgaggcccagcgatttcatttgtttaaacaacagtggggacttttacaatttctaccaatttactattttgaaaatccggcatatggatactttttcgagggcgaaagcgttgtgtttggcgttgacatcaacattgttaaaccctttgaaaattgggaagtgttctctaatgaacaaaacattcgtgaccctattttcgaatggagactcaccaaattctctacacgttttcttgactcttacacttctgattccttttcttccggaggaagaaactggtacgtgtgactttcttcctcttgtatatatataacaatacgtacaagatgtgttagtttaataatatgatggttttttacattgaagggcattgaaagtgtatccaaatggagttggaaatgctacgggtaattcgttgtcactctatttgttgagtgatcagtcaaatgataagggttatgtggaagctaagttacgagttattgaccagatccaatccaacaatttcgagaaaaaaggtttgatatctactttgtcaactactactactaatttaaagctaattaattataattaatgagcctttaaaaaataaaaataacttttgatttcttcctatatacacagtggcggcatggcccaatgcaacggagaatggatggggtttcgacaggtttctatcatttgcagatatcaaaaacacatcaaaaggtttcctagtcaacgatactctcaaacttgaagtccagatcttgtccttctcgaaaaccgactactactctcatcaatcgtctcttaatgttttaacgggagatagtacttaggtgactaatcgtcgctagtgtaa

SEQ ID NO: 87 - DNA, 138 bp, Arabidopsis thaliana
atggcagattctaactgtggatgtggctcctcctgcaaatgtggtgactcttgcagttgcgagaagaactacaacaaggagtgcgacaactgtagctgtggatcaaactgcagctgtgggtcaaactgtaactgttga

SEQ ID NO: 88 - DNA, 1179 bp, Arabidopsis thaliana
atggcttcatttacgaaaacggttttgatccctattgcgcacggtacggagcctctagaagcggtggcgatgattaccgtgttgcgtcgaggtggtgctgacgtgacggtggcgtctgttgagactcaggttggcgttgatgcttgtcatggcatcaagatggtcgctgatactcttctctctgatattaccgactctgttttcgaccttattgtgctccccggagggcttcccggtggcgagactcttaaaaactgtaaatctttagagaacatggtcaagaaacaagactctgatggccgacttaacgcagctatatgttgtgctcctgccttggctcttggtacttggggtctactagaaggcaagaaagcaacgggttaccctgtttttatggagaaacttgcggctacttgtgcaactgctgttgagtcaagagtgcaaattgatggaagaatagtgaccagtcgtggaccaggaaccaccattgaattctccatcacgcttatagagcagttgtttgggaaagaaaaagctgatgaagtctccagtatcttgctgcttcgtcctaaccctggtgaggagtttacttttactgagcttaaccaaacaaactggtcatttgaagatacaccacagattctcgtacccattgcagaggagtcagaggaaattgaagctatagcgcttgtagatatcctgaggcgggcaaaagcaaatgtagtgattgctgcagttggtaacagtttggaagttgaaggatctcgcaaagctaagctagtagcagaagttcttcttgatgaggttgcagagaagtcgtttgatctgattgtgttacctggcggtcttaacggtgctcaaagattcgcaagctgcgagaagctagttaatatgttaaggaaacaggcagaagcaaacaaaccatatggaggaatctgcgcatcgcctgcttacgtcttcgagcctaatggtttactcaagggtaagaaggctactactcacccagtggtgagcgacaaactttcggacaagagtcacattgagcacagagtcgtggtagatggaaatgtcataacaagcagagctccagggactgcaatggagttttcacttgccattgtcgaaaagttttacgggcgagagaaagctcttcagctcggaaaggcaacacttgtgtga

SEQ ID NO: 89 - DNA, 1050 bp, Arabidopsis thaliana
atggctcgtccacaagaccctccacgtggtttcttcccttttggaaaccccttcaaaaatctatcttcgaagaactcggtactctcctcaaagcttctcccactcctgaacaattttgagaccaacttagcatcttctattagtaagcttgtccctaaggaaaagagcgatatcctgactgtctcatggatgaaacaagctatggaatctctttgcgagacacataatggtatcaagacccttataaccgatcttgagcttcctgtatcagattgggaggataaatgggttgatgtctatcttgacattagtgtgaagcttcttgatctctgcaatgcctttagctctgagcttacccgtctcaaccaaggtcatctcttactccagtttgctctgcataacttggaggccaactctcctcagaatctgtcgaaagctcagtcatcactagacagttggaagcaacacattgtctccaagaacccgagaatagaaaattgccgtgcaatcttgagcagccttgttcagaccttgaatctccccaaggtgaaaaactcggccaaagggaaagtcttgatgagagctctatatggtgtaaaggttaagaccttatacatctctggtgtttttgctgcagcgttctcaggttcatcgcagaatctgatgtaccttacagtctcaaacgagcttccatgggcacaatcattcatggaagtgcagaacaccatgaacgcagaaatcaagaacatatttttgtcagacgggttaacggttctgaaagagctagaggcagttgcttcaggtgtcaagaaactctaccctgcgatccaacaaggatcaatagatcccatatcgctgcagccactgaaggactcggtcacagaattatcgaatgggatagatcttgtttcgaaagaagtggattgtttcttcaagattctgttatcggggagagacacattactagagaacctaaggtcgatgggtgcatcaaccctacaggcaacatcgccaaaaaaggctgccggaaaaaattacagaggattctga

SEQ ID NO: 90 - DNA, 1176 bp, Arabidopsis thaliana
atgttctcacatgggtcattgcccttcttgtccatgacgggaatgtccagaaatatgcatcctcctcgcagaggatctcgcttcactgttagagctgatgcagattactattcggtactcggagtttcgaaaaatgcaaccaaagctgagattaaaagcgcttatcggaagctggctaggaattaccatccggatgtgaacaaggatcctggcgcagaagagaaattcaaagaaataagtaacgcatatgaggttttatcagatgatgaaaagaaatctctttacgataggtatggtgaggccggacttaaaggcgctgctggatttggcaatggggattttagtaatccgttcgatctattcgactcattattcgaaggcttcggtggtgggatgggtagaggttcaagaagcagagctgtggatggtcaagacgagtattacacgctaatcttaaacttcaaagaagcggttttcggaatggagaaagaaatagagatatcccggctcgagagctgtgggacatgtgaaggttcaggtgcaaaacctggaaccaaaccgaccaaatgcaccacgtgtggcggacaaggccaagtggtttcagcagctagaactcctctgggcgtgttccaacaagtcatgacttgctcgtcctgtaatggcactggagagatctcgacgccgtgtggtacttgctctggagacggacgcgtgaggaagacaaaacggataagtctcaaagtaccagccggggttgattcaggtagccggttgagagtgagaggagaaggcaatgccgggaagagaggcggatcaccaggcgatctgtttgttgttatagaagttatcccagacccgattttgaaacgagacgatacaaatattctctacacttgcaagatatcgtatatcgatgcgattttagggacgacactgaaagtaccaacagtggatgggacagtagatttgaaagttccagctgggacacaacctagcacgacgcttgtgatggcgaaaaaaggagttccggtattgaacaagagtaatatgagaggagatcagttggtgagagtacaagtggagatacctaagagattgagcaaagaggagaaaaaacttattgaagagcttgctgatatgagcaagaacaagactgctaatagcaccagtagatga

SEQ ID NO: 91 - DNA, 1329 bp, Arabidopsis thaliana
atggaaggcgaagagaagaatgattatagaaacgaggaagaagatttcaatacaccacaacaactacaaaagaagcaaaggaaagggaaaaaaatagcaacggaaacagaggatgaaaacgaagaagacaagagagttactctcaaagtcacgcaagtcgccgagagacccgatagaatctctccgatcgtcgcctatttctctacaggatacgatccttgtaaagtagatccaaaaacaggcaagagagttcatgaaactcccaaggttactgtttacaagcataaggatgattctaagaagaggattcaggttgttgtaagtcctccaggcgcaagagttgagttcgtcggaactaattacacaggcgagcaagctgctatgcagacgaatacttatagagttggtgtttttaatagagaggctaaaactttgaggattcttcctgttgctcacaataagataatcagattggagcctagagttaaagctcaagaaacaaatgaggaagaagcttcaggaagtgctgtcgtcaaagaacttgaagaactaaaaacaggagaacgcgatcgttataatacaaaaaaagctgttactcgggataagaagaagcgtgccttatatatgggagatgatgctgcgactcagaaggtccttgatgggaaactaagtgagttaggtgttaacacagctgctcttgaaggcaccagttctactgttgcacgcaacattcctccttacaataccgctgcaacgactgcaaatgaagcttatcccttagaaaagatcattgaaaagggggattggagttttcttgaagatatttactggcttctgcaacaggaaactgaagcagcaactgaggcttaccctgtatttgtccgcaacagattgtacagattgcgagatatcaaggacgatatgaaaaagcagacggtttgtggtgctgcaacgcttctcacccatctggttaagttcaaggacagaaactcaatgaatggttacgattccgctaaagaccacaagatgccagacatcttccgtcaaaaattcaacagcatgttcaaggattctgaatcagataggatacctgttgacaagatcaaccttctgataagctacgttcttgtgctatcccttcacgtggataatttcatgaccgatccagaagacatagcaaaagatctgaggataagcacagttgagctgaggaaacattttctacagcttggctgcaaattcctgaagcagaattctactacggttgctaccttaccgacccctctcaatttcccggaggttaaccggaggcgcagggcacgaaagtga

SEQ ID NO: 92 - DNA, 1662 bp, Arabidopsis thaliana
ttaattaaatacgattctcgattcgtcttcttcaatcagtgaagaagaactcaaaagatggctaaagagagagaccaaaacactaaagacaaaaacctcctcatctgtttcttatggaacttctccgccgagcttaagctagctctaatggcgttactcgttctctgcactttagctactctcctcccttttctaccttcttctttctccatctccgcttccgaactccgtttctgcatctcacgcatcgccgtaaactccacctccgtcaacttcaccaccgtcgtcgaaaagccagtcttagataacgctgtcaagttaactgagaagccggtgttggataacggcgttacgaaacagccgttaactgaagagaaggtgttaaataacggcgttattaaacggacgtttactggttacggctgggcagcttataacttcgtgttaatgaacgcttacagaggcggcgttaacacattcgccgttatcggtttatcatctaaaccacttcacgtttactctcatcccacttaccgttgcgaatggattccactaaaccaatccgataaccggattttaaccgacggtaccaaaatcttaaccgattggggttacggtagagtttacacaaccgtcgtcgtaaactgtacttttccgtcaaacaccgtgataaaccctaaaaacaccggaggtactcttctcctccacgcaaccaccggagatacagaccggaacatcaccgattcaattccggtactcaccgaaactccaaacaccgtcgattttgctctctacgaatccaatctccgccggcgagagaagtacgattatctctattgtggatcttctctctacggcaacttatcaccacagagaatcagagaatggatcgcttaccatgtaaggttcttcggtgaaagatctcattttgttctacatgacgccggagggattacagaggaagtgtttgaggttttaaagccatggatagagcttgggagagttactgttcatgatattagagaacaagagagatttgatggttattatcataatcaattcatggtggtgaatgattgtttgcataggtatagattcatggcgaagtggatgtttttcttcgatgttgatgagtttatttatgttccggcgaagagttcgatttcgtcggtgatggtatctttggaggaatattctcagtttactattgaacagatgcctatgagtagtcagctttgttacgacggtgatggtccggcgaggacttacaggaaatggggatttgagaaattggcgtatagagatgtgaagaaagtaccacgacgggataggaagtatgcggttcaaccgcggaacgtatttgcgacaggggttcacatgtctcagcatctacaagggaagacgtatcacagagcggaagggaaaatacgctattttcactaccatggttcaatctcgcagcgtcgtgagccttgtcgtcatctttataacggtacccgtatcgttcatgagaacaatccttacgtgcttgataccacaatgcgtgatattggtctcgcggtgaagacgtttgagattaggacgattggagatcgcttgcttaggacgagacaatgaaggcaggagaagaatggttaaagacatgttatcatcaggcgcgcc

SEQ ID NO: 93 - DNA, 1545 bp, Arabidopsis thaliana
atgagtgatacaaagatatcagcagtagcagttgctgctgctgtagtggtggtaactacggttacggtatggatatggaaaggtctgaatgtagcttggcttagaccaaagaaaaatgaggcttatctaaagagacaaggtctctctggaactcctttcacctttcttgtcggagacattaaaagggaagccagtatggtggagcaagaaaagtccagacccatcaatctaactgatgattacacgcatcgtgtcatgcctctgatacaacagaccgttaaggatcatgggaagacatcttacatgtggatgggacctatagcgagtgtgattgtgacgaaaccagaacacatcaaagatgttctaaacagagtttacgatttcccgaagccgccagtgcacccaatcgttgagctcttcgcgactggagtcgcgctgtatgaaggagagaaatggtctaagcacaggaagattataaacccttcttttcatcttgaaaagctcaagattatgatacctgcattctacgagagctgcagcgagatgataagtaaatgggagaagttggtgaccgagcaaggatcatcgaatgagatcgatgtttggccatatcttggagatttaacatcagatgtaatttcacgtactgcatttggtagtagctacgaggaaggtaagagaatctttgagcttcaagaagaacaaggccggcgagtgttaaaagctcttgagttggcttttatccctggaatgaggtttctaccaacaaagaacaatttgaggatgagacaaattaacaaagaagtgaaatctagactgagagagatcatcatgaaaagacagaggggtatggatacaggggaggctccaaagaatgatctgttaggaatacttttggaatcgaattctggagatcatggtatgagtatcgaagatgtggtagaagagtgcaggctgtttcacttcgcgggccaagaaaccaccgcggtgctgctcgtgtggactatgataatgctgagccatcaccaaaaatggcaggatcaagctagagaagagatattaaaagtcattgggaagaacaacaaacctaattttgatgcactctctcgactcaaaacaatgagcatgatcttgaacgaagttttgaggttatacccaccagggatactacttggtcgaaccgtagagaaagaaacaaagcttggtgaagacatgacactaccaggtggtgcacaagtagtgattcctgttcttatggttcatcgtgatcccgagctctggggtgaagatgtgcatgaattcaatcctgaaagattcgcagatggtatctcaaaagccacaaagaaccaagtttcgtttcttccgtttggatggggaccaagattctgtcctggccagaattttgctttgatggaagctaagatggcacttgtcttgattctgcagagattctcctttgagctgtctccttcgtacactcacgcacctcatacggttcttacacttcatcctcagtttggtgctccgttgatcttccacatgctc

SEQ ID NO: 94 - DNA, 2843 bp, Arabidopsis thaliana
atttatttgtcagctttcaaactctttgtttcttgtttgttgattaacccttaattaagttactgtagagatggctccaactcaggatcccaacagtgtcggaggcggtgcgaagaaagatgaagctaccttgaaggttccgtctaaggatcccaagaagaaggacgagaaaaaggatgaggatttgtctgaagaggacttggaactaaagcagaaccttgagctctatgttgagagggttcaggatcctaatccggaattgcagaaggctgcccttgagagcatgaggcaggaaatccgagcttcaacaagttccatgacttcagttcccaaaccactaaagtttctgcgtccccattatggaactcttaaagcgtttcatgaaacaatggctgattctgatctcaaaaagtacctgtccgatatcctgtctgtcctggcccttaccatgtctgcagatggtgaaagggaaagcttaaggtttagattgattggaacagagggtgacattggatcgtggggtcatgaatatgtcaggaatttagctggagagattgcacaagagtatacaaagcgtcagagtgaggaggcctctattgacgatttaatggagcttgtgcaacaaattgttgcttttcacatgaagcataatgcagaaaccgaagctgttgatcttttaatggatgttgaggatcttgatctcttacttgagcatgtagacaaaacaaatttcaagaggacatgcaactatctcacaagtgcagctaggtaccttcctggaccagatgacatgttggttctagatatttcctacatgatttacatgaagtttgaagagtatccaaacgctctgcagattgcactatttcttgataacacgcagtatgttaaacaagtatttacctcatgtacggatctgctgaagaagaaacagttctgctacatgattgctcgtcatggtataacctttgaacttgacgatgagatggttgcagatgatgatgaccgggaagccctacaggatattgttaacaacactaagttaagtgaaggatatctgacccttgcaagggatattgaggtcatggaggccaaaacgcctgaagacatctacaaggctcacttactcgacggcagggctagctccggtgcaagcgtggattctgctagacagaatttggctgctacctttgtcaatgcattcgtaaatgctggttttggtcaggacaaactaatgacagtaccttcagactcaaccaccggatcttctggaaactggctcttcaaaaataaagaacatggcaagactagtgcagctgctagtctgggtatgattcaactgtgggatgtggactctggactttcccaactcgacaaatatttccatagtaatgataatcctatcattgctggagcactgctgggagttgggattgtaaattgtggcattaagaacgattgtgatcctgcattggcacttcttggagactatatagacaaagaggattcatctgtcagaatcggtgctatcatgggtcttggaatttcatacgcaggttcccaaaatgaccagattcgaaacaaattgtccccgatactgaatgatgcaaaagcgcctcttgatgtgattgcatttgcttcactttctttgggaatgatatatgttggttcctgtaacgaagaagtagcccagtctattatatttgctttgatggatcgaagtgaggcagaactgggtgatgccctcactcgtttcttgccacttggtcttggacttctatacctgggcaaacaggaaagtgtagaggctacagctgaagtttcgaagaccttcaatgagaagattagaaagtattgtgatatgacacttctttcttgtgcttatgctggaactggaaatgtcctaaaggtacaagaccttcttgctcagtgtggcgagcatcttgagaaaggtgacatccaccagggtccagctgtgcttgggttagcaatggttgctatgtctgaagaactgggagttgatatggagatccgttctctggagcggatgctacaatacggagaacaaaacattcggcgtgctgtgcctttggcccttggtctcctttgtatatccaatccaaaggtgactgtaatggacaccttgagccggcttagccatgacacagattcggaagttgccatgtcagcaattatatcattgggactgattggcgctggaactaataacgcaaggatagccgggatgcttcggaacctctccagctattattacaaagacatgagtcttctcttctgtgtgcgtattgctcaagggcttgtgcacatgggaaagggtctcttgacactcagccccttccactctgaacggttcttgctatcgccaaccgcacttgctggtatagtgacacttttgcatgcatgccttgacatgaaaccaatcatactcgggaagtaccattatgtgctgtacttcctcgttttggcgatgcaaccaaggatgatgttgacagtggatgaaaacctgaagccactgtcagtgccagtgcgggtaggacaagcagttgatgtggttgggcaagcgggtcggcccaagaccataaccggtttccagacacactccacacctgttctcctggctgctggagagagagccgaactagccacggacaaatacattcctctgtcgccaatactagaaggattcatcatcttaaaggagaacccagactacagagaggagtgaagagagagagcttctgcatttaaatacccagcaaatacccagcaaattggagctctgcagagctttcgttcgtatcatcggtttcgacaacgttcgt

SEQ ID NO: 95 - DNA, 930 bp, Arabidopsis thaliana
atggcttcttttgtgatgggatacttcttattgttcgctgttgctttcatgtgtttggatgcgagaacggacaaaacgcaagattatacgtcgtttcagtaccataaaggagctctcctcaccggagacgtttccatcaacctaatctggtacggtaagtttaaaccgtcgcagcgtgcaatcgtaaccgatttcgttgcttccctctcgtcttcccggagatcgaccatggctcaaaatccctcagtcgccacgtggtggaagacggtggagaagtattaccaattccgcaagatgaccacgacacgtggactcagtctctccctcggagaacagatcctcgaccaaggatactcaatgggaaaatctttaacagagaaaaacctcaaagacttggccgcaaaaggtggccaaagctacgcggttaacgtcgtgttgacctcagctgacgtgacggtccaaggcttttgcatgaacagatgcgggtcacacgggactggttccgggtcaggcaagaaaggatcaagattcgcttacatctgggttggaaactcagaaacacaatgtccaggacaatgcgcgtggccattccacgcgccggtttacggaccgcaaagcccaccactagtggcaccaaacaacgacgttggtttagacgggatggtgattaacttggcgagtctcatggctgcgacggcaacgaacccgttcggagatggatattaccaagggcctaaaacggcaccgcttgaggctggatcggcttgtactggagtctatgggaaaggttcgtatcctggttatgctggagagttacttgtggatgcaacgaccggtgggagttataacgttaagggactgaatgggagaaaatatttgttaccggctttgtttgaccctaaaacagattcttgctcgactctgttttga

SEQ ID NO: 96 - DNA, 1466 bp, Arabidopsis thaliana
ttaattaagagagagtcagagagtcaagagagaaaaggggtcgagaatggcggtcgcaatatctgggagtagtttgatatcgtcgactcttcagcattataataatcggatttatatccgagattatccgattccgtgtcactcttctaatccaatttgcaattcttttaatttcaaaagacgttcgttctctccttcttcccccaaatttaacgaccatgtcgttaacccttcctcttcttatttatcctccaagctttctccaattcgaacccattcctctttcgctgcgtgtggctgctcctggattcaagacaattcaatggttcatgattatgctacaacaactaatgggacgtccaagcgttgctcggcgttaccaacaacaaacacagtggatgtctcttcggtgtcagatctttttgaattcatatgctcgggtcctctcgtaaacaagattggtatcactcctcaaagagttggccagtctattgacaaatggttactctacggctcacaactttgtagactgtttcagcttaatgagcttaagcttacaattcctcagaaagctaggctataccactactacatacccgtttttatttggtgcgaagatcagattgctttgcataattccaagtttaaagatggagatgatgtacctcctttagtgattggatttagcgctcctcaaggatgtggcaagactacacttgtgtttgcacttgattatcttttcaagacaacaaaaaagaagtcagcgacgatatccgtagacgatttttacttgactgcagaaggccaggctgaattgagaaaaaagaatccaggaaatgcacttctagagtatcgtggaaatgcaggaagtcatgatctgaaactttctgttgaaacactagaagccctgtcgaaactgaccaaagaaggcttaaagatgaaggtacctaggtacaataagtctgcctatagtgggagaggtgacagagccgattcatcaacatggcctgaagttgaaggacctctatcggttattctctttgagggatggatgcttggttttaagcctcttccagctgacgttgttaaagcagttgacccacagctggaggttgtgaataagaaccttgaagcgtattacgacgcatgggacaagtacatcgatgcttgggtcgtcatcaaaatccaggacccaagttatgtataccggtggcgtcttcaggcggaaatcgccatgaggcaggatggccaagctgggatgtcggatgaggaggtgaatgactttgtgtcgcggtatttgccggcgtataaggcctatcttccaactctttacgcggaagggccaagcggctcagacccagaccgtgtccttgcgatagatatcgatgaagaaaggaacccgatactcgcaaactaatgcgatgctgtctccattgcctttatagtatatcatcattgggcgcgcc

SEQ ID NO: 97 - DNA, 2072 bp, Arabidopsis thaliana
ttcttgtttgttgattaacccttaattaatccgggcgcgcctgatttatcacaagtttgtacaaaaaagcaggctcctgcaggaccctcaatgaagcaattcatgtcagtggtgagattcaaatttggtttcacttcagtcagaatgagggattggtcggtgggagtctccattatggttcttacattgatcttcatcatccgttatgaacaatctgatcacactcacactgtggatgattctagtatagaaggagagagtgttcatgaacccgcaaagaagccacattttatgactttggaagatcttgattatctattttcaaacaagagcttttttggagaagaagaagtgtccaatggaatgcttgtatggtctcgaatgcgtccatttcttgaaaggccagatgctttgccagaaactgctcaagggatagaagaagctacattggcaatgaaaggtttggttttagaaatcaatagagagaagagagcttattcttctggtatggtctctaaggaaattagaagaatctgtccggattttgtcactgcatttgataaggatttgtctggtttaagtcatgtacttcttgagcttccttgtggtttaattgaagattcttcaataactttggttggtattcctgatgaacattctagtagcttccagattcagctcgttggctcgggattatcaggagaaactcgtcggccaataatcttgcgttacaatgtgaacttttctaaaccatcgatagtgcaaaatacatggacagagaagctaggttggggaaacgaagagcgatgccaatatcatggatcattgaaaaatcatttagttgatgaacttcctctctgcaacaaacagaccggtagaatcatttcggaaaagagttccaacgatgatgcaactatggaactttctctttcaaatgctaattttccatttctcaaagggagtcccttcactgccgcattgtggtttggcttagaaggttttcatatgacgataaatgggcggcacgagacttcatttgcttacagggagaagctcgagccatggttagtcagtgcagtcaaagtctcaggtggtttgaaaattttatctgtcttagccacaagactgcccattcccgatgaccatgcatctttaatcatagaagagaaacttaaagctccatctctttccgggacaagaatagaactattggtgggtgttttctccactggaaataattttaagcggcgtatggcattgagaagatcttggatgcaatacgaggcagtaagatctggcaaagtagctgttcgatttctcattggccttcacacaaatgaaaaagtcaatttagagatgtggagagaatctaaggcatatggagacattcagtttatgccatttgttgactactatggtttacttagcttgaaaacagttgcgctttgcattctcgggaccaaagtcatcccagcaaaatacataatgaagacggatgatgatgcgtttgtacggattgatgagctcctatcaagtctagaagaaagaccgtctagtgcccttctgtacggtttgatctcatttgattcatcaccggaccgtgaacaaggcagcaaatggtttatccctaaagaggaatggcctttagattcataccctccatgggcacatggccctggctacatcatctctcatgatatagcgaaatttgtggtgaagggtcaccgtcaaagagatcttggacttttcaagctggaagatgtggcgatggggatatggattcaacaattcaaccagacgataaaaagagtgaagtacatcaatgacaaaagatttcataacagtgattgtaaatcaaattacattcttgttcattaccaaactcctagactaattttgtgtctttgggagaagctgcaaaaagagaaccaatctatttgctgcgaataaatctctcgagcatgtacgtatgtaacttttctggttctgtttcacacttcagctcgagacccagctttcttgtacaaagtggtgataaattggagctctgcagagctttcgttcgtatcatc

SEQ ID NO: 98 - DNA, 3345 bp, Arabidopsis thaliana
ggttttggctacaattggaattggttttgctattggtgtaattacagctatttttgggaatctttaaacataatgtttcagtattaatagagcttatgatcaaagagtgttgccggaaatatggggaagaaagggagtggtggatggttctcgacggtgaagaagaaagtcttcaaatcctctcctaaagactccaaggttctaatcacacctttaattactatttttattttgtcaaccaccattatatatacatatatttatgtatgacaacgtattaaagaaaattaggacacttaagtgggatgtgtagaagtatatatgaggatcttcatgaaaacatatcctagcttaaagaaagatagaactatagtaatcaaattacaaatatgcataacgtttcaagtgattttagcattgctaacaaaacataactttaataataagatataactaatacgaccgcataactactttttcataagtaagcaatttggtttagtgtctttttcttcttgattgaaagcaattttccatactaattacataaataacatttttttttgcattgaacacttttttcttatttttctacctatttaataggattcgtaagatatatttatgcatattatagcttaaaagaggaaaaaacaatatacgatctttcatcttataaatgtatgacaagttgagttacaaaaagtaaatgtttagaccgtatatacttattaattaaaagccgaaaaagattggtccccttgtgaaagagatagactaagaaggctccttataagagcatctaaatatgatttttgtgacaccgaaaaaaatcttttttccatctcccaattttcatgtgcattgctttgttccctcaccatcactccaccccatttatttccccacctatagatatatacattaaatttatttcataaacttgtatctatagatagtcatatcttcacattaccataatatagaggttctctttttaccactatccaaagtccccacaatctttatcatctttttatatattttggatctcaactctagcccttttctattggttctcaaaatttattatagacatatagtaaaaacaaatgttaaatactttggacgtaaacattaaaactaaaaaggaagtaatcataagccaacaagtttattaagatggaaattattcaaatgttagattactgttattatgtgaatatgtcacacttaatttacttacatgcagagagagaacaacattggtagtaataacgccgacatatggcagcagcagcatgatacgcaagaagtcgtgtcgtttgaacattttccggcggaaagttcaccggagatctcccatgacgtcgagagcacagcatctactccagcaactaatgttggagacagaaaacacgctatggctgtagctatagccactgcagctgctgccgaagccgcggttgcagccgcacaagctgccgctaaagtcgttcgacttgccggctacaaccgccagacggaggaagatagcgccgccgtgctaatccaatcgcactataggggttatttggtaattttctatccctaaattttactatcaaatcatttccaactctcatttgtcaataacatgcaccctcgaatataaccattttacaatcaaattttaccacttctcttacccacaaaaatcgaaatgcattttgcctagaatccgttatgactataattcatttcagtattatcgctaaaccggttttagtggaatttcgtgttttagtatacacaatttattgactaaatttgtttttgtttttttttcattgtaaacttgcagtaatgccaaaccagaaatcttaagaaacattctaggttattcaaattatgaccggttttgtgttttttttttctttctaggcgagacgagcacttcgtgccttaaaaggactagttaggctacaagcattggtccgtggcaaccacgtacgaaaacaggcacagatgactatgaaatgtatgcaagcattggttcgtgtccaaggccgagtcagagcaagaagactccaagtggctcatgaccggtttaagaaacagtttgaggaagaagagaagcggtccgggatggaaaaaccgaacaagggtattgatatcaatacatactaaatcacccaatatgtatgtacatctataattagtggtgaacctaatatttgtatggttaagtagggtttgcgaatctcaaaacggaacgagagaagccgaagaaattacatgaagtgaatcgaaccagtctgtaccaaactcaaggaaaggtaatgatgaaaaatcttaggtactattttgctcacgtttcaatgtttttcttttaagtaattacactattggcatatctttttaggaaaaagagaggagtgaaggaatgatgaaaagagagagggctctagcttatgcgtacacttaccaggttggtcgccactctgtttctgttagagaaaaattccctcttaattgtcataaaatatgctatgcattataggtccttaaacatctttcataatagttttggttttcatattgaagcgccaaatgcaacacacaaatagtgaagaagggattgggctttcttctaatgggcctgatagaaaccaatgggcttggaattggcttgaccattggatgtcttcccagccatacactggccgtcaaactggtccgggtcccggtcccggacagtacaatcctcctccgtatccgccttttccgacagctgcggcaaccaccacatctgatgatgtatcggagaagacggtggaaatggacgtgaccactccgactagcctcaagggcaatataatcgggcttattgatcgagagtatatagacttaggatcatatagacaaggccataagcaacggaaaagcccaacccatataccaagctatatggctccaaccgcatctgctaaggctaaagttcgagatcaaggcccaaccgtcaaactacaaggaacttcgtttatgccgtattggaactcctcgaccaaaaacgggtcggttaatggatcaggttgtgattcgtcaagttcaggtggagcaataacaactggttatcccggtcctaggagtccgaacccaaaatcggatatccgacgtaaaccggttagtcctagtcaaagtcctaccgggtttggaaagagaggctggaggcatgatcattagaagaaagtatatgtaatcttgaataaaaacttacatgtgtggttggttaattatcttgtttgaaatatattttccctgttacataattgtatatgacattaataattgaacatgtcttct

SEQ ID NO: 99 - DNA, 1623 bp, Arabidopsis thaliana
atggcggtctcagctttccgtggcacgcggttaccgttatttcaccattctcagtttcccgtcgcgagaactgtgtcaggaacgtctaagaagatgatcggagccaggaatttcaagggttttgttcttacagcccagtattcgcaaactcaggaccttttcacttctcgtcttcaaagccagatagagaaattgcccaaattggttgaggatatagttcagacatcgataaacacaggtccacgaggtgtgacacgccttgtccaaggtgttcaagcctttgtaggggttggaggagagtggctaaatgatttatctaagtctacaagcgcgtctggtggattaccaagtgaattgcagcttggtctactgtctcctctatatttgaggaaactctttgaacgcatgggagctacttacattaagctgggccagtttatagcatctgcgccaactttgttcccaccagaatatgtcaaagaatttcagaactgctttgacaaagctcctcctgtgccatttgaagaaattcgtaaaatcttgcaagaggagcttgggagacccattgaaagtgtatacgaatatgttgaccctacgccaattgcatcagcctcaatagcacaagtccatggtgcaaggcttcgaggctcccaagaggatgttgtgattaaagtcttgaagcctgggatagaagatttcttagtggcagatttgaactttatctacgttgtttcccgtatatttgagttccttagtcctgagtttagccgtacttcactggttggaattgtcaaagatattcgtgagtcaatgcttgaagaagtagatttcaataaggaggctcaaaacattgagtcatttaagagatatcttgaaaccatggggttgacagggcaagctactgctccaagagtatataagtactgcagcagccggcgggtacttacaatggagaggctatatggagttcctctgactgatctggactctataagatcacttgtttccagtcccgaaaacagccttattaccgcgcttaatgtgtggtttggaagcttacttgcttgtgaaagcttccatgctgatgtacatgcaggaaacttatggctgttgcgtgatggccggattgggtttcttgattttggcattgttggtcggatatcccccaaaacatgggctgctatggaagtatttttagcgtctattgcaactgaagaatatgaatccatggcctcagctttgattcaaatgggcgccacaaacagagatgttgatggcaaagcttttgcaaaagacttggaaaagatgttctcatctatccaggaactagatacagagatagtagtggctacagctcgtggaacaaattcagacactactgctgttgctgctaacgtagttatggatgagagacagatgaatgctcttttcctcgacctggtgcgtgttagcgaatcatatggtcttaagttcccgagagagtttgcacttctgttgaagcaacttctgtacttcgatcgatacacaagactattagccccaaacctgaacatgctgcaggatcagcggatctctatcgcgtccaacaagaggacgaatggatacaaggacagcttcaactaa

SEQ ID NO: 100 - DNA, 1891 bp, Saccharomyces cerevisiae
ttaattaaatggtggtgcagaaaaaacttagggctatcttgaccgatgaaggtgtattgatcaaatcgcaatcacaccatatgttcaataagcatggtcaactcagaagcggagattctttatccttgttgagctgcttgtcctgtctggatgatggaactttgagctctgatggaggttcttttgatgaggatgattccctggaactgttgcctcttaatactaccattccgttcaacagaattttgaacgcaaaatatgtgaatgtcggtcagaaaggcttcaataatggcaaaatttcttcgaatccttttcaaacggaaaatctgagttcttcgtctgaaaatgacgacgttgagaatcatagtttgagcaatgataaggctcctgtaagcgaatcacagtcatttcccaaaaaagacaagtgggatacaaaaacgaacactgtgaaggtgtctcccgatgattcacaggataactcaccatctttagggataaaagataatcaacagttaattgagttaacttttgctgtacccaagggccatgatgttataccacaaaaattaaccttgttaatagatcacgtttctaggaaatcgagagcaaataccggagaggagaacatttcttctggtactgtggaagaaatcctggaaaaaagttatgaaaattccaagagaaacagatcgatattagtcattattaatccccacggtggtaaaggtactgctaaaaatttattcctgacaaaagcaaggccaatactagtggaaagtggctgcaaaatagaaattgcatacacaaaatatgcccgtcacgccatcgatattgccaaagatttagatatcagcaaatacgataccattgcatgtgcctcgggtgatggtattccatacgaagtaattaatgggctttatagaagacccgacagagtggatgcgttcaataaactagccgtaactcagctaccttgcggttcaggaaatgctatgagcatttcatgtcattggacaaataacccatcgtacgccgctctgtgccttgtcaaatccattgaaacaagaatagacttaatgtgttgttcccaaccttcttatatgaacgaatggccaagattatcctttttgagtcagacgtacggcgttattgcagaatctgatattaacactgaattcatcagatggatgggtcccgttaggtttaatttgggtgtagcattcaacattatccaaggtaagaaatatccctgcgaagttttcgtcaaatatgctgccaaatctaaaaaggaattaaaagttcatttcttagaaaataaagataaaaacaaaggatgtttaaccttcgaaccaaatcctagcccaaactcttcgccggatttactatctaaaaacaatatcaacaacagtacaaaagatgaactttcaccgaattttctcaacgaggacaactttaaattaaagtatccgatgacggaaccagtacctagagactgggagaaaatggattcagagctaactgataacttaacaatcttttacacagggaaaatgccgtatattgctaaggacaccaaattttttcccgctgctttaccagcggatggtaccattgatttagtcataacggatgcaagaatcccagtgacaagaatgacaccaattttattatccttggataaaggttctcatgtattagagccagaagttattcactcaaaaatattggcttataagattataccaaaagtggagtcaggtttattttcagtggatggtgaaaagtttcctttggaacccttgcaagtggaaataatgcccatgttatgcaagacgttgctaaggaatggtagatatatcgatacagagtttgaatccatgtagatttaaat

SEQ ID NO: 101 - DNA, 1152 bp, Saccharomyces cerevisiae
cagaaaagtaacgactagctattactgatcatgttatagaagagtgcgacaaccatatattattagcgcagcgatcaacgtggcagtcttgtcatccatataaaaaaggagttctgattgatgtctgttatcttagtatctgctggctatgaccacacaataagattttgggaggctcttactggggtttgttcaagaacaattcagcattccgactcacaggttaatcgcttagaaatcaccaacgataaaaagttgttggcaacagcaggccatcaaaacgtacggctttatgacattcggacgacaaatcccaatccagtagcatcctttgagggtcatcggggaaacgttacctccgtttcttttcaacaggacaacagatggatggtgacctctagcgaagatgggaccattaaagtttgggatgtgcgttctccgtccattcctagaaattacaaacataacgcaccagtaaatgaagtcgtaattcatcctaaccaaggcgagttgatatcttgtgatagagatggtaatataagaatttgggacttaggagaaaatcagtgtacccatcaattgacacctgaggacgatacctctctccagtctttatctatggcaagtgatggttcgatgttagcggcagcaaatactaaaggtaattgttacgtatgggaaatgccaaatcatactgacgcatcccatctaaaaccggtaacaaaattcagagcgcactccacatatataactagaattctactatcatctgatgtaaaacatttggcaacatgttcagcggatcacactgctcgtgtgtggtcgattgatgatgattttaagctagaaacgacattggatggccaccaaaggtgggtttgggattgcgcatttagtgctgacagtgcgtatctagtaacggcatcgtccgatcattacgtgagattatgggatttatcaactagagaaattgtcagacagtacggtggacaccacaagggagctgtatgtgtcgcattaaacgatgtatagtttacaatttatcaactaccaagcttgaaggaccgaagtgacaaaaaacattatgattttcagtgtttgcttatccgcctttttgtaaatatagattttactatcctgtgcattttagtt

SEQ ID NO: 102 - DNA, 1650 bp, Arabidopsis thaliana
ttaattaaatggaagctctgtcttctcttacgttcaagggttctcttccagaagccatatttgaagccaaagggaagaagaagctttttgttgtctacatttctggagaggatgaagagtcggataagttgaacagattgacttggactgatgcatcggtggcagattcgttgtcgaagtattgtattttagtgcatatccaagctggaagtgttgacgccacaaacttctctgcaatatacccatattcatctgttccttgtatagctgccattggattcagtggtacacaagtttggagaaccgaaggatttatcactgctgaagaccttgcatccagtttagagaaagcgtggttaggacttcatatccaggaaacaactgcaagtatcttttcagcagcacttgcatcacagaactcagagacacctgtttctagtgcttcgagtgttgtcttgcctcccggaagtgttcctttagatgcagcggttgcatctccatcgacggcttctagtgttcaaccctcagagacaaagtcaacggtaacatctgcatcaacaacagaaaacaatgatggcacagttgcagttaagggcaaagaatctgctgaacccagtaatttgtgtgatactactaaaaaccagccagcaccctctgttgatggaactaaggccaatgttgaacatgaagcgacagagacccctttgcgtgttcaggcagaaaaggagccaattcgtcctacagccccaggaacaaatgataatacatccagggttcgatcttctgttgatagaaaaaggaaacagggaactgtgataaatgaagaggatagtggtgtaggtgttagtggaagggacattaatctaacaaaatctgtcgatacaaaagagaccatgaagccaaaggatgaaggaggagaggaagaggatggagaaaaatccaaaaaagcatctgacgttcatttaaacattcgattacctgatggtagtagccttcaggagaagttttctgtgacaagtatattgagaatggtcaaggattatgtgaacagtaatcaaacaatcggactgggtgcttatgatcttgcggttccttacccacgtaaggtgtatactgaccaagatctggataagtctctatccgagttgagattgttcgatagacaagcacttgtagtagttccgcgaaaaagagcaaccgtctatcaaagaggaacatcttactcggagtctaacaacaacacagaccctaatagtggcggttactttgcttatgttagaagagtactgtcttatgcaaacccgttttcatattttggcggtggtactgccaacgcatcaagctctgttccagaacgtcaaacaagaccaaatacggaggtgagaaacaatctggggcaagtagggacgtcctttcaagatccatcagaaggtaggagcaacgttaggaataggagaccaaccacttctcggattggaagtaacatccatacgttgaatcacaatgaagatgaggctccgtttggtgatggaaacgctttttggaacggaaactccacacagtacggtggtggaagcggtggagacagtaatgatagacgatgaaataagagaagttgaaatctgtgtggatagatacgaaaggcgcgcc

SEQ ID NO: 103 - DNA, 1911 bp, Arabidopsis thaliana
ttcttgtttgttgattaacccttaattaatccgggcgcgcctgatttatcacaagtttgtacaaaaaagcaggctcctgcaggaccatggaggcccaataccggaaccacgacggagacacctctttctctagcctccgtgtctacctcaactctctctccgacactccctcccgtttttcccgccgagccgtttccgtttccacctcttacgacgagatgagccgcgtccgcgccgtctccggcgagcagatgcgtcgtactctccgttggtacgatctcatcggactcggaatcggtggaatgatcggagccggagtcttcgtcaccaccggccgtgctagtcgtctctacgctggtccatcaatcgtcgtctcttacgcaatcgccggactctgtgctctactctccgccttctgttacaccgagttcgccgttcacctccccgtcgccggcggtgctttcagctacatccgtatcacattcggcgagtttccggcgtttataaccggagcaaatctgataatggactacgtactgtcaaacgccgccgtttcaagaggattcaccgcttatctcggatctgcattcggaatctcaacatcggagtggagattcatcgtctccggtctcccaaacggattcaacgaaatcgatcccatcgccgttatcgtcgtcctcgccgtcacgttcgtcatctgttacagtacgagagagagttcgaaggtgaatatggtattaacggcgttacacattgcatttatagtattcgtgatcgtcatgggtttctcgaaaggagacgtaaagaatttaacccgacccgataacccggaaaacccatccggattcttcccgtttggagtttcgggtgtgtttaacggagcagcaatggtttatctaagttacataggatacgacgccgtttcgacaatggctgaagaagtaaaagacccagtcaaagacataccaatgggaatctctggctcagtcgcaatcgtcattgtactttactgtttaatggctatctctatgtcaatgcttctcccgtacgatctgatagatgcggaggcaccgtattcggcggcgtttagtaaatcggaaggatgggaatgggtgacgagagtggttgggattggagcaagtttcgggatattaacgtcgttgatagtagccatgttgggtcaggctcggtacatgtgcgtcatcggacggtcaagagttgtccccatttggtttgctaaggttcatcccaagacatctactccagtcaacgcttccgcttttcttggaatcttcacggcggttctcgccctcttcaccgacctaaacgtcctcctaaacctagtctccatcggaacgctcttcgtcttctatatggtcgcaaacgctgttatatttcgccgttacgtaacggtcggatacacggagccatggccaacactctccttcctctgcctattctccataacctcaattttgtttaccttggtctggcaacttgcaccgtcgggcccacctaaatggttcatacttggagctagcacggtcacggctatagccatcgtccagatattccattgtgttgtacctcaagctaggatccctgagttttggggtgtaccgttgatgccgtggactccatgcgtttcgatatttttgaacattttcttgcttggatcattggatgctccttcgtatatcagattcgggttcttctcgggattagtggtgctcgtgtatgtgttttatagtgttcatgcaagctatgatgctgaaggagacgggtctcttgatttcaaagacgtggaaagccttgaaagaattaacagagtgttgagttaactcgagacccagctttcttgtacaaagtggtgataaattggagctctgcagagctttcgttcgtatcatc

SEQ ID NO: 104 - DNA, 660 bp, Arabidopsis thaliana
atgctatggaaccttgctattactcagtttcaagctctcgtgtcaatcaattttgtttctttctatcattcgcagattggttttaacaatggtgtcccaatcgatgagaaattctttgttgagaacattgctggaaaacacaattctgaaattgctctacttctgttccctgatgatgtttcaagagggttaaaattctgtgatgaaaaggaagctctttaccgcaaaattgttgcagagaagataaagccacttgatgggcttataaaactgaccaaatggatcgaagatcgtggattgaaacgagctgcggtaacaaacgctccaaaagaaaacgcagagctcatgatatcgaaacttggtctgactgatttctttcaagcagtgattcttggctctgaatgtgaatttcccaaaccacaccctggaccttacttgaaggctcttgaagtgcttaacgtgtcaaaggagcacacgctagttttcgaagactcgatctctgggataaaagctggagttgcagctggaatgccagtgattggactgactacagggaatccagcaagcctgcttatgcaagcaaaacccgcttttctcatcgagaactatgcggatccaaaactgtgggctgtgttggaagaacttgataacaagtcttaa

SEQ ID NO: 105 - DNA, 345 bp, Arabidopsis thaliana
atggcggctctctccaccaccttctactaccacccactctgcactaaccaccgtacaaagagacaagcctcaagcagacacggagttagatctatgagagtgatgtcttgtcggaagcagaaattaccagaagagaatgaaggagtgatccagagaacattgagaaggatgatttcagaggctgggaagattgggaagaatctgaagccagagaagaagaaaggagacgtcaaggacctgatgcttatgagtctctcttttgctgtttatgtttatatctctcaactattggtttgtgcttacttctcctggcaacatctcagcttccccaaatcttcatggtag

SEQ ID NO: 106 - DNA, 1744 bp, Arabidopsis thaliana
ttaattaaatgacggagtatgagaatgggaagaagaggaaagtacgaaacaaacaacaagtaaaagtacagttcttgtctcaaaggtatctaatcttatgcttttgttgtttcttcgtcttgctcttcttcttatcttccgaccgaatctccacactctctgttcgttccgattctctgagaccgtctcttcgtgttcctactctctccgttttatcatcatccatggattcgtttcaccgtggtagattccctccgttgagtgttgaagacagagttcaattccctgaccatttattgctgattctttcgcacggaattgggaaaggtgaaaaaaacctagtttgtgtttatcgtggagtaaaggaagagactttggtgttgccctcgatttctagtgatgaattcgatgagtttaggtcgattgttcgatgtcctaatgctcctttgaactattcttcatctgttgatttgcaattccgtggagatttggtgaagaagaagatgaagaaacagagccgtcgtgttcataattgggaaaaggttggttatgaggcggtgattgacggcgacacggtggttgtgtttgttaaaggattgactcgaagacctcacaaggaatcagatccttcttactataagtgtcaatttgagattgagaattcggaggagaaagaggtgactcaagctattgctgctgcgcaagaagttgtgaggtgtggtttgcctgagagtttgaagctaaatccagagatgatgtttcgagtgagtgtaattcacattgatcctagaggaagaactacccctgctctgccttcggttgcgagaatctacggttctgattcgattgagaagaaggagaagaagagtggagttaagcatgagctttgtgtttgtacaatgttatggaaccaagctccgttcttgcgtgaatggatcatgtatcactcgtggctcggtgtcgaacgttggtttatatatgataacaacagcgatgatggtatacaagaggagattgagttgcttagttcggagaattacaatgtgagtcgacatgtttggccttggatcaagactcaagaagccggtttttcgcattgtgcggttagagcgaaagaagaatgcaattgggttggattcttcgatgtcgacgagttctactacttccctacgcatcgctctcaaggcttaccgagcaaaaacgctttgaagtcgcttgtatcgaactacacttcttgggatttggttggagagatcagaacggactgtcatagctacggtccatccggtctgacctcggttccatcacaaggcgtgaccgtaggttacacttgtagacaagcgaaccccgagagacacaagtcgataatccgccctgagttgctcacaagctcattgctcaatgaagtacatcattttcagttgaaagaaggagtggggcatatgagtttggtggagagtgttgcggtagtgaaccattacaagtaccaagtttgggacactttcaaagctaagttttacagaagagtggctacttatgttgttgactggcaagagaatcagaatcaagggtctaaagatcgagctccagggctcgggacagaggcaatcgagccgccggattggaaacgacggttctgtgaagtgtgggacactggattgaaggatttggttatgtcgaattttgctgatcaagtgactggttatctgccgtggcagaggcaacaacaagaatgaggcgcgcc

SEQ ID NO: 107 - DNA, 345 bp, Arabidopsis thaliana
atgggttgtgctggatcgacacagtctcaagcagatgggtcagtgaagaaaattaggaagccgaaaccgtggaagcatacccaaccgatcacgaaagctgagcttatgaaacttagagaagagttttgggacactgctcctcattatggtggtagaaaagagatatgggacgcacttcgcgctgctgcagaagctgacatatctcttgcacaagcaattgtggacagtgcaggagtcattgttcagaacacagatctcacagtctgctatgacgagagaggtgctaagtatgagctacctaagtatgttctaagcgagcctaccaacttggaggaagaaaattga

SEQ ID NO: 108 - DNA, 561 bp, Arabidopsis thaliana
caaatattattcatttatttgtcagctttcaaactctttgtttcttgtttgttgattaacccttaattaaaaaggacaattggaaaagattaatagcaaatgggttctttaatgtcaggatgggactctcgagtaagggatcccaaatcagtgagaaggtgcaagtcgctcacaagagaagaaatcgacactttttggaaaacgaagaagaagaatgaagaagaagaacatgttcaagccttttccaagttggtaactcaggaaggtgcacaaagccaagcgaaagagaagaagagtgtagatgatctttttgagaaccaaagcaagagtagtggatggtggagaaaaacctactgggcgttcttgaatgagccgagggaggaagagggtcgaccgaacaactacgtgtcgcaattcaaagttgctcacatcgccaaaattgcgggctcgtaatgacgctataatcaccggctaatcacatatatatctcgtgtgaaaggcgcgccaaaaattggagctctgcagagctttcgttcgtatcatcggtttcgacaacgttcg

SEQ ID NO: 109 - DNA, 1173 bp, Arabidopsis thaliana
atgcggttgcgttttccgatgaaatctgccgttttagcgtttgctatctttctggtgtttattccactgttttccgtcggtatacggatgattccgggaagactcaccgccgtatccgccaccgtcggaaatggctttgatctggggtcgttcgtggaagctccggagtacagaaacggcaaggagtgcgtgtctcaatcgttgaacagagaaaacttcgtgtcgtcttgcgacgcttcgttagttcatgtagctatgacgcttgactcggagtacttacgtggctcaatcgcagccgtacattcaatgctccgccacgcgtcgtgtccagaaaacgtcttcttccatctcatcgctgcagagtttgacccggcgagtccacgcgttctgagtcaactcgtccgatctactttcccgtcgctaaacttcaaagtctacattttccgggaagatacggtgatcaaccttatctcttcttcaatcagacaagctttagagaatccattgaactatgctcggaactacctcggagatattcttgatccatgcgtagacagagtcatttacctagactcggacatcatcgtcgtcgatgacataacaaagctttggaacacgagtttgacagggtcaagaatcatcggagctccggagtattgtcacgctaacttcacaaagtacttcacttcaggtttctggtccgacccggctttacccggtttcttctcgggtcgaaagccttgttatttcaacacgggtgtgatggtgatggatctagttagatggagagaaggaaactacagagaaaagcttgaaacttggatgcagatacagaagaagaagagaatctacgatttgggttctttgcctccgtttcttcttgtcttcgcagggaacgttgaagcaattgatcataggtggaaccaacatggtttaggaggagacaatgtacgaggaagttgtaggtctttgcataaaggaccagtgagtttgttgcattggagtggtaaaggtaagccatgggtgagacttgatgagaagagaccgtgtccgttggatcatttatgggaaccgtatgatttatatgagcataagattgaaagagctaaagatcagtctttgttcgggttctcttctttgtctgagttaacagaagattcaagctttttctga

SEQ ID NO: 110 - DNA, 861 bp, Arabidopsis thaliana
atgagtttcaacaaagttcccaacattcctggagctcctgctctctctgcccttcttaaggtcagcgttattggtgggctcggtgtctatgcccttactaatagtctctacaatgtcgatggaggacaccgtgctgtcatgttcaaccgattaactggtatcaaggaaaaggtgtacccagaaggcacacattttatggtgccatggtttgaaaggccaatcatctatgacgttcgtgcacgaccttaccttgtagagagcaccactggtagtcatgatcttcagatggtgaaaattggattaagggttctcacacgtcccatgggtgaccgtttgcctcagatttaccgaacccttggcgagaactacagcgaaagggttcttccttccatcatccatgaaaccctaaaagcagtggtagctcagtacaatgcaagccagctcattacccagagagaagctgtgagcagagagatacgcaagattctgacagagcgggcttctaactttgacattgctcttgatgatgtctccatcacgactctgacattcggcaaagagttcaccgcagctatcgaggcaaaacaagttgctgctcaggaagctgaacgggctaagttcattgtggagaaagccgaacaagacaggagaagtgcggttatccgtgcgcagggagaagctaaaagtgctcagcttatcggacaagcaattgcgaacaatcaggcattcatcactctgagaaagattgaagctgcgagagagattgcacagaccattgcacaatctgctaacaaggtttacctgagctccaacgatctgttgcttaaccttcaagaaatgaacttggagcctaagaagtaa

SEQ ID NO: 111 - DNA, 588 bp, Arabidopsis thaliana
atgtcgtcgtcttctccgagtggaagcggtagtgatttgactgagagaagagggatccctgccgccaaattcatccaagatgtggagacttatctctctcagtctggtctcgatcctaactctgctctcgcctttcaccaagaaaggcttcagcaatataaagttgttgagatgaagcttcttgctcaacaaagggatcttcaggctaaaatcccagatattgaaaagtgtttagaggttgttgctactttggaagcaaagaagggtactggtgaggcgctcttagctgattttgaggtgtctgaaggaatatattcacgggcctgcattgaagacacagactcagtgtgtttgtggttgggagctaatgtcatgctggaatattcctgtgaagaggcttcagctcttctgaaaaacaatctggaaaatgctaaagccagcctggaggttcttgtagctgatttacagttcttgagggatcaagtcacagttactcaggtaactattgcacgtgtttataactgggatgttcatcaaaggagggttaaacaagttacccctactgctattgctgttgcagattcatga

SEQ ID NO: 112 - DNA, 1773 bp, Arabidopsis thaliana
atggctatggtagatgaaccgttgtatcccattgctgtgcttatagatgagcttaagaatgatgatattcagcttcgtttgaactcgatccgtcgcttatctactatagctcgtgctcttggagaggagcgtacaaggaaggagttaatcccttttttgagtgagaatagtgacgatgacgatgaggtgcttcttgcaatggctgaggagttaggagtttttattccgtttgttggaggaattgagtttgcgcatgttcttcttcctcctttggaatctctatgtactgttgaagagacttgtgtgagagaaaaagctgtggaatcgctttgtaagattggatctcagatgaaagagaatgatcttgttgaatcttttgttcctcttgtgaagaggttagcgggtggtgaatggtttgcagcaagagtttctgcatgtggtatatttcatgttgcataccaaggttgcactgatgtgttgaagactgagttacgggctacttatagccagttgtgcaaagatgatatgccaatggtgcgaagagctgctgcatctaacctggggaaatttgctacaactgtcgagtctacctttttgattgctgagatcatgactatgttcgatgatcttactaaagatgaccaagattctgtgagactattggctgttgaagggtgtgcagctcttggaaagttgttggaacctcaggattgtgttgcacgcattttacctgttattgttaatttctctcaggataaatcttggagggtgcgctacatggttgctaatcagctatatgaactttgtgaggcagtgggtcctgattgcacgaggacggatttggttccagcatatgtgagattgctaagggacaatgaggctgaagtgcgaatagcagcagcgggaaaagtgaccaagttctgtcggcttttgaatccagagcttgcgattcagcacatccttccttgtgtgaaggaattatcatcggattcttctcaacatgtccgctctgctctagcttcagtaataatggggatggctcctatccttgggaaggactcaaccattgagcatctgttaccaatttttctttcccttttgaaagatgaatttcctgatgtgcgccttaacatcataagcaagttagatcaagtcaaccaggttattggaattgatctactatctcaatccttgttaccggccattgtagaacttgctgaggatcggcactggagagtccgacttgcaataatagagtatgttccactgttggccagccagttaggtataggatttttcgatgacaagctcggagccctttgcatgcaatggctgcaagacaaggtctactctatccgcgaagctgcagcaaacaacctaaagcgcctcgcagaggagtttggtcctgaatgggcaatgcagcacttagttccccaggtattggacatggtcaacaatccgcactacctacacaggatgatggttctacgcgcaatatctctcatggcgcctgtaatgggatcagaaatcacatgctctaagtttcttcctgtggttgttgaagcatcaaaagacagagttccaaacatcaagttcaacgttgccaaacttctgcaatccctcatccccatagtcgaccaatcagtggtggacaaaacaatccgtcagtgtttggtggacctgagcgaagaccctgatgttgatgttcgttattttgcaaatcaagcacttaattccatcgatggttccacagcagcacaatcctgaatttaa

SEQ ID NO: 113 - DNA, 1065 bp, Agrobacterium tumefaciens
ttaattaaacaaggacagcggcaagcgcatctgaacacgacaggagcgaagggaatggtaaaggaaccgggcggcaagcatgtgctctgcgtgggtgccgccgtgctcgacaccctgtttcgcgtggcagacatgccgaagggcgaaggcaaggtcctgccctatgaggtgctgcagatcgccgaaggcatggcgtcgagcgccgcttatgccgttcatcgcatgggcggccgcgccagcctctggggtgcggtgggcgacgacgaaaccggtacccgcatccttcgcgatctcagtgaaagcggcatagacacatcaggcatgacggttgcgcccggcgcgcgctcggccctgtcgacgatcattatcgataacaggggcgaacggctgatcgtgcctttctacgatcatcgccttcacgagaaaaaacgcgcctgcacgccggaggatattgctctctttgatgcggttctggttgatgtgcgctggccggaactggcgctcgatgtgctcaccgtggcgcgtgcgcttggcaaacccgccattctggatggcgacgtagcaccggtggaaacgctggaggggctcgcccccgccgcgacccatatcgtcttttccgaacccgccgccacccggctgaccggacttgaaacggtgaaggacatgctgccggtactgcatgcccgttatccgcagaccttcatcgccgtcaccgccggaccagcgggctgctggtggacggaagccgacgatccgacagtgcatttccagacgacgatgcaggtcgaagcggtggacacgctggcggcgggcgatatcttccacggcacctttgcgctggcgatggctgaaggcatgcaaagccgcgcggccgtccgcctctcctccgttgccgccgcgctcaaatgcacggtcttcggcggtcgcatcggcgcaccgacgcgcgaagagaccgaggaagccatgcggcaatggctggaacgggaaagcgaacctgcgttgcgcgcctcctgagcgcatccattgcccgcataaaactattccatttttgcgatgcatttaaat

SEQ ID NO: 114 - DNA, 1334 bp, Arabidopsis thaliana
aactctttgtttcttgtttgttgattaacccttaattaaatggcggagatgtcttaccttcagatcgacgatgctaacgatgccgttttcaaccattaccgccaccaacggcggctacatgatcacctgagagatcaatcgttttctcagatcctatatccgcttcctcactggatccaatcagacgacggcgatctctacatctctgaaaccgatttttcttccggcgacgtttcggtgtccgatctagtattcacgaccgacgacggtctcgatcttctcgatcggcgtagctttgttatggatctgttccaccaacgcgttgagcaatctcaggtaactccgcttgataatgacggaatcgatgatttcgaaaattacgagatgcgtgaggataatgtggaacttgattttggattggagatggaatctggtaacggtttcgttgatagtgatcttgttgttaaccttaatgaacacgttgatgggatgaggttattagggattgagtcaggcgatgttatagttacagtggaatcgtgttttgattctgatgatgaagatgatcaagagaaggaagagagtgagatttggggaatagatttgaatgaagaagatgagtatgtgaatgatgatgatgataatgatgatgaagaagaagatgctagtgtgacaatccctctttgttgggattcacttcaattagaagatttaggaataaacaatgaggattgcgagtgggaagaagttgatagtgatgatgagagggaggttttgagtgttttagcagaagctgatgataacaattctgtatcagtctctgtcgcagctacaatatctttggaagatttagcgataagtgagagaaggggaagtagtaatctagggtgggaagttctgttgaattctcgtagtctcgagtttaatctagatgatgcagaaagcaacttggagttatacattggtgatattgatcatgaagaagaagattatgaagattatcttcatacaacagagtatgagatgttgtttgaagctgagatttcatctggtattggtaagcctccagcatctaaatcattcataaagaatctgaaagtgtctcctttgagcaatgaggatgttatggagaacgatgatgatgcggtgtgttgtgcggtttgcaaggaagagatgattgtaggaaaggaggttgcagagttgccttgtagacataagtaccatagtgaatgtattgttccatggcttgggattagaaatacgtgtcctgtttgtcgttttgagttgccttcagattgaggaaattggagctctgcagagctttcgttcgtatc

SEQ ID NO: 115 - DNA, 1305 bp, Arabidopsis thaliana
aactctttgtttcttgtttgttgattaacccttaattaaatgtcttcttcttccttgatacttctcttctctactctctctctctttctcaatgtctcactcgcagacaatcacacggcggttgttataacaacctcagatactccaccgccacttcctccgccttctccaccgccacggcataacttcacttcctctctcatgcccggaatcgcagtcgttatcgccgtcctcactgcgtttttctctctcactttcttacttctcctctacgtcaaacactgtaaacgacgaaacggcagcgtttacgtaaaccacccgcagcgtttcgcaatcactagatacggaggaggatattacaacggtggaggagtagtaggaggaaggaaaaactccggtatagaccggtccgtgattgaatctttaccggttttccggtttggtgcattaagcggtcacaaggatggtttagagtgcgccgtgtgtctcgctcggttcgaaccgacggaagttctgaggttattgccgaaatgtaaacacgccttccacgtggaatgtgttgacacgtggcttgacgctcactccacttgcccgctttgccgttaccgggtcgacccggaagatatactcttgatcggtgattgtaactcctggttcgagctccagttctctaaagatgaatcaaacagtgttaataataatcctcccggtttaacccggtttattccggttagtcgaatttccggtcgtcattcctcggctggtgaacgagcgagtcgactcaacgagattagaacatcttcgtcgtataaatcgaatccgatgtcgtttcggagatcactcgatagctctctgaaagttaacgacgccggcgaggagaaatcggaatctgtcgccgttaattgcttggatcgtctacagagaaaagacggattgttgttgattccgaatcgggagagctttgaggggagatttgagcaccggataattatctccggcgggaatcgagacgatcagaggtggagcgaagtaaggccgtcggatcttttgtatttacgatcagagatgatactcagcgattgccggaaattagctgcggcggagggtggcagagatgtaattaacgggagaagtgtgtcggagttaacgggaattgagagacggaggagatggggaggagagccgagacaacgacaagccacggcggtgatttcgaggtggctcgcttggtcccaccgtgcctccgcttccagcattgtttaaggcgcgccaaaaattggagctctgcagagctttcttgtatca

SEQ ID NO: 116 - DNA, 1399 bp, Arabidopsis thaliana
ttaattaacattgggagagcgatcatggcgacgagagcaaacgtacctgaacaagtcagaggtgctcctctcgttgatggtttgaagattcagaacaaaaacggtgctgtgaagagtcggcgtgccctcggtgacatcggaaatcttgtttctgttcccggagttcaaggaggaaaggctcaacctccgattaatcgacccattactcgaagtttccgtgcccagttattagcgaatgcccaactcgaaagaaagccaatcaatggagacaacaaggttccagctcttggtccaaagagacaacctcttgctgcaagaaacccagaggctcaaagggcggttcagaagaagaatctagtggttaagcaacagacgaagcctgttgaagtgatcgagacgaagaaggaggtgactaaaaaggaagtagcgatgtcacctaagaataagaaagtgacgtactcgtctgtacttagtgctcggagcaaagctgcttgtggtatagtcaacaaaccaaagattatcgatattgatgaatctgacaaagataaccatttggctgcggtggagtatgttgatgatatgtactcgttctataaagaagttgagaaggagagtcagcctaagatgtacatgcacattcagactgaaatgaatgagaagatgagagcgatcttgattgattggttactagaagttcacatcaagtttgagctcaaccttgaaactctgtacctcaccgtcaacatcattgatcgattcctctctgtgaaagctgtccctaaaagagagttacagctagtgggaatcagtgccttgcttattgcttccaaatatgaagaaatctggccacctcaggttaacgatctggtgtatgtcacggacaatgcttacagtagcagacagattctggtgatggagaaggcaattcttggaaacctcgaatggtatttgacagtcccgactcaatacgtcttccttgtccgcttcatcaaagcttcgatgtctgatccagaaatggagaatatggttcacttcctcgctgaattggggatgatgcattacgacaccttgacgttctgtccctccatgcttgctgcttcagctgtttacacggcaagatgctcattgaacaagtcccctgcttggactgatacattgcagttccacaccggctacacagagtctgagattatggactgctcaaagcttttagcttttcttcactcgagatgcggtgagagcaggctacgtgcagtgtacaagaagtactcgaaggcagagaatggaggtgttgctatggtttctccggccaagtctctcttgagtgctgctgctgattggaagaagcctgtttcttcttagatgttttttttcatcagatctctctctgaatttaaat

SEQ ID NO: 117 - DNA, 1777 bp, Arabidopsis thaliana
ttaattaaaatggaagtggaagaagaggtctcaagatgggaaggctacgccgattggagaaacagagcagccgtgaaaggccgtcacggtggcatgctcgccgcctctttcgtcttagtggtggagatattagagaatctagcgtatttggcgaatgcgagtaatcttgtgctatacctaagagaatacatgcacatgtctccatcaaaatcggcaaatgacgtcaccaatttcatgggcacagcttttctcctagctctcctcggtggtttcctctccgacgctttcttctccacttttcaaatcttcctcatctcagcttccatcgagtttttgggattgatcatactcacaattcaagctcggacaccatccttaatgcctccatcgtgcgatagtcccacatgtgaagaagtgagtggttcgaaggcagcgatgctattcgtggggttgtaccttgtagctttgggtgtgggagggatcaaaggttcattagcatctcacggagcagaacagtttgatgagagtacacctaaaggtcggaaacaaaggtcaacgttctttaactacttcgtgttttgtcttgcttgtggagcactagttgctgtcacgtttgtagtttggttagaagacaacaaaggatgggaatggggattcggtgtttctaccattgctatcttcgtctctattctcatctttctctctggatcaagattttataggaacaagattccatgtggaagtcctctcaccacaatcttgaaggttcttcttgcggcttcggttaagtgctgctcgagtggaagttcaagcaatgcggttgcgagtatgtccgtgagtccctcaaatcattgcgtatcaaaggggaaaaaagaagttgaatcacaaggagaattggaaaagccacgtcaagaagaagctttgcctcctcgggcacaactaactaacagtttgaaagtattaaatggagctgcggatgaaaaacctgtccatagattgttagaatgcacagtccaacaagtggaagatgtgaagattgtcttgaaaatgcttccgatatttgcttgcaccatcatgcttaactgttgcttagctcagctctctacattctccgtccaacaagctgcttccatgaacacaaagataggaagcctaaagatacctccagcttccttaccgatcttccccgtcgttttcataatgatcctcgcacctatctacgaccatctcattatcccattcgctagaaaagctaccaagaccgaaacaggagtcactcatctacaaagaatcggagtaggtttagttctttcgatattagcaatggcggttgcagctctagttgagattaaacgaaagggagtggctaaagactccggcttgcttgactcgaaagaaaccttacccgtgactttcctatggatcgcacttcagtatcttttcctagggtcagccgatctattcacactagctggactactagagtatttcttcacggaagcaccttcctcaatgagatctctcgcaacatcgctctcgtgggcttctttggctatggggtattacctaagctcagtgatcgtgtccatagtaaacagcatcacaggaagctcagggaacacaccttggctcagaggaaaaagcataaaccgttacaaactagactacttctattggctaatgtgtgttcttagtgcagctaacttcttgcactacctcttttgggcaatgcgttacaagtatagatcaactggttcaagaagctaaaaatttaaat

SEQ ID NO: 118 - DNA, 1410 bp, Arabidopsis thaliana
atgggtcgcaacgtcaaaaccaaggcaaagaggaagaacaagaagaaagcagaggcgtcttcttccgagataccatcgataccaactagggtttggcaaccaggtgttgatacccttgaagatggagaagaacttcagtgtgacccttctgcttataattctctccatggcttccatgttggttggccctgtctgagctttgacattttaggtgataagttgggtttgaaccgaactgagtttcctcacacactttatatggtggctgggactcaggctgagaaagcagctcataactccatagggttatttaaaatcaccaacgtatctggtaagagacgtgatgttgtgcctaagacatttggcaatggtgaggatgaggatgaggatgacgaagatgacagtgacagcgatgatgatgacggagatgaagcttctaaaactccaaatattcaggttcgaagggttgctcaccatggatgtgttaaccgtatacgtgcaatgccacaaaactctcatatctgtgtctcttgggcagattctggtcatgtacaggtctgggacatgagctctcatcttaatgctttagccgaatcagaaacagagggtaaagatggaacttcaccggttcttaaccaagcacccttggttaacttttctggtcacaaagatgaaggctatgctatagactggagtcctgcaaccgctggaagacttctttccggggactgcaagagtatgattcacctgtgggagccagcttctggttcatgggctgttgatcctattccgttcgctggacacactgcaagtgttgaagatttacaatggagtccagccgaagaaaacgtgtttgcctcatgttctgtggatgggagtgttgcagtctgggatattcgacttgggaagtcccctgcactatctttcaaggcacataacgcagatgtgaatgtcatctcatggaacaggctggctagttgcatgttggcctcaggaagtgatgacgggacattctccatccgtgatcttagactgatcaaaggtggagatgctgtggtagcacattttgagtaccataagcatcctattacgtcaattgaatggagcgctcatgaagcttcgacacttgcagtcacttccggtgataaccagctcacgatatgggatctatccttagagaaggatgaagaagaagaggcagagttcaatgcacagaccaaggaactagtcaacacacctcaagacttgcctcctcagcttctctttgttcaccaaggacaaaaagatctgaaggaacttcactggcacaaccagattccggggatgatcatctcaactgctggtgatggtttcaacatcttaatgccttacaacattcagaacacgcttccgtctgagctaccagcctga

SEQ ID NO: 119 - DNA, 840 bp, Arabidopsis thaliana
atggcaggcagagagattctccataagatgaaggttggattatgcggatctgacacaggcagaggtaaaaccaaggtgtggaagaacatcgcacacggttatgactttgtgaaaggcaaagcgggccatccgatggaggactatgttgtgtctgagttcaagaaagtagacggccatgatttgggtttgtttgctatctttgatggtcacttagggcatgatgtagccaagtacttgcaaaccaatctctttgataacatactcaaagagaaggatttttggactgatacgaaaaacgctataaggaatgcatacatatcaaccgatgctgtgatattagagcagtcacttaaacttggcaaaggtggatcaacggctgtaacaggcattctgatagatgggaaaacgctagtgattgctaacgttggagactcacgtgcagtgatgtcaaagaacggtgttgcttctcaactctctgttgatcatgaaccaagcaaggaacaaaaggaaatagaaagccgtggtggctttgtatcaaatattccaggggatgttccaagagttgatggacaactagcggttgctagggcgtttggagataagagcttaaagatacatctgagctcagatccagacataagagacgagaatatcgatcatgagactgagtttatccttttcgcaagtgatggagtttggaaggtgatgtcgaaccaagaagcggtggatttgatcaaaagcataaaagatccacaagcggcagccaaggagttgatagaagaagcagtctctaagcaaagcacagacgacatttcttgtatagttgtaaggttccagtga

SEQ ID NO: 120 - DNA, 813 bp, Arabidopsis thaliana
atggagctgtcgtctgcgtccgccatattaagccactcctcctccgccgctcagcttctcagacctaagctcgggtttattgatttgcttcctcgtcgagcgatgatcgtttcttctccttcttcttcgcttcctcgatttttgcggatggaatctcaatctcagcttcgccaatctatctcttgctctgcttcttcttcttcttctatggcattaggtagaattggagaagtaaagagagtaacaaaggaaacgaatgtttcagtgaagattaatttggatggtactggagttgcagatagttctagtggaattcctttccttgaccatatgttagatcaacttgcttcgcatggcttgtttgatgtgcacgttagagctactggtgatgttcacattgatgatcatcacactaatgaagatatagctcttgccattggaactgctctattaaaggctcttggtgagcgtaaagggattaaccggtttggtgacttcacagctcctctagatgaagcgcttatacatgtttccttggacttgtctggtcgaccatatcttggttacaacttggagataccaactcagagagttggaacatatgatactcagttggtggagcactttttccagtcgttggtgaatacttctggtatgactcttcacatccggcagctcgctggtgaaaactctcatcacataatagaggcgacgtttaaggcgtttgccagagctctacgacaagcaacagagactgatccacgccgtggtgggacaataccaagttcaaaaggagtcttatcacggtcttga

SEQ ID NO: 121 - DNA, 1560 bp, Arabidopsis thaliana
ttcatttatttgtcagctttcaaactctttgtttcttgtttgttgattaacccttaattaagatgtctttaggttacgcagagaaattatccttcattgaagatgttggtcaagtcggcatggctgaattcttcgacccatctcatcttctacaatgcaagattgaagaacttgctaagttgattcaaaagagtaagcatctagtagtctttactggtgcaggcatttcaacttcttgtggtattcctgatttccgaggccccaaaggaatttggacgttacagcgcgagggcaaagatttacctaaagcatctctgccatttcaccgtgcaatgccgagtatgacccatatggctttggttgaattagaaagagctggcattttaaaatttgttatcagtcagaatgtggatggcttacatcttcgatctggaataccaagagagaagctttctgaactgcatggagactcttttatggagatgtgcccatcatgtggagcagagtacctgcgtgatttcgaggtggaaactattggattaaaggagacatcaagaaagtgttctgttgaaaagtgtggagctaaacttaaagatacggtcttggattgggaggatgctttgcctccaaaagaaattgatcctgcggagaagcactgcaaaaaggctgatcttgtactctgtttgggtaccagtttgcagataacccctgcttgcaatttgcctctcaagtgtctcaaaggtggaggcaagatcgtcatagttaatcttcagaaaacaccgaaagacaagaaagcaaatgtagtgattcatggtcttgttgataaggtggttgcaggggtcatggaatcgctcaacatgaagattcctccatatgtcagaattgatcttttccagataatcctaactcaatctataagcggagatcagaggtttattaattggaccctgcgtgttgcgagtgttcatggattgacttctcagttaccattcatcaagtctattgaggtttctttctcagataaccataattacaaagacgcagttctcgataagcagccttttcttatgaaaaggagaacagcacgaaacgaaacttttgatatattctttaaagttaactacagtgacggttgtgactgtgtctccactcaacttagcctcccatttgaattcaagatttcaacagaagagcatgtagagattattgacaaggaggctgtgctacaaagcctgagagagaaagcggtagaagaatccagttgcgggcaaagcggtgtggttgagagaagagtggtttctgaaccgagaagtgaggctgttgtgtatgctacggtgactagtctcaggacttaccatagtcaacaatctctgcttgctaatggagacctgaaatggaagctggaaggttctggaacatcccgtaaacgctctagaaccgggaagcgaaaatcgaaggctctggcagaagaaaccaaggcatagatttaaatacccagaaatacccagcaaattggagctctgcagagctttcgttcgtatcatcggtttcgacaacgtt

SEQ ID NO: 122 - DNA, 2581 bp, Arabidopsis thaliana
ttaattaaatttggctcaatcgtaacatgtgattgctgttacaaaccacgaacaaaaaatggttgataacagtaacaataagaagaggaaagagttcatcagtgaagcagacatcgccactcttttgcagagatatgatactgtgacgatactgaagttgctacaagaaatggcgtattatgctgaagcaaagatgaattggaatgagttagtgaagaagacaagtactggaattactagtgctagagaatatcagttgctttggcggcatcttgcttatagagattctctcgtccctgtgggaaataatgctcgagttctggatgatgatagtgatatggagtgtgaattggaagcatcccctggagttagtgttgatgtagtaacggaagctgttgcgcatgtgaaagtgatggctgcttcctatgtgccaagtgagtccgatattcccgaagactcaacggttgaggctcccttgaccattaacataccttacagcctgcatagggggcctcaggaaccatcagactcatattggtcatcaagagggatgaatatcacctttcctgtttttcttccgaaagcagctgaaggacataatgggaatgggttagccagtagcttggctcctcggaagagaagaaaaaaatggtcagctgaggaggatgaggagctgattgctgctgttaagcgacatggtgaaggcagctgggcccttatctctaaggaagaatttgaaggagagcgaacagcctcacaactctcacagcggtggggggctataaggagaaggactgatacttcaaacacttctacccaaactggcctacagcgaacagaagcacaaatggcagctaatcgtgcattatctttagcggtgggaaatcggttaccctcaaaaaaacttgcagtaggtatgactccaatgctgtcatccggtaccatcaagggagcacaagccaatggtgccagcagtggtagtacattgcaaggtcaacaacagcctcagccacaaattcaagcattatcacgggcaacaacatcagtgccagttgcaaaatctcgagttcctgtaaagaaaacaacagggaactccacttcgagagcagacctaatggtaactgctaattcagtagctgctgcagcctgtatgtctggcctggcaaccgctgtaacagtgcctaagattgaaccaggaaagaatgctgtttctgcgttggtgccgaagactgaacccgtaaaaaccgcttccacagtttctatgcctcgtccttcaggtatatcatcagcactgaatactgagcctgtaaaaaccgctgtggcagcctctttgcctcgttcatcaggtattatttcagcaccaaaggttgagcctgtaaaaaccgctgcttcagcagcctctttgcctcgtccatcaggaatgatatcagcaccaaaggttgagcctgtgaaaaccaccgcctctgtagcctctttgcctcgtccatcaggtattatttcagctccaaaggctgagcctgtaaaaaccgctgcttctgcagcctcttcgcctcgtccatcaggaatgatatcagcaccaaaggttgagtctgtgaaaaccaccgcctctatgcctcgtccatcaggtattatatccgcaccaaaggctgagcttgtaaaatccgccgcttctgcagcctctttgccttgtacatcaggtattatatcttcaccaaaggctgagcttgtaaaatccgccgcttctgcagcctcttttcctcgcccatcaagtatgctatcagcaccaaaggctgacccagtaaagattgttcctgctgctgccactaacactaaatcggttggacctttgaatttaaggcatgcagtcaatggaagcccaaaccacacgataccttcatcaccctttactaagcctttacatatggctcctctctccaaaggatctacaatccagagtaattcagttcctcctagttttgcatcgtcaaggttggtccccacacagagagctcctgcggctactgttgtcacgccacaaaagccaagtgtggtagcggcagctactgttgtcacgccacaaaagccaagtgtgggagcagcagctactgttgtaacgccacaaaagccaagtgtgggagcagcagctaatgttgtaacgccacaaaagccaagtgtgggatcagcagctactgttgtaacgccacaaaagccaagtgtgggagcagcagttaccgtcacttccaagccggttggtgtacagaaagagcaaactcagggaaacagagcaagccccttggttacagcaacacttccgccaaataaaaccatcccagcaaattcagtgattggcacagcaaaagcggtggctgcgaaagtggagactcctcctagccttatgcctaagaaaaatgaagtagttggcagttgcaccgataaaagttcattggataaaccacctgagaaagaaagtactaccacggtgtcacctctagctgtagctgcgactaaatcaaaacccaaagatgaagcaaccgtgacagggaccggactgaaggagttgtagttcatttactggcgcgcc

SEQ ID NO: 123 - DNA, 195 bp, Arabidopsis thaliana
atgagcgaccctagcggccaatcttcaacaacgactgtcggtggaattgccggcggtagcggttgtaacggaggaggtggtggaagtggcagtggaagcggcggctcctttgggaatcagccgaggagatcaaaggtgaggaagcaagtgtgggctggagtactcggcatctcatccgactccaccaacaattaa

SEQ ID NO: 124 - DNA, 1281 bp, Arabidopsis thaliana
atgacgaccattcgatcttcaccttcttcctctcgttgttccaattcgtcttcctcttcttcttattcactcgcttccacaagtttgtctaacagacttgagactatattcaagaaagcttcagagctttgcactctctgtgatatcgaagcctgcgtcatctattacggaccagacggagaacttaaaacatggcctaaggagcgagagaaagtgcgagacattgctctgaggtttaatcaattaaacgaagccttgagacacaagaaaagcgttaatcttcatgggttcctgaacaagaagaagaagaacaagggtttgaagaatccgaacaagaagaagaagacgagtcttaagaacgtgaatgttttaaagtatccactcgctgatcattactctcccgaccaagtttctcaattgactcagtccttagaactcaatgtctctaaattccaagaaaggcttcgatttcttgagtcgcagaaacagaatgagacaaaaccggatcatcagagtttaacatcaatatcttctctgaaccaatctttgaaccctagccagttctcgctgtttatgtataaccatggatataatactctgtctcagatcccagtctctgcatcaaatttcaatcaggattatatctcagcgttacttgaacaatctgagttgaagagtcagataatgaagcaggaggtttgtggttatgagcagaacatgtgcatgagtaaccatggagatgctacgctctctcaaatcccattctctgcatcaaatttcaatcaagatttttcagccaacaacaacttccaacattcttttgtctcaaacacacaagattactactctgttcaaaaatctgtgaataacaactatgggttgaagaatcagttaatgaagcacgatctttgtggttatgagcacaacatgtgcatgagtaaccatggagatgctaccttctctcaaatcccactctctgcatcaaatttcaatcaagatttttcagtctcaatacaagaagaatctggcttgatgcagcaggagctttgtggttatgatcagaatcagaacatgagcatgggtgacatcacaaacaacaattttcaagttacttgcgcctcagtactagaatctgtgaacaactttgggttgaatcagttgatgcacaaggagttttatggttgtcatcaaaacatgtctatgggtaacatcaataacaacagctttcaacatccttgggtctcaaacgcagaccatactcggcggtacaagaatctgtga

SEQ ID NO: 125 - DNA, 1358 bp, Arabidopsis thaliana
ttaattaagggtttgcctaaaagttgtcgtcacttgtggattttggtctgagaaatgatgatgtcatgtcggaatatagacttgggtacgagtgttcttgatcattcttgtagctcttcttcaacaagtcgtcgattcttgtttggcaattcttcgaagaccgtttgtatgattggtggcagaagctgtgttggaaatttggtatttctccggcgagatttggctacttgcagagctgttccggctaaatccaaggagaattctctggtcaacggtattggtcaagatcaaacagtgatgctcaatctgaggcaagagtcacgaaagccaatatctttggaaactctgtttgaggtcgtagctgatgatttgcagaggttgaacgacaatcttttatcgattgttggtgcagaaaatccggttttgatatctgctgctgagcaaatcttcagcgctggtggcaagaggatgagaccgggtttggtattccttgtatcacgagccactgcggaattagcaggcttaaaggaacttacagtagaacatcggcgtttaggtgagatcattgagatgattcacaccgcaagtttgatacacgatgatgtgttagacgaaagtgatatgcgaagaggaagggaaacggttcacgagctattcggaacaagagtagctgtattagctggggatttcatgtttgctcaagcatcatggtacttagcaaatctcgaaaaccttgaagtcattaagctcataagtcaggtgatcaaagattttgcaagcggtgagataaagcaagcatcgagtttattcgattgtgatgtcaagcttgatgactacatgctaaagagttactacaagacagcttcattagtagctgcaagcaccaaaggagcagcaattttcagtaaagtcgaaagcaaggtcgcagagcaaatgtatcagttcgggaagaatctcggtttatcttttcaagtagttgatgacattctggacttcactcagtccacagagcagttaggtaagcctgcagctaatgacctagccaaaggtaacataacggcgccagtgatcttcgcgctagagaatgagccaaggctaagagagatcattgagtctgagttttgtgagcctggatcgcttgaagaagcgattgaaatagttagaaatcgcggtgggatcaagaaagctcaagaattagcaaaggagaaagctgaacttgcgttaaagaatttgaattgtcttcctaggagtggtttcagatcggctcttgaggatatggtaatgtttaatcttgaaaggattgattagtttcaaagggtatttggcagaggaaactgtaacaacactcttggcgcgcc

SEQ ID NO: 126 - DNA, 591 bp, Arabidopsis thaliana
atgatcactgggattccaaatcctaatgccagagcagcttataatcccgggccagcagaaacggttacaacggttatcgtggagaaaaaggctattgaagaaagaagccgaagaactcggtcaaaacatatgcatttcaggtctgattattcagatatctcaccggttaattctgattccatctcaccaaaataccagccgccgaaacgaagaaagcagcatagaagaaagcgagtacataaccaagaaccatgtttgatgagaggagtctactacaaaaacatgaaatggcaagccgccattaaagtcgagaagaaacaaatccacttaggcactttctcttctcaagaagaggctgctcgcttatacgatagggctgctttcatgtgtgggagggaaccgaactttgagctctcggaagaagttatacgagaactcaaacagcaaagctgggaagagttcttgaattgcacacgccgaacaattacgaacaaaaaaccaaagagtaggatagaacatgaggatacgaagatcaatgccagcatgccacatcaaccagaagaagaagagcaagattcagacaaaatgtga

SEQ ID NO: 127 - DNA, 783 bp, Arabidopsis thaliana
atggcttcttcgtcttctatgcagatggttcacacttcccgctccattgcccagattgggttcggtgttaagtcgcaattagtttctgcaaatcgaacaactcaatcagtttgctttggagctcgttcctctggaattgcattatcttcgagattgcactatgcatcacccattaagcaattttctggggtttatgcgaccaccaagcatcagagaaccgcttgtgttaaatccatggctgctgaggaagaagaagtaatcgaacctcaagctaaagtgacaaacaaggtttactttgatgtggaaattggaggtgaagttgctggcagaattgtgatgggtctctttggagaagttgtgcctaaaaccgttgaaaacttccgtgccttgtgtactggtgagaagaaatacgggtacaagggttcctctttccatcgtattattaaggatttcatgatccaaggaggtgatttcaccgagggaaatggtactggaggtattagtatttacggtgccaagttcgaagatgaaaacttcaccctgaagcatactggacctggaatcttgagcatggcaaacgctggtcctaatactaatggaagccagtttttcatttgtaccgtcaagacttcatggttagataacaagcatgtcgtgtttggacaagtaattgaaggtatgaagcttgttaggactcttgagtctcaagagactcgcgctttcgatgttcccaagaaaggttgtagaatctatgcctgcggagagctcccgttagatgcttga

SEQ ID NO: 128 - DNA, 837 bp, Arabidopsis thaliana
atgacgcaatcatcatcaaagccacctcttgctaattgcaagatctctgttccagcgtgggagaaggatttttgtgctgtgattggttcagttccatggtggaaagttgtagaggccaagcggtttatgcacatatacgatagagtggtccaatgggacgactcagctggtgaagacgcattcaagaacgctaaatctcgtttctgggcagagataaatggtttaacttgtgacttatctttgcctgatcctgatgtttacattgatgatgttgattgggatgctgaagttgacaatgagttgatacttgaccttgaacgtggtccagaccctttaacagaagaacaagagcatgttgtgatactcgatgctttggttttatctggacagtatggcgggcttggttggggaactggttggggtgacgctgaagggattaacgaggagaatgttggaaagggtaaaccagaaaactcatggggtgatcagaaatatgatggatggaatgaagattcttgggggataaaggagaaaactgaaacttgggatcataacaacaacaacaccaacactgattcttgggatcataacaacaacttcaaagctgaaacttgggatcagaaaaactgcaacaacaacagcttcaactacaagaaggttgagaattggaatggtagggatcaaggaagagagaacagagggtggagaaagagaggagaagggcgacatggaggagaacgagtggaggattgtcgatggaggaatgggagagggagaagcagaggcgggtttcagcaacattcggcgaatgcatggggttggactgaatccttctga

SEQ ID NO: 129 - DNA, 618 bp, Arabidopsis thaliana
atgttttctcttatgtctggactatggagttacatgtttagcaagactgagtttaatgtgcttattcttggtatcgacaaagctgggaagacgacatttttggagaaactgaagacgatatactcaatctcggaaggtcttcctcatgatcgaattgttcctactgtggggcttaatattggtcgcattgaagtctccaatgctaaaattgtgttctgggatctgggaggtcagcctggtttgcggtctatttgggagaaatactatgaagaagcacacgcgttgatatatttgattgatgcagcttgcccaacccgctttgaagattctaaatctgctttagaaaaagccctgcggcatgaggatttgcaaggagcccctcttttaatattggcaaacaagcaagacctcacaaatgctgtatcggctgaggaactggaccgataccttgatttaaagaaattggatgaaagagtgtacatgtttgaagcagtttctggatatgatgggcgaggaatcaaagaaagtatagaatggctggttggagtaatggagaaaagcaagagaaccgaatcattaagagcccgtgcagggtacactcctgtgccaaattcatag

SEQ ID NO: 130 - DNA, 1034 bp, Arabidopsis thaliana
ttaattaaaaagtccagaaaccaacacagttcaattttacgaaacctctcagaaatggagaagtacgagaagctagagaaggtcggagaaggaacatacgggaaagtctacaaagcgatggagaaaggaactggtaagcttgttgctctgaagaaaactcgtctcgagatggacgaagaaggtattccaccaactgctcttcgtgagatctcgcttctccagatgttatcaacatcgatctatgttgttcgattactctgcgtcgaacatgttcatcaaccatcaaccaaatctcaatctaccaaatccaatctctatctcgttttcgagtatctcgatactgatcttaagaaattcatcgattcgtataggaaaggacctaatcctaagcctcttgagccttttttgattcagaagttgatgtttcagctttgtaaaggtgttgcgcattgtcatagtcatggtgtgcttcaccgtgatcttaaaccgcagaatcttcttctggtgaaagataaagagcttcttaagattgctgatttgggtcttggtcgtgcttttactgttcctcttaagtcttatacgcatgagattgttactctttggtatagagctcctgaagttcttcttggatctactcattattcaactggtgttgacatgtggtctgttggttgtatctttgctgagatggttcggaggcaagctcttttccctggtgattctgagtttcagcaattgcttcatatcttcaggttgctaggaacaccaactgagcagcaatggccgggtgtttccacactgcgtgactggcacgtttaccctaagtgggagccgcaagacttaactcttgctgttccttctctttcacctcaaggagttgatcttctcacgaaaatgctcaagtacaatccagccgaaagaatttcagcaaaaacagcacttgatcacccatattttgacagccttgacaagtctcagttctgaagttcattgctgtatctgttgtcatcgtcttgggaatttaaaggcgcgcc

SEQ ID NO: 131 - DNA, 810 bp, Arabidopsis thaliana
atggcaaaggaagggggcttgggagagaactcaagatggagtcttggaggcatgaccgctcttgtcactggtggctctaaaggcatcggggaagctgtggtggaggaactagccatgttgggagcaaaagtccacacgtgtgccagagacgaaactcagcttcaagaacgcttacgtgaatggcaagcaaaagggtttcaggtcaccacttctgtctgcgacgtctcttctcgtgaccaacgagtgaaactcatggaaactgtttcctctctctaccaaggaaaactcaacatcctcgtcaacaatgtgggaacgtcaatattcaagccgaccacagagtatacagcagaagatttctcttttgtaatggctacaaatctcgagtcagctttccatctctcacagcttgcccacccattgttaaaagcctctggctcagggagcatcgtgctcatatcctctgctgctggagtcgtgcatgtcaatgttggatccatctatggagcaaccaaaggagccatgaatcagctggctagaaacttagcttgcgaatgggcgagcgacaacataaggacgaactctgtttgtccttggtatatcacaactcctttaagtaacgattttttcgatgaagagtttaagaaagaagcggtgcgtacgacaccaatggggcgtgttggagaagcaaatgaagtctcaccgcttgtggcatttctttgtcttccttcagcttcttatattactggtcagaccatttgcgttgacggcggtgccactgttaacggtttttccttcaagactatgccataa

SEQ ID NO: 132 - DNA, 2116 bp, Arabidopsis thaliana
gacgaatttgagagagaaaaaaaaagaaaatcagagataaagaatttgagtttcttggaattaaaggatcgattttgttgaagtgaaattgaaattgattgtgaaaagagaaagagactgatggtagcagaagcagaggttgtgtttcaacagagtttaccggcggttctggagattgagttgtttgacggagtttcctccgccgttaaatctcccgtttcttctccgaaattgggttttactcagtcaacggcgtcggtttccggaagtttaacgacttctcctgtggtaagtcttgtttaaagtttacatttttattttctgggtgagaatttaagaagctgggttctgaaacgtaattagaaattcgactgaattattggttttagtctattaggaatcatcaaataagatgactttattgtaaatattttgcaaacatatccttggatctcttaggcttagaggacctctagttcatgtgtgtttgcgtgtcgtagcaaatatagatgcttgttgtctataactttgccttaatgaagcaactttaaagctgttggagaagccctttgtagttattgtgtgttgttaactgtcttgtcttcactgcttgtgttttatttgttgctatactcaattgagcatccgtgtataccttttatttagcaggctgatatctttccagagggtgattgcgatcctagtgtcttggattatattccgaccatccggtctggaagctttgctgatattgggccaaagagaaacatggaagatgaacacattcgcatagacgatttatcttctcaagttggttccctttttgagttgccgaagcctagtgctttctatgcggtatgtatcgttgcttccttataatctgatgctcttttaagtatacattctgacttgactttcctctgcttaggtttttgacgggcatggaggaccagaagcagcagcatacgtacgggaaaatgccattaggtttttctttgaagatgagcagtttccacagacatcggaagtgagtagtgtttatgtggaagaagttgagacttcattgagaaatgcgtttcttcaagctgatctagctttggcagaggattgcagtatcagcgattcttgtggtaccaccgctctgactgctcttatttgtggaaggtacgtgtttcattcagttttgtttagttctcaatctatctttagaatcttaagagatctcttgcgcatatacgaagatgtgcacaaaggtaaataaatctattgttaggatcttaagagagctcttacatatactagattgtaagtatataacctgtgacatgagcaatattggctatggttttatacttttggttactctttctgttgttgtctttggggtttaactgtgattttctcatgggatacttatgttcttgtcttttgcagactcttaatggttgcaaatgccggagactgcagagcggttctatgcaggaaaggcagagcgatagacatgtctgaagaccataaaccgattaatctacttgagagaagaagagtggaggaatccggcggtttcatcactaatgacggttacctaaatgaagtcctagctgtaacccgagctctgggcgactgggatttaaaactgccacacggctctcaatctccactgatctcggaaccagaaatcaagcagataactctaactgaagacgatgagtttcttgtgattgggtgcgatgggatttgggatgtcttgacgagccaagaagcggttagcattgttaggcgtggcttaaaccggcacaacgatccaacaagatgtgcgcgagagctagtgatggaggctctggggcggaactcatttgataatttaactgcggtggtggtatgtttcatgacaatggacagaggggacaagccggtggtgccattggagaagagaaggtgttttagtctttcgcctgaagctttctgtagcttgaggaatctgttggatggctgaaactagtgtgttttctggtgaaaaccgatgattatataattgatgatgacgaataatctctcccacggctgcttttgtatttagagattttacgcagctgagagaactcttttgagatat

SEQ ID NO: 133 - DNA, 384 bp, Arabidopsis thaliana
atggcatctcctaaatcctcaacaagaccaaaccaagaaaaccaagaacctcagttccaagatttcttcccaacaatggcaggaaaactcggtggagaaggtctgatcgaagagatttgcaaagggttcgagcttcttatggacaaagacaaaggagtcatcacattcgagagcttacgaagaaacgcatcgacggttcttggactcggagatctaacggacgacgatgttcgatatatgatcaacgaaggagattttgatcgagacggtgcgttgaatcagatggagttttgtgtgctcatgtttagacttagtcctgaattgatggaagcgtcacggtgtgttgtgacggaggtgatcgaggaagagttttaccggcattga

SEQ ID NO: 134 - DNA, 1204 bp, Arabidopsis thaliana
  misc_feature (11)..(79): n is a, c, g, or t
  misc_feature (441)..(441): n is a, c, g, or t
  misc_feature (443)..(443): n is a, c, g, or t
  misc_feature (516)..(635): n is a, c, g, or t
  misc_feature (637)..(637): n is a, c, g, or t
  misc_feature (649)..(649): n is a, c, g, or t
  misc_feature (660)..(660): n is a, c, g, or t
  misc_feature (667)..(667): n is a, c, g, or t
  unsure (1)..(1204): unsure at all n locations
atgatactccnnnnnnnnnnnnnnnnnnnnnnnnnnnnnnnnnnnnnnnnnnnnnnnnnnnnnnnnnnnnnnnnnnnnnccacgcgtgcgggaggatcaaagaagctatggcttccaatttctggacttcgacgcactacaaagagcttaaggacccacaagaggttaatgttgttcatcctcttgatgctcagagaggaatctctgttgaagatttcagactcattaagcttcatatgtctaattatatatcgaaactggcacaacacattaagattaggcaaagagttgttgcaactgcagtaacctatatgcgtcgtgtttacacaagaagagtttgacggaatatgagcctcggcttgttgctcctacatgcttggatttggcttgcaaagcaaaagagagtgtggtgcatgccaaacttcttgtcttctacatgananaactttatgcggatgaaaagtttccatttgagattaaagattttctggaaatggagatgaaggtcttggaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnanttcggtccggcnggatcccgggngcccccngtcggggccttccccccctgttggagcggatgaaaaggttcggtatggggttaaaggtatcctggaaatggaggtgaaggtctgggaagcattggacctccaaccttggttgtattccacccatatcgatctctgcctgagttcttgcaggattctggaatcaatgacactagtatgacccatctaacttggggtcttgtcaacgacacatatagaatggacctcatccttatacatccgccgtttctcataacactcgcttgcatttacattgcttctgtacacaaagagaaagacataaagacatggtttgaagagctttctgtcgacatgaacattgtgaagaatattgcaatggagatattagatttctatgaaaaccatagactgttcacggaagagagagttcacgccgccttcaacaaacttgctacaaacccataaagtttcgacttgtctgtgtggggtgttcccttgagaaaatataatgttttgccagaagttttggaaatgagattattctgtttattgtacatc

SEQ ID NO: 135 - DNA, 444 bp, Arabidopsis thaliana
atgcctcatggaactcttgaagttgttcttgtcagcgccaaaggtctcgaggacgcagattttctgaataacatggatccttatgtgcaactcacttgtcggactcaagatcagaagagcaacgttgcagaaggaatggggacaactccggaatggaatgagacatttatcttcactgtctctgaaggaactacagagttaaaagcgaaaatcttcgacaaagatgtcggtacagaggatgatgcggttggtgaagcaactattccgttggagccggttttcgtggaaggaagtattccaccaactgcatacaatgtggtgaaagatgaagagtacaaaggagagatttgggtggctctctccttcaagccctcggaaaaccgaagcaggggtatggacgaggagtcctatgggggctggaaaaactctgaagcatcatactaa

SEQ ID NO: 136 - DNA, 1380 bp, Arabidopsis thaliana
atgcctgggttcgatagaattagcgaattaccggaatctctgattactcaaatactcttatgccttccgactaaagattcggtgaagacgagtgttttatcgactaggtggaagaatctatggctaaatgttcccggacttgacttaacttgcagtgatttcccttttgaagatgaagaatatgaacaagtgttcattaacttcatcgacaggtttctagagtttaatcctgagtcacgcctgcaaacattcgaggtagattacaaaaggcgtgagatacgcgggttcaaggatcggatcggtacagcgattaaccgcggaattcgacttctagatgctgtgagtagtaccatgtattgggaggaggaatgcattatgtatccttatttggagttcatgcctctgaatctctttacaagcaagacgttggttactttaaagctccgggattcggctcttaacgatccgggtttgctttctatgccttgtcttaagttcatgattcttcgtgaagttcgatggtctggtaccatgagtcttgagaagcttgtctctggatgtcctgttcttgaagacctgaccttggtaaggaccttgatatgtcatattgatgacgatgaattgccggttactcgtgtgagatctcggagtctgaagacgttttatgttccgctcgcgtatggagtaggttgtaggtcaagagtcccagacaaagtacttgagattgatgctccaggactagagaatatgactctcaaagaagaccatttcgatggaatcgtggtaaagaacctgacttctttgttcatgattgaacttaatatcaagtttgctgtcgattaccgcaggagttttgatccagaggacttatcgaagagaaatgaaattggtgattttctcactgggatatctcgtgcaagacatatgatcatctctcagaaaacagtgaaggctcttgaaagttactcaaaagttggatcgattcccaaattcaataacttgtcacatttaaaagctgtgttcccgagccccttgttaccgttcttgccagcctttcttgagagtttcccgaatctgaaaaacctaatcttgaagattgcttttgcaaaggatgatgagacggaggagctgaatctcataaacgtgcctcggtgtatcgtatcgactctcgagtgtgttgagataaaaggattgtttgaatgggaggaagaggagatgaaaatagcgaggtactttcttgaaaacgcagcagtcctcaagaaacttactatgagttttatagactaccctcgatatgcttcaaattcagatgtctacgaggaccttgataaactcacaaaacgttctcaacaatgtcgaattatcgttgatgatgagtga

SEQ ID NO: 137 - DNA, 1080 bp, Arabidopsis thaliana
atggagggagacgtcggaataggtttggtatgccagaatactatggatgggaaggcgagtaatggaaatggtttagagaagactgtaccttcttgttgccttaaggctatggcatgtgtacctgaggatgatgctaagtgtcactccactgttgtttctgggtggttttcggaacctcaccctcgctctgggaaaaaaggcggcaaagcagtctatttcaacaaccctatgtggccaggagaagcacactcactgaaagttgagaaagttctgttcaaagacaagtcggattttcaggaagtcctagtgttcgagtcagccacgtacggaaaggtgcttgttctagatggtatcgtacagctgaccgaaaaagatgaatgtgcatatcaggagatgatagcccatctgcctttatgctctatatcttcccctaaaaatgttcttgttgttggtggaggtgatggtggtgttcttcgagagatttctcgccatagttctgttgaggttattgatatctgtgagatagacaagatggttatagatgtgtctaagaagttcttccccgagttagcggttgggtttgacgatcctcgtgttcaacttcacattggtgatgctgctgagttcctccgtaaatcccctgaagggaagtatgatgccatcattgttgattcttcagatcccgtaggtcctgctcttgcgcttgttgagaagcctttcttcgagacactggctagagcgttgaagcctgggggagttctttgtaacatggcagaaagtatgtggctccatactcatcttattgaagatatgatctccatttgccgtcaaacattcaaaagtgttcactatgcgtggagcagcgtccccacatatccaagcggcgtgattggtttcgtcttgtgctctactgaaggaccagctgttgacttcaagaacccaatcaaccctattgagaaactagacggtgcgatgacccataaaagagaattgaagttctataactctgatatgcacagagccgcatttgctttgcccacattcctgcggagagaagtagcttcacttctggcttcttga

SEQ ID NO: 138 - DNA, 1371 bp, Arabidopsis thaliana
atggaggaagagaacgaagtagtgaagacgtttgcagagcttggtgtgcgtgaggagcttgttaaagcttgcgagagattgggatggaagaacccttccaaaattcaagccgaagcccttccttttgctcttgaagggaaagatgtaattggacttgcgcaaaccggttctggtaaaaccggagcttttgcaattcctatattgcaagcactacttgagtatgtttatgattctgagcctaagaaaggacgtagaccggatcctgctttcttcgcttgtgttttatctccaactcgagaacttgcaatccagattgctgaacagtttgaagctcttggtgctgatataagtcttaggtgtgctgtgcttgttggaggtatagacaggatgcaacaaactattgctcttgggaaacggcctcatgttattgttgcaacacctggtcgtctttgggatcatatgtctgatacaaaaggcttttctctgaaatcattgaaatatctggttcttgatgaagcagatagactgttgaatgaagattttgagaaatctcttaaccagattttggaagagatccctcttgagcggaaaacatttcttttttcagcgactatgactaaaaaggttcgaaaacttcaaagggcatgtttgaggaatcctgtgaagattgaagctgcctccaaatattccactgtcgatactcttaagcagcagtatcggtttgttgccgctaaatacaaggattgctatctggtatacattctgagtgaaatgcctgaatcaacatctatgattttcacccgaacatgtgatggtactcgctttctggctttggtgcttcggagccttggttttagagctattcctatcagtggtcaaatgactcagtcaaagagactgggagctttaaataagttcaaagcaggggaatgtaatatcttggtttgtaccgatgtggctagtagagggctcgatatcccatcagttgatgtggttatcaattatgatattcccacaaattcaaaggattacatccatagagtaggaagaaccgctcgtgctggacgttctggtgttgggatatcacttgtaaaccagtatgagctcgaatggtatatacaaatagaaaaactcattggcaagaaactacctgaatatcccgctgaggaagatgaagtcttgtcattgttggagagagttgcagaagcgaaaaagctatctgcaatgaatatgaaagaatcaggaggtaggaagagaaggggagaagatgatgaagaaagtgagaggttcttgggaggtaacaaggacagaggcaacaaggaaagaggtggtaacaaagacaagaagtcttctaagaagttcaaacgataa

SEQ ID NO: 139 - DNA, 1933 bp, Arabidopsis thaliana
ttaattaatgcaactttttctagatttaggacgttacaaatttcaatcatgagtgcatcatgggcagatgtggctgattcagagaaggccgtttctcagtcaaagcctccttatgttcccccacacctacggaacaggccatcagagcctgttgctgctcctttgccacaaaatgatcatgcagggtatggtggtcaaccagctgggtctcgttgggctcctcctagcagtgggggtggtggtgccagcggcggtggctataggaatgatggagggcgcactggctatggttatggtgctggaggaggaggtggtggtggtggtggctggaacaacagaagtggagggtgggaccgtagggaacgtgaagtaaacccatttggagatgatgctgagttagaaccggtctttacagagcaggagaatactggcattaattttgatgcctatgaagatattccagttgagaccagtgggggagacgtgccccctcctgttaacacatttgctgacatagatcttggggatgcattaaatctgaacatccggaggtgcaagtatgtgaggccaacaccggtacagcgtcatgctattccaatactgcttgcagagagagatttgatggcctgtgcccagactgggtctgggaagactgctgctttttgctttccaataattagtggaatcatgaaagatcagcatgtagaaagaccccgtggttcacgggcggtttacccttttgcagtcatcctctcaccaacaagggaattggcatgccagatacatgatgaagccaaaaaattctcctaccaaactggtgtgaaggttgttgttgcttatggaggaacacccattcaccagcagctcagggaactcgagaggggatgtgatatccttgtggcaactcctggccggttaaatgatttgcttgaaagagctagagtctcaatgcagatgattaggtttttagctctagatgaggcagacaggatgctggacatgggttttgagccacagattagaaagattgttgagcagatggacatgcctccacgtggggtgagacagacaatgctgttcagtgctacatttccaagtcagattcagagacttgcagctgatttcatgtcaaactatatatttttggctgtgggaagagttggttcaagcactgatttaattacccaaagggttgagtttgtccaagagtctgacaagagaagccatctcatggacctgcttcacgcgcaaagagagacccaagacaagcaatcattgacattagtttttgtggagacaaagaggggagctgatactttggaaaattggctgtgcatgaatgagtttccagcaacctccattcatggcgatagaacacaacaggaaagagaagtggcactgaggtccttcaaaactgggaggacacctattttggttgcaacagacgtggcagcacgtggtcttgacattccccacgtggctcatgttgtaaacttcgatctaccaaatgacattgatgactatgtccaccgtatcggacgaacaggacgtgcaggcaaatctggaatagcaactgccttcttcaacgagaacaatgcacaactggctaggtcgcttgctgagctaatgcaagaagccaatcaagaggtccccgagtggctcacacgatatgcttcacgtgcttcatttggtggtggtaagaaacggtctggtggtcggtttggtggccgtgacttcagaagggaaggctcttacagtagaggaggaggcggcggcggcggaggaggcggcagtgattactatggcggaggaggctatggtggtggtggatacggtggtgctccaagcggtgggtatggtgctggagtgaccagtgcttgggattagccaattaggctccccaatttttcctctttttaacctgaggcgcgcc

SEQ ID NO: 140 - DNA, 1807 bp, Arabidopsis thaliana
ttaattaattcttagcatgatcaaggtgtctgacttgtgaagtttgttagatgacggatgatgatttctgagaaaccgttgggagaagaatctatacggcaggatctggaggttttaaccgtttcgaggaggcttgtgaaaagtgttagccagaagttgaagaaaaaaattcataaaactgaggtggtggaagatgaagaggttgcaaggggagcggtgaattgtttaagcatcagtgttggttgcagagttgctgatacgggtgaggattttgaggaggatttaagtaataagagatggtctagtgctagtgaggatggtaagggattgatgaccatttgtggaactgaagaaattaggttagattgtttttcttatggggttagagagaggttctggaagaagaataatagaagataccttgcggactcgggccaggattaccgcaagcacgtttatcttcccgatgatattctggaaatgtgtttgatgaggcttcctttgaccagcttattgaatgcacaccttgtttgcaagaaatggcaatccatggccaacactcagcggtttctccagatgagacgagaaggctcctttcaaacaccgtggttgtttctgtttgctgctcttaaagatggatgctcctctggtgatattcacgggtatgatgtttctcaggacaaatggcataggattgaaactgatctacttaaaggccggtttatgtactccgtgacaagcatccatgaggagatttatatagttggaggtcgttctatggacagaaactctttcaagtcccacagagggatcttggtattcagcccttcgatcaaagcatggcgtaaaatcgcgtctatgagacatgctagatcacttcccattgttggtgccactgaagttacttcagagttttcgaccatgcagaccaaacagaatcgccaagatagacgctttcacctgtcaagagttggcggagagtcagacgtttatgaagaccctcacaggctatcggtaagacgacagaacagaaactcggctgatcaaaatggaaccaaatcccacagattaataagacaaaagcttgatcggcttaaccgaaacagctccaagagatttgtgctcattgccataggaggcactggcatattcgatgagccactggattcaggtgaaatatacgactcagcaacaaacacatggtcagaaatgcagagactcccgatgggttttggggttgtaagttgtgggattatatgcaatggaatcttctatgcttattctgagaatgataagctatcagggtatgacattgagagaggcttctggattacaatccaaacatctccaatccctcctcgggttcatgagttctaccctaaacttgtctcctgcaaccatcggttgttcatgctctctgtttcatggtgcgatgaaggagatgggcaaattgggaggagaaacaaggcagtgagaaagctgtgggagttggatcttgtgtacctcacatggaccgaggtttcagtacacccggacgcaccaatggattggaacgccacatatgtctcagaccagaacatactaatgggagttgagatgttcaagatatttgggcaggtattaagtttcttcactgtctgcgatatattaacggaagaagcttcttggagacatgtttcgaggaaccaaaggaatcaaaaacttaatctatcttgtatgaacaagaccattgcattgcttcatctctgattttcgtcattcattttttataactttcaggactcgtcaaaattgattaaggcgcgcc

SEQ ID NO: 141 - DNA, 357 bp, Arabidopsis thaliana
atggcaagagttgttaaaatcgattctgcagagtcatggaatttctatgtgagtcaagccaagaatcagaattgtcccattgtggctcatttcactgcattatggtgtattccttctgtgtttatgaactccttcttcgaagagcttgcgtttaactataaggatgctctgtttctaatagttgatgttgatgaagttaaggaagtggcaagtcaactagaggtaaaggcgatgccaactttcttgttcttgaaggatggtaatgcgatggacaaactcgtgggcgcaaaccctgatgagattaagaaacgggtcgatggtttcgttcagtcctcacgtgttgttcatattgcttaa

SEQ ID NO: 142 - DNA, 1206 bp, Arabidopsis thaliana
atgactatggggaatttcttaaagagatttggaagtggaaaaagcagaagcagtagaaatatgactctgggaacgacgtcgtctcaatctcatgaaccatcaccgtcggatccttcactctcccttgccgataataccaacgccaccaagaagaagtacgctctcatccctgaccgcttctcttccctcgaccaggtatcaaaagctctaagagaagctggtcttgaatcatccaatctcattctcggagttgatttcacaaagagcaacgagtggactgggaaaacttctttcgatggaaaatgtctgcacgcgctcggcgaaacttcgaatccatatgaaaaggcgatttttgtaatcggccaaacgttggctccttttgatgaagacaatctcatcccttgtttcggctttggcgattcaacaactcatgacgaggaagtgttcggtttccatagcgacaattctccatgtcatggcttcgaagaggtcttagcatgttacaagagaattgcacccaacttgcgtctatcagggccaacgtcgtatggaccgctcatcgatgctgctgtcgacattgtggagaagaacaacggacaattccatgttctggtgattgttgcagatggacaggtaacgagaggtacggatatggccgagggagaactcagtcaacaagagaaaacaaccatcgacgcgattgtaaatgcaagctcgtatgctttgtcgattgttttagtcggtgttggagacggaccatgggaagacatgaggaagttcgatgataagatccctaagcgtgaattcgacaactttcagtttgtgaatttcacagagattatgacgagaaactcaccagagtctgccaaagaaactgcttttgctctagctgctctaatggagattccctttcagtatcaagcagccatcgaactccgcttactcgggaagcagacgggcttagcgaagacaatagttccgaggccaccaccaattccgtacacacctccaactaatgctgaactaccatcaactgcatcacctgcatcacctgaacaaacccagagttgcccgatttgtctgactaaccgaaaagacgtggctttcagctgtggccacatgacttgtggagattgcggatccaaaatatcaaattgcccgatctgtcgagtaaggatcacgaaccggctaaagctttacacatga

SEQ ID NO: 143 - DNA, 1248 bp, Arabidopsis thaliana
atggggagctcaatggaggagaaagtggtggctgtgatcatggtcggtggtccaaccaaaggcactcgatttcggccattgtcgctgaatattccaaagcctctgtttcctattgcgggacaaccaatggtgcatcatccaatttcagcttgtaaaagaattccaaatttagctcaaatatatcttgttggcttctatgaggaaagggaatttgcactttatgtttcagccatctctaatgaacttaaagttcctgttagatatctgcgagaagacaaaccacatggttcagctggtgggctgtatcactttagaaatcttattatggaagatagtccgtctcatatcttcctgcttaactgtgatgtttgctgcagtttccccttgcccaaaatgctcgaggctcacaggggatatggtggaattggaactcttcttgtgatcaaggtctctcctgaatcagccagccaatttggagaattggttgcagatccagttactaatgagctgcttcattacaccgagaaacccgaaacttttgtcagtgatcgaattaactgtggtgtttatgtatttacacctgaaatttttaatgccataggagatgtttctactcagaggaaagatagagcaactctaaaacgtgtttccagcttcgaagctcttcaaccggcaacaaggatcccgacagattttgtaagactggatcaagacatcctttcacctctagctgggaagaaacggctatatacttatgagactatggatttctgggagcaaatcaaatctcctgggatgtcgttgaggtgttcaggactctatctttcccaattccgcttgacatctccccaactgttggctagtggtgatggaacaaggagtgccattgtgattggtgatgtttacatacatccttctgcaaaagttcacccaactgcaaagattggtcccaacgtctcaatctctgcaaatgctcgtgttggaccgggcgtcaggcttatgagctgcatcatccttgacgatgttgagatcatggaaaatgcagtggtgactaacgcaattgttgggtggaaatcttctatcgggagatggtcccgcgtccaggctgagggagtctacaattcgaaactcggagttacaattctcggagactcggttgcagttgaagacgaggttgtggtgaccagcagtattgttcttccaaacaagacactgaacgtcagtgttcaagacgagatcattttgtaa

SEQ ID NO: 144 - DNA, 1458 bp, Arabidopsis thaliana
atgaaactggagctggtgttcataccatcacctggtgacggacatctccggccattagtggaggtagctaagcttcatgttgaccgtgacgaccatctctccatcaccatcatcatcatccctcagatgcatggatttagtagcagtaactcttcttcttacatcgcttctctctcctctgattctgaagaacgtcttagctacaacgttctctccgtccctgataaaccagactccgatgacaccaaaccacattttttcgactacattgataacttcaagccgcaggtcaaagccacggtggaaaaacttactgacccgggtccaccagattcgccgtcgcgtcttgctggattcgtggtggatatgttttgcatgatgatgattgatgtcgctaatgagtttggtgttcccagttacatgttttacacatccaacgcaacgtttcttggattgcaagttcatgttgaatacctttacgacgttaagaactatgacgttagtgacctcaaggactcggacactactgagctggaagttccttgtttgactcgtcctttaccggttaagtgtttcccctcggttctattaaccaaggagtggttaccggttatgtttagacaaaccagaagattccgagaaactaaaggtattttggtaaatacattcgctgagcttgagcctcaagctatgaagtttttctccggcgtagatagtcctctgcctacggtgtacacagttggaccggttatgaatcttaaaatcaacggtccaaattcatctgacgataagcaatcggagatcctacggtggctagacgagcagccacgtaaatccgttgttttcctctgtttcggaagcatgggaggtttccgtgagggccaagctaaagaaatcgcaatcgcgcttgagcgaagtggtcaccgctttgtctggtctcttcgtcgtgctcaaccaaaaggatcgataggacctcccgaagaatttacgaatcttgaggaaattctcccggaaggattcttggaacggacggcagagataggaaagattgtaggttgggctccacaaagcgccattctagcaaatcctgcgatcggagggttcgtgtcgcattgtggatggaactcgacgctagagagtctatggttcggagttccgatggctacgtggccgctttacgcagagcaacaagttaacgcgttcgagatggttgaggagctagggctagcggtggaggtccgaaatagtttccgaggagatttcatggcggcggatgatgagttgatgacggcagaggagatagagagagggatccggtgtttgatggagcaggatagtgacgtgaggagtagagtgaaggagatgagcgagaagagtcacgtagctttaatggacggtggatcttcgcacgttgctcttctaaagtttattcaagacgtcactaagaatatctcttga

SEQ ID NO: 145 - DNA, 1101 bp, Arabidopsis thaliana
atgagaccgattcaatcgcctccaggagtttccgttccggtgaaaagccgtccccgtcgccgtcctgatcttaccttaccgcttcctcaacgcgatgtttctctcgctgtacctcttcctctcccacctacttccggtggttccggtggctctagtggatctgcgccgtcttctggtggttcggcgtcttcaacgaacactaacagctccatagaagcgaagaactattcggatttagtgagaggtaaccgtatcggaagcggagcaggtggaacggtatacaaagtgattcaccgtccgagttctcgtctatatgcacttaaggtgatatacggtaaccacgaggagactgtgagacgtcagatctgtagagagatcgagattttacgagatgtgaatcatccaaacgttgtgaaatgtcacgagatgtttgatcagaacggtgagatccaggttttgcttgagtttatggataaaggttctttagaaggtgctcatgtgtggaaagagcaacaattagctgatctatctcgtcagattcttagtggtttagcttatctccatagccgtcacatagttcatcgtgatatcaaaccatcgaatcttttgataaactctgctaaaaacgttaagattgctgattttggagttagtaggatcttggctcagactatggatccgtgtaattcatctgttggaaccattgcttatatgagtcctgagaggattaacactgatttgaatcagggaaagtatgatggttatgctggagatatttggagcttaggtgttagcattttggagttttacttggggaggtttcctttccctgtgagtagacaaggtgattgggctagtcttatgtgtgccatttgtatgtctcagcctccagaagctccagcgactgcgtcgccggagtttcggcattttatctcgtgttgcttgcagagagaaccggggaaaaggaggagtgctatgcagctattgcagcatcctttcatattaagagcaagtccgagccagaacaggtctcctcagaatctacatcaactcttgcctcctcctcgtcctctgtcctcgtcttcttctccaaccacatag

SEQ ID NO: 146 - DNA, 654 bp, Arabidopsis thaliana
atggaaggaggtggaggaagtagcggcggaggagctggaggagtggttccggaatcagcgattgaagcggtgaatcaaacacttgcgtacctcaaggaactgaagccacagcttgagcagatgctgactttagctgagccagaggttctcgctgcaatgcaaccattacagcgagctaagactatgcacttgctagctgaagccaccactactctttacgaactgaggttgagatgtactggtgttgatcctgatgatcatcgtgtaaaatctgaaattgagcggataaacgtgtacagagagaagtttcagaagtgtgttgatcaaagtaaaggacctttgcgcccgaccactgtcttaaaccgtcaggcagcaacccgtttcatcgaacattctctacctgatcttacatcgacccaaaagcaaagcattagagacctcagtaaaggagagaaatcgaggatcaggtattctgaaacatctgcgagaaagaggaaataccaatcaaatgagaaacagtctgttcagtcagctgcgaaggactttcttgaaaaggcagctcgtgagattatcggtcacaatgaaaatggtttgaagggccctttagtagcggcagctgatggttcagatgatgtcgaagttggtacagcctga

SEQ ID NO: 147 - DNA, 519 bp, Arabidopsis thaliana
atgtcagtagcttcaccgattcaatgtatcaggattctaaatccatcatcttcatcttcttcttcgacagcttcgtcgtcttttagattctcaacaacgactaagccatgtgtcttcatcatcagatgctctcagacagaaggtcctttaagaagaccatcggctcctcctactctccgggagcctcaaaaacctgttcctccatcacagccatcttcctctcctcctccttctccgccgccgcagaaagctgtagctgttgatgggaagagtgtaactacagtggagtttcagagacaaaaggctaaagagcttcaagagtactttaaacagaaaaagcttgaagctgctggtcaaggtcccttttttggtttccaacccaaaaatgagatctccaatggaaggtgggctatgtttggtttcgcagttggtatgctcacagagtatgcaacaggatcagaccttgttgatcaagttaagatccttctctcaaatttcggcattctagacttggaataa

SEQ ID NO: 148 - DNA, 1032 bp, Arabidopsis thaliana
atgagaggtcttttcaaatccaaaccgcggactcccgctgatattgttcgtcagactcgcgatctcctcctctacgccgatcgatccaactccttccctgaccttcgagagtccaaacgcgaggaaaagatggtggaactaagtaagagcatacgagatttgaagttgattctatatggaaacagtgaggctgagcctgttgctgaagcttgtgctcagttgactcaggagttctttaaggctgatactcttcgccgtttgctcacttctcttcctaatttgaacttggaggcgaggaaagatgctacacaagttgttgcaaatcttcagaggcaacaagtcaattcacgtcttattgctgctgattatcttgaatccaacattgatcttatggattttctagttgatgggtttgaaaacaccgatatggcgttacactatggtactatgtttagagagtgcatccgtcatcagattgttgcaaaatatgttttggactcggagcacgtgaagaagtttttttactacatacagcttcccaatttcgacattgctgctgatgctgctgcaacttttaaggaacttctgacaaggcacaagtctacagttgctgagtttctcattaagaatgaagactggttttttgcagactacaactcaaagcttcttgaatcaactaattatattacccgacggcaagctattaagttgttgggcgatatattattggataggtcaaattcggctgtgatgacgaagtatgtgagctcgatggataacttgaggattctgatgaatcttctcagagaatcaagcaagactattcagatagaagctttccatgttttcaagctgtttgtagcgaaccaaaacaagccttcagacatcgccaacattctggtggcaaacagaaacaagcttctgagattgttggctgatatcaagccggacaaagaggacgagaggtttgacgcagacaaagctcaggttgtgagagagattgcaaaccttaagctgcgagagcttgcttga

SEQ ID NO: 149 - DNA, 774 bp, Arabidopsis thaliana
atgggaagagggaaagttgagctgaagaggatagagaacaagatcaatagacaagttacttttgcaaagagaagaaatggtttgctcaagaaggcttatgagctttctgtcctttgtgatgctgagattgctcttctcattttctctaaccgtggcaagctctacgaattctgcagcagccctagtggtatggcgaggacggttgataagtatagaaaacatagttatgcaacaatggatccaaatcaatcagctaaagacttgcaggataagtatcaagactacttgaagcttaaatcaagagttgagatccttcaacattcacaaaggcatttgctaggtgaagagctatccgagatggatgtgaatgagcttgagcatctcgaacgccaagtagatgcatcactaagacaaataagatctaccaaggctcggtctatgcttgatcaactatctgacctcaaaactaaggaggaaatgttattggaaaccaatagagatcttaggagaaagttggaggacagtgatgcagcacttactcaatcgttttggggaagttctgctgcagaacaacaacaacaacatcaacaacagcaacaaggcatgagctcttatcaatcaaaccctccaattcaggaagcaggtttcttcaagcctctacaaggcaatgtagcattgcaaatgagtcattacaatcacaatcctgcaaatgcaaccaactctgcaacaacatcacagaatgttaatggattcttccctggatggatggtctga

SEQ ID NO: 150 - DNA, 384 bp, Arabidopsis thaliana
atggcatccaaggctttgattctgttgggtctcttcgcaattcttctggtggtctccgaagtttctgccgcaagacagtcgggcatggtgaagccagagagtgaggcaactgtgcaacctgaaggttatcacggaggacatggtggtcacggagggggaggccactacggaggaggaggccacgggcatggaggacacaacggaggagggggccacggacttgacggatacggaggaggacatggaggacactacggaggaggaggaggacactacggaggaggaggaggccacggtggtggtggacactacggaggtggaggacaccatggaggaggaggccacgggcttaacgaacctgttcagacgaaaccgggtgtttaa

SEQ ID NO: 151 - DNA, 1135 bp, Arabidopsis thaliana
ttaattaaatgccgaaagagaggaaagaacggtccgtatctcttgataagtataaacgatcgccactgtgttgtgaggcaagccttgctttgaagccgagtgagaaacaagttaaggaatgggaagaggctcgttgtcctgtttgtatggaacatcctcacaatgggattcttctcatttgttcttcttatgaaaatggttgtcgaccttacatgtgcgacactagccatcggcattctaactgtttcgatcagttccgcaaagcttctaaagagaaaccttctttgtctttacttcgtgaggaagaggaaagtaatgaaccaactgagatggaagatgtggattcagactcaactgctgtaaatctattaggagaagctgcatctgagataacagttgtggatttaagtgatggtgagagaggagaagaagaagtagaagaagaagaagaagaagtagtagtagaagaagaagaagaaggaattgtaacaacagaagaagatcaagaaaaaaacaaaccacaaaagcttacttgtccgttatgtcgtggacatataaaagaatgggtagttgttaaagcagctcgatgtttcatgaactcaaaacatagaagctgttcttgtgagacttgtgatttcagtggaagctattccgatctgagaaagcacgcaaggcttctacatccaggagttaggccatcagaagcagatccagagagacagagaagctggaggaggctagaaaggcagagcgatttaggggatttacttagcacactccaatcttcttttggaggagatgaaataagtaacgatgatgggtttctatttgctgatactcgcttgcttacagtgtactttctcatccgcgtgtttagaccagaatcgagtggctcaaggagtagtagctggtctggtacatctagagctaggacacatacaagtgggagaagaagatcttcaagacctgcaagtctttggggagagagctatgaaggtaatacaggaacatcacctagagatgaggagaataatcaatcttctgatgaacaagtgtctggaactcggagacgtcgttctagaagaagaactgtcattgatgatgatgatgaagaagaagaaccgtgaggcgcgcc

SEQ ID NO: 152 - DNA, 1005 bp, Arabidopsis thaliana
atggcacctgagatgaacaacaagttgagctacggagaaaagaagagagcgtacgttacgttcctcgccggaaccggagactacgtgaaaggagtggttggtctggctaaagggctaaggaaaactaaaagcaagtacccattagtggttgctgtgttacctgacgtgccggccgatcaccggagacagctattggaccaaggctgcgtcatcaaggagattcagccggtttacccaccggataaccaaactcagtttgctatggcttactacgtcctcaactactctaaacttcgtatttggaagtttgtagagtacagcaagctgatatacttagacggagacatacaagtgtttgagaacatagatcacttgtttgatcttcctgacggcaacttctacgccgttaaagactgtttctgcgagaagacttggagccacacgcctcagtacaagattggctactgccaacagtgtccggacaaggtgacgtggcctgagtcagagcttggtcctaagccaccgttgtacttcaacgccggcatgttcgtctacgagccaagcctccccacttattacaaccttttggagacactcaaagttgtccctcccacaccttttgctgaacaggatttcttgaacatgtacttcaaagacatatacaagcctattccaccagtttacaatcttgtcttggccatgctctggaggcatccagagaacatagagcttaacgaagctaaggttgttcattactgtgcagccggtgctaagccttggaggttcacaggccaagaaggaaatatggagagggaagacatcaagatgcttgtagagaaatggtgggacatttacaacgacgagtctcttgactacaaaaactttaatgtgcattgcggacaaaaagaagatgttcacaggaaaccgaaaacccttccacagttctttacagatttgtctgaagctgatgtgcttcaatgtgccaaagctccatccgcggcttag

SEQ ID NO: 153 - DNA, 1341 bp, Arabidopsis thaliana
atgactttgttccatagactcgatctcatcgatccgtacacgtgtacaccactcatcgtccgtgaaacctccattgttgaaccttcatcattgttcctagggtttccttccttcatcgacgaagacattgaagatctcttcgagttttcatcacctaatcctctcgatctattcgaaaccgtgacggatctggttaagattaagaaatctccgtcgtcttgcaagtacaaggtgattcgtcggagattagagccggagtatccattgaagtatctttgtgaccgtgtttctgatttggaatcaaagtttgatagattggttagtcctaagagtgataggaagtatacattgacgaaggagataaagggaagtggtgagaggaagtataaatgggaggcggagattcaaggaccgttggagaggaagtataagttggaagctgagattgaaggttcgggagagaggaagtatagatggacgacggagattaaaggagggaagaaggatgaggaagggttaaagttagctgctttgaagaaggagaaggcgaaagctaaagctattgctgctgctgaagcggagaagaagaagaataagaataagaagaagagttataattggacgacggaggtgaagagtgagagagagaatggtgaggtttcgcatacttatatcatcaaggctactactggaggagagaaaaagaagaaacatgaggagaaggagaagaaagagaagatagagactaagagcaagaagaaggagaaaactcgtgttgtggtgattgaggaggaggaagaagaagatgatgagtcgtcagaacatggtgctatcgttcttaggaaggcgttttccagaaggaatggagcagttaggaccaagaaggggaagaacaaggaaatgccacctgaatatgcggctgtgatgatccagagggccttcaaagcttatttgattcgtcgctcaaaatcattgcgtgctcttcgtgatcttgctattgcaaagactaaacttaaggagctaagagcttctttccacaacttcagctaccgtcgcctgattgctcgtgatggagaggagcgtcagaaattctcagagaagatcattgtactcctcctcactgttgacgccatagagggagttgatgtgatggttcgaggagcgaagagatcaatggtggatgagctggaagcaatgttagatgtggtagacccgcaaccgcaggggaaatcattgtcgatgagaagaagaacatttgatatgccagacagtttgatccgcaaagaaatcgcagagggagtgactcagattgtgcagatgcttgaaacggaagaagaatga

SEQ ID NO: 154 - DNA, 777 bp, Arabidopsis thaliana
atgatgaatcttagggttttgttcctcgctctccttctccttgcatctcctctgcttcaagttgctagatgtcaatcggatgccgaggatcattcaagtcttgttgacgatgttgtgggagaaaacactgatgatgcggttgaggaagatgaccatgatttggatatgaacttgtcctcatttccaggagttgagactgtttgtgttttccccaaaaacagtgccaaattggttccagctggagaagagactgagctccttgttggtcttaaaaatgaagggaaaactagagtaggtgtgatgggaattagggccagcgttcatcttccttatgatcataagttgttggttcagaatctaaccatgttgagacttaacaatgcatccatcccaacgtctcttcaagcaacattcccatacatctttgcagtcagccagtacttgcagcctggagcatttgatctggtgggttatatcatatacgatgtggaaggaaagccataccagagtgtcttctacaatggaaccatagaggtagttgaatctggaggtcttctcagcggcgaatctgttttccttttaacactcggaatcggtctcctcctcctcctcggtctatgggcatacagccaagttcagcgtctcaccaagaaaaccaaaaaggtttccaaggtggaagtaggaactaggtctaccgaggcatcactcgatgaatggctcgagggaactactttggccaagacatcgtctgggaaaacaaagaacaagaagaactaa

SEQ ID NO: 155 - DNA, 360 bp, Arabidopsis thaliana
atggagaaatctagagaaagcgagttcttgttctgtaatttgtgtgggactatgcttgtcttgaaatcaaccaagtatgcagaatgtccacattgcaaaacaacacggaatgcaaaagatatcatcgacaaggaaatagcttacacagtttctgctgaggatatcagaagagaactaggaatatcattgtttggtgaaaaaacgcaggcagaagctgagctaccaaagatcaaaaaggcatgcgagaaatgccagcatcctgagcttgtatacacaaccagacagacgagatcagctgatgaaggacagacaacatattacacttgccccaattgtgctcatagattcacagaaggttga

SEQ ID NO: 156 - DNA, 1318 bp, Arabidopsis thaliana
atgtcaacaaagttatggagatgggtgttagggctgatatacctatttgccgttgccacgatttggattgcggctagttttgtagtccagtctgtggtggaagctggtgtttctccgttcttgatcactttcatttgtaattcattgttcgttgtttatcttcccctttttgagattggtcgatatctggaagatgcatatgggagtttattgttctggagaagcaaaaggtcgcatttaatggaactggtcgaatcagagaaggctgttttgcttggaaaagatgtttctggtgtgaaatcagatgctactgagagttcagggcttgttgtgagagagcaagagattagtgagggtggtaatgggattgaatctggattggaaaatatagagcttgagattgatgctagtgtcaatgttagtgatggagctagtggagtttctaataaaggattagatgagaagggtcgttggacaaggatgcgagttgctaaagttagccttgtgatttgtccgttttggtttttggcgcagcttacatttaatgtctctctcaagtacacaacagttacgtcaaataccatattaagcagtgcatcaagccttttcacctttcttgtttcactaatattcttgggtgagaagttcacatggttgaaactcttcagcgttcttctttgtatgtctgggactataattgtaagtatgggtgactcagagtccaagtcaaatgcagtagctaagaaccctcttttgggagatattctttcgctggtctcagcggcgctgtatgctgtctacatcactcttatacgcaaaaagcttccggatgatgatgaaagaaacggccgggtcagtatggctcagttcctcgggtttcttggtctcttcaatttcttcattttccttcctcctgctctaatactcaacttcacaaagcgagaacgcttcaacgcacttaccttgaaacaatttggcctagttgttggcaaaggtttgttagataatgtgcttagtgactatctgtgggcaaaggcagtactattgacaacaaccactgtagctacagctgggctaactattcaggtcccattggcagccattgtagacagcttatcagggaacaaaccaagcttcaccgactacattggtgctgcagctgttatggttggctttgcagggattaatattccctcagagatgttttgcaaatccaaagagactgctattgagttagaacctgggacttcgttcacagatcctcctccgattgtgccagatagcataagagtagattcttcactgactgtagtataag

SEQ ID NO: 157 - DNA, 2212 bp, Arabidopsis thaliana
ttaattaaatgatgttggtttttcttctgattcgccggcaatggagatctgcttctgtgagaagagaagaggtgattcgtctcattgctttagccaccgaggaatcttatttggcggaggaagttcgtcccgccactgttgattacggcggagactcggtttctgatgtttaccgttgtgccgtttgtctataccctaccactactcgttgctctcagtgcaaatctgttcgttactgttcaagcaagtgtcaaattcttcactggcgacgaggtcataaggaagaatgtcgatcgcctgattatgatgaagaaaaggaggagtatgttcaatctgattatgatgctaaagagtctaatgtggattttccatctcgtgggactgcgtatgaatcatcatctaatgtgtctgttgatgttgcctgtgatatgtctacaagtaggcctagtattcataaagtgcaacctagatctgaagctgtggatttcactacttctttaaacataaaggataatctctatgagaccaggccactaagtaggaagaaatcacgtaatcgtacagacaaggttgagtcagccagtaattattccaaaggaaagactgatgcaaagctgcggaaacttggcaatcaaaattcacgtaggtcaggtgattcggctaatatgtcaatttcagatcaatttttgtcagttgggtttgaagaagaaatgaatgcacttaaacatgaaagaattacatctgaaccatctagtgcttctgctgcaatgtcttcgtcttcaactcttctcctaccttcaaaagctaacagtaagccaaaagtgtcacaagcttcaagtagtggattgaaaacatcggtgcagaaagttgttcagcattttagacctccacagtcgtccaaaaagtctcaaccttccagttctattgatgagatgagcttctcgtatgagttgtttgtgaaactttattgtgatagagtagaattacagccatttggccttgtgaacttagggaacagttgttatgcaaatgctgtccttcagtgcttggcattcactcggccactgatatcataccttattaggggattacactctaaaacatgtagaaagaagagttggtgttttgtttgtgagtttgaacacttaattttaaaggcaaggggaggagaatctcctctttcacctatcaagatcttatcaaaattacaaaagattgggaagcatcttggccctggaaaagaagaagacgcgcacgagtttttaaggtgtgctgttgatacaatgcaatctgtttttctcaaagaggctcctgcagctggtccgtttgctgaagaaactactttagtaggccttacgtttggtggatatcttcactccaagattaaatgcatggcatgcctccacaaatctgagcgaccggagctgatgatggatctaactgttgagattgatggggatataggaagcctcgaagaagcacttgctcaattcacagcatacgaagtcctagatggagagaaccggtatttctgtggcagatgtaaatcttaccagaaagccaaaaagaaattgatgatattggaaggacccaatattcttactgtcgtgctgaaacgttttcagtctgataactttgggaagctgagcaaacccatccattttcccgagcttctcgatattagcccgtatatgagtgacccaaatcatggggatcatccggtttatagtctctacgcagtggtggtccatttggatgctatgagcactttattttcaggtcattatgtttgctacataaaaacccttgatggagattggttcaaaattgatgacagcaatgttttcccggttcagttagagactgtgttactagaaggagcatacatgcttctttatgcaagggattctccgagaccggtgagcaagaacggtggtcggaaatcaaagcaaagaagaaatttggccgcaattccgtcaagaaagggcaacaagaaacagagagacggtgataataacagtttgttgccgcgtgtggactggtcgagtggaagcctgtcgtcaatgtttagctcatcggacacaacaagctcatgtagcacaaaagactcatcaggtattgagaatttatcagattacctgtttggtggagttgaaccggtttggaaatgggatcgtcataataaatctcaaacgtttgattgaggcgcgcc

SEQ ID NO: 158 - DNA, 678 bp, Arabidopsis thaliana
atgggttactggaattccaaggttgttccaaaattcaagaagttattcgagaaaaatagtgctaagaaggctgctgctgctgaagctaccaagacctttgatgaatctaaggaaacaatcaacaaggaaattgaggagaaaaagacagaactccaaccaaaggtcgtggaaacctatgaagccacgtctgcagaagtcaaggctttggtgagagaccctaaggtggctggtttgaagaaaaactcagcggctgtgcagaagtacctcgaggagctagtcaaaattgaattccccggatcaaaagcggtgagtgaggcttcgtctagcttcggagctggctatgtcgcaggaccggtcacgttcatattcgagaaggtatctgttttcctcccggaggaggtgaagactaaagaaataccggtggaggaagtgaaagctgaagaacctgccaaaactgaagaaccagccaaaaccgaaggaacaagtggtgagaaagaggagattgttgaagagacaaagaaaggcgagacccctgaaaccgcggtcgtggaggagaagaaaccagaggtagaggagaagaaggaagaggctactccggctccggcagtggttgaaactccagttaaggaaccggagacaacgacgacagcgccagtggctgaaccaccaaagccttga

SEQ ID NO: 159 - DNA, 1139 bp, Arabidopsis thaliana
ttaattaatcgactctcgttcttaaagatgaaagctttctacgtattcgttgttgctcttcttctcaccttgaattataggggagaagcaagtggttctgttttcttcattgatggatccaacaatcaatatcttcgtccacgatcatccagtgaggcacttcccatgtcgcctgttgaaatatctgcagcagtgtctgccttgttgggttttgcaccttcagcaactttgacagctgatggctcatccaagttgaacaagattctaaaacctaatccatttgagaggcctcgcgctgcttttgtgctagaaatcgctggagctgatgatatgcttttggaaacctcccctagtcattctttcttgggcaatgccataaggagcagtattaagtctgattcgtacaaagctgatactgaacttccagacaatgaagtggttgttgtgtctgtcaatgaaccctcctctgatgtgactgacaaggacattaatgattttgcatcttggttgggtggatcatatgttgctggagctgaaccatcgtctggattgttgagtatccctctggctgggggtgctaatgtggagttcaatttggaaaaggaagcagagaggaaatttgcattgaaccttttgggtctatatcagaatatcagacaggcagtcagcgtttatgacgatttatctcatggtattgacagaactgccgaattaacggttggacgctttggtggtatcgatgctttagcacaggagtatggacaaggtatggctaagcaagggatggatgtattactttccacattatcaaagctattcaatctgttggagacatctcataaaggccaaattgttggggttatcgtccttgatgagagagtaaaccaagaatcagaaaatcttttgaactttgggtcttcccgttcatctgcacgctcaatggtggaagtggagggaattccaagtgcagccattatcgctgaggttatacttgttaggctgactcttgcatggttgactggaatcattcttctcattgcaactatccttggggtatacttccttatgaacatgcctttgacgaaggatactcttctatattcaaatgtaaagctcgactaagaaatgaaaatttaaat

SEQ ID NO: 160 - DNA, 444 bp, Arabidopsis thaliana
atgttgctagggaagagacagagaccaccaataaagagaaccacgagtctatctgagattaagttcgatttgaatcaacctagcgaacaagaaccatccgatcatcagattcagcttgtgaacgttgatgaacatcgtcaagttcatcaaagattgttagatcaacggcttttagcgatggtctcaccaagaggtacacagagaagacactcaagtgattattctgaagattttctaagatcttgctctctttgtaaacgtcttcttgttcatggccgtgacatctatatgtatagaggagatagagcgttttgtagtttagagtgcaggcaacaacaaattacagtggacgagaggaaggagaagaagaaaggttcggtgaggtccaccatcgtcgtcgccaccggaaccaccacaggagagagagtttccgccgccgtgtag

SEQ ID NO: 161 - DNA, 615 bp, Arabidopsis thaliana
atgggaagcagaagcggagaacaaggaaagcgaatggcggaactgagcaaaaatcttaaagaaggtgagaggattctggagcccacacgtagacctgatggtactctccggaaacccattcggattcgacctggatatactccagaagatgaagttgtcaaatatcagtccaaaggttctctgatgaagaaggagatggcctcacaagggcctccaggttatgaacctgatccagctcctaaaccaaagactaaagctgctaagaggaacgaacgtaaaaaagagaagcgattacaggctactgcagaaaaagctaacagctctgaggatggatcagctagtaatggatcccaatcggtgaatgtattggcttctgaaatggaggctttggacgtttcgtcaaataatgatgtatgtgggggagcacctaatccaggaaccacaggagaagacgtagagaaaagaatccgcgcacttaagaagaaaatccgactcacagaagctcaacagcagaagactgcttcccgagacctaaacccagagcagttagagaaattctctaagttggaagaatggaggcaagaactcaaggctctggaggataaggcggcttaa

SEQ ID NO: 162 - DNA, 699 bp, Arabidopsis thaliana
atggcgtcttcatcggattcatggatgagagcatacaacgaggctttaaaactctctgaggagattaatggaatgatatcagaaagaagttcatcggctgtcacagggcctgatgctcagcgtcgtgcttcagctatacgaaggaagatcaccattttcggtaacaaattagatagtctgcagtctcttcttgctgaaattcatggaaaacctatttcagagaaagagatgaatcggcgaaaggatatggtagggaatctgaggtcaaaagcaaaccagatggcgaatgctttgaacatgtcaaactttgccaatagagacagcttgctcgggccagatatcaagccggatgattccatgagcagagttactggcatggataaccaaggaattgttggatatcaacgacaagttatgagagaacaagacgaaggacttgagcaattggagggaacagtcatgagcacaaaacacattgctctggctgttagtgaagagcttgacttgcagactaggcttattgatgacttagattaccatgtggatgttactgactctcgcttaaggagagtgcagaagagccttgctgtcatgaacaagaatatgagaagtggttgctcttgcatgtcaatgctcttgtcagtgctggggatcgtcggtcttgctgttgtaatatggatgttggttaagtatatgtaa

SEQ ID NO: 163 - DNA, 627 bp, Arabidopsis thaliana
atggatcaaaacgtaccaataagcaagaagctatggaacatcgtacgttttctcttgtacatgatccgcaaaggcgtctcaaaaaacaaactcatcgctgacttcaacgccactctcaaacgtggcaagaacctcatgttccaccaacgtcgtcgtgtccacgccggttccaccgcctcagccgctctaaacgctacttcagccaccgcgtcatcgcgacaagagtacgagtttagctgcagcaacactccaaactattcattccctttctctaatatggctttcatgaggaaaaagagtcacaataatctcttcacgtgtggtcaaacgcctcagacgcttgacgacgacgtagccgccgctagagccgttcttgagcttcttaacggcgttggagagaaaggaaacgtcacgccggcagatttaacggtggctttgtctccttatttccccggttttggacagactccattggttagaccgttaagagtaacggactcaccgtttccgttaacgccggaaaatggtgatgtggctaatggacacgttgacaaagcagctgatgattttataaagaagttttataagaacttgaatcagcagaaaaaaatgattgagttcagctaa

SEQ ID NO: 164 - DNA, 447 bp, Arabidopsis thaliana
atggctttcagaatcaccggccaattgcgaccggtcggaaatcaatttggtggctctcgtcgttttgcaaccacagtcgccgatggcgccaaacaaacatataacaagttctccataatgggagagtttgcaccagtggctataataggaggttttgttggtttagcggtactaatggccgggcatagcctcaagcaacagcttatgcatgcaccggcaatcagtacaagaaagaatagaagagcggctgtcgcggaagtcgatgatccagaaaactgtgtttcctctgctgacaaatttatcaacaagtcttggttacgtaaagtaggtcagattcaagataaatctaaggcaatcttatctgatcccactcgacctaacccattcaccacgcctcgaaatgcagagacattgaactccgtcggcgtggctccaaagggaatctga

SEQ ID NO: 165 - DNA, 1047 bp, Arabidopsis thaliana
atggcttctcttatctctttttctttgctcccaaaaccaaaagccgtaagaagttcaatttcagctcctcagacacagacaataaatactgaaaagcttgaagataaattcggacgaaaaggcataaaattctcggaatcaaacaacattcctatggtagagcttaaggtcagaaatggaagttcattaaaactgagtctatcagatgctcatgtactttcatataagccaaaggtatactggaaagacgagggattcgaggaagtcctttacacagttgatggtgatgagagcagaggtggggttggtgttgttatcgtaaacggggaagaacctaaaggagggtcttcagtaatctcaggatgtgattggagtgtcaaggatactgattcagacgccattgatgctcttcagatcgaacttagctgtacggccggggttctcgacataacgtatatcgtctctctctacccagtaagcatggctacagctctggtggtgaagaacaatggtcgcaaaccagttacccttaaaccggggattatgagttacttgaggttcaagaaacggagtggggcaggaattcaaggactaaagggatgctcttattgtcccaacccgcctttgtcatcgccttttgagctcttgtctccttctgaggcaatgaaggcggaatcttcggggtggttcgggtcggaagaaggggaaaagccggggatttgggcagtagaagattctgttattacacttcttgagaaaaagatgagtagaatatatggtgctcctccggctgagagattaaaggcagtctataacactccaccttccaaatttgaaactatagatcaggggagaggattgtttttcaggatgataaggattgggttcgaagagatgtatgtgggatccccaggatcgatgtgggacaagtatgggaagcaacattacttcgtgtgcacaggtccaacgtcaatgctcgttcctgtcgatgtagcctccggagagacatggagaggagcaatggtaatcgagcatgataatttgtaa

SEQ ID NO: 166 - DNA, 1059 bp, Arabidopsis thaliana
ttgactttttcaaactcatttcctctctttttccttcttctcacatcatattagacccaaacataaaaagaacgaagaatcctctgttcttgtctgcgaattttgctgttgtgatcagcgatggacattaagcatcatacttcaacttcaaaacctaagaacaagaacaagcttttgaagatgcttcctaaagcgatgtcgtttggacatcgagttccaccgtttagtcccggaagagatctccaccacaacaaccaccataattacacggcggctaacaaaatgtttttctctggtcctatggttcctttggtacctaacgcggctcgggttagaagaaacaaaagcgacgctgtttgggacgaacctacttcacctaaagtctcttgtatcggtcagatcaagcttggtaagtctaaatgcccaaccggtaaaaagaacaaagcaccttcatctctgattcctaaaatctccaaaacgtcaacgtcgtctttaacaaaagaagatgaaaaaggtcgtctttcgaagatcaagagtatcttctcgttctcgccggcgagtggacgaaacacatcaagaaaatcccatcctaccgccgtctccgccgcggatgaacatccagttacggtggtttccaccgcggcggtgccttcgttaggtcagatgaagaaattcgctagcagtcgtgatgctttaggtgattttgattgggcggttgagatgaaacatgaagaagaatcacccgctgatcatcaccgtggttactattctgacgacgacaccagaggagcttacttgagatacgatgatgacgaggatgaagatgacataataatccctttttcagctcctttagggttaaaaccaaagaaagaagttaacttgtggaagagaagaaccatggatccaccaaaaccacttcatcttcaaaccatttgattaaatttctttctttcagtatactatatcaattactgcagttcaaattgtataatgatcatcattcacaatgagtctggattttcttgttttgtgtatatatgtgatatattgtgatga

SEQ ID NO: 167 - DNA, 1438 bp, Arabidopsis thaliana
ttaattaaatgaaatctgtcattttcacagaggaaaaaaacttacaaagacaaaatccattgcaaaagagcgagcaacaacgacgaaatttcgaaatgccatcgccaccgacgacgacttctctctcggtgacacagaccataaacggatcacacagcttcacaatcaaaggctattctttggctaaaggaatcgggatcggaaaacacatcgccagcgatactttcaccgtcgggggttatcaatgggctatctatttctatcctgatggcaagaatcctgaggataattcggcttatgtctccgttttcattgctttagctagcgatggtaccgatgttagggctctttttgagctttctttgcttgatcagagtggtaaagggaagcataaggttcatagccacttcgatcgtgctcttgagagcggtccttatactctcaagtatcgtggcagcatgtggggctacaagcgcttttttcgaagacttatgctggaaacatctgattttctgaaggatgattgtctgaaaattaattgcaccgtgggagttgtggtctcagaaatagattgcccacggttacattctattcatgtccctgcatctgatattggatctcatttcgggatgcttctagagaacgaggacggttcagatataacttttaacgtctctggtgaaaagttccgtgctcacaggttagtattggctgctcgatctcctgtctttgaaagcgagttcctcgatgttacgggagaagaagatcgtgatatcgaagttactgacatggagcctaaggttttcaaggctttgctccactacatatacaaggatgctctcattgaagatgcagagtcatcatcatcttccggttcatctgttggtccatctgcctcagacacattagctgcaaagctactaggagccgctgataaatacaagttgcctagattaagtctaatgtgcgagtcagtgctctgcaaggatatatcagtagattccgttgcaaatattttggcgcttgctgaccgttacaatgcttccgccttgaaatccgtttgtctgaaattcgcagcagaaaatctcatcgctgttatgaggtcagatgggtttgattatctaagggaacactgcccgtcacttcagtctgagcttctgaaaacagttgcgggttgcgaagaggagttaagcggaggaggagggaagacgagaagcgtatggggccaattctcagacggtggagctgagacaaacggaagacaagcacagacttggggagatatcaatggaggagcagagagaagccagagtgtttgggtcgaagttgtgaacgctaatggaagcggtagaaacaataatgacaacaataacagtgatgacccaatggcagaactagaagattgagcaaataaaaggtaataaaaaggcggcaaaat

SEQ ID NO: 168 - DNA, 1186 bp, Xanthomonas campestris
ttaattaataggtatctttaaaatctacacaggactggaccacaatgccgctgtcacgcctgctgacctgccttgttgcgagccttgctgcctacgcagttcaagccaaatcgcccatgccgccgccctcaccgatcatgctcagcgagttcattgccgaccaggcaccgacgccacaggcgcacgcctctacgctgttggaaacccgcgacggcacgctgctggcggcctggttcggcggcgcacacgagggtgcggccgatgtcggtatctggctcgcccaacgcggcccgcagcactggcagacaccgcgccgcatcgcagacggcgcacacgcaggcgtggatggcgccgcactgccggcctggaatccggtgctgtttcagtccgccaccgggccggtgcagctgtactacaagctcggcccgaatccgcgcgattggtggggcctgcgcatcacctccagcgacaacggtgcgcactggtcgccaccgcagcgcctgccagacggcattctcggcccgatcaagaacaagccggtgcaattgccgagcggacgcatcctggcacccagcagcggcgaagaccgtggctggcgcgcgcatctggaatggagcgacgacgacggtgcgcactggcagcgaggcctgccgctcaacgacgccgccaccatcggcgccatccagcccagcctgttgctgcacgccgatggccgcctgcaggcgcttggccgcagccagcaaaacaaactgttcagtgccttctccgacgatggcgggctgcactggcagccaatgcaattgctggacgtggagaaccccaacagcggcacggatgccgtgatgctgcacgacggccgtgccctgctcgtctacaacccgggcattgccggcaagcaatggtgggatggccgcggcacgctggccgttgcggtgtcagacgacggcgtgcagtggcgccgcgtgctcaccctggaagacagcccgaaagatgaattctcgtacccggccgtgatccaaacccgcgatggcctggtgcacatcagctacacctggaagcgccagcgcatcaagcatgtggtgatcgacccggcgaaattaaaagtgcgttgattgggattggtgcgctgagtgagcgggtctgatgctccataaagacggttgcagggttcgcgacagatttaaat

SEQ ID NO: 169 - DNA, 1528 bp, Saccharomyces cerevisiae
ttaattaaaaacatcgctacatagtaataacactaacgcacgctagaaatgatagcttccaaaagctccttattagttactaaatcgcgcataccctctctatgctttcctttgataaagaggtcctatgtgtcaaagactccgacacactctaacacggctgctaatctgatggttgaaactccggccgccaatgccaacggcaatagtgtgatggcacctcctaactcaatcaattttctacagacacttcccaagaaggaactattccaactgggattcatcggtattgcgaccttgaacagcttcttcctgaacacgatcattaagttgttcccttacatccccatcccagtaataaaattcttcgtctcttctttatactgtggcggtgagaactttaaagaggtcatcgaatgcggcaaacgtctgcagaagagaggtatatcgaacatgatgctttcattaactattgaaaattccgaaggtacaaagagtttgtccagtactccagtagaccaaattgtcaaggaaacaatcagctctgtccacaacatcctactgcccaatattattggccagctggaatctaagccaatcaatgacattgctccaggttatatcgctctaaaaccctctgctttggtcgataaccctcacgaggttctgtacaatttcagtaatcccgcctacaaggctcaaagggatcagctgatcgagaactgctctaagattacaaaagagatttttgaactaaatcaatctttgttaaagaagtaccctgaaagaaaggccccatttatggtttccactattgacgctgagaagtatgatttgcaggagaatggtgtttacgaattacagagaatcttatttcaaaaattcaatcccacttcatctaaactgatatcatgtgtcggtacttggcagttgtacctaagggactctggtgaccatattttgcacgaattgaagctggcccaagaaaacggctataagcttgggctgaaactggttcgtggtgcttatattcattctgaaaaaaaccgtaaccaaattatctttggcgataaaacgggcactgacgaaaattacgatcgtatcatcactcaagttgtcaatgatttaatcatcaatggcgaggattcttattttggtcacttggttgtcgcctctcataattaccaatcccaaatgctcgttactaatttgctaaaatctacccaagacaactcttatgccaaatcgaacattgtgttggggcaattactaggtatggcagataatgttacctatgacctaattaccaaccatggcgctaaaaacataatcaagtatgtcccatggggcccaccattggaaactaaagattatcttttgagaagattgcaagaaaacggggatgctgtgagatctgataatggctggccattaatcaaggccatagcaaagtcgattccaaaaagagtaggcctatgagaggactataatatatactccaatttcaaagacaaaccaaaatttaaat

SEQ ID NO: 170 - DNA, 886 bp, Arabidopsis thaliana
ttaattaaatggcaatttcacaagccgtcttggctactgtctttggcatcctagggaatatcatctcctttttcgtctgccttgccccaataccgacgttcgttcgtatatacaagaggaagtcatctgaagggtatcagtcgatcccttacgtgatttctctgttcagcgcgatgctatggatgtactacgcaatgatcaagaaagatgctatgatgttgatcactatcaactcctttgcctttgtcgtacaaatcgtctacatctccttattcttcttctacgctcctaagaaggaaaagactctaacggtgaagttcgtcctctttgtggatgttttgggtttcggcgcaatcttcgtgttgacatactttataattcatgccaataaacgtgttcaagttcttggatacatttgtatggtctttgctctatctgtttttgttgctccccttggcataattaggaaagtgatcaaaacgaagagcgccgagttcatgccattcggtctctccttcttcctcaccttatcggctgtcatgtggtttttctacggacttctccttaaagacatgaacattgccctgccaaatgttttgggtttcatctttggagtacttcagatgattcttttcttgatctacaagaaaccagggactaaagtcttggagccaccagggattaagcttcaggacatatctgagcatgtagtcgatgttgtgaggctaagtacgatggtttgcaactcacagatgagaactttggtgccacaagacagtgccgatatggaagcaaccattgatatagatgagaagatcaaaggagatattgagaagaataaggatgaaaaagaagtatttctcatttctaagaattaaggcgcgcc

SEQ ID NO: 171 - DNA, 1087 bp, Arabidopsis thaliana
ttaattaaatggtgtcacatgaagagaacacaagtattgtggaatggtttcttggtccacatccatacacgtatccgccttatggtattgagatgattcatgaggatgatgaagtagcagtagctcatcatcatcatcatcaccagagcggtgagtattacagagagtatgaagatcatcgtagtagcgatgtagataacgatgagatcattgctagaactctccaagacgattttttgcagcttgaaatcgcagaaagtaacgattattcgcatcagaatcaacaacaacaacatcaacaagaaggttatactaacaactatagtaataacaacaatggttatgcttggaatgatcagtctcctgctgtggattattcttcagaatggataggaaatgataatgatcaagatgggaggagcgatgattcggttaatgtcttttcgtgttcaagcccgagtgacacggatgagtatgtatactcgtgggaatcggatcagtgtgatgctgatggtgaatttggaaggagattgaatcaaatggttcccattccgtatataccgaaaataaatggagaaatacctccggaagaagaagcagtttcagatcatgaaagacttcggaataggttagagatgtttgacttcactgaggttaaggttccaggagatggtaattgccagttccgtgctttagctgatcaactgtacaaaaccgcagatcgccataaacatgttcgacgacaaatagtaaaacagctaaaatctcgtccagattcttatcaaggatacgttcctatggacttctctgattatctaagaaagatgtctcggagcggcgaatggggcgatcatgtgacattacaggcagctgcagatgcgtatcgggtgaaaatagtagtcctaacatcgttcaaagatacatgttacattgaaattcttcctacctcccaagaatccaaaggagtaatcttcttgagcttctgggcagaggttcattacaacgccatctacttaaacagagatacatctgaaacagagctacagaggaagagaaaatggtggcgtttcggaaactagggcgcgcc

SEQ ID NO: 172 - DNA, 1554 bp, Arabidopsis thaliana
ttaattaagagtctgattgcgagaatcgctgacaaaaaaatgcaattttcttgtgatcctgatcaagaaggagatgagctgccacaatatgaacacatttatcaaaatgacttctcttatcgaaagcacaagaaacaaaaggaagaagatatatctatctgcgaatgcaagtttgatttcggagaccctgacagtgcttgtggtgagagatgcctcaatgtcattaccaacactgaatgtactcctggttactgcccctgtggtgtctattgcaagaatcagaagttccaaaaatgtgaatacgccaaaacaaagttgatcaagtgtgaaggtcgtggttggggactagtggctcttgaagagataaaggcggggcaatttataatggagtactgtggtgaagtaatatcatggaaagaagcaaagaagagggctcaaacttatgaaactcatggtgtcaaggatgcatacattatatctctcaatgcatctgaggctattgatgccactaagaagggaagccttgctaggtttataaatcattcatgtagaccaaattgtgagacgaggaagtggaatgtactgggagaagttagggttgggatctttgcaaaagagagcatctctccccggaccgaattggcttacgactataattttgaatggtacggtggtgccaaagtgcgttgtctctgtggtgcggttgcatgctctggatttcttggagccaagtctcgtggctttcaggaggatacatatgtatgggaggatggtgacgatcggtattcagttgataaaattccagtctatgattctgcagaggacgagcttacatctgagccttctaagaatggcgagtccaacacaaatgaagagaaagagaaagatatctcaacagagaaccatttggagtctactgctctgaatattcaacagcaatcagattcaactccaactcctatggaggaagatgtcgtcacggagactgttaaaaccgaaacatctgaagacatgaagctgctctcacaaaattcacaagaagattcatcgccaaagactgcaattgtatcacgggttcacggtaacatttccaagatcaagtccgaatctcttccgaagaaaagaggcaggccgttttcaggcggaaaaacaaagaatgtcgctcagaagcatgttgacatagcgaatgtggttcagctactagcaaccaaagaagctcaagatgaagttctcaaatacgaggaggtgaagaaggaagcagcagtacgactctcgtcattgtacgacgagataaggccggcgattgaggagcatgaaagagatagccaagacagtgtagcaacaagtgtggcggagaaatggatacaagcaagctgtaataaactcaaggcagagtttgatctttactctagtgtaataaagaacatcgcttccactcccatcaaaccacaagacacaaagaccaaagtcgcggaagcaggaaacgaagaccatattaaactcttggaagccaaatgagaattagctcggaaggacacctggcgcgccaaaaat

SEQ ID NO: 173 - DNA, 1189 bp, Arabidopsis thaliana
ttaattaacctttaccttcttacagagatctaacctctccttttccaatgttcggcactccgtcttcatcgccgtcattcggcactccgtcatccacacccgcctttggcacatcttctccggcgttcggtacaccgtcagctacgcctgcgttcggtacgccatcgaatccttccttctcctccggcggatttggctcttcactcttctcgtctcccttctcatctcaacagccacagcaacaacaacaacaacaacagcagcagcagccgagttcactgtttcagcaacagccatcttctaattttggttttcagtcaccattcaacaacaccgctcagcagcagcagcaaacgcctttcccaaatgctcaattgactactcagatggctcccgttgctccaattccttactctctcgccgatcgtgatgtccaggctatcattgaagcttataaggaagatccaacgaatcccaagtatgcttttcagcatcttttattcagtgtgactgaaccacagtaccgggtgaagcctgcagctgtatcagatataatgtgggcagaggccatgagcaaacttgaaggtatggattcaacagaaagagagcgcctttggcctcagcttgtgcaaggtttcaaagatctctctcagcgccttaagcttcaagatgaagttctcgtctcagatagggatagaataaaaacgactcagagcaatgttaaaatgcttcagagacatttgcaagcatcaaccttcccatctattgaaaggttgagacagaaggagcagagtcttcaaagacgcatgttgagggtgatgaggattatagaaggcttagaagggaagggtttccggttacccttgacgaaaggagaggccgaactgtctgagaagttaactgcaataacaagacaggtgaaaggtcctggagcagagctttctaggagggtgcaaagtctgcagacgatatctcgtgctcaagcaaattcaattgctgctggtagttccctttatctccctgggtcaactaaaatagacgagcagagcttgatagatatgcaggaggtattgcaacaagagacagaagccataggaagacttgggaacgtattgaagcgagacatgagggatatggaaatcatggtggctgaagatacagaaatggcactagactcatagggcgcgcc

SEQ ID NO: 174 - DNA, 858 bp, Arabidopsis thaliana
cttcttctcgctttaatactctttgattcctctgttcgtttgatgagaattagattttaaatggcaaaagtttcgtttaaggattctctgaaagctcttgaagctgatattcaacacgctaacactgtagctttagattatcctcgggagaaggatggagcgcgtgttcaaatgaggctatcgtacactccagctgctcagtttttactttttcttgtacaatggactgattgccatcttgctggtacactcggtctgctcagagttctgatttacatgacctatgcggatgggaaaaccacaatgtcggtttatgagagaaaaacaagtattaaagatttctatgctgtgatatttccgtcgttgttacaactagaaagaggtatcacagacctggatgatcgtaaacagaaagaagtctgcaaaatacggtacagaaataaagatgagactgaaaaggtcaagctctcggagattgacatcgagagagaagaagaatgcgggatttgtatggagatgaacaacatggtggttctccctaattgtacgcattctttatgcatcaagtgttaccgcgattggcacgggaggtcagaatcatgccctttttgccgagacagtcttaagagagtaaactcaggggacttatggatgttaatggagaaatccgatacggttaatatgtatacaattgagcgggagaataagaagaggttgtttgtgtatatagagaagctacctctagtggttccagatcaagtgtttgcttcttctccttatgattgccatgtcaagtaaataagacggagaagagctttggcaaaagccgaaaccgggtctggtaaacttttatctgaa

SEQ ID NO: 175 - DNA, 985 bp, Arabidopsis thaliana
ttaattaaatggggggcgtgaagagaaagatttctatagagctgatagagaagaaagattcaagagctgttgctttctcaaaacgcagtaggggtctatatagcaaagcctctgatctttgtcttctctccgatgcacaaattgcgatcatagccactccggtctcttccaaatcaaacgtttctttctacacctttggccattcctctgttgataacgttgtagccgctttcctcacgaatcagcgtcctcgggaaggtctagggttagactattggtgggaagatgagaggctttcaaaatcagaggacctggaggaactgagagacgcaatggactcgatgtcgaagatgttgaaagatctgaaggatttgcagaatcaacgagattgtgaggaggacgtgaagaagaagggtgttttacacggaactcatcaaaagcaaacctttaatcctgaatcatgttctgtgaatttcgatgggtttaacaagaacactgaagaatttgatcttgatgaaatatttgattatgtgtcaacagctgaagctctatcgatgaacttggacatggacgatgtctctgtggtgaccacgaatcaaaaccccgtctctgcttctgaaactgttgaagatagagaattggttgttcacaaaaatatggatgaggacaatatccacgtgtctgatatggacgacaaggatacgatgctaatgatttctgacaagaacaatgttttacctgaaaacttggatgaattcgatcaagagctagatcttgatcagctacttgattttgagacaaactatgaaagccttttgaagagttgtgagatggaggattatgcctcgatggtgactacaaagcaaaatctgtgctcaaatcctgaagctgttgaagatggaggattaatgattcaaaaagatttaccggaggataatctctgcttttctgattatttcagtgacttacattgctgaggcgcgcc

SEQ ID NO: 176 - DNA, 331 bp, Arabidopsis thaliana
ttaattaaagatgtcaggaagaggaaagggaggaaaaggattgggaaagggaggagcgaagaggcacaggaaggttctgagggataacattcaaggaatcaccaagcctgccattcgtcgtcttgctcgtagaggtggtgtcaagcgtatcagtggtctcatctacgaagagaccagaggtgtcctcaagatcttcctcgagaatgtcatccgtgacgccgttacttacactgagcacgctagaaggaagacggtgaccgccatggatgttgtctacgctttgaagaggcaaggtcgtactctctacggtttcggaggttaatatttaaat

SEQ ID NO: 177 - DNA, 880 bp, Arabidopsis thaliana
ttaattaacatcatgaacggaggagaaaagttagaatctatcccgattgatctcattattgagatacattcaagattaccagcggagtcagtcgcaaggtttcgctgcgtgtcgaagctatgggggtctatgtttcgccgtccatatttcaccgagctgttcttgaccaggtcgcgtgctcgtccacgtctcttattcgtcctccaacacaaccgtaaatggagcttcagcgtcttctcttcgcctcaaaatcagaatatatatgagaagccgtcttttgtagtagctgatttccacatgaagttctctgtaagcacgttcccagattttcatagttgctctggtttgatccatttctctatgatgaaaggcgcatatacagtgccggtggtatgtaaccctcgcacgggacaatatgcggtcctacctaaactgacaaggacaaggtacgaaaattcgtatagctttgtagggtatgatccgattgagaagcaaatcaaggtactgttcatgtctgatccagatagtggtgatgaccatagaattctgacgttaggaacaactgaaaaaatgttggggaggaagatcgaatgtagcttaacccataatatattgtctaatgaaggggtatgcatcaatggagttttgtattacaaagcttcccgaattgttgaatcgtcatctgacgatgacacgtctgatgatgatgatgatgatcatgaacggtctgatgtgattgtttgctttgattttaggtgtgagaaattcgagtttattgtcatatgcttttatggccagttgataaattccgtccagttatcactaaaacaaaaatctcaccagaaacttgacttaatcatatagcaaactcaggcgcgcc

SEQ ID NO: 178 - DNA, 1082 bp, Arabidopsis thaliana
ttaattaaaaatggtttccaacattgatcacaaggctatggaagcactcctccgtggccaaggatgcgctaacaacctcaagattctccttgaaaacggcgaaataagctcagtttcaacagaaccactcatccacaccattctcgattctttctcacttgctctgtcttttatggattctcctaatcatccaccataccatgaatcctcttctcataacatggcaagtcatatgtcccggagatcatctaagcagtaagttaccaacaaaattctaaactcaaattgtatatgtcgtatgcaaattttcataagttcaaaatcaagtgaagtcgcacatgtttttttttttatgttactttatcatatcttctataaccttcgattcaagtgtctcctatattcttgataattcctagagtacaacatcgcagaaaactttgtgtagcagaaggtttagtgaattacaatcacgattcccggactatgtgccccaatgatggcttcacctggaggaaatatggacaaaaaaccattaaagcctcagcgcacaaaaggttagtcaattaggtaaattagaaaaacagagccaatgctctgttttatgaaagacatgtaaatagagtaccggctatttatttattttaagcagcgatagatataaaagtgctatatttacaggtgttactatcggtgtacctatgcaaaagaccaaaactgcaatgctacaaagcgggtgcagaagatcaaagacaaccctccagtgtacagaaccacttacttgggaaaacatgtgtgtaaagcttttgcagttcatgatgatacatatagttccacgatgattcgattcgaccaagttgttcctgaaccgattatgccgcagctcacaacaattgaccaccaagtaattaccgtggaggaaaactccgcagaacatatcatgaaccaagaatgtgatattaatgattatttggtggatgatgacccattttgggctagtcaatttcccccgtttccatcgagtgacacaatgttcttggaaaacatttctgcttttgattagaaccttatccaggcgcgcc

SEQ ID NO: 179 - DNA, 985 bp, Xanthomonas campestris
ttaattaaatgagcgcgcgcatccccaccctggacatcacccgtttcgacagcgaccgcgaggcctttgtcgccgagctcggtgccgcttatcggcaatggggctttgccggtatccgcaatcacggcattgcgcagtccgacatcgacgccgcctacgaggtgttcaaggcatttttcgcgctgcccgacgaggtcaagcgcagctaccacgtgcccggcagtggcggcgcgcgcggctataccgcgttcggtgtggaaaccgccaaggactccaagcatttcgatttgaaagagttctggcacatcggccgcgagatcccggacgattcgccgtaccgcgcggtgatggcgcccaatctgtggccgaccgaagtgccgggcttccgcgaacgtggctaccacctgtatcagcagttggatcagctgggctcgcgcgtgttgtcggcgctggcgctgcacatcggcctgccgcaggactacttcgccgacaagaccgatcacggcaattcgatcctgcgcccgatccattacccgccgatcaccagcgacgacatcccgaatgtacgcgccggtgcgcacggcgacatcaatttcatcaccttgctggtgggcgccagcgccgccggcctggaagtgcgttccaacgaaggcgagtgggtgccgttcactgcggacgccgacaccatcgtggtcaatatcggcgacatgctgcagcgcctgactaaccatgtgtacccgtccaccatccaccgcgtggtcaatccgccgggagaggaagcgcgcaagccgcgctattcggtgccgttcttcctgcacccgaacccggatttcctgatcgacgtgttgccgtcctgcatcagcgccgacaaccccagccgctatcccgagccgatcaccgcacacgggtttctggaagagcgcctgcgcgagatcaagctcaagtaagccgaacggacccaagcgcagcctatggccatttaaat

SEQ ID NO: 180 - DNA, 411 bp, Arabidopsis thaliana
atggctcgtactaagcaaacagctcgtaagtctactggaggaaaggctcctaggaagcagcttgctacaaaggctgcacgtaagtctgcaccaaccactggaggagtcaagaagccccatcgttaccgtccaggaactgttgcactacgtgaaattcgtaagtaccagaagagtaccgagttgctgatcaggaagctccctttccagaggctagttcgtgagattgcccaggatttcaagactgacttgcgtttccagagccatgctgtgcttgcactccaggaggctgctgaagcataccttgtgggtctctttgaggacactaacctctgcgccatccatgccaagcgtgtgaccataatgcccaaagacattcagctcgctcgcaggatcagaggagaacgtgcttaa

SEQ ID NO: 181 - DNA, 1502 bp, Glycine max
ttaattaaccacacagtacttcccttctcctcctccaccatgtcattgccaccgccgtcgctggtaacggcggcgactccgacggagcttccgatccggcagattccgggaagctacgggttcccgttgctgggccccatctcggatcggcttgactacttctggttccagaagccagagagcttcttcagaaagcgagtggagaaatacaagagcaccgtgttccgcaccaatgttcctccctccttccccttcttcgttaacgttaatcccaacgtaatcgcggttctcgacgtgaaatcattctcccacctcttcgacatggacctcgtcgacaagaaggatgttctcgtcggagactttgtccccagcgtcgccttcaccggaaacatgagagtcggcgtttaccaggacactaccgaacctcaacattccaaggtgaagaactacatcatggatattctgaaaagaagctcaggcatatgggtatcagaactagaatcaaacctagacacactgtgggacaacatcgaagcatcactctcgaaatcctcatcagtttcgtaccttttcccgttacaacagtttctcttcacgttcctctgcaaagtccttgccggtgcagaccctgcacgtgaccctaaaatcgcagagtcaggctattccatgcttaatagttggctcgctcttcagctgctccccacagtcagcgtgggcatccttcaacccctggaagaaatcttcctccactcctttgcctaccctttcttcctcgtcggtggaaactacaacaacctctacaacttcatcaagcaacaaggcaaggacactataaaccggggcgcaatcgggttcgggttaaccgaagaagaagccatccacaatttgctcttcgtgctgggcttcaactcctacggcggattctccatttttctcccctctctgatcgatgccatagccagcaactccgcattgcaggagaagcttaaaaaagaagcgagagaaaagggcgggtcaacgctgaccttcgactcggtcaaagagatggacctgatccaatccgtggtctacgaaacgctgcgcatgaaccctccggttccactccagtacggtcgagcccgaaaggacttccggttgagttcgcacgactcggtcttccacgtcaagaagggcgagttgctgtgcggctttcagaagctcgtcatgagggactccgttatattcgacgaaccggaccggttcaagccggaccggttcacccaagagaaaggggcccagttgttgaactacttgtattggtccaatgggcctcagaccgggtcgcccagtgtgtccaataaacagtgcgcgggtaaggacgttgtcacactcaccgcggctttgattgtggcgtacctttttcgcaggtatgattccatccaaggggatggcagttccatcactgcccttcaaaagaccaagtgaaagaagggtaaatgtgtattttcattgtggatttaaat

SEQ ID NO: 182 - DNA, 1084 bp, Arabidopsis thaliana
gtttgttgattaacccttaattaaatgaagacagttcttgtaatcataaactgtatattcttggccattggaaactgtggaggccctctaatgatgcgtctctacttccaaaatggtggcgaaaggatctggtttccaagcttccttcaaaccgttggttgtccactcattttcttccctcttctcttatctttcctccgccgtcgtcgttgccttgaagaacaagaaacgactccatttttcctcatgaaacctcctctctttatcgccgctatcgttgttggtttgctcgtgggatttgacaattacctctactcttacgggttagcttatatccctgtttctactgcgtctttgatcatctccgcgcaattaggcttcactgctctctttgcattttttatggtgaagcaaaagttcacacctttcactataaacgctatcgttttgctcactggtggtgccgtagtccttgcccttaactctgatagtgacaagcttgcaaacgagacacacaaggaatatgttgttgggttcatcatgactcttggtgcagctcttctctatgggtttatattgccacttgtcgagctttcttacaagaaatctggtcagcgaatcacgtatacgctcgcgctcgagttccagatggtcttatgctttgctgccacttgtgtctgcctcgtggggatgctagccgctggcgatttcaaggtgatagcaggagaagcaagagattttaagcttggagagtctttgtactatgtggtgattgtgttcacggccataatctggcaagcattttttgtgggagctattgggttgatcttctgtgcatcgtctctggtctctggaattatggtcagtgctctgcttccggtgacggtgatcttggccgtcatttgcttccaggagaagtttcaggcggggaaaggtgtcgctttggctctctccctctggggatcagtctcttatttctatggacaggttaaatccgaggagaagactaaggctcaggatacacaactgtctcagcttccagttactgattatgtagcttaaggcgcgccaaaaattggagctc

SEQ ID NO: 183 - DNA, 1233 bp, Glycine max
ttaattaacggagaaagacacgatgcaggaagcgacgaaggtgataataatcggtgccggaacttctggtatcgccaccgccggttgcttaacgaagcaatcaataccttacataatgctcgagagagaagactgtttcgcttcgctgtggcagaaatacacctacgatcgtctccaccttcatttgaggaagcaagtttgcgagttaccgcacttaccgtttcccaagtcttaccctcactacgtgcctcggaagcagttcatagactacttgggaaactacgttaaccactttgagatcaagcctctgtaccagcgtgcagtggagttggtggagtatgatggatggaaagggatttggagagtgaaggctcagaatagaagatctggtgagcttgaggaatacgctggaaagtacctggtcgtggccagtggcgaaaccgccgagcctcgtctgcctcagattcaaggcttggagagtttcaatggaaaagtgattcactcaactgcctacaaaaacgggaacgagtttaagaataaacatgttctggttgtcggatctggcaattccggcatggagattgcgctagacttgtccaattttggtgccaaaccttccatcattgttcgcagcccggttcattttctttcgagggatatgatgtattatgcgtcgcttatgctgaattacttgtcgctgagtacggtggagaaggtgttggtgatggttagcaaggttgtgtatggagatctgagtgagtatgggataccgtatccgagtgaggggcctttcaccatgaagatgaagtatgccaagttcccaatcatcgatgtaggaactgtcaagaaaattaaatctcgagagatacaggtgttgccagctgaaataaagagtataagaggtaatgaagttttgttccaggatggcaaatcgtacacattcgactcaattgttttctgtacaggcttcaagagatcaactcaaaagtggcttaaggggggtgatgatcttctaaatgaggatggctttccaaaaaacagtttcccaaatcattggaaaggtcgaaatggtttgtattgtgttgggctgtcaagaaggggtttctttggagctaacatggatgcccaattagtagcaaatgatattgcctcgttaattcctcaagaagaaagagaaggaatttgtgtcatgtaatgatctattatctattattggttgcagaaaatttaaat

SEQ ID NO: 184 - DNA, 930 bp, Arabidopsis thaliana
atggcaggaaccggagttgtggcggtgtacggcgaaggagccatgacggagacgaaacagaaatctcccttctccgtgaaagttggtctcgctcagatgcttcgtggcggtgtaatcatggatgtcgtcaacgcagagcaagctcgaatcgctgaagaagctggcgcatgcgccgtgatggctcttgaacgtgttcccgccgatattcgagctcaaggcggtgttgctcgaatgagcgatccagagatgatcaaagaaatcaaaaacgccgtgacgattccggtgatggcgaaagctagaattggtcatttcgttgaagctcagatcctggaagcaatcggagttgattacgtcgacgagagtgaagttctcactctcgccgacgaagataatcacatcaacaaacataatttcaaaatcccttttgtttgtggatgtaggaatctcggtgaagctttaaggcggatccgtgaaggagccgccatgataagaaccaaaggtgaggctggaactggtaacgttgttgaagccgttaggcacgtgaggagtgtgaacggagctattcggttacttagaagcatggacgatgacgaggttttcacttacgcgaaaaagatcgctgcgccgtatgatttggttgtgcagactaaggagcttgggaggttaccggtggttcagttcgctgctggaggagtggcgacgccggcggatgcggcgttgatgatgcagttgggatgtgatggagtgtttgttgggtcgggtgttttcaagagtggagatccggtgaagagggctaaggctattgttcaggcggttacgaattatagagacgcggcggtgttggcggaggtgagctgtggtttaggtgaagccatggttggtcttaatttggatgataaggttgagaggttcgctagtcgttctgagtaa

SEQ ID NO: 185 - DNA, 1379 bp, Glycine max
ttaattaatctattatggtgaaggggttgcacgggcagaacctccccgcccacgtggcacagctggttgatcagctggagcgccactgcttcgctcccgatggatctctcatctccaagcctctcttcaacgatctccaactcgccagagaggaaatgtgcagggaaagactgcgttacctggaagccatggctatatattctgaggctattgcaatggtggaggagtatcagcaagccatttctgtgtctaaccttggtggaatcagagatactggcaatctttatccacagcttgggttgaagaactctcctcaggtttatcagactttagagcatcaaatggttgttgctgaagcagctcaacgattgagactacctcttatctccaaagatggggaggttcatgatgaagacattgaaaagctaagtgtagtgtctcgaagctctcttgacagtactgttagtggggctaattcttctaactataacacaccaagcagctctgttagtggggctaatactgcccttgctgcttcggatccagtggaagtcggagttggtggtgttgccaatcgttttttgggaattacaccttcttatttgtggcaaactcagcatcaaaaagcaccattatccgtggatatgactgaatatcgcctgtctgtttcacgggaggtagaggctcgcttgaagatgaaatgtgaaaaattatcagaagcctttgtattggatgacaatgattcttcatcatctggaagtcatagttcaagttctcggcttccagaaagggtgaaactgttgattgaggagattgaaagagaagaaacagcgctgcgggatgacctttattctgcagatagaaagtttgctgaatattataatgtcttggagcagatacttgcagtgcttattaaacttgtcaaagatttgaagttggagcatcaacataaatatgatgagatgcagaagacttggctctgtaaaaggtgtgagaccatgagtgcgaaattgagtgttctagagcacgttctcttgctcgaaacttacactaaggactctatacctgcccttcataagataaggaaatatcttgttgaggcaacagaagaagcttctattgcatataacaaagcggttacccgcctgcgggagtatcagggtgttgatcctcactttgacaacattgcaaggcagtaccatgatattgtgcagaaattggagaacatgcaatggacaatccaccaagttgaaatggatctgaaacgtttgccagataaacccagcacatagaagttttatgctttgtctccttgttcttggtttgaattctttttgtaaatggtattaaaggcatcaccctcaattaaccatttaaat

SEQ ID NO: 186 - DNA, 1227 bp, Glycine max
ttaattaattttactatcttcaatggctgattcaggctcagcctcttcttccagaatgtggtgctccatccccgaacgggttcagctgcatgcggccatgttggccctgcagtttggctatgctggctttcatgtggtctcaagagctgcccttaacatgggcattagcaaacttgttttcccagtctaccgcaacattattgcttttctcctcctccttccttttgcctacttcttggaaaagaaggagagacctgccattactttaaacttcctcttacagttctttcttctggcacttgtcgggattacagcgaaccaaggtttttacttgcttggcttggacaacacatccccaacctttgcatcagcgattcagaactctgtcccagccattacatttctcatggcagtcatactcaggatagagcaagtgaggctgaacagaaaggatgggatagcgaaggtggcgggaacgatattctgtgtggctggggcgacggtgattacactatacaagggtccaacaatatatagcccaagtccacctctacagagtgagagctcagtagtagttgagtttgggacactctcatcactgggagatgcaaaggggaagaactggacccttgggtgcctctacctcatagggcattgcttgtcctggtctgcttggcttgtgctccaagcacctgtactcaagaagtacccagctcgcctctctgtcacttcctatacatgtttctttggactcatccaattccttgtcattgctctcatcgttgaaagagatgctcaggcttggattttccaatctggtggagaagttttcactattttatatgcgggagtggtggcatctggaattgccttcgctgtacagatatggtgcattgacagaggtggccctgtgttcgttgcggtgtatcagcctgttcaaactcttgttgtcgctattatggcttcccttgctttaggcgaagagttctacttgggcgggatcataggagcagtgttgatcgttgtgggactgtactttgtcttgtggggtaaaagcgaagagagaaagtttgcaaaggaacatgctgcaattacgtctactccagagcacagtggtatcaggtcctcaagccatgccaaaacattactcactcagccacttctcccttcatctacggagaatgtctgatcaacaaaaccatatatgacttcaagctggatttaaat

SEQ ID NO: 187 - DNA, 1983 bp, Glycine max
caatgccataatactcaaactcagtaggattctggtgtgtgcgcaatgaaactgatgcattgaacttgacgaacgttgtcgaaaccgatgatacgaacgaaagctctgcagagctccaatttaaattcactcaagtgattagaagttgctatgtctatgccacaatgaagtggctagaatgtgtaattgtttgttctgacctcaaaccttcaaaagctgcatcttgttggcaaaagcaatggcaatccaatcgggctgggcggcggaccactgcagctggttaatttcacagccagcagagtacatgcagacgggatcaatcccagtgggagaagcaagcgtgggcaattcccaaataagagcctgagtatcatcaccagcagaacaaatatgcgtggagctatgaggagcccaagcaatggcgttcacactcccacggtgcctctctaactccgcaacaggggtagtgggagacctaatatccaaaatcacaactttattactgtccattaaaatggtggccatgtacctcaggtcctgtttgttccaagccaagcggagcaaaggggtgtcagggtgggggctctcgtagatgatggtggagtgctccttgtcgcgaaggtcgaagattctaacggagccgtcggcggagacggaggcgaagactctggcctctccccaggcgatgtcgtaaacctccttgtcgtgagcgatgagttgggtttcgacgagggtgcgttcgatgtcccagatggtgcaggtggtgtcgatgctggaggtggcgatgcggttggggtcgatgtcgttccagtcgaaagaggttaagggggcgcagaactcgctggtcttgctgttgttgaagagggagacggcatccacggagttatcacggatctcccagaggcggaggtagtcgccggaggtggcgaggaggtcggaggaagaggaaggggagggtttgcgggggtggaacatgagtttggtgggagggtaagggtggtcgaaggagagagaagggtggggagttaccgaaagggtgtcagggtggaaagagaggatgtcgacgcggttgttgtattcttcgatgaagctgccgagggcgaggcggtgggggtgggagggggagaatgacatgccgtagatagggtaaggggactcgtaagtgacggagttttccgatcggagatgggattcttcggtcgaattctccattttggttcttgtttcagaggaaggaagatcaaattaattaagggttaatcaacaaacaagaaacaaagagtttgaaagctgacaaataaatgaataatatttgaagtttgtgaaacaatgtagcaaatttttctgtctagatttaaactattgatccttcaaatgggaatgaacccctccttatatagaggactgcagggggatctcggaggagagtcttccggatctcggaggagagtcttccggatctcggaggagagtcttccggatctcggaggagagtcttccggatcccattcggctgagtggctcccgggactctctccactctcttggggtgtcatctatgttactagatcgggaattaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttcccctcgggatcaaagtactttgatccaacccctccgctgctatagtgcagtcggcttctgacgttcagtgcagccgtcttctgaaaacgacatgtcgcacaagtcctaagttacgcgacaggctgccgcccctgcccttttcctggcgttttcttgtcgcgtgttttagtcgcataaagtagaatacttgcgactagaaccggagacattacgccatgaacaagaacgccgccgctggcctgctgggctatgcccgcgtcagcac

SEQ ID NO: 188 - DNA, 888 bp, Glycine max
ttaattaatgagatttggttgattggatcgtacgatggcggcgccgaggaatgtgacggcgacgagggacgaagagaagggcgaggacgatgattcgccctccgcgaagaagcccaaatcggagaggttcccgctgaacacgtgggaattcgccgtcgccgtcgccgtcttcttggtgttctccaccggcctcttctgcatttacctcaccatgccctcggccgcttacaccaacctcaaactcccccgcaccctctccgatcttcgcctcctcaaggaacatctttcgacgtatgcgagtaaccaccctgcgcagttcattcttgggtactgctccacctacatcttcatgcaaactttcatgattcctgggacaatcttcatgtccctcttggctggggcgctttttggagttgtacgaggaatcctattggttgttttcaacgccactgcgggtgcatcttcctgtttctttttgtctaagttaattgggaggcctttggtttcttggttgtggcctgaaaagctaaggttcttccaagctgagattgcgaagcgtagggataggctgctgaattacatgctttttctgaggataaccccgacattgccgaatctgttcatcaatttggcgtctcccatcgttgatgttcccttccatatattcttttcggcgacattgattgggctcgttccagcctcttatattactgtcagagctggccttgctcttggggatctaaagtcaattaaggatctatatgattttaagaccttatcagtacttttcctcattggttttgtttccatagctccaacacttttgaagcggaagcgagtatatgaatgaaggtttcctggctcagcttgcacaatcaagatttaaat

SEQ ID NO: 189 - DNA, 1282 bp, Glycine max
ttaattaagatgctatcaaggttgatggactttctgactgcctgctggcggcgaagatccttctccgacggcaagggtggttccgaggttacggggcggaaggaagggctgctgtggtacaaggatgcggggcagcacttgtttggtgaatactcaatggctgttgtccaggccaacaacctgctcgaggaccagagccagattgagtctggtcctctcagcctgcttgacactggcccttatgggacctttgttggtgtatatgatggacacggtggacccgagacgtcgcgctacgtctgtgatcatctcttccaacatctaaaacgatttgcatctgagcagaagtccatgtctgaggaggttattcggaaggcataccaagccacagaagaaggttttttgtcagtggttaccaaacagtggcccatgaatccccaaattgctgctgtgggatcttgttgtttggttggtgtgatttgtggtggtatcctctacattgctaaccttggcgattcccgtgctgtgcttggccgggttgtcagagcaaccggggaggttttggcgatccagctttcgtcagagcataatgtggccagagaatctgtgagacaagagatgcattctttgcatccggatgactcaaaaattgtggttctaaagcacaatgtatggcgggtgaagggtctgatacagatttctagatccattggcgatgtttacctaaaaaaggctgaattcaacaaggaaccattgtatgctaagttccgtgtgcgggaaggttttaagaggcccattttgagctctgacccatcaatttccgttcatgaaattcaacagcatgatcaatttctcatatttgcttctgatggtctttgggaacaccttagcaatcaggatgctgttgatatagttcaaaacaacccacacaatggaattgctcggaggctcatcaaagctgctttgcaagaagcagcaaaaaagagagagatgaggtactctgatttgaagaaaattgaccgtggtgtccgccggcatttccacgatgacatcacagttgtagttgtatttcttgactccaatcttgtcagcagagccagctcggtaagaggtcctcctttatcggtgagaggaggtggtattcccctaccttctagaactttggctccctgtgctgcacctatggaaacttagttcaggttgatgaagctggctgtataatctgttatgcttgtatttagtgttgtacacttagcagacattgagctctggtgatttaaat

SEQ ID NO: 190 - DNA, 2759 bp, Glycine max
ttaattaaggtggaaatgggagcgagtcgaaaactccaaggcgagattgatcgcgttcttaagaaggttcaggaaggcgtcgaagtcttcgatagcatctggaacaaggtttacgacaccgataatgcgaaccagaaggagaagttcgaggcggacctgaagaaggagattaagaagctgcagaggtacagggaccagattaagacatggattcagtccagtgagatcaaagacaagaaggttagtgcctcatatgagcaggctctggtggatgcacgcaagcttattgagcgtgaaatggaaagattcaagatctgtgagaaggagacaaagacaaaagcattctccaaagaaggcttaggtcaacagcctaaaactgatcctagagagaaggctaaatcagagacaagggattggttgaacaatgtggttggggagttagaaaatcagattgataactttgaagctgagcttgaaggactttctgtcaagaaaggaaagaacaggcctcccagattgacacatctagaaacatcaattactcggcacaaggctcatataaagaaatgtgaatttatcttgaggctactagataatgatgaactaagtccagagcaggttaatgatgtcaaagatttcctggatgactatgtagaccgtaatcaggacgactttgaagaatttagtgatgttgatgagttatatagttcattacccttagacaaggtggagtcacttgaagatattgttacaattccccctggtcctgctaaggtgacacctgtgcttagcttgaagccttctgtggcagcttcagcttcagcatcacaaacatctgagcaagctgatgatacagcttcccaggatagcaattctgattttgtcgcaagaactccacctcctaaaagtagtatagttagtcctactgctacaacaccagcagggaattttgctactcctgtttctatgaatgttcctgtgcctaacttgtcgagtccaccagccattgcatcagtcatgcctggttcaaattctgttcagagttccttggagattagtagtcttgtggatgcttcatcttttgttaatcagtctagcactatgaaggaggaagagattaatagtttccctggtcaaagaccatctccatcgctttctgatgttacactcataaggaacatcagcagaaacagcgtatcaaatcaagcaacaaatagcatacctcttgcttctggcaatatggtttccagcaatgggccccttggttcagtgccttctgcacctgaaataaccaagagaaacatattggtaggtgatgatagactcggaagcaatgggatggtgcagcctcttgtatcccctttaagtaatagaatgatcatgcctcaggttgctaggcctaatgatggaacttcctcagttgactctagtagtgtcaacgaagctgcaactgtatctgggagagtgttctccccttctgctgttcctggcatgcaatggagatctggaagccccttccagaatcagaatgatgtggttcaggttcgtggaagaactgaaatagctcctgatcaaagggaaaggtatttgcagaagttgcagcaagtgcagcaacaagggcaaagtgccattcttaatatgccatcttttgtagcagggaatcctaagcagttttctgctcagcaacaaaatcctctcttacagcagttcaattctcaaggctcatctgttgcatctcaatctggtgtgggacttggagtccagtcaccaggtcttagtggtattgcttccacctcattaccgcagccaccaaattctgtccattccccatctagtcaacagtcattgctattagttgtttccaaagatgcagatgttggcaattctaagggtgacgagccacaacaacagatttttcctgatgattcagggactgaatctactgctagtaatgggattggcaagaattttgtgaatgaagatgaattgaaatccacatatgctgtagattctcctgctggagtacctgcctctcttcctgagcctgctcagacttctagagatattgatttgtctcctggcctacctttacaatcaaatcagcgtactggtaaccttggtgttataggaagaagttcaactgaccttggagctcttggtgacaacttcagtgcatcaactgctaattctggcggagttcgtgatcaattatattatttacagatgcttgaggcagcccacctcaaacttccacaacctaaggactcagaacgtcctaggacctatactcctaaacaccctacgataacacctcctagttttcctcaagtacaggcacctattgttaataatcctgctttttgggagagagtaggtatcgaacaatatggcactgataccctgttctttgcattttactatcaacagaacacttaccaacagtatatggctgcaaaagagctaaagaagcagtcttggagatatcaccggaagtataacacatggtttcaacggcatgaagagccaaaagttgcaacagatgaatatgagcagggaacgtatgtgtactttgatttccatattgcaaatgatgatctgcagcatggctggtgtcaaagaatcaagaccgacttcacctttgaatataactatcttgaagatgagcctattgtctagaagattcttagaaagatgtttcctggtaaatatgtagcatcttggttcttattagtgttttagttttcacaagcaatttaaat

SEQ ID NO: 191 - DNA, 1328 bp, Glycine max
ttaattaaagcttgaaggctttgctcttctgtgtgaaaaatgttggaaggtggtgcgaaattcccgggaataatagatctcaacaagaataataacaactactatgatttctctcaaggcttttaccataagctgggggagggtaccaatatgtcaattgacagcgttgggagcttacagacaagtaacggcggaggatctgttgcgatgtctatcgataatagcagtgttgggtccaatgattcccatactcgcatgttggaccaccaagggttacggaggcgtgccaatgataactactctgttgcacatagtgccaatcgtcggggaagagtcacccatgctttgagtgatgatgctttagctcaagctctaatggacaatagttctccgactgaagggcttgacaattttgatgagtggacaattgatttgaggaaactgaatatgggtgagccttttgctcaaggagcttttgggaaactctacagaggtacttacaatggtgaagatgttgctattaaaatcttggagaggcctgaaaatgatccagcaaaggctcaattgatggagcaacagttccagcaggaggtcatgatgttggccacactaaagcatcctaacatagttcgtttcattggtgcgtgccgcaagccaatggtatggtgcattgtaactgagtatgccaaaggtggttcggttcgacaatttttaatgaagcgtcaaaaccgctcagttcccctcaaattggctgtcaaacaagctttggatgttgcaagggggatggcttatgttcatggccttttattgatccacagggacttgaaatctgataatcttttgatttttggtgacaagtcaattaaaattgctgactttggagttgctcgtattgaggtgcaaactgaaggaatgacacccgagactggaacataccgttggatggctccggagatgatccagcataggccttacacacaaaaagtggatgtatatagctttgggattgttctatgggaactcattaccggtatgcttccatttcagaacatgacagcagtacaggctgcatttgcagttgtcaacaaaaatgttcgtccaatcatacccaacgattgcctacctgttctccgtgacatcatgacaagatgctgggatcccaaccctgatgttaggccaccatttgctgaaattgtaggaatgcttgagaatgcagagaatgagatcatgacaacagttcggaaggcccggttcaggtgttgcatgactcaaccaatgactgctgactgatcctgtgaaagcaaatgcaaatgcaaatgcatttaaat

SEQ ID NO: 192 - DNA, 851 bp, Glycine max
ttaattaaggttaagcggtgagatttgcgaatctgagaaatggcggattcttctcgggaggagaacgtttacatggcgaaattggcggagcaggccgagcgttacgaggagatggttgagttcatggagaaggttgcaaagactgtggaggttgaggagttgacggtggaggagaggaatctcctctctgtggcttacaagaacgtgattggtgcgaggagggcttcgtggaggatcatatcctccattgagcagaaggaggagagcaggggcaatgaggaccacgtggccattataaaggagtacaggggcaaaattgaggctgaactcagcaagatctgtgatgggattttgaacctccttgagtccaacctcattccttccgctgcatctcccgagagcaaagtcttttaccttaaaatgaagggtgattaccacaggtaccttgctgagttcaagaccggggcagagaggaaagaggctgcagagagtactttgcttgcttacaaatccgctcaggatattgctcttgctgacttggcccccactcaccccattaggttgggacttgctctcaacttttctgtgttctattatgaaatccttaactcgccagatcgtgcttgtaatcttgccaagcaggcatttgatgaggcaatttccgagcttgacacattgggtgaagagtcatacaaagatagtacattgatcatgcaacttctccgtgacaatctgactttgtggacatcagacatcacggacgatgctggagatgagatcaaggaaacatctaagcaacaaccaggcgaataggcgatggcagttgcgatgtggtagttgattatttaaat

SEQ ID NO: 193 - DNA, 1008 bp, Glycine max
ttaattaaaccgatcgaaaagtttccttgacaatctaattctgcaaaaatggcaagcaataaggagtctaagttcccagcacagagccagaaaactcagccaggaaaagaacatgtaatgaatccactcccacaagccacaaatcctgatcacaaggccgccaataaactccagggaaaggtggcgttggtgacaggaggtgactcaggaattggcagagcggtttgcctgtgtttcgcaaaagagggtgcaaccgtggcctttacatacgtaaagggccatgaggacagggataaagatgatactctgaagatgctgcttgaagctaagacaagtggtgcagacaatccattggcaatagcagcggatattggctttgatgagaactgcaaacaggtcattgaccttgttgtcaaagaatatggccgccttgatgttctggtcaacaatgcagctgagcagcatttgacaaactctgttgaggaaatcacacaacagcagcttgagagagtcttcggaaccaacatcttttctcagttctttttggtcaagcatgctctgaagcacatgaaagaagggagctgcatcataaactctacttcagttaatgcatacaatgggaatccagaagcgttggactacactgctaccaagggagcaattgtggccttcaccagaggtctttctcagcagctagcgagtaggggaattagggtgaatggtgtggcacctggcccagtttggacgccaatacaaccagcttcaaagcctgctgagatgattcagaacttggggtgtgaggtgccaatgaaccgcgtggctcagccttgtgagattgcaccatgttatttgttcttggcaacttgtcaggactcttcctactttactggccaagtcctccatccaaatggtgggatggtcgtcaacgcttaagctatagtgtgccttcacctatttcctattgaactggtttttctagcttacccctcctgaataagcaatttaaat

SEQ ID NO: 194 - DNA, 949 bp, Glycine max
ttaattaatccccagttttgatcttgtaacactttttcgggtttgttgaatctgcttctttttatttcaatttgggattgactcatatgacaagtatgtatagtggtggttacactgctctagttacaaacttatccccaagagcaacagaggatgatgtgcgcaattttttcacatactgtggtttgattgagcatattgaaatattaagatctggtgaaaatgcgcctactgcatatgtgacttaccgggatgcttatgccctggaaactgcattattgctaaatggatcaatgatattggaccaatgtatattcatttcacgctatgaagcttatgtaaatgactatgataattggagcaatcatgcatcaaatcctgaatacagtattacaacctcacaggatgttcacatggataagtttgttgcttcccctggagaagcactaactatggctcaggtggttgtcaaaacaatggtggctaagggatatgtattgggcaaagatgcatttgtcatggcaaaagctttcgatgaatctcatagtgtatcatctacagcagcaaccaaggttgctgaactcagcaataaaattgggttgactgataccattaattcagggattgaaacttttaagtctgtggatgagaaatatcatgtcacagatttcaccaaatcagctgcaacagtgacaggaacaacagctatagtcgttgcatcagttaccggaaaagctgctgtggcggctggaactgctatagccaacagtagctactttgccaaaggtgctctttgggtttcggatgtgttgacacgtgcagcgaaagcggctgccgatttgggtcagaatgaaaagaaatgaaactccaaacataaactgctgtctaatatgttaacttgttgaacacaaacaaataccagcatttgtttgttgctattgatttaaat

SEQ ID NO: 195 - DNA, 1945 bp, Glycine max
ttaattaacttcagcttctgggttctccattttccttcgtcttctgcatctgcattccgtagattcagttctcgtcggaaaatggacgttcgccgaagacccattcctccctccggcgatcgccgacaaacccagaagctgaagaacaccgccaccaccgattcgcagactcttctgcctctctacctcaccaacgccctcttcttcgcggtgttcttctccgtggcctacttcctcctccaccgctggcgcgagaagatccgcaccgccactcccctccacgccgtcacccccgccgagaccgccgccatcgtctccctcgtcgcctccgccgtctatctcctcggcttcttcggcgtcgcctcccgcgcctccctcgacgagctctccgacgacgagatcatcctcaaggaagactcccgcgccccgggcccgtgcgccgcggcgctgtcggactcctgctcactccccaacaacaaaatccaagaccaattccctctgccacccagggctgtccacagtttggcgaaggaaaaacaacatattccttcgccaccacaagtggacagtcctgtctctgtctcagtctcggtctcttcctcctcggacgacgaggacgaggagatcgtgcaagccgtagtgtcgggctccatcccgtcctactcactcgagtcgcggctcggtgacacccgtcgggccgccaccatccgccacgaggtggtgcagagactgacttcccgatccctgtcaggtttacctctggaaggtttcaactacgactcgatattggggcagtgctgcgagatgccgatagggttcgtgcagatccccgtgggagtagcggggccattattgttggatggaaaagaattcaccgtgcccatggccaccactgaagggtgtctggttgcgagcaccaacagaggttgcaaagctatatacgtctccggtggggcctcctcggtgttgcttagggatggtatgaccagagcacccgttgttcggtttccctccgcccagcgcgccgcgcagttgaaattcttcttggaggatcctctcaacttcgattctcttgctgtcgttttcaataagtcaagcagatttgccaggttgcagaatattcagtgtgctattgcgggcaagaatttgtacatgagattccgatgcagcactggtgatgcaatggggatgaacatggtgtcaaaaggtgttcaaaatgtccttgattttcttcagagtgacttccctgacatggatgttattggaatttctggaaatttctgttcggacaagaaagctgcagccgtgaattggattgaagggcgtggcaagtctgtggtgtgtgaggccataattaaggaggatgtggtgaagaaggtgttgaagaccagtgtggaggccatggtcaagcttaacatgctcaaaaaccttacgggttcagccatggctggtgctcttggtgggttcaatgctcatgctagcaatattgtgtctgctatctacattgccactggtcaggatcctgcccagaatgtggagagttctcactgcatcaccatgatggaagctatcaatgatggcaaggaccttcatgtttccgtgaccatgccctccattgaggttggtactgttggaggtggcacacaactcgcatctcagtcagcatgtcttaatttacttggtgtcaagggtgccaacaaagaatctccgggtgcaaattctaggctactggccaccattgtagccggttcagtcctcgccggggagctatcgctcatgtctgctattgcagctggacaacttgttaagagccacatgaaatacaacagatctagcagggatatatctacaattgtccaatgaactggccacagtacacttaaacttgtgtcagagactaatattctaataagcaaaccatcagataaagacataaaatttaaat

SEQ ID NO: 196 - DNA, 1201 bp, Glycine max
ttaattaagactgaaatttccagaccctcaaatcaaactcttctattctctcatcaatcaatcaatccagttccctctcggataggaatgggaatatatctcagcactccaaaaactgaaaagttttctgaagatggtgaaaatgactgtcttagatatggtttatcatccatgcaagggtggcgtgcaacaatggaagatgctcatgctgcatatactgatctggatgagtccacttcattttttggtgtctatgatggccatggaggtaaggtggttgcaaagttttgtgccaagtttcttcatcaacagttgttcaaaagtgagacatacttaactggagatataggagcctcccttcagaaagcctttttgagaatggatgaaatgatgcgtggtcaaaggggatggagggaattatcaatattgggggataagataaacaagtttactgggatgatagaagggttgatttggtctccacgaagcagtgatgggaattgccatgttgatgattgggcttttgaggaggggcctcattctgattttgctggaccaacttcaggaggcactgcctgtgttgcagttattagaaacaaccaacttgttgttgcaaatgctggtgattcgcgctgtgtgatatccaggaagggccaggcatacaatttgtctagagaccacaaacctgatcttgagattgagaaggaaagaatcttaaaagctggtggtttcattcacgtaggacgagtcaatggaagtttaaatcttgcaagagctattggtgacatggaatttaaacagaataagtttctttctgctgaaaaacaaattgtaactgccaatccagacatcaacactgttgagctttgtgacgaagatgagtttgtggtgttagcttgtgatggcatatgggattgcatgtcaagtcaacaactggttgattttgttcatgaacaattgcactcggaaacaaaactttctgccgtgtgtgaaagagtacttgatcggtgtttggcaccatcaactgccagtggtgaaggatgtgacaacatgaccatgattgtggtgcagttcaaaagacctgctcagtccagtgtaccagcagaagagtcctcttcaaactgacaagctgaacctgaaacaaaactagagagaagtgagagttagcattattcctcagtgacagttcaaaatttaaaat

SEQ ID NO: 197 - DNA, 1833 bp, Glycine max
ttaattaactaagggggcacttttcatgggaggtgtggaagatgaagaaccatccatgaaacgaatgaaattatcctctaaaggattagttggcttgtctaacggttcttctaaagagcctgttggaggcttgtccagtgacttgatggctcggcccctaccatccaaaggggacgaacatgttggttccaaaggggttataaagaaagaagaatttgtcaggataattgcaaaggcattatactctcttggttacggaaagagtggggcacatctagaggaggagtctggaatacctttgcactctcctggggtaaatctgtttatgcagcaaatacttgatggaaattgggatgacagcgtagccacattgtataaaattggtctggcagatgaaagtatggtcaggtcagcctcattcttaatattggagcagaaattttttgagcttctaaatggtgaaaaggtcatggaagcgttgaagaccttgaggacagagattgctccactttgcattaatagtagtagaattcgagaactttcttcctgcttagtttcagcatcttctaggctagacattctaagggtgaggtctcgatcaaagcttctggaggaattgcagaaactgcttccccctacagtaatgatacctgaaaagaggttggagcatctagttgaacaagccctaatcttgcaacgagaggcatgcccatttcataattcattggataaggagatgtcattatattcagatcatcattgtggaaaagatcagataccttccagtacattacagatattagaagcacatgatgacgaagtctggtttgtacaattttcgcataatgggaaatatttagcttcagcatcaaaagatcaaactgcaataatttgggaggttggcataaatggaagactgtctgtaaagcatagattatctggtcaccagaagcctgtttcttctgtttcatggagtcctaatgaccaggagctcctcacatgtggagtggaggaggctattaggcgttgggatgtctctactggcaaatgcctccaaatttatgaaaaagccggtgctggtctagtctcctgttcatggtttccatgtgggaaatatatactttgtggcttaagtgacaagagcatttgcatgtgggaattagatgggaaagaagtggagtcttggaaaggacaaaaaacccttaagatatctgatttggaaataacagatgacggggaagagattctaagtatttgtaaagccaatgtggtactgttattcaatagagaaacaaaggatgagagatttattgaagagtatgaaacaataacctcgttttctttatcaaatgataacaaattcttgttggttaatcttttgaaccaagaaattcatctatggaacattgaaggtgatcctaagcttgttggcaagtacaaaggtcataaacgcgcccggtttattatcaggtcttgctttggtggcctgaagcaagcttttattgctagtggaagtgaggattcacaggtttacatatggcacagaagctcaggggagctaatagaagcattggctggtcattcaggatctgttaattgtgtgagctggaatccagcaaacccccacatgttagcctcagccagtgatgaccgaacaattagggtatggggcctaaattgtctgcacaacaagtaccaaaatgttcacagcaatggcatccattactgcaatgggggaacttagtatgacaaactcattccaattgatttctcttttttatcattgcaattgtgtaaataccgttactattatctcaagtggaccatttaaat

SEQ ID NO: 198 - DNA, 858 bp, Arabidopsis thaliana
atggcgaacaaaccaagaaccagatgggttcttccttacaagaccaaaaacgttgaagacaattactttcttggtcaagtccttggacaaggccaattcggaaccactttcctctgtacccataaacagacaggtcaaaagcttgcctgcaaatccatacccaaaaggaagctcctttgtcaagaagattacgacgacgttctgagagagatccagataatgcatcacttgtctgaataccccaacgttgtccgtatagagagtgcgtacgaggacaccaaaaacgtgcatcttgtgatggagctttgtgaaggaggtgagttgtttgatagaattgtgaagagaggtcattacagtgaaagagaagctgctaagcttatcaagaccattgttggggttgttgaggcgtgtcactctcttggtgttgttcatagagatcttaagcctgagaatttcttgttttcttcttctgatgaagatgcttctcttaaatctactgactttggcctctctgttttctgcacaccaggagaagcattttcggaactcgttggtagtgcttactatgtggcacctgaggttttacataagcattatggtcctgaatgtgacgtatggagtgctggagttatcctctacattctcttatgtggttttcctcctttttgggctgagagtgaaataggcatcttcaggaagattttacagggaaagttggagtttgagatcaatccttggcctagcatttcagagagtgccaaagatcttataaagaaaatgcttgaaagcaatcctaaaaagaggctaactgctcatcaagtgttgtgtcatccgtggattgtggatgataaggtttag

SEQ ID NO: 199 - DNA, 1011 bp, Arabidopsis thaliana
atgggaaattgttgctctcacggacgggactcagccgataacggagacgcattggaaaacggagcttccgcttcaaatgctgccaattcgactggtccaaccgcggaagcttctgtaccacaatcaaaacatgcacctccttctcctcctcctgcaaccaaacaaggccctataggccctgtcttaggtcgacccatggaagatgtaaaagcttcatattctttagggaaagagctcgggcgaggccaatttggtgtcacacacctctgcacacagaaggcaacaggtcatcaatttgcttgcaagacgattgcaaaaagaaagcttgtaaacaaggaagacattgaggatgtaagaagagaagtgcagataatgcatcacttgactggtcaaccaaacattgtggagcttaaaggggcttatgaggataagcattccgtgcatttggttatggagctttgcgcaggtggagagttgttcgataggattattgctaaaggacattactcggagagagcagctgcttcgttgctaagaacgattgttcagattgtgcatacttgccattccatgggggtgattcacagggatttgaagccagagaactttctcttgctcaacaaagatgagaattctcctctcaaagctactgactttgggttgtcggttttctacaagccaggagaggtattcaaggatattgtggggagtgcttattacatcgcacctgaggttttgaaaagaaagtatggaccagaggcagatatttggagtattggtgtcatgttgtatatcctcttatgtggtgtcccgccattctgggctgagtcggagaacgggatattcaacgcaatccttaggggacatgttgatttctcaagtgatccatggccatccatctcgcctcaggcaaaggatcttgttaagaagatgctcaactctgatccaaagcaaagactaactgctgctcaagttctcaaccatccatggatcaaggaggatggagagtag

SEQ ID NO: 200 - DNA, 1212 bp, Arabidopsis thaliana
accgacattagtattatctaatctctatatatttgtgctttgcctctactctcttttcactctctctttttctctcgattccattatctctctctgtaagacacaaaacaaaccctaataatgcagtcgtcgaacgtaactgattgcacaatgaggaaaagaggaacaaaaagaaagattgaaattgagaaacgcatgactaaacaacaacgatccgtcgcttgcagcaaacgccgtcccacactcttctccaaagcggctgatctttgccttctctccggagccaacatagccgtttttgtaacttctcctgacgagaactccgatgtcgtttattcattctcgggctactctcatgcctctgaaattgttgactgttacctcaacaacaagtctcctcccaagactactattaaccctgaatcagccaagttttggtgggaagagcccgatctttaccgtgattgtgacgatctgtctgagttaagaatcatcgaagatcgtttgatgagaacgaagaagcatctcatggattatcttgagaagaaagaaaaatcacactctgtttctaaatccgatcaaaaccctaacaacgacagtgggtcttcttcttcgtcttctcaaattgcttctgattttggtcaaaaccctagtaccttgtctccgtcttccttaaaaattgtttcttttgatcagaactcttactcctcacttgagccttcgtcacaagttactacttgttttgatcaaaaccctgttttctctgttggcagcgagtcatcatctgatcaatctcgttacttggtgaatgaagattctggatttgttgacggcctcttatgtgaaacagaggaagagaataacggaatgcgtcttccccaagaaacacaaacacaaccgatgttcacagaggaggatcagagcttttgggaaaacctagatgtcgacgacgtgtttggtctttttaaggacgacaacaatcttgaggttcctcttcaagatcattcctcaaccaacgaagacgacgagttattgatcgacataagtgaatacttaagcgaagaagcaatggaatgcccatgttttagttagttctcacagcttgattaagcacgatctcatagttaattacggttttagttagttcattaggtaattaccatttatgttgttgtgtgtaacgatctatagatatctgttttatctcaactc

SEQ ID NO: 201 - DNA, 1356 bp, Arabidopsis thaliana
tacaaaagtatgaatctttagattgcttcaagaaaaaaagttttaaagactttaagagattcttagatacatagaatttgaagatcttgtattggtttttgtgaaacagatatttgttagatggaagaagattgcgagtttcgacattgggatgagttgattccagatgctcttggtttaatctttagccacttacctcttcaagaagtactaacagtggtgcctagagtttgcaaagcatggaacagagctgttactggaccttattgttggcaagagattgacattgagctgtggagtaaccgttttcaccagtctgatcatcttgaccggatgcttgagatgttgatccctagaagcgctggctctttgcgaaaactctccgttactggccttcgaaatgactctatcttctccttcattgcacaacagtaagttgctatagtttaatgtattatgatcatatttagaataagcttttaagtggttataggcatagaatgtattaggggatgtgattgaagcaacatgatttcttagttcattgcttttgtatctaatattttacatgttttcttgttttgtttggtaagtgctggttcacttaagaccttgaaggtgccaagaagtggtctgactaattcgggtgtggtaaacgtagctgaaaagctctcgtctctcactttcttggatttgagctactgctgcaaaataggcccagaggcgatacaagccataggaaaacactgtaaatcactgagagagttttgcagaaacatgcatccattggatgtagcaagtgttgtctctcacgacgatgaagcttatgctatcgccaatacaatgccgaagctgaagcggttagagatagcttaccaccgagtcagcacagaaggagtactcaagatcttatcgtgctgtgtttttcttgagttcttggaacttagaggctgttgggacgtgcaacttgataacaagtttttcaaagagaagtttccggatatgaaagtgttaggtccacgcgtgatcggattctatgatatgataaatgattgggaggattgctgctcagattacttctcagatgggtctgattacttggcttgggagttttttgaagatggtgtaatgggagagttctatgaggatgagtttgagcatggttgggacgataatttttatgcggaaaacgcagttttagacatggaaccgcatatttggccaccatctccatgaaccaggccttgttatgttcgaagtctctacctaaaagttgcaactaggaatggttttagcctctcttaagtgtcttaatctatgtatggtgcttgaacttgtgtggcttctttgtgttat

SEQ ID NO: 202 - DNA, 2319 bp, Arabidopsis thaliana
cgttgatttctcttatcctcagatatttttttacgaaaatccacggccactaaccgtaaaggacactcttttgatttttctcttcttctacttaactcgctttgcctgactcactgagtcatggcgcttctgaggccgcatcttcatcgctttcactccaacactctccgccactcagcctatccttccgccgacgctggcggtggccttgtcgtctatcccacgtatggtcgtcaccgttgctccgcgattgcgatcgacgctccgtcgtctctgactggcgtgacgccgattcgttggggttacacgagtgttcaaggattccgagatgagatggaagacgacatcgtaatccgttctgatgctgtcgatagcttctcctacgcagcggtcttcgacggccacgctgggtcgtcctctgtcaaattcctcaggtaacttgtgttgcttctcatgcaagctctgtcttctagggtttaagtgttgacgatggtgatgatgattgatagggaagagctgtataaagagtgtgttggtgcattgcaagctggatcgttgttgaatggaggcgatttcgcagcaatcaaggaagctttgattaaggcctttgaaagcgttgaccgcaatttgctcaaatggtgaaaatgagcttaaatttctcagagcttgaatgaattttgatgattttgagtgaaatgaagtgattcatcatgcgtttggatccaggctagaagctaacggtgacgaagaagatgaatcaggttcaacagccactgtaatgatcatcagaaatgatgtttccttcattgctcatattggtgattcgtgtgcagtaagtcttcttatttataaatggatcattgtaacttggtcatgtctaaagtcttgttaatgcattgaaataggtcttatctcgatctgggcaaatcgaggaattgactgattatcaccgtccatatggaagcagtagagcagctattcaggaagtgaaaagggtcaaagaagcaggtggatgggtgtgtcttcttattttccatgtttcaaattcctcaagtatcattggatttgcttatctatctctccgagaatttggcttaaaaccgattcattgctttttgtataatcagattgtcaatggaaggatttgtggagacatagctgtatctcgtgcttttggtgacatccggtttaagacaaagaagaatgagttgggttctttctcttctcacaacggctcttctatttttataattgttatctcattgctcataagggtttcatacacagtatgttaaagaagggtgttgatgaaggaagatggtccgagaagtttgtttccaggtaacgaactacttggaagctgtttctacttttgctcgtctctcctgttattccatttcaaggatatctgtttctcatgagataaattctcagaatcgagtttaaaggggacatggttgtggcgactccagatatcttccaagtacctctgacatctgatgtggaattcattattttagcttctgatggattatgggactacatgaagaggtttccttttctttttcctctttcccccattcagtcatatgctttttaattgggaaaagtatagagcttacagtgatcaatgttttgccaatacagctcagatgtggttagttatgttagggatcagctccggaaacatgggaatgtgcaggcaagtttttatttcatcttcttatcaaattagtttcaataatcatgtatgactttaaggcttaactagtttcctaactgtccatatgtaacagcttgcttgtgaatctcttgcgcaagtagctttggtaaaatagctaataccctcctcagcctttcttttgattaggaatcaaaactttcaaatgtacgattttgttccaacgttacaggaccggcgatctcaggacaacattagcatcattattgctgatctagggtaggggttcatctaaacaaaagttccactgctatatgaaacctctgtatacattatctattagctattcaatctatatactcttaacgtgttttggtttcgatttttgcataaacagaagaacagagtggaagaatctccccgcgcagcgacaaaacgtagtggttgaactggttcaggctgcaacgactatcggtttagttactgttggcatatggatgtcttcacatctatcttaagtgaattgaacattctatctctttcgttagtgtatataaaacctgtaactatgtctaacactctagtcttcccatagaaatggagatatgaagatacctcacaaacagaaccagctttat

SEQ ID NO: 203 - DNA, 708 bp, Arabidopsis thaliana
tatgttgctgtacgtgtatatatgttttatagacgataaagattgcacaatttctcaataaatagatttacacatttcctcaacataaccaaaagatccaaactacccttctctgatcaaatggattgttcattcataactacaaacgatctccgaagaatgttcaagacgctcgacaagaaccaagacgggcttgtgaccctcgacgagctcctttggattcttgataaactcggttgggccgaacacactcccgatgagcttgaactgatcgttggtaaacagagcctcgatttagacgagttccttcggttctactacgacgctgttttagatagcaaaggatctaagaagaatattgatgttgttgctgataatgatgaagcgattgcgagggcgtttaatgtgttcgatgtgaacggagatggttatatttcagcggaggagcttcgtgatgtgttggaacggctagggtttgaggaggaggcaaaggcttgggattgtgggagaatgattcgagttcatgacaagaatcttgatggttttgttgactttgaagaattcaagaacatgatcttacatgtctaatgatggtgatacacatgtgacatgtgtgtgtagtccttttacatgtttgatgtgttatttgcaaattgcaatcactatatgtaaagtatatctttgcttatccgatgtgttgatgtataa

SEQ ID NO: 204 - DNA, 884 bp, Arabidopsis thaliana
tttcttgtttgttgattaacccttaattaaatggagatacgatgggaagatctacaacttggggaggaggtcggaagaggttcatttgctgcggttcatcgtggagtttggaatggatcggatgttgctattaaggtttacttcgatggtgattacaatgcgatgactttgacggagtgcaaaaaggagatcaacattatgaagaaactgagacatccgaatgtgctactatttatgggagcagtatgtacagaagaaaaatctgccataatcatggaatatatgccaagagggagtctcttcaaaatacttcataatacgaatcagccattggacaagaaacgccgtttaagaatggcccttgatgttgctaggggaatgaattacttacaccgcagaaatccgccaattgtacatagagacttgaaatcttccaatctactcgtggacaagaactggaatgtcaaggttggagactttgggttatcaaagtggaagaacgcaaccttcttgagtactaaatccgggaaaggaactccgcagtggatggctcctgaagttctcagaagtgaaccttcgaatgagaagtgtgatgtgttcagctttggagtcatcttatgggagctaatgactacgttagtaccatgggaccgtttgaactctattcaggttgttggagttgttggtttcatggatcgacgattagacttacctgaaggattaaatccccggatcgcatccataatacaggattgttggcaaactgatccagcaaaacgaccgtcgttcgaggaattaattagtcagatgatgagcctgttccgcaaaccagggtcaggtgcgcaagaagaagacgattgaggcgcgccaaaaattggagctct

SEQ ID NO: 205 - DNA, 1801 bp, Arabidopsis thaliana
ataagataaaaaaatcttgattaatttttctataaattgaagcctttcctctttacatttcgttaacacctaggttcttgtttcctaacaaaggctctactttttctttagttaactactatggctcatttcctcgagacacaggagcccctcgtattctccgggaagaaacgaaacgatcgcgatgacgaagacggtgacgccttggttgcgaagaaatcagcactggcggtgtgtgatgccgaccctgcagcggccatagcgaatatccgacatgagtttggggagcacgggggagtaaacatgtccatcgaagcctccgccaccttcaccgtcatggaaccggataccatgaggcggatgttcaccggagaactgggaccggacaacgacttctacgtatacagccgacacttcaaccccaccgtgctcaacctcagccgccagatggctgctctcgaaggcacccaagctgcctactgtacctctagcggtaatttatatatataaaataaaagaatatacagaacccatggaaacctagttgcgtgtttgatacggaaactttggttggacttcaccttttagtagtttacgaaaaaaactaatggtatcggattgacttcaggtatgtcggcgatatcgtcagtgatgctgcaactgtgcagcagcggaggacacgtggttgcggcaagcacgctatacggaggaacacacgctttgctctctcatttcttgccacggacatgtaacataaccacctccttcgttgacataacggaccatggcgccgtggcaaacgcgatcgttgagggtaggacacaggttctctactttgagtcggtggcaaacccgacgctgactgtggctgacatacctgagctgagccgtatggcacacgagaagggcgtgacggtggtggtggacaacacattcgcccccatggtgctgtctccggccaagcttggagcagatgtggtggttcacagtatctccaagttcatcagtggtggggctgacatcatcgcaggtagcgttatatttagtttgtcgcgacgtacgtaagtttctctttcacgtgaatgagcaaaataaccgtacacgtgtctttgtcgtgacctaaaaaacaggggccgtgtgtgggagtgagaatttggtgaaagagatgatggatcttcgtggcggatctctgatgcttctaggtcccaccatgaacgccaaggtggctttcgagctctccgagcgaatccctcacttgggcctacgcatgagagagcacagccacagagcccaagtgtatgcggagagaatgagggatttgggcatgaaagtcatatatccagggctcgagacccacccgcagcacaagctattcaaagggatggtgaatagagactatggatacggaggattgctgtcgatagacatggagacagaggagaaagccaacaagctcatggcatatctccagaacgccactcagtttggcttcatggccgtcagtttgggttactacgagacactcatgtcttgctccgggagcagcactagcagcgagcttgacccctcacagaaggaagctgcaggcatctctcctggtcttgtacgaatgtcggtggggtatgtgggtacattggagcagaagtggacacaattcgagaaagcattcctcagaatgtaaaatgtcttcttctatatatgatggttttctttcccccaaataccaacaattcatcatctgcgttatatgtatgatgtggccaatgttcagtctcttatttgttatatcacaatgttctag

SEQ ID NO: 206 - DNA, 885 bp, Arabidopsis thaliana
acactttcttctctaatctccatcacctcttattttcatctgcttttgaatttcaaaccttcacataaaaaaaatacttttgaatccgtgtttcattcatcgaatctttttccgataactatggctgaggaaatcaagaatgttcctgaacaggaggtgccaaaggtagcaacagaggaatcatcggcagaggttacagatcgtggattgttcgatttcttgggaaagaagaaagacgaaacaaaaccagaggagactccgatcgcttcagagtttgagcagaaggttcatatttcagagccggagccagaggttaaacacgaaagtcttcttgaaaagcttcaccgaagcgacagttcttctagctccgtaagtttagatctgatctgttgatgataaactataacatgatcgaatgcttttcttatctaactatatgggtctgaatttatacagtcaagtgaggaagaaggttcagatggtgagaagaggaagaagaagaaggagaagaagaagccaactactgaagttgaggtaaaggaggaagagaagaaagggtttatggagaagttgaaagagaagcttcctggacacaagaaacctgaagacggttcagccgtcgctgcggcaccggtggttgttcctcctcctgtggaagaagcgcatccagtggagaagaaagggattcttgagaagattaaggagaagcttccaggataccaccctaagaccaccgtagaggaggagaagaaagataaagaataagaagattatcattaaagatattaagaataatgatggttgatttgctttgtttttttttttttttattgtgatgattgatcatcttttgcttttgtgatgtgtaagtttgttggctttttt

SEQ ID NO: 207 - DNA, 567 bp, Arabidopsis thaliana
ttaattaattttcaaactgtgagagaaaaagaaagagagaaagagatgggagagattgggtttacagagaagcaagaagctttggtgaaggaatcgtgggagatactgaaacaagacatccccaaatacagccttcacttcttctcacagatactggagatagcaccagcagcaaaaggcttgttctctttcctaagagactcagatgaagtccctcacaacaatcctaaactcaaagctcatgctgttaaagtcttcaagatgacatgtgaaacagctatacagctgagggaggaaggaaaggtggtagtggctgacacaaccctccaatatttaggctcaattcatctcaaaagcggcgttattgaccctcacttcgaggtggtgaaagaagctttgctaaggacattgaaagaggggttgggggagaaatacaatgaagaagtggaaggtgcttggtctcaagcttatgatcacttggctttagccatcaagaccgagatgaaacaagaagagtcataaaaccctattgatcatttgggtatcgcatacatgaatcggcgcgcc

SEQ ID NO: 208 - DNA, 1496 bp, Arabidopsis thaliana
ttaattaaatgggtgaaaccgctgccgccaataaccaccgtcaccaccaccatcacggccaccaggtctttgacgtggccagccacgatttcgtccctccacaaccggcttttaaatgcttcgatgatgatggccgcctcaaaagaactgggactgtttggaccgcgagcgctcatataataactgcggttatcggatccggcgttttgtcattggcgtgggcgattgcacagctcggatggatcgctggccctgctgtgatgctattgttctctcttgttactctttactcctccacacttcttagcgactgctacagaaccggcgatgcagtgtctggcaagagaaactacacttacatggatgccgttcgatcaattctcggtgggttcaagttcaagatttgtgggttgattcaatacttgaatctctttggtatcgcaattggatacacgatagcagcttccataagcatgatggcgatcaagagatccaactgcttccacaagagtggaggaaaagacccatgtcacatgtccagtaatccttacatgatcgtatttggtgtggcagagatcttgctctctcaggttcctgatttcgatcagatttggtggatctccattgttgcagctgttatgtccttcacttactctgccattggtctagctcttggaatcgttcaagttgcagcgaatggagttttcaaaggaagtctcactggaataagcatcggaacagtgactcaaacacagaagatatggagaaccttccaagcacttggagacattgcctttgcgtactcatactctgttgtcctaatcgagattcaggatactgtaagatccccaccggcggaatcgaaaacgatgaagaaagcaacaaaaatcagtattgccgtcacaactatcttctacatgctatgtggctcaatgggttatgccgcttttggagatgcagcaccgggaaacctcctcaccggttttggattctacaacccgttttggctccttgacatagctaacgccgccattgttgtccacctcgttggagcttaccaagtctttgctcagcccatctttgcctttattgaaaaatcagtcgcagagagatatccagacaatgacttcctcagcaaggaatttgaaatcagaatccccggatttaagtctccttacaaagtaaacgttttcaggatggtttacaggagtggctttgtcgttacaaccaccgtgatatcgatgctgatgccgttttttaacgacgtggtcgggatcttaggggcgttagggttttggcccttgacggtttattttccggtggagatgtatattaagcagaggaaggttgagaaatggagcacgagatgggtgtgtttacagatgcttagtgttgcttgtcttgtgatctcggtggtcgccggggttggatcaatcgccggagtgatgcttgatcttaaggtctataagccattcaagtctacatattgaagggcg

SEQ ID NO: 209 - DNA, 816 bp, Arabidopsis thaliana
atggttagccctggatcgcgatggaaaaaagggagattgctggggatgggaagttttggacatgtgtatcttggctttaacagtgaaagtggggagatgtgtgccatgaaagaggttactctatgctcagatgatcctaagtcaagggagagtgcacaacaattggggcaagaaatttcagttctaagccgtttacgacaccaaaatatagtgcagtattatggctctgaaaccgtcgatgacaagctgtatatatatctggagtatgtctccggtggttcgatctataaacttcttcaagagtatggacaatttggtgagaatgccattcgtaactacacacaacaaattttatcagggctcgcatatttgcacgccaaaaatactgttcatagggacatcaaaggagcaaatatattggtggatcctcatggacgagtaaaagttgctgattttgggatggcaaaacatattactgctcaatctggtcctttatcattcaaggggagcccatattggatggcacctgaggtgataaagaattcaaatggcagtaaccttgcggtcgacatatggagtcttggatgtactgttttagaaatggctacaacgaaacctccatggagccagtatgaaggggttcctgctatgttcaagattggaaacagcaaggagcttccagatatccctgatcatttatctgaagaggggaaggattttgtaagaaaatgcctacaaagaaaccccgcaaatcgtcctacagctgctcagcttttggatcatgcttttgtaagaaatgtgatgccgatggaatag

SEQ ID NO: 210 - DNA, 1936 bp, Arabidopsis thaliana
ttaattaaactcagtgactcaaatcgttcttcccacacaaaaaaaatggttactgcgacagcatcaactccattttcactctcgtcgtccgtggttttcacgcgccgtcgtaatttcaaacgttttccagtttgcgccagtctttctccggaggtttctcctcttctcagagcagctcatcacactgtaagggttaaatcgggaaaattgaatccttgaaactcaatttcaaatgggtattgtttgaaattgtgttgaaaattcataaaattgaagaaagattgatacttgattacaaaacttttgtctggtaatgttttcaggtggataattatgtaaagagtgggatgattattggtttaggatctggagaagcttcagattttgctatacgttatttgggtcaacaacttggttctggttctttacataatgttgttggtgtaccaatgtaagtcttttgcttctctctctgatgtttatctactatgaatccaataaaaaatcaatcttttgtttgttcagttgttgaatttccctattcattagttcttcgataatgattttgttgttggtgtaccaatgtgagtcttttgattctgattctgctgctggttatcttctatgactccaaataaagtatcaatctttttgtttgttcagttgttgatctctctatattcaatcttttatgttacgagttgagttttgataggcttcatgatgatttgtcctgaccctttttcaggtctgctcgaagtgcgagtgaagcagcaaagtatggaatccccttggaatattaccgggatggtgttcaggtagctgcttctctgtgttttctaaagcggtttgatctatttctgcatctaggggtaatgtttgcagtgtgacacttttgtagattgattttgcatttcatgatgctgatgctgtagaagagaatacgcttattgcagttattggacggcggagaagttcacaggaagatgactatattctgaaacaaaaggtgtatgcagtttcgtgtactttttgcagtctttgaatactcattgcttagctttgggctgacaaaagagagattttacaatacagtctattgtaaaagtagctgatgaggcagtcttcatgataaaggaagaacaatacaaagccggtcttgaaggttctatccctgttttagttcaatctgtaagtaaatttctactgatgaacttcgttttaatcccttggtgatatgattcaaaacttttattccttgaactttgattgcagcttaattggttggccatagctgaggagatagatgacttgtatctaggcgatgcagaggtgtgaatctgcttctttcataaatgctttctcgggcttttggttctatcgattgtgtcaagccttgtttgagtcattgtattttacttggtggaaaaggtgtggagaagagcttctgttgaaaatgaaggccctcttggaggagactttcctatagttaccagtgatggtcacaacattcttgatgttatatttacaactccgattcgaagcctcggtaaaagcttatactgtaaccattgaaacttgtgcaatggtctctattgttgatggatgcaaaatcctgcagctgacttggctacaagccttgataagattgatggggttgtggaccatggactaattatcaaaactcggttagtttctccaaattaagcagtcaggtttagtatgtcattggtcagtagtaagaatctgttttctacttttggcattacagatgcacggtggtgattgcagaagaaactgttgtaagaagtgttaccttgcagaccagtgcattggagggtggtgtacgaacctatggacagactttgcaaaagtagttcgtctcacacattaccgaaaacggtgatccattttgccagtcaatttatggcgcgcc

SEQ ID NO: 211 - DNA, 2424 bp, Arabidopsis thaliana
cagaccaattcagagacccaacaagctcgactgtatacacaaaattcacaaaaacagcttttgagaagttttcttcttcttcaccttattttcgggtatcaaagccacaaaaccctgagaatggcggcagctactcaatttctctcccaaccttcgtctctcaatccacaccaactgaagaaccaaacctcacaacgctccagaagcatccctgtcttgtctcttaaatccacattgaagccacttaaacgcctctccgtgaaagccgccgtcgtttctcaaaactcgtccaaaaccgtgacgaagttcgatcactgtttcaagaaatcatcagatgggtttctctattgtgaaggaactaaagttgaggatatcatggagtcagtggagagaagacccttttacttatatagcaaacctcagatcactagaaacctcgaggcttataaagaagcattggaaggagtgagctctgtgattggttacgctatcaaagctaataacaatcttaaaattttggagcatttgagaagtttaggctgtggtgctgtgctcgttagtggaaatgagcttagacttgctcttcgtgctggtttcgatcccacaaagtaacattctttatttacccattattgccctgtatctgatttagagagctttaacttcatccctataacaaagtgtttgacttgttgatggaatcagtattgatatgaatggtatgatttggtgtaaaatgaataggtgcattttcaatggaaatggcaagtctttggaagatttagttctagctgctcaagaaggtgttttcgttaatgtcgatagtgagtttgacttgaataacattgtggaagcttcaagaatttctggtaagcaggtcaatgtactgctgcgtatcaatcctgatgttgatcctcaggtatggttaaaatttactttaaactttagcatcatgtctaacataattggtcttggatattagttagtgagcttttctgttttatacatttttcaggtgcatccatatgttgctactgggaacaagaactcaaagtttggtatcaggaacgagaagcttcaatggtttctggatcaggtcaaggcacatcccaaagagctgaagcttgttggagctcattgccatctaggctctaccattactaaggtaacactctgattatagttgcttaaagttgtattttgatgtaatcagatgaatatggattgctctctgtttagtgtttgcttttggtccgtccttagatctcaactcttgagctctacgtatttgcgtatgttctgtttattccaggtggatatattcagagatgcggcagttctcatgatagaatacattgacgagatccggcgtcaaggttttgaagttagttacttgaacattggtggtggtttagggattgattattaccatgccggcgctgtccttcccacacccatggatctcatcaacactgtaagaacaacatctctttcgttcatttgatctcaaaagtagtgggatggtagaattgttacaatccttgatgtgttccaggtaagagagcttgttctttcacgagacctgaatctaataatcgagccagggagatctctgattgcaaacacttgctgtttcgtcaaccatgtaactggtgtgaagacgaatggaactaagaacttcatagtcattgatggaagtatggctgagcttatccgtcccagtctttatgatgcttatcaggtaaaaacaaatatacttctcacaacagcatctgcagattttggtcccctttgagctatagctaaacattctcttgttcatgtttttaactcaaaagcacattgagttggtctctcctccaccggctgaagcagaggttaccaaattcgacgtagtgggtcctgtctgtgaatctgctgatttcctgggcaaagacagagagcttcccactcctccacaggtatgataaggatatgattctgtttggaagctcaggtaatgtggaatcttatgagtttattgtattcattacagggagctggtctggtggttcatgacgctggtgcatactgtatgagcatggcttccacttacaatctcaagatgcgtcctccggaatactgggtaccaacacattttcttgttccaggagaatcaagatcccgagagaaattgtcatgaatttgaacttattttcttcaatgtgttgtttgtttttgcaggttgaagaagatgggtcgatcactaagataaggcatgctgagacattcgatgaccatttgcgtttctttgaaggtctatgaactcttagatttactcatcattgttgcttttttgattgaattgtatgattattcggaatcaggaccataatgatattgctgttttagattttcacattatgtgctttgattcaaagtcaa

SEQ ID NO: 212 - DNA, 1535 bp, Arabidopsis thaliana
ttaattaaagagaagatgatgtccaccacagtcagattaaacaggtttacgtatctaacgagtactgcaaaactgacacgttacttttgctctcaccatttagttgaccgatcggaaacggcgttgcatgaagttattcggatagtttcttctccagttggtggtctagatgaccttgaagaaaacttgaaccaggtttctgtttctccatcatcaaaccttgttacccaagtgattgagtcttgcaagaacgagacttcaccgagaaggctgttgaggtttttctcctggtcgtgtaaaagcttgggatctagtttacacgacaaggaattcaactatgtcctaagagttttggctgagaagaaggatcacacagctatgcagatactcttatcagatctcaggaaggagaatcgggcgatggacaagcaaacgtttagcattgtcgctgaaactctggttaaggttggtaaggaagaagatgcaataggtatcttcaagatcttggacaaattttcttgcccacaagatggtttcactgtgacggctattataagcgctctttgttccagaggacatgtgaagagagcattgggagttatgcatcatcacaaggatgtaatatccgggaatgaattgtctgtgtatagaagtcttttattcgggtggtcggtacaaagaaacgtgaaggaagcaagaagagttatacaagatatgaaatcagcagggattacaccggatttgttctgtttcaactcgttgctgacctgcctttgcgaaagaaacgtgaatcgaaacccgtctgggcttgttcctgaagctttgaatattatgttggagatgaggtcttacaaaatccaacctacgtctatgagttacaacattttgctctcttgtttgggaaggactaggagggtgagagagtcctgccagattttagaacagatgaaaagatcgggatgtgatccggatacagggagctattacttcgttgtgagggtcctgtatttgacaggaaggtttggtaaaggcaaccaaattgtggatgagatgatcgagagaggatttagacccgaacgcaaattctattatgatctgatcggggttctttgtggggtcgagcgggttaactttgctcttcaattgtttgagaagatgaagagaagctcagtgggtggttatggtcaggtttatgatctgctcataccaaaactatgtaaaggaggaaactttgagaaaggaagagagctttgggaagaggcattgtcaattgatgttacacttagttgctccattagtttgcttgatccatctgtcacagaggttttcaaacctatgaagatgaaagaagaagctgcaatggtggatcgtcgtgctcttaacttgaagattcacgctagaatgaacaaaacaaagccaaaactgaaactaaaaccgaaacgcaggagcaagacaaagaagaagaatctgcaacattgattgatttcttctacccattgttaagaacatctgatatagcaggcaatgggcgcgcc

SEQ ID NO: 213 - DNA, 1890 bp, Arabidopsis thaliana
ttaattaatcctccatacatacaacaaagagagaaacttttgatatggggttaaagatgtcagaatcagccaagccttactttgcaatggtttgtcttcaattcggatacgccggcatgaacctcgtgacgaaggttgtgctagaccgcggcatgagccattacgtccttgtggcttaccgtaatgcctttgccacggctgctatcgcaccttttgctctactctccgagaggtatcatattttatagaaatatatattaaaaaagttcgattgattctcatcaaatacaaacatttgataacttgataatggtgttgtaggaaagtgaggccgaagatgacatttccaatattcatgcagatttttgttctagctcttctcgggttagtcttcttaaaatttgaattatttttcaaaaacatgcacttgatgagtatatgaatactttatgaattatttaccacaggcctttgatcgatcaaaatttatattacgccggtctcaaacttacttcaccaacttttgccggcgcagtcacaaatatcgttccagctttgacctttatcatttccataatttgcaggtacctaaatttaacgcatagctttattattagttatccattgcggtagccaaatacaataggttaattcatacaatatggtacgttgatgatgatgcgtggtttatattttggtgaaaaaaataaaggatggagaaggtggagatgagaaaagtaagattccaagcaaaagtggtggggacattagtgatagtggttggagccatgttgatgattttattcaaaattcctctaatcacctttctccgatctcacctcaccggccatgctttgtcgccggcaggtgaggactacctcaaagccaccgtcttcctcctcatcgcctcattttcttgggcttcctttttcgttcttcaggtacatcatttaaattttacatcgactgatctctttaactcgtgaagccccttctaaaagtatctttatctacggattaatatatacatatctaatagtagtgatccgatagtactatatctaaataagggagtcttctaacgaattaggacaattatgtttcatcatttctttaggcggctacgttgaagagatactcatctcacctttcattatcgacgatggtgtgtttcatgggcacgttacagtccacagccttaacgtttgtgatggagccaaacctttctgcatggaacattggctttgacatgaaccttcttgcctctgcttatgcggtttgtccttctcatgattatataaattatgttatatacggaaccatataatacttataatctgatgtgtgaatatatatacttttatagggcataatgtcgtcgagcatagcgtactacgttcaaggaatgatgacgaagcaaaagagtgttatctttgttactgcttttaatcctcttgttgtcataatcggatccatcattggcttcctcatcctcaaccaaactttaaaccttggcgggtaagcaaccagtggattttgatctgattaggtcatatggctggattcatcatcatgtttctaaactagtatattttgttgatccaactccgaaatttagggttcttggaatggcaattttagtggtgggagtttgcacggttctttggggaaaggaaggagatatcgatgaagaagagaacattgaggagaagtttgtagaaattgtcaagtgttgcaaccgctgcgatatcaaggttctctcgatgatgccaagaatcgatgaggaagtagacgttgaaatgcaatccgcaggaacagctaaagtggcggtgggtttctcgtaacctctcgtgtgtggaaaaagatgttcacgaccttaattggcgcgcc

SEQ ID NO: 214 - DNA, 1010 bp, Arabidopsis thaliana
ttaattaacttcttctggttgcgtttgagtccgtacgaaaacaaaagaaaagagagagatggcggaagagaagaaagctccaatcagtgtctggactaccgtgaagcccttcgtcaatggcggtgcctctggtatgctcgctacttgcgttatccagccgatcgacatgattaaggtgaggattcaacttggtcagggatctgcagccagtataaccaccaacatgcttaagaatgagggcgttggtgccttctacaagggattatctgctgggttgctgaggcaagcaacttacacgacagcccgtcttggatcattcaagttgctgactgcaaaggcaattgagtctaatgatggaaagcctctaccgctgtatcagaaggcactatgtggtctgacagctggtgctattggtgcttgcgtcggtagtccagccgatctagcacttatcagaatgcaggccgataatactttgccgctagctcagcgcaggaattataccaatgctttccatgcgcttacccgtattagcgctgatgagggagttttagcactttggaaagggtgtgggcccactgtggtcagagctatggctttgaacatgggaatgcttgcatcttatgatcaaagtgctgaatacatgagagataatcttggtttcggggagatgtctacggtcgtaggagcaagtgctgtttctgggttctgcgctgcggcttgcagtctgccatttgactttgtcaaaactcagattcagaaaatgcaaccggatgctcaaggaaagtatccatacacaggttcgctcgattgtgcgatgaaaaccttaaaagaaggaggacctctgaaattttactcgggtttcccagtttactgtgtcaggattgcccctcacgtcatgatgacatggatcttcctaaaccagattacgaaatttcaaaagaagattggtatgtgaggaacaaatacagcagcaaaaaaataagatagaagaacgaaaacacaggcgcgcc

SEQ ID NO: 215 - DNA, 2212 bp, Arabidopsis thaliana
ttaattaaacccatctgagagcataatcaagagatagagagacaatgggagtgatattggactcatggtgcttttgtaaaggagttggcaaaagcgagaagatgaaaggttccatttttaccggcaaagctccggcgatggctcgaatctctgtctccggaccaaatggtgttacttctggaactggattcctcattcaccggaatcttcttctgaccactcacctcaatcttccttccatctccgccaccgaaaccgccgaggtccgccttcagaacggtgtcgctgctgctctcttccctcacaggtcccacctctctctttactctctcttgagtttgattcaaaatttgatttttcattttcctgtgttgtcggttgcacgatcctggtaaattttgatgcaatgccatcaaaaaaattggctcttgttcaaattttcaaaaatgaatccatatcttttcgtcaaaccaaaagaacttaaaagaaaagagctttatactgtacttatgttatatggtaatgattctggatctgtagctgaatttggtaagttttcattttaatttcataaactttaaaccaaaacattgatatatcattttgtgattattggaacatgaaaattcatttgttcagatatttcccaaaatggaaacgtcttgattgcatcaaacataataagaaccaatctgaattgtggatttgtttggtcaatgatggtgttttctgttctttagctatcagaaaatgagtgttatctttatatggtgtcatttgcaggtttttcattacgagttcagttattgatctcactattgttggcttagaccttgttgatggagactcaagttcccagagccaacttcaacaacaaccacattacctgaagacatgttccaaaccaaacctggatctagggagtgtggtgtacctcttaggctatgccaatcagaatgaactcaagatcggcgagggaaagttagttgtagctaccgacaatctcatcaaactctcaactgatgaaatgatttggagtcctggatctgctggatttgatgttcaagggaatcttgcattcatgatttgtgatccgaggaaactatcgacatcaccaacctcaacctcgtcatcttcctcttcttctttgaagaaagataacaacaagacactgatgatgcagtttggtataccaataccagtaatatgtgactggctgaatcagcattgggaaggtagtttggatgaacatacgacgaaacctaagttgcctctcattcgattaatgtcttctggtcagaagagtgagcgttcttgtacttcattcaccatgcgccgtgttttcaagccaaacgactctgctgatgttggaacaccatcttcatctaacactagagatcaaactcatccgagctcttctatcgctgctgaggaagaaaaagaagaagaaacctcaaaaaccaatccacaagtctgcggaactactactcatgcgcagggtatccctacccctgagatatatgaatcgccaaagttgacttctggtcctctaagaaatgagacagctcaagtacaccttttggacatcaactttcctccacggatacctaaagctataacctttcatcctgagctcaactctctacagagtaaccatatagtggaagaggctgagattgtctctgaaggatcagatgcgcagattgcttcgacaggttcagtaaatggtgctctcagtgaggtcatctcaagttcaccgccagcagcagctcactatgtatataacaatcatggatacagcagcgaggaagagacaatgtattctgcagaaacagcagaaagccgaaactacccaactcctccaagaaaaagcgagtttcatcatgagagagttggaaggagtcaaagctgtgtgagctccagcagatggggaactcctcagaagagtttgaatggtagaagagaaatgctggagaaacagagaagcttcgtccatgggaagaagatgcattcacaaggagcaatgtcacagaggagtaatgactattacagcccaacggtctcatctatcatgaagaaaaggattaatagttcagagcaacagattatcaaaccggtacctagacctagagctgttagttcttcaccaagatgggcgttctaaggtcgatacagaccggagaaagagccaccttcatagaaagggcgcgcc

SEQ ID NO: 216 - DNA, 2120 bp, Arabidopsis thaliana
ttaattaaaaatctctctcaatccgtgtagcttagcttccctaatccaaccatggcaaagttcggtgaaggtgacaagagatggatcgtagaagacagacctgacggcaccaacgtccataactggcactggtccgaaaccaattgccttgaatggtctcgcaacttcttcaccaaacaattctccggcgttgatatcctctccggcgaaggtaatcttttcatcaaggtcagtaagatcgagaaagtcgaaggcgaggcttatgtgaatgtgaggaaggggaagattatccctggctacgagcttaacgtctctttatcttgggaaggtgaggctaaagattccgatgggaagacgcttttgaaagctgatggattggtcgatatgccttatatctccgatgagaatgctgatgaagatccggagattaggttttcggtgaaggatgagggaccgattgggaggactttgaaggaagcgatggtgaagaaggggaaggagattattctggagaaggttagggtttatgtggaggctatggcgagaggaggcccgtgtagggatgaattggaatcgaagaaggttgcgccgaaatcggtagcggctggatcagctacggtggcggtggagaagtctggtgctgccccggtggtgtctgctgctgcggtggagagtaaggtagttaaggagaagaagaaggcgaagactaaggaagggtttaagacaattactatgaccgagaagtttaattgcagagctagggatttgtatgagattttaatggatgagaatcgttggaaaggttttacgcagagtaatgctaagattagtaaagatgtgaatggtccgattagtgtctttgatgggtctgttactggaatgaatcttgagcttgaagaaggcaaattgattgttcagaagtggagatttgggagctggcctgatggtcttgattcaacggttagtttagtgaatttggaatggctaaacgtattaccctgattatagatttgattgtggttgatatattggctgttgctttgacatttcaggtgaagatcgttttcgaggagcctcaaccaggagtcaccattgtcaatcttactcacactgacgttcctgaagaggacaggttagttttactcatggcatgtctatcttatagtcttacttataatgagttgctcttgattctgagtctgaactttgggattaggaaacaaaaaaggagcttttaagtttttacctattaacacgttgttggtcattcatgaagtagaaagactattgagtgactatgttttgtgtttggttgaatgcaatgaattctgctggaatctggactgctttatagcttggttttaaaatagaattttgctaccgatgtacaaagctagaaccaagggtctatttgctcaactctccctaaccacctatagctagttaaatttcccagtgaccgacactacttttaactctattatctatgcttatccttggcactaatttgatttgttgtatgtagttgatggactcttctagtcttcccctttagtgacttgcttgtgattctgaattagaactttggtttctggtaaaccaagacagaaagtttgaacttctttcatccttaaagtggaaagaagtgatgactgacatgtttaataatcgaatggattcttttggaatttgggtttactgttttggttggtatatgatagattgctcctgtttcccaatgtcccacgtctcttcgatctactatctatgtcaatctttgctactaactcactcttagcttatgctgacaatataactcttctttgttccttgtgaacacttgataactgatgatttttttttctttggtatatggcctgtgtcttaagatgagtgagtgattcaatgttgctaaatgtgaggacattgatgtaactactgttatctgatgtttatccaatggttgatgcagatacgggaatgcgactgtggtggaaaacactgagagaggatggagagatcttatattccataggatccgtgcagttttcggatttggaatatgaacttatgattttgattatcaaataagttgattatgatttggaccgaggcgcgcc

SEQ ID NO: 217 - DNA, 2017 bp, Arabidopsis thaliana
ttaattaatccaggaaataaaaacttctaatcaaagagcaagagattaagaaatgtatgcagaaactagcttagctttccgattcatgcagagttcttcttctccagagattcaccaatttgaagacctctttaaatcctacaagctctctgatgaaatggtttgtctttttgacttcacttcctctttttttgtcactgcatttgatttttttgattttgggtttcttgtctctgcttgacctttgatgaaattaagttgattgatgaagacaattggagtgtgaaggagatggaaaacactaattagtggatattagtggcaaagttttgtgctttaagtggttttcttgagaaaatttgtggtaactggaaatttgattcgatctatttgctgagctcacatctgttttggcttttaaaaattgggtctttctgggtagatgaaaagacggaatcttcttctgctgatgtttgatagaacaaaaaaaaaactcaactttatttttggttttgagaaaaagaagacctttttatatgtgttgtgattatgggatcatgggagtggcccttttctctttatagaagctgaacttagaacttaataagagtgtatcatacacgattgacaacaaacttttgtgtttatagactatcagattccgtgttctttgagaattgtgtttttcttttttcagttattcttttgctctgcttggggtttgtcgattcatagtgtcataatcttactttcattctccactatgactgtaagaaagaataaaaattccctttcgttttaccttttttgaacgaattcattttaaagagatctgtgtgtgtttgtgcataaaaccaaagaaactcattgtgtcttagtcaagttttgagttttgatcttgtggtttgtggttttggttgtctcttgttatgttttgctcatttttcttataattgtgatgcagaacaatcttgttgaggcaagtgagtatgattttggagaagagagtgacctattcaaagcccctgagccgattattgaagaaccaatgttagctgttgatcccctctctcaagagcttgttgaactcggtgatctcgggtcgttgcagagtgaccaacagcttatagacaaggctttctacgactgtgagcaggacctcctggtgaaatcagccatggagtctccgctctccgaggtactagacatcaagaacatctctttagtggcaaaaatggacaacgatgtgaagagtacgagtgtagtcgtctctgatgtcccaattccgaagagtgtgagctcgggaaacttgagctcaatggatatggtcgagcacaaggatgcggtgattcagggattccctgatttccctccagtggattatgggatgagaagagccttcagtgaaagcgatatacaggttagaactgaaattattgatattactcttgtgatcattgaactcaacctatacaagggtttgcaagaatttagactgtgctcattcttgtcacatcatcgatatttcagagaaagttgtgacatttcccaaactcaaatgaatatatatagatatgatgttggcaaaagttctcatgtgtatgttcatcacttgtgatctttttggtctatgacagacactggggactggaaatacgggtcttgttcagtctcagttggatcgaataatcataagttgcacctctgaggaccgccgtgagaagctttctcgatacaggaacaagaagagcaagcgaaatttcgggcgtaaaatcaaggtaaagacccgaaaaaacagtttatataacactaaactctactctttcttctcaaacccgctttgttggaaactgagatctggtttgtttcggtatgtaccgtatggttgcagtatgcttgtaggaaggcacttgcagacagtcaaccgaggatccgaggaaggtttgcaaaaacagaggagatgcagaaatgatgaggactagttaggtctgatgcggtgttaagaatatggcgcgcc

SEQ ID NO: 218 - DNA, 613 bp, Arabidopsis thaliana
ttaattaaaaagcagagagaaaaacaaaatccattgaagaaggagaagaagaaaaaaaatgggagcattttgcaagttgatcgatgcggttctcttcttatactttgctctcatggcggtaattgcgccgcttatcgacggtcaaacgagtcttcccggcgatatcttcccggcgtttatcgtcgatctgaatcgctggtacattgatgaatttggagattatctagtcaaagagaagccgcatttcctagtcggactcgtctggcatgagcttttgcttctttggccgctctcaatcgtcaacgtctacgcaattctcgctgggaaatcgtggtttggtaccacctcaatggtgtacggagcttccgtcgtgacttctatggctgctatactgggagagatgataggatcagggaaggcatctgagaaattgttgatgatgtatgtgccattcatgggtgttggtattctagctcttcttcgtggtcttctttctcaatccaacaaaagtggtggagctgttggcaagagacctgctattttggccaggagaaagcgtgcttgaggtacacttgatgatcagcaagtgtatcttttgactctgaggcgcgcc

SEQ ID NO: 219 - DNA, 1875 bp, Arabidopsis thaliana
ttaattaaatgtacctggacataaatggtgtgatgatcaaacagtttagcttcaaagcctctcttctcccattctcttctaatttccgacaaagctccgccaaaatccatcgtcctatcggagccaccatgaccacagtttcgactcagaacgagtctactcaaaaacccgtccaggtaaacttctctgtttcttagtgatctttactttgatggtaaatagtcaaatgatgatgaacaaaggcattgtttcgattctcgtgttactgttcttgaaagatctaatcttgaagggtcctcctatttgtttgggcactgcttttccaacattggaagctgctgttctgtctatttgatgttttgttttttacctctgttcgtaatgatttccaactttgtccgatttggattccacttaagttcttgctgtttggtcccactgtaccttttaacagtttacactatcgaatcaatcccagtttcatcttcgttagctcgatgacccaattaatgggttttgcttaagcatcgcagagtttaaacccgataaatgattcttctcgtttgtgactttagggtcatcattggcatacgtactgatctcaatgcataaaagatttgtactttgaaaattttggatttggtatttgagatattagcagtaaagttttttctctctgttcttctaaatatttccaaacttgattacttaggtggcgaagagattagagaagttcaagactactattttcactcaaatgagcatattggcagttaaacatggagcgatcaatttaggccaaggctttcccaatttcgacggtcctgattttgttaaagaagctgcgatccaagctattaaagatggtaaaaaccagtatgctcgtggatacggcattcctcagctcaactctgctatagctgcgcggtttcgtgaagatacgggtcttgttgttgatcctgagaaagaagttactgttacatctggttgcacagaagccatagctgcagctatgttgggtttaataaaccctggtgatgaagtcattctctttgcaccgttttatgattcctatgaagcaacactctctatggctggtgctaaagtaaaaggaatcactttacgtccaccggacttctccatccctttggaagagcttaaagctgcggtaactaacaagactcgagccatccttatgaacactccgcacaacccgaccgggaagatgttcactagggaggagcttgaaaccattgcatctctctgcattgaaaacgatgtgcttgtgttctcggatgaagtatacgataagcttgcgtttgaaatggatcacatttctatagcttctcttcccggtatgtatgaaagaactgtgaccatgaattccctgggaaagactttctctttaaccggatggaagatcggctgggcgattgcgccgcctcatctgacttggggagttcgacaagcacactcttacctcacattcgccacatcaacaccagcacaatgggcagccgttgcagctctcaaggcaccagagtcttacttcaaagagctgaaaagagattacaatgtgaaaaaggagactctggttaagggtttgaaggaagtcggatttacagtgttcccatcgagcgggacttactttgtggttgctgatcacactccatttggaatggagaacgatgttgctttctgtgagtatcttattgaagaagttggggtcgttgcgatcccaacgagcgtcttttatctgaatccagaagaagggaagaatttggttaggtttgcgttctgtaaagacgaagagacgttgcgtggtgcaattgagaggatgaagcagaagcttaagagaaaagtctgaggcgcgcc

SEQ ID NO: 220 - DNA, 1697 bp, Arabidopsis thaliana
ttaattaaaccacaaacaaaactgcagagagtttactgagaagagactacaatgtctttaacagagcgactttataatcatctttctctcttcgatctacttctttccttgttggggctctttgttttctgctgtttgcgtgagaagttaaccaacaagcgtggaccaatgctatggccagttttcggaattactttagagtttttctttcatataaatgatgtctatggatgggtcacaaggagtttgaaaaaatgtcgaggtacctttctttatcggggagtttggcttgatgggtcttatggagctgtgacttgtgttcctgcaaatgtcgagtacatgctcaagactaacttcaagaacttcccaaaaggtaccttctttaaaagccggttcaatgatctgctcgaggaaggtatctttaatgctgatgatgattcttggaaggagcaacgacggatcatcataaccgaaatgcattcaaccgggtttgtagagcattcctttcagacaacacaacatttggtaaggaagaagctgttgaaggtgatggagagtttcgcaaagtcacaagaagctttcgatctccaagacgtgttcctgcgcttgacgtttgacatcatctgccttgcgggtctaggtgctgacccggaaactctagctgttgatcttccccaagttccatttgctaaagcttttgaagaagcaacagagtctacactgtttagattcatgatccctccatttatatggaagcccatgaggttcctcgacacaggatatgaaaaaggtctcaggatagctgttggggtcgtgcacgggttcgtcgacaagatgattgtggatcgtatctgcgagctcaaggaagaagaaacgttagacaatagatctgatgttctctcaaggattattcagatagagagtcataaaagggaaaatgagattgatccttccaccattagatttttcagacaattttgcacaagttttatattagctggacgagatacaagttctgttgcactttcatggttctgctgggtgatacagaaacacccagaggttgaaaacaaaatcatctgcgagataagagaaatcttgagacagcgaggggattctccaaccagcaaaaacgagagcctcttcacagtcaaagaactaaacaacatggtatacctacaagcagcactatcagaaactctgagactgttccctccaattccaatggaaatgaaacaagccattgaagatgatgtgttaccagatgggacattcgtaagaaaaggttcacgggtttacttctcaatctatgccatgggaaggatggaatcaatctggggaaaagattgtgaaattttcagaccagagagatggatccaagcagggaagtttgtcagtgacgaccagttcaaatacgttgtattcaatgctggaccaaggctgtgcataggaaaaacatttgcttacctgcagatgaagatgatagctgcttcagttttgttgaggtactcaatcaaggttgtccaagatcatgtcatagccccgagagtcacaactaacttgtacatgaagtacggcctcaaagtaaccatcacaccaaggtcgctggaagagaagaaacttgagtcatgttccatgtagaagatttgtaaactataataccttagaggaactcaattttactgttgaggcgcgcc

SEQ ID NO: 221 - DNA, 1928 bp, Arabidopsis thaliana
ttaattaaatggagatagtaattgcatcattggctttagttgttgtattgtggtgtatatggagaattttggagtgggtttggcttaaacctaagatgcttgagagttacctgagaagacaaggtcttgtcggaactcgttacacgcctcttgtaggagatgtgagaaggagttttagcatgttgaaggaagcaagatccaaaccgatgaaaccaacggatgatctcatctcacttgtcatgccttactcttttcacatgctcaacacttacggttgagattttaaattctttttgtatttactagaggtctaaacggttcttcttctaatatatatgcatgtatgtatctgtggctacaacagggaagacatttttcacatggtcaggacccatacctgccataacaataatgaatccacagctgatcaaagaagtgtacaacaagttttatgatttcgagaagacgcacacgtttcctttgacttcattgctaactgatggacttgctaatgccgatggagataaatgggtgaaacaccggaagattatcaacccggcattccattttgagaagattaaggtttcaaatcctcttctctaatattgtcacaaaaccatgcatgttaatattgcttctggctgacgagtgaatggcctttttttgtgacctgattatgattttgtgtatagaatatggtccctacgttttataaaagttgcatcgaggtcatgtgtgaatgggagaagttagtttcagataaagggtcgtcgtgcgagcttgatgtttggccatggattgtgaatatgaccggagatgtgatctctcgaaccgcttttggtagcagttacaaagaaggacagaggatattcatattacaagcagaattagcccacctcatcatactagctcttggaaagaattacattcctgcataccggtaagaaactttacttgttttggtctctaattacttagcatgactcttggttacaatactcttcttggaactgtgaatttcattcttctttgtttttgtatgtgtaggcatttcccaactaagaataacagaaggatgaaaacaatagtcaaagaaatccaagtcatactaagagggatcattggccatagagaaaaggcgagagacgctggagaagcaccgagtgacgatttgttaggtatacttcttaaatcgaattcagagcaaagtaaaggaaatggactgaacatggaagaaatcatggaagagtgcaagttgttttattttgcgggacaagagaccacttcagtacttttggcttggactatggttttgttaagccaacaccaagactggcaagctcgtgcacgagaggaagtgatgcaagtttttggccataacaaacctgatctacaaggcattaaccaactcaaagttgtaagtattaaccaaaccaaaaaaaaatcaagttgatgcatttcttcaattttgttttgatgattttgttcctacagatgacaatgattatatatgaagtcctgaggctatatcctccagtaatccagatgaacagagcgactcacaaagagataaagctaggtgatatgacactaccaggcggtattcaagtccatatgcctgttctgctaatccaccgtgacactaagctttggggcgatgatgcagcggagttcaagcccgagaggttcaaagacgggatcgcaaaggcaacaaagaaccaggtctgcttcttgcctttcgggtggggaccgaggatttgcatcggtcagaacttcgctctgttggaagcaaagatggctctggctttgattcttcagagattctccttcgagctttcaccttcctatgttcattcaccttacagagtcttcactatacatccacagtgtggggctcatcttatcctgcacaagctttgaggcgcgcc

SEQ ID NO: 222 - DNA, 1580 bp, Arabidopsis thaliana
ttaattaaatggaatccatgacaatgataattctgcaaagcttaataatctttattaccatcctctttttcaaaaaacagaaaagagggaagaaaagcaacacacctcggtcaccaccgagacttccattgatcggaaaccttcatcaactcggccaccaccctcaccgatcactatgctctctcagccacagatacggccctctcatgctcctccatttaggccgtgtcccagttcttgtagtctcttccgccgacgtggctagagatattttgaagacgcatgatcgcgtttttgctagccgtccacggtcaaaactcttcgagaagctattttatgacgggcgtgatgtggccttcgctccttatggagagtattggaggcaaataaagagtgtgtgcgtcctccggctcctcagcaacaaaatggtcacgtcctttcgaaatgtgagacaagaagagatcagtctgatgatggagaagatccagaaatcaagttctttgcaagtgaatgtaagcgagctcttggggagtttaactaacgatgtgatatctagaattgctttgggacggaaatatagcggtgaaacagattctaaagagttaatgaaaaggctcatgatgctaatgggcgagtttagtgtggggacttatgtaccatggcttggatggattgattggatctctggtttggatggacagctaaataagacaggcaatgatcttgatgaattcttggagaaagttgttcaagatcatgtagatggtgacggacaaaggactgattttgtggatgtgttgctcagaattcagagagagaagagcatcggatttgaaatcgaccggttatgcataaaggctatcgtcttggtaaagggataagaagatctcatattcatattcattgatgttttagtgtataaccgtagttcttgtttttttggttttgatcgcttttcaggatgttttagttgctggtacggattcatcgtacgcacttatggattgggcaatgacagagcttctacgtcacccagagtgtctgcgcacactccaggaagaagttcgtacgatttgtaagggtaatttgagtgtatcagaagaagacattcaaaacatgagctacttaaaagctgtaatcaaagagacaacgaggctacatcctccacttccattgttggctcctcacgaatcaatacaagatgttatattaggagattaccacataccagccggtacacaggtaatgatcaatgcttgggcaatcgggagagaggctgcgacgtgggggccagacgcagagaagtttagaccggagagacatttagattcgtctgttgatttccgaggtcacaattttgagctggttccatttggagcagggagaaggatttgtccagcaatatcattcgcagtggtcttgattgaggtggctttggctaactttgtgcatcggtatgattggaaattaccggaggattctaaagaaaatcaaaccaatgtcgctgaatcaaccggtatggtgattcaccgtttattccctctttacgccattgcatcatctactacttgaggcgcgcc

SEQ ID NO: 223 - DNA, 1762 bp, Arabidopsis thaliana
ttaataaatggagttgatgaatttggcttcaaaagaaacaagctattggatgattgcactgcctgccggttttggatcccaaaacctacatgatgtttccaccctaggctatctattccttgccgtcgtttttctctctatagtcacgtgggctctcgccggaggcggtggtgtcgcttggaagaacggccgtaaccggttgggtcgtgtcgcgatccctggtcctcgtggcataccagtattcggcagtcttttcactctcagccgaggcttggctcatcggacgttagcagccatggcttggagccgagccaacactgagattatggcttttagccttggttcaacgccggttatcgtggcttctgaaccaaacatagctcgtgagattctgatgtcgcctcacttcgcggaccggccggttaagcagtctgctaagagcctcatgttcagccgagccataggtttcgccccaaacgggacttactggcgcatgttaagaaggatcgcatcgactcacctatttgctcctcggcgtatcttagcacacgaagctgggcgccagctagactgcgctgaaatggtgaaagctgtgtcagtggagcaaaacggcgctggatcagtcgttttaaggaaacacttacaactagccgccttgaacaacatcatgggaagtgtttttgggagaagatacgatcctctggctcagaaagaggatcttgatgagcttacatcaatggttagggaagggttcgagcttttgggtgcttttaattggtctgattatcttccatggctcggttatttctacgactcaattcgtttaaaccaacgttgctcagatctcgtccctcgaattagaaccctcgtcaagaaaatcatcgacgaacatcgagttagtaactctgagaagaaaagagacattggagattttgttgatgtcttattgtctttagacggtgatgagaaacttcaagaagatgacatgatcgccgttttatgggtaagaattcgtatgaaattgaaatagtactagctagtcacattaaatttaacggtatatttgtaacgatctagttgtaatgttttttcttttgcatttagtgttgctaatattttattttttaatgtcaatataggagatgatttttcgagggacagatacaacggcgttattaacggagtggaccatggccgagctagtactgaaccctaacgtgcaaaccaagttacgagacgagattttaactgctgtgggcgacggcgccgacggagacgtggcagatgctgacctggcaaaactcccgtacctaaacgcagtggtgaaggaaactctaaggctgcatcctcctggaccactgctttcatgggctcgtctttccacgtcagacgtccagctcagcaatggcatggtgattccaaagggaactacagcgatggtcaacatgtgggctataacccacgaccagactgtatggtccgacccgctaaagtttgacccggagagattcactgggaatgctgacatggatattcgtggtggggatctaaggcttgcaccgtttggagccggtaggagagtgtgtccggggaagaacatggggctagctactgtgactcggtgggtggctgagttggtacgacggttcgagtggggtcaggatcagaccgagccagttgatcttggtgaggtcttgaagctttcttgtgagatggagcatccgttacgtgccgttgtaacggaaatattttaaggcgcgcc

SEQ ID NO: 224 - DNA, 1662 bp, Arabidopsis thaliana
ttaattaaaccatattctcaatcacaacactcgccactgtttcgaatagatggcttctatttcaaccccttttccgatttctctccacccaaaaaccgtacgatcaaagccgttgaaattccgagttttgacccgtccgatcaaagcttccgggtcagaaactcctgatctaaccgtagcgacacgaaccggatccaaagatctcccgatccgaaacataccgggaaactacggtttaccaatcgtaggaccaatcaaagaccgttgggattacttttacgaccaaggagctgaagagttcttcaaatcacgaatccgtaaatacaactccacggtgtacagagtcaacatgccaccgggagcttttatcgccgagaatccacaagtcgtggctttactcgacggtaaaagcttcccggttttattcgatgtcgataaagtcgaaaagaaagatcttttcaccggtacttacatgccgtcaacggaactaaccggaggctaccgtatcctctcgtacctcgatccatcggagcctaaacacgaaaagctcaaaaatctccttttcttcctcctcaagtcatctcgaaaccggatcttccctgagtttcaagctacttactccgagcttttcgattctttggagaaagagctttcccttaaagggaaagcggatttcggcggttccagcgacggaaccgcctttaatttcttggctcgagctttctacgggacgaatcccgcagatacaaagctcaaagccgacgctccgggtttgatcactaaatgggttttattcaatctccatccattactctctattggtttaccgagagttatagaagaacctctcatccatacatttagtctaccaccggcgttagtcaaatctgattaccagagactctacgagtttttcttagaatccgccggtgagattctcgttgaagccgataaattgggtatctcacgagaagaagctactcacaatcttctcttcgccacgtgcttcaacacgtggggtgggatgaagattttgtttccgaatatggttaaacgtatcgggcgggcgggtcatcaagttcataaccgattagcggaggagattagatctgtgattaaatccaacggcggagaactcacgatgggagcgattgagaaaatggagttaaccaaatcagtggtttacgaatgtctccggtttgaaccaccggttacggctcaatacggtagagcgaagaaggatctggttatcgaaagccacgacgcggcgtttaaagtcaaagccggtgaaatgctttacggttatcaaccgttggcgacgagagatccgaagatttttgatcgggcggatgagtttgtgccggagagattcgtcggagaagaaggagagaagcttttgaggcatgtgttgtggtcgaatggaccggagacggagactccgacggtggggaataaacaatgcgccggtaaggattttgttgttttggtggcgaggttgtttgtgattgagattttccggcgatatgattcgtttgatattgaggttggtacgtcgccgttaggaagctccgttaatttctcgtcgttaaggaaagctagcttttaggagccaagggtaaatttgtaattgtatatgttcgcacctgtgtagtccggcgcgcc

SEQ ID NO: 225 - DNA, 1720 bp, Arabidopsis thaliana
ttaattaaacgttaatacggaaaaatggctacgatttggtttctttcacttctctttctctgttgtattctcctcgccgcctttaaacacaagaagcgtcggacaaatcagcagcaaccaccgtcccctcctggctttccgatcatcggaaacttgcatcagcttggagaattaccacatcaatctctatggagtctttccaaaacgtatggtccggtgatgcttttgaagcttggaagtgtcccaacggtcgtagtttcttcttctgagacggcaaaacaagttctgaaaatcaatgatctacattgttgtagccgtcctagcttagcaggtactataactctaacttaacacatacaattttctttctttctatttgttcctttgttcatagaactcaacaaaaaccatgattttgatcattcgttaggggcaaaagagctctcttacaattacttggacattgctttctctccttttgatgattattggaaagaattaaggaggatttgtgtccaagaactctttagtgctaagcgagttcactctattcaacccatcaaggaagaagaagtgaggaaactgatcgtttcagccacggaatcagcctctcagaaatcaccagttaacttgagcgagaagtttcttgatttaactgtaagcgtgatatgcaaggcagcattcagtctagacttccatacttcagttctcaataatgatggatttgacaagttaatccacgatgcgtttttgtttttggggagcttctcggcctcaaacttcttcccaaatggtggctggatcatcgactggctcacgggtctacaaaggcggagagaaaaaagcgtcaaggatcttgatgtgttctatcaacaaatgtttgatctgcataaacaagaaaacaaacaaggagtcgaagatttcgtggacttgctcttgaagttagagaaagaagaaactgttcttggatatggcaagctcacaagaaaccatgtcaaagccatcttaatggttagtactatacaaatatgtgcaacacattagataccttatgattctaaactttgttttctcatcttatcacagaacgttcttcttggggccatcaatacttctgcaatgacaatgacatgggccatggcagaactaataagaaacccgcgagtgatgaagaaagtacaatccgaaatcagaaaccaaatgataaacaaatcagtgatcaccttagatgatatagatcatctaccttacttgaagatggtgatcaaagaaacatggaggctacatcctccagtacctcttctacttccaagagaagttatgtctgaatttgagatcaatggctacaagatacaacccaagacattgctttacgtgaatgtttgggctatagggcgtgatcctgattcctggaaagatgcagatatgttttatccagaaaggtttatggataataacattgatgctaaaggacagaactttgagctgttaccgtttggaagtggccggagaatctgtcctggaatgtacatggggacaacaatggtggagtttggtctagcgaatatgttgtatcagtttgattgggaagtaccagatggtatggtggtcgaagatattgacatggaagaatctcctggactcgccgtgggcaaaaaaaatgagcttctacttgttcctgtcaagtatttaggtcattgatgatcacttaaggcgcgcc

SEQ ID NO: 226 - DNA, 2633 bp, Arabidopsis thaliana
ttaattaacttcaacttcaccaaaaagatgttcggagaacttagggatctgctcaccggcggcggaaatgagacgacgacgaagaaggtgaaaggaacggtggttctgatgaagaagaacgtcctcgatttcaacgatttcaatgcttcgtttctcgatcgtcttcatgaatttctcggaaacaaaatcactcttcgtcttgtaagctctgatgttactgattcagaaaacggttctaaaggcaaactagggaaggctgctcacttggaggattggatcacaacaatcacgtcgttaaccgcaggcgaatccgctttcaaggtcacgttcgattacgaaaccgatttcggttaccctggagcattcttgatcagaaacagccatttcagtgagtttcttctcaaaagtctcacacttgaagacgttccaggccatggcagagtccattacatctgtaattcttggatttaccctgctaaacactacactacagaccgagtcttcttctccaacaagacttatcttccacatgaaacaccagcgacgctgctcaagtatagagaagaagagctagtgagtttgagaggaaccggcgaaggagagcttaaggaatgggacagagtatatgactatgcttactacaatgatttaggcgtcccaccaaagaacccacggcctgtacttggagggacacaggagtatccttacccaagaagaggaagaaccgggcggaaaccaactaaagaagatcctcaaaccgagagcaggctaccgatcacatcgagcctagacatatatgttccacgagatgagagatttggacacttgaagatgtctgatttccttgcttatgctctaaaagcgattgctcagttcatccaacctgcacttgaggctgtattcgacgatactcctaaagagtttgattcttttgaagatgttcttaagatctatgaagaaggaatcgatctaccaaaccaagctttgattgatagtatcgttaagaatataccgcttgagatgttaaaggagatattcagaacagatggccagaaattccttaagtttccagtgcctcaggtcatcaaagaggacaaaactgcatggagaacagatgaggaatttgctagagaaatgttggctggactaaaccctgttgttattcaacttcttaaggagtttcctccaaagagtaagcttgacagtgaatcatacggtaaccagaacagtacaatcactaaaagccacatagaacacaatttggatggactcactgttgaagaggctctggagaaggagaggttgtttatattagaccaccatgacacactgatgccatacttgggacgcgtaaacaccaccacgaccaagacttatgcaagcaggacacttctgttcttgaaagatgatgggaccttgaagccgttggtgatagagctgagcttgcctcatcctaatggagacaaatttggagcagtgagtgaagtatatacgcctggtgaaggtgtctacgactcgctatggcagttggctaaggcttttgtcggtgtaaatgactccggaaatcatcagcttattagccactggatgcaaacacacgcatcgattgaaccgtttgtgattgccacaaacagacagctgagtgttcttcacccggtctttaagctccttgaacctcacttccgtgatacgatgaatatcaatgcacttgctaggcaaatcttgatcaatggtggtggtatatttgaaatcactgtgtttccttctaaatacgccatggagatgtcatctttcatttacaaaaaccactggaccttccctgaccaagcattaccagcagaacttaaaaagagagggatggccgttgaggatccagaagcaccacacggattacgtctgaggataaaagactatccttacgcagtggatgggcttgaggtttggtatgctattgaatcatgggtccgagactacattttcttgttctacaagatagaggaggatatccaaaccgacacagagctccaagcctggtggaaggaggtgcgcgaggaaggtcatggagacaaaaagtcagaaccatggtggcctaaaatgcaaacccgtgaagaacttgttgagtcttgcaccatcattatttgggtggcttctgctcttcatgcagctgttaacttcggacagtatccagttgctgggtacctcccaaacagaccgactataagccgtcagtacatgccaaaggaaaacactccagagtttgaagaacttgagaagaatcctgataaagtgtttttgaagaccatcacagctcagcttcagacacttctagggatatctctgattgagattctctctactcattctagcgacgaggtctatttgggacagagagattctaaagaatgggcggctgagaaagaagcgttggaggcgttcgagaagtttggagagaaagtaaaggagattgagaagaacattgatgagaggaacgacgacgagactctcaagaacaggactggtttggttaagatgccatacactttattgtttccgagcagtgaaggcggagtcaccggcaggggaattccaaatagcgtctctatctgaaacaactctcgcttcagaattgtgtc

SEQ ID NO: 227 - DNA, 1709 bp, Arabidopsis thaliana
ttaattaaatggacatcatctcaggacaacctatgtttctccttttctgctttatcttatcatgttttcttttcttcactgccgcaagatcccgacggagccctactcaagtactatccaagtcacctccgggtcctccacgattacccataatcggaaacattcatctagtcggaaagaacccacaccactcattcacggacctctcaaaaacatatggaccagtcatgagtcttaagcttggatatttaaactcagtggtcataacttcacgagatgctgcgagagaagtactaaaagcacacgatcaaatcttgtctggacggtacataactcaagcgaccaaatccaacaatcatcatgagttttccgttggctggatacatccgtcgtcacctcgtttcaggtaactgcttttgattattctttttctacaatttctcctttttagcgctttagttttttctattgatatatcatcgtttccacatatgtaatgtttttcagaaagttgaggaaatgacgtttactcagctgttctcaccgcagcgtatcgaggctactaaagctctgagaatgaagaaggtgcaagaacttgtcaactttttgagtgaaagcagtgagagaggagaagctgttgacatttctcgtgcatctttcgtcacagctctcaatatcatatcgaatattttgttttcagtcaatctcggtagctacgattcgaaaaattcaagtgcgtttcaggagatggtgattggttacatggaatctatcggaaatccagacgtttctaacttcttcccatttatgaggttacttgacttacaaggtaatagtaagaagatgaaagagtactcgggtaaattgcttcaggtatttagagagttttacgatgctaggattttggaaaactcatcgcgtatagatgagaaagatgtttcgagcagagacttcttggatgcactaatcgatctccaacaaggagatgaatctgaaatcaacattgacgagatcgaacacctacttctcgtaagtcttagcataatgcataacatgatcttatattagtacactgatatataaaatatgcttgtattgtttcaggatatgtttctagcaggcacagatacaaactctagtaccgtggaatgggcaatgacagagttacttggaaaccctaaaacgatgacaaaagttcaagacgagatcaatcgtgtgataaggcaaaacggcgacgttcaagagtctcatatctcaaaactgccgtatttacaagcggtcataaaagaaactttccgattacacccggctgctccatttctcctcccaagaaaagcggaaagggacgtagatattcttggattccatgtgcctaaagactctcatgttcttgtgaacgtgtgggccataggacgagacccaaatgtatgggaaaatccgactcagtttgagccagagaggtttttagggaaagatattgatgtaaaaggtacaaattatgagcttacaccatttggggccgggcgtagaatttgtccgggactgcctttagctttgaaaacagtgcatctcatgcttgcttctcttctctatacctttgagtggaagcttccaaacggtgtcggttcagaggatttagacatgggagagacctttggtctcacagtgcacaagacaaacccgttacttgcgtgcctctgaggcgcgcc

SEQ ID NO: 228 - DNA, 1849 bp, Arabidopsis thaliana
ttaattaatcctcaacatgacatcaagaacattcacaagacattccagtctcattcatgtttttctcctgctttctctcgttttctcaggttattttctttttcattctgaaattttaaaaccaaattcttaacacttaagttatgctttacgttgccgccttaaaacctcaacgtgtaagattttaacatagtgaaataacggatcgataataagtctagaattcattttttcaatgtttgtttaatggaatattaaagatttttggcattgttttctaaaagttcgattctttgtttggaaatatagggaatatactacaaacagtaacgtctcttggcatcaattacggacaagttgggaacaatttgccttcaccggataaagtcattaacctcttgagatctttaaggatcacaaaaacaagaatttacgacactaaccctcaaatccttagtgcctttgcaaattcaaacatcgagatcatcgtcaccatcgaaaatcaggttttaccattactacaagatcctcaacaagctacccaatgggtagattctcacattaaaccctatgttccggccactaggattaccggaattatggtcggaaacgagcttttcaccgacgacgactctagtttaatagggtaagtactaatcgttgaatattagtctaatttgttacatgatcacagaattagttttttttcattaactgatttcacattttcttgactaccacttggtcaaatgtaacgaactccttcgaaaaaaatattatatttattaaactccactttgaatttcaataagaaatgagtgtaatagtttttgtccaataattgctaattttgactatattctctcctctttttggtaatagatacatgatgccggcgataatcaacatccacaaagccttggtccaattaggtttagatagatacattcaagtctcgtctccaagctctcttgccgtcctcggtgaatcttatcctccatctgccggaagtttcaagccggaggtttcctccgtgatgcaacaacttctagatttcttggaagccacgaaatctcctttttggataaatgcttacccttactttgcctacaaagataacccacaagaaatcccagtcgattacgttctattcaaccgtaacatcggcatgaccgatcccaacacaagactacactacgacaacatgatgtatgctcaagttgacgcagttgctttcgcggctgcgaaactagggtaccgtaacatagaagttagggttgcggaaacagggtggccttcaaaaggagatgtcggagagattggagcgtctcctgtgaatgctgccacgtataaccggaatcttatgatgaggcaattcgccggagaaggaactccagcgagacggaatgcaagactcgatgtttatatatttgcgttgttcaatgaagatatgaaaccaggtcctacttcggagaaaaactacggtatattccaaccagatggatcattagcttacaatttgggattctctacaatgtcgacaacgacggcaaattcagaatctgtcacttattcatcctctgccactaaggtacgattagtattatgtggtgaattttgttagaatttggaattattggggccacgacgagaataagtttgtgaaaggactagatgtgcaaaatgaattaattctctgttttcttcttctttcaggcaaagaggagcttggagtattggacaattttgatattggcgatggttcaagttgtaatgttgagactattttagaggaaaagttattgacaatataataacgcgattgtttaggatatttatgtggcgcgcc

SEQ ID NO: 229 - DNA, 1822 bp, Arabidopsis thaliana
ttaattaaatggaactcttacttccacacccttcgaactcaacacctctcaccgtcctcggcttcttagaccgagccgcctctgtctacggcgactgtccgtccatcctccacaccactaacaccgtccacacttggtccgaaacccacaaccgctgtcttcgaatcgcctcggctctcacttcttcctctctcggcataaaccgaggccaagttgtctccgtcgtaggtcccaacgtcccgtccgtctacgagcttcagtttgctgtcccaatgtccggagccatcttaaacaacatcaaccctcgtttggacgcacatgcactctctgtcctcctgcgtcacagtgaatctaagctcgttttcgtcgatcccaattcaatctccgtagtcctcgaagcagtctcgttcatgaggcaaaacgagaaacctcaccttgtcctcctagacgacgaccaagaggacggttctttgtctccttcggccgcatcagattttcttgacacataccaaggagttatggagagaggagattcaagattcaagtggatccgtcctcaaaccgagtggcagcctatgattctcaactatacttctggaacaacgtcatctcccaaaggagtagtgttgagccacagagcaattttcatgctaaccgtaagctcattgcttgactggcattttccgaacaggccggtttacttgtggactctaccaatgttccacgccaatggttgggggtatacatggggcactgcggcggttggagccaccaacgtctgcacccgtagagtcgacgcgccgactatctatgacttgatcgataagcatcacgtaactcacatgtgtgccgcaccaatggttctcaacatgctaaccaactacccgtctcgtaaaccgctaaagaacccggttcaggtattattaaatacatccatgttcaataccggtttggtttattaaaaacttccatttgaaaatcatttggtgaacttttgaataaactctgttttgtgtttctgaaatcaggttatgaccgccggagctccacctccagcagccatcatctcaagagcagaaaccctaggtttcaacgtcggtcatgggtacggtttaacggaaaccggaggcccggttgtgtcatgtgcttggaaggctgagtgggatcatcttgatccattggaaagagcaagactgaaatcaagacaaggagtaagaaccatcggattcgcggaagttgatgttagggacccgagaaccgggaagagtgtggaacacgacggtgtttccgttggagagatcgttttaaaaggcggttcggttatgcttggttactacaaagaccctgaaggaaccgcagcgtgtatgagagaggacggatggttctacagcggagacgtaggagttatacatgaagacggttacttggaagttaaagaccggtcaaaggatgtgatcatatgcggaggagagaacataagtagtgccgaggttgagacggttctgtatacaaatccagtagttaaagaagccgcggtggtggctaaaccggataagatgtggggagagacaccgtgtgcttttgtgagcttgaagtatgatagtaatggtaatgggttggtgactgagagggaaataagggagttttgtaagacgaggttacctaagtatatggttccaaggaaagtaatttttcaggaggagcttccaaagacttctactggaaagatacagaagtttcttctaagacaaatggctaagtctctgccttaaagattcgcttgagttattgaggatatgaagaagaatctccaaggcgcgcc

SEQ ID NO: 230 - DNA, 1627 bp, Arabidopsis thaliana
ttaattaaatgaagcttcttgggttcgccttagctattctattagttgtggcgacttgcaaacctgaagaagagattacttgcgaagagaacgttccattcacatgtagccaaacagatcgtttcaacaaacaagatttcgaaagcgacttcatcttcggtgttgcatcttctgcttaccagatcgaaggcggcagaggtcgtggacttaacgtttgggatggcttcactcaccgatacccagagaaaggtggagccgatttgggcaatggagacactacttgtgactcataccggacttggcagaaagatctagacgtgatggaagagcttggagttaaaggctacagattctcctttgcgtggtcaagaatccttccaaaaggaaagaggagtaggggaatcaacgaagatggtattaactactacagcggtctcatagatggcctgatcgcaaggaacataacgcctttcgttacactctttcactgggaccttcctcaatcattgcaagatgaatatgaaggtttcttggacagaacgatcatagacgatttcaaagattacgcggatctatgtttcgagagatttggtgatagagtaaagcactggatcaccatcaaccagcttttcacagtgcctacgagaggctatgcattgggaacagatgcacccggtcgatgttcccaatgggtggataaaagatgttacggtggagattcttccaccgaaccctatatcgttgcgcataaccagcttcttgctcatgccacggtcgttgatctatacaggacgagatataagtaccaaggagggaagattggacctgtgatgataactagatggtttctaccatatgatgacactctagagagcaaacaagcaacttggagggccaaagaattcttcttgggatggttcatggagccgctaacaaagggtaaatacccatacatcatgaggaaacttgttggtaatcggcttccaaagttcaacagcacagaagctcgccttttaaagggttcatatgattttcttggtctcaactattacgtcactcaatacgcccacgcccttgacccaagtcctccggaaaaactcactgccatgacggactcactcgcaaaccttacatctcttgatgcaaatggtcaaccccctggtccaccgttctctaaaggcagttattaccacccaagagggatgttaaacgtaatggagcacttcaaaaccaaatacggtgaccctttaatctatgtcaccgagaacggattcagtacctccggtggccccatacccttcaccgaagcatttcacgattacaaccggattgattatctctgcagtcatctatgttttctccgcaaggccatcaaggagaagcgtgtcaacgtgaaaggatactttgtttggtctcttggggataattacgaattctgcaacggctacaccgtcagattcggacttagttacgttgatttcaataatgtcactgctgatagagacctcaaagcttctggcttatggtaccagtcgttcttgagagataccaccaagaaccaagatatcctccgctcaagtctgccctttaagaacggggataggaagagcctcacatgaggcgcgcc

SEQ ID NO: 231 - DNA, 1875 bp, Arabidopsis thaliana
ttaattaactctctcgcgctcccaatttctccgccggcgggaaaaccatgtcgcacttcggaaggtcaggtccaccggatatcagcgacacctactcacttctcgtccttaacatcaccttccgtaatctctcaagtccctatttctgtttctcaacctctaatcaattttcgtgaactgggggtttctaagagattaggttttgttgttatgtgtaggtacgactgctgatgatctctatcctctattcgcaaagtatggaaaggtcgttgatgtgtttattcccagagatcgaaggtccaatttcttcttcttctccgactgaggaattagggtttcttgatttctgtcattgagtcttgtgtcaatttataggactggtgattcgcgtggttttgcgtttgttcggtataagtataaagacgaagctcacaaagcagtggaaaggcttgatggtataattatccagatcttcttatctctcttgtgttcttggttttgttgtgtgcttttggtgcctggattcaacatgaagcttctttctctgtttcaggaagagttgttgatggcagagaaataactgttcagtttgcgaaatatgggccaaatgctgaaaaaatgtaagcttctttctttgccaatgattgttcaagtttactcttgatattcgggagctcactatgaatgtttcctctttagaccgtttccgttatttgtgcaattggaacttctatcacgtaaaaagctgcatctgtaattgtattttgattcgtttgttattatcatgattcatgacagttccaaaggaagagttgtggaaccaccgccgaagtcacgaagatctagaagccgtagtcctaggcggagtcgtagtcctaggaggagccgtagcccgcctagacgtcgtagtcccagaagaagccgcagtcctcgtaggaggtgagtttcttctttaatctgcattcttatgatgattaggtgaactagtgggagttaataatggttatgttattagtcaactagcttttgttacttgatttatgaaagaactccatctctgcctaagaacagtatttgtctgaataattctctcatccgagttacataacttgtaggtcccgagatgactatagggaaaaagactaccggaagcggagcaggagcagaagctatgacaggcgtgaaaggcatgaggagaaggatagagatcatcgtcgtcgcactaggtctcgtagtgccagcccagatgaaaaacgcagagtcagaggccgttatgataatgagagccgcagtcacagtcgttccttgaggtttcttccgttgtgaacctctttttttcatgttgttgctccacaatactgtgtatcctgatttcaactttttgacatgcagtgcatctcctgctcgccgcagccctagaagttcctccccacagaaaacctctcctgctagagaagtttctcctgataagcgtagcaatgagaggtctccatctcctcgtcgcagcctcagcccaagaagccctgctttgcaaaaggcctctccttctaaggagatgtctcctgaaaggcgtagcaatgagaggtccccatctcctggtagccctgctcctctgcgcaaagttgatgctgcttctcgaagtcaatctccttatgctgcggtgggttacaaaaacactgtgtttcagatgtgtatcactaatgaaacttgatgtctgaattgtccttgtttacattttgtttgcaggaatgactgcagccacttgtgaaagtgatacggtgtatgatgaaaaacacgtttgcttgtactgatgatgtttcatcaggcgcgcctctagtatacatttggaacagttgatgtttcatcaggcgcgcc

SEQ ID NO: 232 - DNA, 920 bp, Arabidopsis thaliana
ttaattaaatcacaatgacgacaaacgacgatgatcacgcggctgagagaaacacgatgtccatgaactatgaattggcggctacgttgagtgatgaagaacaacgcgcaagaaaaggaaaagccaagattgtctgtaaagaagaagaccacgtctttatcaaaaagaaagaaaaatacgaggaagagagcgagaagagggaattcttcagtcatgtccccagaaagataaggcctgcgcttagatacccacaacctaactttgaaaaccctaatggggcttcttcttctttaaacttacccttcgaagaagactactacatggctgagtactacaagaagacggagaccataaacccacctaacccttatcaccaatggtctccttcttcgttcttaacggagtacacacaccctaggatgcttgaggtgttacatcgctgtggattcaacagaccagtggtaacttgttattcaaggacggccagggagatgcggtggtggcttcgccaggtgatgaaagacatgagagcagaagacctaacacttatcttagagaagactctgtccacaactgatgtgatcacaacgacacatggccgtttctcaatgcatttcaacagattaatcagtaacgacttcttgaagcctgaggagcggagtatcctagaagaagatacctacaatgatgagacgatgggagttggagccattctcgtggatcaaaggtctcaaaagtggagtgtgattttgaagagatggggccagaattactttctgagttgtggctggaacgacgttgttaaggctaataaattgaaagctggcgacgacatctgtctttgggcgtttaggtgcgatggagtcctctgttttgccatgaggcagtatagctcctattttcgtcattgacggcgcgcc

SEQ ID NO: 233 - DNA, 523 bp, Arabidopsis thaliana
ttaattaatttagggtttaatttgtgttaatgagccaccgtgtttcgattctatcatctcatttctcacctgcctccgccgtcatggcttccgagaaagaagctgctctcgccgccactccttccgattctcccaccatatttgacaagatcatcagcaaagagattccatccaccgtggtttttgaggatgacaaggtcttagcttttagggacataacgccccagggtcctgttcacatcctccttattccaaaagtgagggatggcctaactggcctctctaaggctgaggaaaggcacatcgacatcttgggccgccttctctacactgccaagcttgtagcaaaacaagaaggcctagcagagggtttcagaattgttatcaatgatggtcctcaaggctgtcaatcggtgtatcacattcatgttcatctcattggaggacgccaaatgaactggcctcctggttaaagatcatcttgaagtggattgttgtcctgatgataagagggaggcgcgcc

SEQ ID NO: 234 - DNA, 2789 bp, Glycine max
ttaattaacgtgccacatctcaatttataaattagatgtggcacgttaattaacgtgccacatctcaatttataaattacaaatatgcttacatggtggggaaaatcatcatcaaaagaaaccaagaagaaagcaaataaggaaagtttctttgacacactgcaccgaaaacttagaatttcatccaaaggtaaagtaagcattagatctggaggatcacgtagacattgtaatgacacaatttcagagaagggagatcattctccatgtggatcaagatcgccttcaccttccaaagtggcaaggtgtcaaagttttattgataggcctcatgctcagccacttccacttcctggtctgcatccttcaagtgtaggccgagtagattctgaaattagcatatcatcaaaatcaagattggaaaaagtctccaagccattatcgtttcttacgcttccaacacctggatgcatacgttgtaggccaaaccctgcagatttggatggagatatggtcactgcttcagtctttagtgattgctctgctgacagtgatgagccggcagactcacacaatcgtagtcctctagcaattgactgtgagactgggactagaactgctgctggcagtccttccagcttaatgctcaaggatcaaccacctgctgtttcccaactgaattcaacgggagtaaagaaaccaggaaatattctaagtaatcatatgtcttctacttcaccaaaacgtaggcctttacgcaaccatgttccaaatcttcaggttcctcctcatggtgccttctatagtgctcctgatagttccttgtcaagtccatcaagaagtccattgagggcatttggcacagatcaggtgttgaattctgcttttttggctggaaagccatatccagagatcaattttgttgggtctgggcattgctctagtccaggttcaggccacaattctgggcacaattcaatgggaggggacatgtcaggaccgttactttggcaaccaagcaggggtagccctgagtattctccagtacctagtcccagaatgactagccctggtccaagctctagaattcagagtggagcagtcacacctattcatcccaaagccgggggaacacccacagaatcacagactcatcgattgcctcttcctcctttgtcagtttctaattcctcactgttctctcattcaaattctgcagcaacatctccgtctatgccaagaagtccagctagagcagataatccaaactctggctcacgttggaagaaagggaagctgcttggcagcggctcatttggacatgtctatcttggcttcaatagtgaaagaggcgaaatgtgtgcagtgaaggaggttaccctgttttcagatgatcccaagtctatggaaagtgcgaagcaatttatgcaggaaattcatttattaagccgcttacagcatccaaatattgtccagtattatggttctgaaacagtcgataacaagctttacatataccttgagtatgtatctggaggctccatacataaacttcttcgagaatatgggcaatttggtgaactagttattcgtagttatactcaacaaattttgtcagggcttgcttatttgcatgctaaaaatactctccatagggatatcaaaggagcaaatatactggtagatccaactggtcgggtcaagttggcagactttggcatggcaaaacatataacagggcaatcgtgcccattgtcattcaagggaacaccttactggatggctcctgaggttataaaaaattctaatggatgcaaccttgcggtggatatatggagtcttggatgcacagttttggaaatggctacaaccaaacctccttggtttcagtatgaaggggttgctgccatgttcaagattggtaatagcaaggaactcccaaccatccctgatcatctctcaaatgaaggaaaagattttgttaggaaatgtcttcagcgtaacccacatgatcgtccttcagccagtgaattgttggaccacccctttgtaaaaaatgctgcacctttggaaagacctattccggctcctgaagctttggaccctgtttctgggattacacagggagcaaaagctctggctattggacaaggaaggaatctttctagcttggattcagatagactttctgttcattcttctagatttttgaaaactaatcctcatgaaagtgaaatccatattccaaggaatatatcttgccctgtttctcccattggaagcccacttttgaggtcaagatcaccacagcacaggaatgggaaaatgtctccttctcctatatctagccctcggactgcttctggggcatctacacctcttgctggtggcagtggtgccattccatttggtaatcactctaaacagtccatttactttcaagagggttttggaagcattcccaagtcctcaaatggtgtctacatgaatggccattctcatcacgactcgaatgttgacatttttcgaggaatgcaaatggggtctcacatttcaccagaactggtttccagtgaaaatgatgttttggttaagcagtttgcaaggcatcctcatgcagagccatatgattttcagtcggtcttggcagatcgtgttggccggcagctgctgggggaacatgttaagattaacccatccattgatctcagtcccaactcgtctttgcttagccggccaaacggtttatgacatcaagatttttcctaaagtttctcataaatttaaat

SEQ ID NO: 235 - DNA, 1505 bp, Glycine max
ttaattaagcaactatgaatatgatgcggaggttgaagagcattgcttctgggaggacttccatttcttcagatcctggaggggattctaactcaaaaagggccaagtttgaaccagaaactgaagggaaggccgatgagaaaacaaataccattgaaacaatctgcacagatcaggaacaacctatagacacatcaaaagaaacttccaatgtaggcacatccgatgtatctacagtagctagaactgagaagtcaggtttcgatgagcttcctaaagaattaaatgaaatgaaaattagagatgagaaaagcaaaaacaacaatgaaaaggatatagaagctactgtagtgagtggtaatggaacagaaacaggacaaataattacaactgccattggtggtcgagatggacaaccaaagcagacaatctcttacatggctgaacgtgtggttgggactggttcttttggtgttgtttttcaggctaagtgccttgaaactggtgaatctgttgccataaagaaggtgttgcaagacaggagatataagaatagggaactccaggttatgcgcacagttgaccatcctaatgttgtcaaactaaagcactacttcttttcaactaccgataaagatgaattgtaccttaacctggttttggagtatgtacctgaaactgtctacaaagtttcaaaacactatgttaggatgcaccaacacatgcctatcatttatgtgcaactttatacctaccagatatgtcgtgcgttaaattatttacatcaagtgattggtgtttgtcatcgtgacatcaaaccccagaacctattggtaaatccgcagacacatcagttaaagatatgtgattttgggagcgcaaaggtgttggttcctggtgaacccaacatatcgtacatttgctctcgatattatagagctccagaacttatatttggggctactgaatacacaattgctattgatatgtggtctgttggttgtgttttagctgaactactcctaggacagccattgtttcctggagagagtggggttgatcagttagttgagatcattaaggtcttgggaacacccaccagagaagaaataaggtgcatgaatccaaactacaatgaatttaagtttcctcagattaaagctcacccatggcacaaggtttttcacaagagaatgccgcctgaagccgtggatcttgtgtcaaggctgctgcaatattcaccaaatctacgttgcaccgctttggctgcatgtgcgcatcccttcttcaatgatctgcgggacccaaatgcatgcttgcctaatgggcgacctctacctcctttgttcaacttcacatctcaagaactggctaatgcacctgaagagttgcgccaacgcctcattcctgagcatgcaaggagttgaatcaatttgaaagttgaaacatctctagggcattgtaaatgggttttgaatgaatagacaccctctccggatttaaat

SEQ ID NO: 236 - DNA, 1454 bp, Glycine max
ttaattaaccatttgccatttggtggtaataatcgatcgatggagttcactgaatcttacaagcaaacgggtccctgttgtttctctcccgacgctcgcttcattgccgttgctgttgattatcgtctcgtcattcgggagaccgtttctttcaaggttgtgcagttgttttcatgcttagacaagattagctatattgaatgggcccttgattctgaatatattctttgtggtctctacaaaaagccaatgatacaggcttggtcactgacccagccagaatggacatgcaagatagatgaaggacctgctggtattgcatatgcgaggtggagcccagatagccgccacatactcaccacatcagatttccagttgcgtttaattgtttggtcattgttaaatacagcttgtgtgcatttacagtggccaaagcatgcttccaaaggagtttctttcactcgagatggaaaatttgcagcaatatgctcaaggcgtgattgcaaggactatataaatctgttatcttgtcacacatgggaaatcatgggcaattttgcagtcgacactctagacttggctgatatcgaatggtcacctgatgatagtgctatagtgatatgggattcaccacttgattacaaggttctaatatattctccagacggaaggtgccttttcaagtatcaagcatatgaaagtggattagggattaaaagtgtgtcctggtctccttgtggtcagtttctggctgtgggcagctatgaccagatgctgcgggttctgaatcacctaacttggaagacatttgcagagttaatgcacccatctacagtccgtggtccttgttatgctgctgttttcaaagaagtagatgagccactacaacttgatatgtctgaactatgtttgagtgatgatttttcccaagggcatgatgattctcctgaagaaccctttagagtcaggtatgaggttatggaagttcctatcaatttaccattccaaaagcctcctgccgagaaacctaaccccaaacaaggaattggtattttgtcatggagcactgatagccaatacatatgtactcgtaatgatagtatgcctacagtactttggatatgggatattcgtcatcttgagcttgctgcaatattagtgcataaggatcctatcagagtggcagcttgggacccaacatgcacacgccttgttctttgcaccggaagcactcacttgtatatgtggaccccatctggcgcctattgtgttcatgttcctctatcgcaatttactataacagacctgaaatggaattctgatggcagttgtctacttcttaaggacaaggagtcattctgctgtgcagctgtacccttgttgccagaatctagtgagtacagctcagatgattgatgatcacgagggaatgaaacaaaatgatggatttaaat

SEQ ID NO: 237 - DNA, 669 bp, Arabidopsis thaliana
atggcttcgattttggctcgcaggtcactgaatactctccgtgctcgacatctcgttttgtcagggcaagctttacagggatctcatctgtctagactgcagtcccgtggtatatcttatggcagcaacaaagatgatgaagaagcagagcaactttctaaggaaatctccaaggactggaatactgtctttgaacggagcataaacaccctgttcctcacagaaatggtccgcggtttgtcgctgaccctcaagtacttctttgatccaaaagttactatcaattatccatttgagaagggtcctctgagccctcgcttccgtggtgaacatgctcttcgaagatatcctaccggggaagaacgctgcattgcctgcaaactctgtgaagctgtatgtccagctcaagcaatcacaatagaggcagaagagagggaagatggaagccgcagaaccactaggtacgatatcgacatgacaaaatgcatctactgtggtttctgccaagaagcttgtcccgttgatgcaatcgttgaaggacctaactttgaattcgcaaccgagacacacgaggaacttctctatgacaaagagaagcttcttgagaatggagatcgatgggagacagagattgctgagaatctgaggtcggagagtctctaccgctga

SEQ ID NO: 238 - DNA, 961 bp, Arabidopsis thaliana
ttatttgtcagctttcaaactctttgtttcttgtttgttgattaacccttaattaaccccaataacagaaaatagaaagaagtaacaaaaccaaagcaaaaaatggtgaagatcgaagttggaagtgtgggagactcattcagtgtatcatctcttaaagcttacttgtctgagttcatcgcaactcttctcttcgtattcgcaggcgttggctctgctgttgcgtttgccaaactaacctctgatggagccttggacccagctggtcttgtagcaattgcaattgctcacgcgtttgctcttttcgttggagtttccattgcggctaacatttctggtggtcaccttaacccagccgtgactcttggccttgccatcggcggaaacataacactcatcacaggtttcttctattggattgctcagtgtcttggctccatcgtcgcttgtcttctcctcgtctttgttactaatggcaagagcgtaccgacccacggggtctcagccggtctaggagcggtcgaaggtgtcgtcatggagatcgttgtgacctttgcattggtctacaccgtttacgccacagcagctgatccaaagaaaggatcgctagggaccatcgctccaatcgccatcggcttcatagttggtgccaacatcctcgctgctggtccattcagtggtggctccatgaatccagcaaggtcgttcggaccagctgttgtcagtggtgacttgtcccaaatctggatctattgggtgggaccacttgtgggtggtgcactcgcgggacttatctacggtgatgtgttcatcggttcttatgaagcggtagaaacccgtgagatccgagtgtaattgactgggttttgtgattgcttgatggttggttgatttaaatacccagctttctaaattggagctctgcagagctttcgttcgtatcatcggtttcgacaacgtt

SEQ ID NO: 239 - DNA, 1952 bp, Arabidopsis thaliana
tcgagagcgaaggaagagagagagagagggagagatcaaaaaaatttgtgaaaaaagagatttattttagggttttgttgattttctttgttcattttgccgtcgtctctttctctttctcttgtgaagaaaaagaagaaaaatgaaacttctgggtttggtcttcttgctgtttaatctgtttatgttttcgttttctcggaaacttttaaccgagagtggtggtggtctccacgacgaagctgctctgttgaagttgaagagtagtttcttggatccaaatggagttctgtctagctgggtttccgacagctcatcaaaccattgttcttggtacggtgtctcttgcaactctgattcgagagtcgtttctttaattctcagaggctgtgatgagcttgaaggtagtggtgttcttcatctcccagatttgtcttcttgttcttcaagtaaaagaagacttggtggtgtaatctctcctgttgttggagatttgtctgaaattagggttttatctctgtcttttaatgatcttagaggtgagattccaaaggagatttgggggttggagaaattagagattcttgatcttaaaggtaacaactttatcggtggaattagggttgttgataatgttgttcttaggaaacttatgagttttgaggatgaagatgaaattggtccaagctcagctgatgatgattctcctggtaaatctggattgtatccgattgagatagcttctattgtgtcagcttcagtgattgtctttgtgcttcttgttcttgtgatcttgttcatctacacgaggaaatggaaacgaaactctcaggttcaggtagatgagatcaaggagattaaagtgtttgttgacattggtattcctctgacgtatgagatcattgttagagctactggttactttagtaactctaactgtatcggtcacggcggtttcggttcgacttataaagcagaggtgtctccaacgaatgtgtttgctgttaaaagactctctgttgggaggtttcaaggtgatcaacagtttcatgctgagatctctgctcttgagatggttaggcatccgaatcttgttatgttaatcggttaccatgcgagcgaaaccgagatgtttcttatttacaactacttatctggaggaaaccttcaagatttcattaaagagagatcgaaagctgctattgagtggaaggtacttcacaagattgctcttgatgtagcgcgtgctctctcctatcttcacgaacagtgttctcctaaagtcttgcatagagatatcaaaccgagtaacatactcttggacaacaactacaacgcttatctatctgatttcggactctcgaaactcttgggaacttcgcagtctcatgtcacaactggtgtggctggaacattcggatatgtagctccagagtacgcaatgacatgccgagtctcggagaaagcagatgtttacagctatgggatagtcctcttggagctgatatcggacaaacgagctctggatccttctttctcatcgcatgagaacgggttcaacattgtctcgtgggctcatatgatgttgagtcaaggcaaagcgaaagaagtcttcaccacaggactatgggagactggtcctccagacgatttggtcgaggttctacatttggcactcaaatgcaccgtcgatagcctctcgataaggccgacaatgaaacaagctgtaagactgctgaaacgaatccagccttctagattgtgatacaaagctagaagaaaggtgtttttagaggatttgtacagcagcaaacaagtgcctagccattagaatctttctcaagtctgttttttatattttcagtgctagggaggtttttcatatgcatcatcaaaatgttattctcagtctactctcttgaaaactgatataaatgatgctctgcggccgc

SEQ ID NO: 240 - DNA, 1311 bp, Arabidopsis thaliana
tgattaacccttaattaagccacaatggtttcctatcgtgctaccacagagacgatttccctggctttagaagccaacagctcggaggctattacgatactgtaccaggttttggaagacccttcttcatctcctgaggctatacggatcaaggagcaagcgattacaaacctttgtgatcgattgactgaagagaagagaggtgaggatctccggaaactgttgaccaagttgaggcctttcttttccttaatccccaaggcgaaaactgcgaaaatcgtcagaggaatcattgatgctgtggcaaagattcctggaacaactgatctccagatcactctctgcaaagagatggtcgaatggacccgcgctgagaagcgtactttcctcaggcagcgagtagaggctaggcttgcagctcttttgatggagaacaaggagtatgttgaagctttggcgttgttgagtactttggtaaaagaggttaggagattagatgataagctccttctggtcgacatagacttgctggagagcaaacttcacttctcattgagaaacttacccaaggcaaaagctgcactcactgcagctaggacagctgctaacgctatatatgtcccaccagctcaacaaggcacgatagatctgcagagtgggattcttcatgctgaagagaaagactacaaaaccggatacagttacttctttgaagcctttgagtccttcaacgctctcggagatccgagagcggttttcagtttgaagtacatgttactgtgcaagatcatggttagccaagctgatgatgttgcaggaataatctcctcaaaggctggactacagtacgttggccctgacctggatgccatgaaagcagtcgctgatgctcactcgaagaggtccttgaagttgtttgagaacgcactccgtgactacaaagcacagcttgaagatgacccaattgtccacaggcatctctcttctctctatgacacgcttctggagcaaaatctgtgtcgtttgatcgagcccttctcaagagttgagatagctcacattgctgagctcattggattgccgctcgaccatgtggaaaagaagctatctcagatgatactcgacaagaaatttgcaggtaccttggatcaaggagctggatgcctcatcatcttcgaagacccaaaggcagatgctatctactcggctaccctcgaaaccattgcaaacatggggaaggtcgtcgacagcctttatgtccggtctgccaaaatcatgtcctgagagtttaaatacccagcaaattggagc

SEQ ID NO: 241 - DNA, 1362 bp, Arabidopsis thaliana
ttcatttatttgtcagctttcaaactctttgtttcttgtttgttgattaacccttaattaactcgagatcatagtcttcatcaattagccataaaaaagcacaatgctttcttcaatcaaaccatcttcgtcttccttctccaccgctatctccggcagcgtaaggcggtcaattcctacaaagctcaagttttctcctttactcatcatcaaaaactgccataaccaaagctttaacgctaatgttgtctcccatcaaaagcctctacacatttcatctgcttcgaatttcaagcgtgaggtcaaagtcgaagcttacgaggccgatcgttcccgtccactggacatcaacatcgagcttcccgatgaacaatccgcgcagaaactgaaaatcggaatctacttcgcaacttggtgggcacttaacgttgtcttcaacatctacaacaagaaagtcctcaatgcttttccttacccgtggcttacttcgacgttgtctctcgcttgtggttctttgatgatgcttgtctcttgggctactagaatcgcagatgctcctaaaactgatctcgagttctggaaaactctgttcccggtcgctgtagcacacacgataggacacgttgcagcaacagtgagtatgtcgaaagtagcagtttccttcacacacatcattaaaagtggtgaaccagctttcagtgtcttagtctcaagattcttcatgggagagactttccctcttcctgtctatctctctctcttaccaatcatcggaggctgcgctctcgcggccatcaccgagcttaacttcaacatcactgggtttatgggggcaatgatatcgaatttggcatttgtgttccggaatatcttttcgaagaaagggatgaaagggaagtcagtgagcggaatgaactactacgcttgcttatcgatgatgtctcttgtgatcctcactccattttctattgccgtggaaggtcctcaaatgtgggctgctggttggcaaaatgcggtttctcaagtcggaccaaactttgtctggtgggtagtggcacaaagtgtgttttaccatttgtacaatcaggtctcatacatgtcattagaccagatttcgccgttaactttcagtatcggtaatacgatgaagcggatttccgttattgttgcatcgatcatcattttccataccccgattcaaccggttaatgccctcggtgctgccattgcgatttttggaactttcctctactcacaggcgaagcagtgaggatggtttaggaggcagttttttgggtttgttttgcaaaatttaaatacccagcaaattggagctctgcagagctttcgttcgtatcatcg

SEQ ID NO: 242 - DNA, 1181 bp, Arabidopsis thaliana
atttgtcagctttcaaactctttgtttcttgtttgttgattaacccttaattaaatgtcgtcccatgctcgaggtaaggagctaattcctctcctgtctttctcccaccaaaaaaaacaaccaaatctctcgatctcatcgacgacgaagatgaacaagaagaacccagatcagaaatccgacatgtcgtcttcttcatcttctccgaagaaacaaaccctcttcatatcatccttaatcattctctggtacacctccaacatcggtgttcttctcctcaacaagttcctcctctccaattacggattcaaattccctattttcctcacaatgtgtcacatgtccgcttgcgctatcctcagctacgtctccatcgtcttcctcaagctcgtccctctccaatacctcaaatctcgttctcagtttctcaaggttgcgactctcagcattgtcttttgtgcctctgtcgtcggtggaaacatctcccttcgttatctccctgtctcctttaatcaagccgttggtgctacgacgccgtttttcactgcactcttcgcttatatcatgacctttaagagagaagcttgggtcacttatggcgctctcgtccccgttgttaccggtgtcgttatcgccagtgggggtgaaccaggttttcactggtttggattcattatgtgcattagtgctactgcagcaagagcttttaaatctgttcttcaaggcatcttactttcttccgagggagaaaggttgaattcgatgaatttgatgctgtacatgtctccaatagccgtcattgctcttctgcctgtcacaatttttatggagccggacgtgatgagtgtgacactaacactcggaagacaacataagtacatgtatatacttctgctggttaactctgtaatggcttattcagccaacttgttaaactttctggttaccaagcacacaagcgcacttaccctgcaggtccttggaaatgctaaaggagcggttgcagttgtgatatcgatcctgcttttccgaaacccggtaacggtgatgggaattggcgggtacagtataaccgttctcggggtggttgcttatggagagactaaacgcaggtttagatgaatttaaatacccagcaaattggagctctgcagagctttcgttcgtatcatcggtttcga

SEQ ID NO: 243 - DNA, 3934 bp, Arabidopsis thaliana
ttaattaagctccagttacagagccgacacaggcaaaacttagaagaagaagaagaagaagaagcaaaaatgagaaaccattgcttagaactctcttccaattgttcctccattttcgcttcttccaaatccaatcctcgtttctctccttccaagctctcctattccactttcttctctcgctctgccatctattacagatcaaaaccaaaacaagcctcgtcttcttcttccttctccactttccccccatgtctcaatcggaaaagctccctcacgcatgttctcaaacccgtctcagagctcgccgacaccactaccaagcctttttctccggagatcgtcggcaagagaaccgatctgaagaagattatgattctcggcgctggtccgattgtcattggacaagcttgtgagtttgattactctggtactcaagcttgtaaagccttaagagaagagggctatgaggttatcctgatcaattcgaatcctgccactatcatgactgatccggaaactgctaatcggacttatatcgctccgatgactcctgagcttgtcgagcaggttattgagaaagagaggcctgacgctttgttaccaaccatgggtggtcaaaccgcattgaacctcgcggttgctcttgctgagagtggtgctttggagaaatacggtgttgaattgataggagctaagcttggtgcgattaagaaagctgaagatcgtgagttgttcaaggatgcgatgaagaacattgggctaaagactccaccttcagggattgggaccactcttgatgagtgttttgacattgctgagaaaattggtgagttccctttgattatccgtcctgcgtttactttaggtggtactggtggtggaattgcgtataacaaagaggagtttgagtctatatgtaaatcgggtttggctgcgagtgcgacaagtcaagttcttgtggagaaatccttgttgggttggaaagaatatgagcttgaggtgatgagagacttagctgacaatgttgtcattatctgttccattgagaatattgatcctatgggtgtgcacactggtgattccatcactgtggcacctgcacagactctaacggatagagagtaccagcggcttagggattattccattgcgattatacgggagattggtgttgagtgtggtggatctaatgtgcagtttgctgtcaacccggttgatggtgaagttatgatcatagagatgaaccctagggtctcaagatcttctgctcttgcttccaaggctacagggtttcccattgctaaaatggctgccaagttgtctgttggctataccttggatcagattcctaatgatatcacgaggaaaacaccggctagcttcgagccctccatcgattatgtggtgactaaggtttgtcattccatacttttggctttatttgtgttgcgaaatgagatacgcttgactttgaagatttacacacatctatccacttcatgatatataaactcaaatgcatattttgcttaacgatatctatttctttaccatgcagattcctcgatttgcatttgaaaagtttccaggatctcagccattgctaacgacccagatgaaatctgttggggaatctatggctctcggccgtacattccaagaatctttccagaaagctctgaggtctctggagtgtggattctcgggttggggttgtgcaaaaattaaagagctagattgggactgggatcagctgaaatacagcctaagagtcccaaatcctgacaggatccatgcgatatatgctgccatgaaaaagggtatgaaaattgatgaaatctacgagttgagcatggtggacaagtggttcctaacccagcttaaagagctcgtggacgtcgaacagtatcttatgtccggaaccttgtcagagattacaaaagaagacctttacgaagtcaaaaagcggggatttagtgacaagcaaatcgcttttgctacaaagacaaccgaggaagaagtccgtaccaagcggatttctctaggagttgttccatcttacaagagagtggatacatgtgctgcagagttcgaagcgcatacaccatacatgtactcttcatatgatgttgaatgtgaatcagctccaaacaacaagaagaaggttttgattttgggtggagggccaaaccgcattggtcaagggattgaatttgattactgttgttgccacacatctttcgccttacaggtatgtctttagacaatctaagcgtctctcccaaaagccagtaaacattgtttcaacttttttatgctaaacttacttatctactttttttaatttatttgcaggatgctggatatgagaccataatgttgaactcaaatcctgaaacagtatccacagattatgatacaagcgataggctctattttgaacctctcacaatcgaggatgttctcaatgttatcgaccttgagaaacctgatggcataatagtgcaatttggtggtcaaactcctctgaaacttgctctgccgatcaaacattatttggataagcacatgcccatgagcttgagcggagcgggacctgttcgcatctggggtacatcacctgactccattgacgctgctgaagacagagagaggttcaatgcaattctcgacgagctgaagattgagcagcccaagggaggcattgcaaagagcgaagctgatgcattagccatagcaaaggaggtagggtacccagttgtggtaagaccttcttatgttctaggtggacgagcaatggagatcgtttatgatgacagtagactaataacctatttggaaaatgcggtacaagttgacccagagagacctgttttggtagataaatatctttctgatgccattgagatcgacgttgatacccttactgattcctatggaaatgtggtgattggtggaataatggagcatatcgaacaagctggtgtgcattctggtgactcagcttgtatgcttccaacacaaaccatcccagcttcttgtttgcaaactattcgaacatggaccactaagctggcgaagaagctaaatgtatgtgggctgatgaactgtcagtacgcaatcacaacatctggggatgtttttttgctggaagccaatccccgagcttcccgtactgtcccttttgtgtcaaaagccattggacaccctcttgccaagtatgcagcgctggtcatgtcgggcaaatctctcaaagatcttaactttgaaaaagaagttatccctaaacatgtctctgtgaaagaagctgttttcccgtttgagaagttccaaggatgcgatgtgatactcgggccagagatgagaagcacaggagaagtgatgagcatcagttctgaattctcaagtgcgtttgcaatggctcagatcgctgcaggtcaaaagctacctctatcaggcacagtcttcctcagcttaaacgatatgaccaaaccgcacctggagaaaatcgcggtgtccttcctcgagcttgggttcaaaatagttgccacctcgggaacagctcatttcctggaactgaaaggcattccagtggagagagtgttgaagttgcatgaaggaagaccacatgctgctgatatggtggcgaatggtcagatccatttgatgttgatcacaagctcgggtgatgctcttgatcagaaagatgggagacagctcagacaaatggctctagcatacaaggtacctgttataaccactgttgctggtgcattggccactgctgagggaatcaagagcttgaagtcaagtgccattaaaatgaccgctcttcaggacttctttgaggtaaagaatgtatcttctttgctcgtctgagttagtttttttgttgtgtgttgatcgtttgtgtggaactttttatttaaat

SEQ ID NO: 244 - DNA, 1395 bp, Arabidopsis thaliana
agccacatgccgacacttacataactgttgaccaagtctctcttccttctttatcaaatcatgcaaccttcaagaacaagagtttcattttttgaaacaggagagaccatgaagcaaagaaagaagagttatctctcaatcttcgtgatcttcttctctcttttcttcttcgggatcttcatgtacaatgacaacctcaaatcctccattgctgacttcacatcttcgaacccattctctagttcatttgtggagttgccgccggatgagtgtgatctgttcaccggtcaatgggttttcgacaacaagacatatccattgtataaagaagaagagtgtgagttcttgacggagcaagtgacttgtttaagaaacggaaggaaagattctttgtttcagaattggagatggcaacctagagactgttctttaccaaaattcaatgcaagagtgttgttagagaagctgaggaacaagagattgatgtttgtcggtgactcgttaaaccggaaccaatgggaatcaatggtttgtttggttcaatcagtgattcctcccggtagaaaaagcttaaaccagaccggttcactcactgttttcaaaatccaggactataacgcgacggtggagttttattgggcgccatttttggtggaatcaaattcagacgatccggaaaagcacagtataatcgaccgtataataatgccagagtccatcgagaagcatggagtcaactggataggcgttgactttcttgtcttcaatagttacatctggtggatgaatactgtctccatcaaagtcctacgtggatcgttcgatgatggggacacagagtatgatgagatcaaacggccaatagcgtacgagagggtgttgaggacattgggagattgggtggaccataacattgatcctctaagtacaactgttttcttcatgagcatgtctcctcttcacatcaagagctcagattgggctaatcctgagggtataaggtgtgctttagagacaacaccgatcttgaacatgtctttcaacgtggcttacgggcagttttccgcggtggggacggattacaggctgtttccggtggcggaaaacgttacacagtctctaaaagttcctattcatttcctcaacattactgcattgtctgagtatcgtaaagatgcacatacttcggtttacacgatcaagcaaggcaagttgctgacgcgggagcagcaaaacgatccagccaattttgctgattgcatacactggtgcttaccaggccttcctgatacatggaatgagtttctctatacacatattatttctcgaagatgagattctttcatcctcttttttggtttaaaaaaattcttgtgatgtatataggacagagat

SEQ ID NO: 245 - DNA, 1881 bp, Arabidopsis thaliana
ttaattaacaaagggtcgttgttgtttgtcgcctctcaatggcagcttcttcaactaatgctcgtctcaccaaccctcctcgtctactctccaaaccccgactttcacctacctccgtcgccaatctccgttttccagccgccgatttctccactcgcttctttgccgattcttcgtccccgcggctaaggagtgtaccgtttccggtggtattttccgatcaaaggcgccggcgaagcatggaacctagcaatgtctatgtggcttcaaattccacggaaatggagatcggaagtcatgatatcgtgaagaatccgagcttgatctgtgctccagtgatggcggattcaatagacaagatggtgattgaaacgagtaaagcccatgaattgggtgcagacttggttgaaattcgattagattggctaaaggacttcaatcctcttgaggatctaaaaaccattattaagaaatctcctctacccactttattcacctacagaccaaaatgggaaggtggtcagtatgaaggtgatgaaaatgagagacgggatgtgcttcgtctggccatggagttgggagctgattatattgatgttgaacttcaggtggcaagtgagttcatcaaatctattgacggaaagaagcctggaaagttcaaagtaattgtttcatcgcacaactatcagaataccccttctgttgaggaccttgatggccttgttgcaagaatacaacagactggagccgacattgttaagattgctactactgctgtggacattgcagatgttgctcgcatgttccatataacctcaaaagctcaagttcccacaattggacttgttatgggtgaaagaggtttgatgtctcggattctttgttcgaaatttggtggttatttgacctttggcaccttagattctagtaaagtttctgcgccaggtcaaccaacgatcaaggatctgttggatctttacaactttagaagaattggtcctgacacaaaggtatatggaattattggcaagcctgtcagccacagcaaatcacctattgttcacaatcaagctttcaaatcagttgattttaatggagtatatgtccacctgttagttgataatcttgtaagctttcttcaagcatactcatcctctgatttcgctggattcagctgtacaattccgcacaaagaagctgcattgcaatgttgtgatgaagttgatccattggcaaagtctataggagctgtgaacactatactaaggagaaaaagtgacggaaagttgttgggttacaacacagattgtattggttccatttctgctattgaggatggcctacgaagttcaggtgatccaagcagtgtaccttcttcttcttcgccattggccagtaaaacagtggtggttattggtgctggtggagcaggcaaggctcttgcttatggtgcaaaagaaaagggggccaaagttgtaattgctaatcgaacttacgaacgagcactagaactcgcagaagcaataggaggcaaagcgttatctctgacagatttagataactatcacccagaagatggcatggttttggcaaacacaacatctatgggtatgcaaccaaatgttgaggagactccaatttctaaggatgcattgaagcactatgcactggtctttgatgcggtatacactccgagaatcaccagactgttgagggaagcagaagaaagtggagccataactgtctcagggtcagagatgtttgtcaggcaggcttacgagcagtttgagatcttcaccggtttacccgctccaaaggaactctactggcaaataatgtcaaagtactgagacatagcttaagtgtgtgtgtgggcgcgcc

SEQ ID NO: 246 - DNA, 469 bp, Arabidopsis thaliana
ttaattaaatgacaactccagcaaaaaagagactgatgtgggatttcaagagactgcagaaagatcctcctgtgggaataagtggagctccacaagataacaatatcatgcattggaatgctctcatctttggacctgaggacactccatgggatggaggtactttcaagttgactcttcacttcaccgaggattatccgaacaaacccccgattgttcggtttgtttcacggatgtttcatccaaacatttatgctgatggaagcatttgcttggatatcttgcaaaaccagtggagccccatctacgacgttgctgcagttctcacatcaattcagtctttgctctgtgacccaaaccctgactcaccagcgaacgcagaggctgcaaggttgttcagtgagaataaaagagaatataacaggaaagtaatcgagatcgtggagcagagctatgtataaggcgcgcc

SEQ ID NO: 247 - DNA, 1626 bp, Arabidopsis thaliana
ttaattaatccttcttctttttccgctcttcccgatgccgatcgataagatcttcaaagatgatgctagtgaagagaagggagaacgtgcgaggatggcatcatttgttggtgcaatggctatcagtgatctggttaagtctactttagggccaaagggcatggataaaatcttgcaatctactggtagaggtcatgcggtcactgttactaacgatggtgctactattctcaagtcacttcacatagacaaccctgcagctaaagttcttgttgacatctcgaaagttcaagatgatgaggttggtgatggaactacctctgttgttgtcttggccggcgagcttctgagggaagcagaaaagcttgtggcttctaagattcaccctatgaccatcatagcaggttacagaatggcttcggaatgtgctcgtaatgctttactgaaaagagtcattgataacaaggacaatgcagagaagtttaggtcagacttgttgaagattgcgatgactactttatgttccaaaattctctcacaggacaaggaacattttgcagaaatggccgtggatgctgttttcaggctaaagggaagcacaaacttggaagctattcagatcatcaaaaaacctggagggtctctgaaggattcgtttttggatgaagggtttattcttgacaagaaaataggaattgggcagcctaagcgcatagagaatgcaaatatcttagtagctaatactgctatggataccgataaagtgaagatttacggtgcacgtgtccgtgtggattccatgaccaaggttgctgagattgaaggggctgagaaggaaaaaatgaaagacaaggtgaagaagatcataggccacggaatcaactgctttgttaacaggcagttgatctacaatttccctgaggaactctttgctgatgctggtatacttgctattgagcatgctgactttgagggaatagagcgtcttggtttggttactggtggtgaaattgcttcgacctttgacaacccagagtctgttaagcttgggcattgcaagcttatagaagaaatcatgattggtgaagacaagttgattcatttctctggttgtgaaatgggccaggcttgttcaattgtcctaagaggggccagtcaccatgtcctagatgaggctgaaagatcactccatgatgccttatgtgtactctctcaaacagtgaatgatactagagttttgcttggaggtggatggccagagatggtgatggcaaaggaagtagatgagcttgcaaggaaaactgctggcaaaaaatctcatgccattgaagctttctcacgtgctctagttgctataccgacaacaatcgctgacaacgctggtttagacagtgccgaattggttgctcagcttcgtgcagagcaccacactgaagggtgtaacgctgggatcgacgtcatcactggagctgtaggagatatggaagagagaggaatctatgaagcattcaaagtgaagcaagcggttctgctttcagccacagaagcatctgagatgatattgcgagtggatgaaatcattacatgtgctcctaggaggagagaagacaggatgtgaggcgcgcc

SEQ ID NO: 248 - DNA, 427 bp, Arabidopsis thaliana
ttaattaaatgagaggtgtcggaggtccgttgctgtcaatcggagatcttctcgccgatctcggtgatgaaactggccactccccgcaaaatcatccaaatcctgaagtttcatcaaaatcatactctgatgataccatctctggacccttggatctaacccgactctttcaggagaactatgataaacttaacgatgcgtttgctggttctgatcactcatggacctccctaacattagagctctgcacttccctagagactgctaacaagttggtccatgccacaaccacaaatgctagattgttgtcagagaaggttgaagaactcgagaaaatagtgaaacgaggagactcagcagtcgcagctgccagaacggttcacgccacggttaaccagaaaggattaccctctacgtgaggcgcgcc

SEQ ID NO: 249 - DNA, 1123 bp, Arabidopsis thaliana
ttaattaatctgtttttaaatcaaagaaatgaagaagaagatgatagccattggtttcgaaggatcagctaacaagattggagttggaattgtgactttagacggtactatcttagcaaatcctcggcatacgtatataacaccacctggtcatggttttcttcctagagagactgcacatcaccatcttgaccatgttcttcctttagtcaaatcagctttagagacttctcaagttactcctgaagaaatcgactgtatttgttatacgaaaggtcccgggatgggagcgccgttgcaggtttcagccattgttgttagagtattgtcacagctttggaaaaagccaattgttgctgtgaatcattgtgtggctcacattgagatggggagagtagttactggagctgatgatcctgttgtgttgtatgtgagtggtggtaacactcaggtgattgcttatagtgaaggtaggtaccggatttttggtgagactattgatattgctgttggtaattgtttggatcggtttgctagagtcttgaagctttctaatgatccaagccctggttataacattgaacagcttgctaagaaaggagaaaactttattgatcttccgtatgctgttaaaggtatggatgtatcgttcagcggaatcttgagttatatcgaaactactgcagaggagaagctcaagaataacgagtgtacaccagcagacttgtgttattcccttcaagagacggtgtttgcgatgttggttgagatcacagaaagagcgatggcgcattgtgacaagaaagacgttttgatagttggcggtgttgggtgtaacgagcgtttgcaggaaatgatgaggactatgtgctcagaacgtgatggtaagctgtttgcaacagatgaccgttactgcatcgataatggagctatgatcgcttacacaggtctactcgcgtttgttaatggtattgaaacaccgatcgaagactctacctttacacaacgatttcgcacagacgaggttcatgcggtgtggcgagagaaagaagctgtactacttggggataagaaagttgcagcgaattgagtctgtccccatttttgttcattttggcgcgcc

SEQ ID NO: 250 - DNA, 910 bp, Arabidopsis thaliana
ttaattaaatgttatcatcatcaccggcggtcaccaccgcctcacacttacatcctcctccgtcgccggaaacctaccaaattcctctgaatttactttcctcgccgcatattacccgccgagaccttttcaaaactctctccgtatgtattgccacaccatcactctccgtctccatcgccgcaccagctaacgcacgcggtctctttcaaatgccgcctctccggctctctaatcgttattaccttgtgagagctggggaatcagattacgaaagcttagggataatcaacacaaacccggttgccaaaacatcggtagatagcggattatcagagaaaggtaagaagcagactctgagagctgcgttacagttaaaagcaatgggagcttgtgaccgaaactgttggctctggccttccataacacagagagcttatcaggctgctgaaatcatcgccgccatcaatggaattagtcgcagctatatagttccggagtatagcttccttgatgctcgtggtttaggagcttacgaaggcaagaagcttgaatctatatcagaagtgtatgcattagactcaatatcgatgaagacaaaacctcctcctataagcgacggtacccccaacgagagtgtatcagatgtatttgtgcgtgtgacgcaactcatgtctattctcgagactcaatactcagaagacacaatcgtgattgtttcgcctgattcagacaacttatcggtgttacaagctggtatccaaggactcgaccttcgaaggcactcggagttgtattttggaccaggagaagtaagattgttggatgcaaacagcattccagtgtataagcaacctgcttctgccgtatataagtgtaagaaaccaccaaactgtgactaaggcgcgcc

SEQ ID NO: 251 - DNA, 1125 bp, Arabidopsis thaliana
ttaattaaaaatcaaagctttcagagatccaaaaatgggatctcttccaccgccatcgctagatttctcatcaatcgatcacaattccctcaaaaatggcggatccagccaccaagagatctctcatgataatctcctcaacctcttcaaatcccagcaagatcttctcaatcacttcttcaaacatctcgatctctctcaaaccctagatttctcacgcattctcctttccaccaccggtaccgttttcttcaccggcgtcggtaaatccgctttcgtagctaacaaggtttcacagacgctcgtttccttaagcttccgttcctctttcctctcccctctcgatgcgcttcatggtgacattggcgctctttcgccacgcgatgttctcgttttcttcagcaaatctggcgccaccgaggagcttctccgtcttgtcccttgcgctagagctaaaggagcctttctggtgtctcttacctctgtttctgggaatccactcgctggtgtttgtgatatgaatgtgcatttacctcttcagagagaattgtgtccgtttaatctcgctccggtgacttctacggcgattcagatggtgtttggtgataccattgccgttgctctcatggcggctagaaatctctccaaggaagagtatgcagctaatcatcccgccggtagaatcggcaagagcttaatcttcaaggtgaaagatgttatgaaaaagcaagaagagcttcctgtgtgtaaagaaggagacttgataatggatcaattagtggagctaaccagcaaaggatgtggttgtttgcttgtggttgatgaacattctcgtttgatcggtacattcacagatggagatcttcgtcggactctcaaggctagtggagaagcaatattcaaactcagtgttggagaaatgtgcaacaggaagccgaggacaattggaccggaaacaatggcagttgaagctatgaagaagatggaatcaccgccatcgcctgtacagtttctaccagtggtcaatgaagacaacacattgattggaattgtaacattgcatggtttggtttcagctggtctctgaacacgaaggtgcctctatattgagttttatggcgcgcc

SEQ ID NO: 252 - DNA, 1129 bp, Arabidopsis thaliana
ttaattaaaagaaggaggagtgtgggtgataatggatttggatgatttccgatcggttatggataacgcaggtgttgatgtttggacatttatcgatacggcgattcttgttgcgtctcttgactatggtcaagaactgaaacgtcggagagataacatcgtcgagcgtctctacgctacgtcgatggctaacaagtgtagaaactgcgattttggcggcggtggtaacgttacggaggcggcgattggtagggttaataatgggagggttcacgaggagacggaggaggaagatgaagaaggagtaacagcagcagcagaagaagaagttagagagaaatctgttaatgttgaagacgatgacgatttcgatccctttgctggtttgtttgatgatgagcagaagagtattgttgaaatcaaggagaaacttgaagatcctgatctgtctgaagaatctttggttgagttgcttcagaatctggaagatatggatataacattccaagctcttcaggaaactgatattgggaggcatgtgaatcgagttcggaagcatccttcgaacaatgttcgaagattagctaaacagcttgtcaaaaaatggaaggaaacagtagatgaatgggtcaaatttaaccagcctggtgatcttgaacctccaagtttgatagccgatgaggattcaccggtgcagaaagctcttcataatggtagtcgccaacaggtccctgatttcggatattcaccggttcctcagaatgggtattccagttcaagcaagaacagtaacattactgagccagaaagaaaaccaagacctgttgctcctcaacctaggagagaatctccttctccagcaaaaccttctcgcccttctccttctcaacaaaccattccgagggacaaagagcataaagaagttgatttcgacacggccaggaaaaggctacaacaaaactacagacaagccgagaatgcaaaaaagcaaaggactatacaggtgatggacattcatgacattcctaaacctaagaaaggtggatttttcccaagaaaaggcgggagttctcaaggtggtagacactggtaaattgagaaagatgagagttaagtgaggaggcgcgcc

SEQ ID NO: 253 - DNA, 503 bp, Arabidopsis thaliana
ttaattaagatgaatccaaaaagatgtgcagcttgcaagtatctgagaagaagatgtccaaaagattgcgtattctcaccatatttccctccaaacgatcctcaaaaatttgcatgtgtccacagaatctatggtgctggaaacgtttccaaaatgcttcaggtatatatatctatacacatctttgtgtatcttcttctaatatcctatttaagatcacactttatgcatatatataagtaagtgtattcatggttggattttggtgatctttttgacagcaacttcctgatcagacaagagctgaagcagtggaatctttgtgctttgaagcaaaatgcagagtagatgatcctgtttatggttgtgttggcattattcatttacttaaaactcagattcagaaaactcagaatgaattagccaaaactcaagctgagattgctgttgctcaaaccaaacttagccaaacccatatttctgattttatgtaatggcgcgcc

SEQ ID NO: 254 - DNA, 753 bp, Arabidopsis thaliana
ttaattaacatgactggctctggctctccttgtggagcttgtaagtttttaagaaggagatgtgtaaaaggatgtgtgtttgccccatacttttgccatgaacaaggagcttcccattttgcagcaattcaccaagtgtttggagccagcaatgcttctaaattgctctctcatcttcccatggaggatcgacgtgaagccgctactacaatctattatgaagctcaagctcgccgtcaagaccccatctatggctgcgtttctcatatcttttccctccaacaacaagttgtgaatttacaaacacagctagagattctaaagcaacaagcaacacaaagcatgatggctattgattctccctccatagaaaaccctaattactatcaagacactaagcctcaatatcttcaagaatctcatgatctccatcatcatcatctaaccacttcgaattgtcaaacggagcaaaactctgatcttaagaacatcatgacgtcgtgctaccaccaaatggaaatcgaaacgacgccgttcacaggagctggcggagataccatggcggggagttactactacaactcctctagtggctgcagcgaagaacttaaatcggtctccaccaacggcgaattttccaaatactctgaattggatcagcacttgacgaacacttttaatcagtatcgtcatggcggcaataatctgatatccgagagtttagggtacatcacgtattcttgatggcgcgcc

SEQ ID NO: 255 - DNA, 1729 bp, Arabidopsis thaliana
ttaattaaatgtttgaaaacaaaccggatgatagtcccgtgtatctcgcaacagcaagccatgatcaaaccatccgattatggcaagcccgaaccggtcgctgttacttttcctttcgctatcctgatttggtgtgtgttttctcaacactaaaatctctgtgacatatgcattttttaattttttgacatttcatctgaaacttttgtattatattcagcatgtgaataggcttgagctaacccctgaaaagggtaaactagtagcagcttgcaatcctcacatacgactctttgatctcagatcctacaaccctcatatacctgtaaatatccttctttttgatgtggtttttgtttgtttatctttccttttgattgaatatatgaatgatcttgatggagtctttgtgcacattaggtgaggaattttgtatcacacaccaaaaatgttatggcggtaggattccaatatactggacacatgatgtattcagggtcagaagatggctctgttaagatctgggacttgaggtatatagcacattcatgttttttttttctctcttctatatatagctcaatgctcattttgatttgacccgtgaaccgaaaatgcagggttcgagaatgccaaagggagtttagaagtgtttcaccagttaacacagttgttttacacccaaatcaggtacatatcttagtgttgttttgtagcaatcggcttagttgtcttacttgttatccttttttatagactgaattgatatctggagaccaaaacggtaatatacgtgtatgggatctcagagcagatttgtgtagctgtgaactggtacatttctttatcctagttacattttctaagaatctgtagatatataatattactttggtgtataactatatataggtaccagaagtcggtacacctatacggtctttaacggttatgtgggatgggacaatggtggttgctgctaacgaccgtggaacatgttatgtatggcgctccttgtgtgaaagacaagtactgttctaatcataagaaaaactttctttcttccattatgctgaaataattgttcatgtcatttaaaaatttgattgtgttttttgctagacgatgaccgagtttgagccccttcataagctacaagctcataatagccacatccttaaatgtctcctttctcctggaaacaagtaattatgtgtttcttcttctttctcttgcaacctgttttctttgtcttctttctttttgtaaggtcttatatatttgttagcagatatctagcgaccgcatcatctgataaaacagtcaaaatatggaaccttgatggtttcaaacttgagaaagttttaacaggtatatggtctctccgtgtttctgaaaggggtatgtgttctcttttacactctcatcaatatcatttaacaggtcatgaaagatgggtatgggactgtgacttctcaatggatggagaatatcttgtaacaggtactacttaatctctttacactggaaaacttgtgtgagacaaaagagtatttaaactggttttcactttgtactattagcatcatcggacaccacggctagattgtggtcgatgcgagcgggaaaagaagagatggtgtaccaagctcatcgcaaagctactgtgtgttgtacactactgcgtgattaaatcctgtaaaattatcaaaaaggataaaggcgcgcc

SEQ ID NO: 256 - DNA, 1318 bp, Arabidopsis thaliana
ttaattaaatggatatcgacggagaagatgtatctagaagacttcacgttaagttcgtgacgaagcttgactctcccttcaaagttccggtcaactccgtcgcaatcccttctaatgtcactcgtctcggcctctcttccatcgtcaattctattatcgaatccgagaatccagagtggaaaactgagccgtttgatttccttattgatggggagcttattcggatgtcactcgaagagtttcttcttgcaaagggaatatcggcggagcgtactcttgaaatcgaatacataagggctgtgacaccacggaaggaagaagaaccctccttgcatgatgattgggtcagtgcggttaatggttcttctcccaggttcattttgactgggtgctatgacggattaggaagggtatggagttcggctggatcgtgttcacacatattagaaggccactccggggctatctcctctgttgctttagttaattccaacgatgcagaaactgttactgtagccactgcctctaaagatcggacattgagattgtttaagtttgatccagctgagtctgttgactctactacgaaagtaagggcatacaagatattgcgtggacacaaggcgtcagttcaaagtgtttcagctcagaaatccggaaacatggtttgctcgagttcatgggattgcaccatcaatttatggaacacaaatgaatctacttcagaaggggagtcagtatcagtaaagaaaagaaaaggaaataatcaggccgaggaatctcagtcagagggagaggcagtgacttctttggttggacacacacagtgtgtatcatcagttgtttggccagagcatgatgtaatttattcctcttcgtgggaccattccgttaggagatgggatgttgagacagggaaagattctttgaacttgttctgtggaaaagctctcaacacggtagatgttggtggtgaaagttctgcccttatagctgctggtggctcagatccaatccttagagtatgggatcctcgtaagccaggaacatccgctcccgtgtttcagttctcttcacactcatcatggatttccgcctgtaagtggcacaaaagctcttggtttcacttgctctccgcttcctacgacggcaaaatcatgctctgggatctcagaaccgcttggcctttgtcagtaattgatacacacaatgacaaggttttatctgctgactggtggaaaggagagagtgtagtcagcggaggagcagactctaacttgcgaatttcttccggaatcgcaatttcttaaggcgcgcc

SEQ ID NO: 257 - DNA, 1516 bp, Arabidopsis thaliana
ttaattaaatgagtaacaactggaaatccgttcgattaaggcttcaaaatcgtactctcgtgtttcttctggtgattttgagcttcggttcttgctattcgttgaaatctcaaggtgatggttttctggaatccgtgacgaaagatctatggtcagatatagatgctgaggatttgagagcagttggttttcacaggaaattacttggccgttttcgtaacccgtacacccatttgaatgcgttcagggaccgccctgtggcaagagctacacctccgtcatcttcggtttctacgagacctgatgccaaaagatcctctacattgcctccgccacaaaaaagtcctcctgcgcaacatgtttctgctccacctccttttgtgcaccatgtgactttacctagtctaacaagcagctccaaaacttcttcaaacagcacaattcctatagtggctggctgcatagcgggtgctgtgtttatcctccttttagctactggtgttttcttttttaaaagtaaggctgggaaatctgtgaatccctggcgtacaggtcttagtggacaacttcagaaagtgttcataactggtgtccccaaactcaaaagatctgagattgaagctgcctgtgaagattttagtaatgtcattgggtcttgccccattggtacattgttcaaagggacgctatcaagtggggtggagatagctgtggcttctgttgctactgcgtctgccaaagaatggacaaataatatagaaatgcagttcagaaagaagatcgaaatgttatccaagataaaccacaagaattttgtcaaccttcttggttactgtgaagaagaagaacctttcactaggatcttggtctttgaatatgcatcaaacggaacagtctttgaacatttacactataaagaatcagaacacttggactgggtaatgcggctaagaatagcaatgggcatagcttattgccttgaccatatgcacggactcaagccacctatagtccacagcaatcttctctcatcatcagttcaactcacagaggactacgcagtcaaaattgcggatttcaattttggatatttaaaaggcccatccgagacagaaagcagcaccaatgcactcatagatacaaacatctcagaaacaacacaagaagacaatgttcacagcttcgggttgctgttgtttgaactgatgacaggaaaactcccagagtcagttcaaaaaggtgactcgatagataccggattggctgtcttcttgagaggaaagacattaagggagatggtggatccgacaattgaaagctttgacgagaagattgagaatataggtgaagtgatcaaaagctgcataagagcagacgcgaaacagagaccgataatgaaggaagtcacagggagattacgagagatcactggattatcaccagacgacactatcccaaaactttcaccactctggtgggcagagctggaagttctgtccactgcgtgaggcgcgcc

SEQ ID NO: 258 - DNA, 596 bp, Arabidopsis thaliana
ttaattaaacaggtaaagtcattgcgattatgggcgtaagtggcgcagggaaatctaccataggtaaaatgttggggaaagctctatcttgcgattttcttgatgctgatgattttcattctttatcaaacagagataagatgcgtcaaggcattgctctttcagatgaagaccgaatgccatggcttgaaaaaatacaagagagtttgcgaaaacgtttactcgatggagaaaccgttgttctcgcatgttcttctttgagaaaacagtatagagaaatcttgagaggttctgatcctgattacaaaccgggaagctatacgagttgcaaggttacgtttgttttattggaaggtaatgcagaggtgattgctgctcggttacagaagagagcttccgaggaagaacatttcatgcctcttactcttcttcagtctcagtttgatctgcttcaagctgatgaatgtgaaaagatattcaaaatcagtgtggttctaagccctgaagttatagtcaatacaattcttgaaatggtagcaaattctttgaacccttgaggtaaagacttgtgaaattctcagcacatagggcgcgcc

SEQ ID NO: 259 - DNA, 2391 bp, Arabidopsis thaliana
ttaattaatcttggatcattagagagacagctatcgatggatgaagatggaaacttgcagattagtaatagtaattacaatggagaagaagaaggagaagatccagagaacaacactttgaatcaaccactgcttaagagacatagaactctttcttcaactcctcttgctttggtcggtgccaaggtttcacacatcgagagtttagattatgaaataaacgagaatgatctgttcaagcatgactggagaagcagatcaaaagcacaagtgtttcaatacatattcttaaaatggacattagcttgtcttgttggtctcttcactggtcttatcgctactctcatcaaccttgctgtcgaaaacatcgccggttacaaacttctcgccgtcggctactacattgctcaagataggttttggacaggtctgatggtctttacgggggcgaatttgggtctgactttggtggcgacagtacttgttgtttactttgctcctacggcggctggtccggggatccctgagattaaagcttaccttaatggcattgacactcccaatatgtttggttttaccaccatgatggttaagattgttggaagtattggagcggttgcagctggacttgatcttggtaaagaagggccattggttcatattggaagttgcatagcttctttgcttggtcaaggtggtccagataatcacagaatcaaatggagatggcttcgttacttcaacaacgatagagatcgaagagatcttattacatgtggatctgcctctggagtatgtgctgctttcaggtcaccagtaggaggagtacttttcgctcttgaggaagtcgctacgtggtggagaagcgctctcttgtggagaacattcttcagtacagccgttgtggtggttgtattaagagcgttcattgagatttgtaactccgggaaatgcggacttttcggctcaggaggactcattatgttcgatgtgagtcatgtagaggttaggtaccacgcagcagatataatcccagtcacattgattggagtctttggtggcattcttggaagcttgtacaatcatcttctgcataaagttctccggctttacaatctcatcaaccagaagggaaagattcataaggtgcttctaagtcttggggtatctctattcacatcagtttgcttgttcggtcttcctttcttagcggaatgcaagccttgtgatccttctatagacgagatatgtccaacaaacggaagatcaggaaatttcaagcaattcaactgtccaaatggttattacaacgatctatccactctgcttctcacaaccaatgatgatgcagtcagaaacattttctcttcaaacactcctaatgagtttggcatggtttctctctggatattctttggcctctactgcattttgggtcttataacattcggtatagcgacaccgtcgggtctcttcctaccgattatcctcatgggttctgcatacggtaggatgctaggcacagcaatggggtcttacacaaacatagatcaagggctttacgcggttcttggtgcagcttcactcatggctggttcaatgagaatgactgtttcactctgtgttatatttctggaactcaccaacaaccttcttttgttgcccattacaatgtttgtgcttctgatagctaaaacagtaggtgacagcttcaatctaagtatctacgagatcattctccatcttaagggcttacctttcttggaagcaaatccagagccgtggatgaggaatctcactgtaggtgagcttaacgacgctaagcctccggttgtaacacttaacggagtagaaaaagtggcaaatatagtcgatgtactaaggaacacaacgcataacgcattcccagtcttggatggagcagatcaaaacactggcacagagctccatggtctgatcctaagagctcaccttgtgaaagttctgaaaaagagatggttcttgaatgagaaaaggagaacagaagagtgggaagttagggaaaagttcacaccggttgaattagctgagagagaagataacttcgatgatgttgcaatcacaagctcagagatgcaattgtatgttgatcttcatcctttgaccaacactacaccttacacagtggtgcaaagtatgtcagtggctaaagctttggttctgttccggtcagtgggtctcagacatttactggtggttcccaagattcaagcttcagggatgtcacctgtgatagggatcttaacaaggcaagatctcagggcttataacattctacaagcatttcctcacttggataaacacaaaagtggaaaagctagatgaataagccaaaatgcaaagagcgttcac

SEQ ID NO: 260 - DNA, 955 bp, Arabidopsis thaliana
ttaattaaatgcagggagcatgcatctccgagagtcagccatggtatctccatttcgtatgcttcataggctttctctttctccttagagtactattcattcctctcctaaaatggttcaccacaagattcctcctcacacccaagcggctcaagcggtacggctcatgggctatggtcactggagccaccgaggggatcggacgcgcctttgctcacgagctggccaaacacggccttaacctcatcctagtcagcagaaacctttcgaagctcgaatctgtctctgatgatttccaacaagagtttccccacatcaagatcaagatcattccatttgacttctcctctgaaggaggatacggagcaatcgaggaagggataaaaggccttgaagttgggattttgataaacaacgttggtattacttatccacgcgccatgttcttccacgaggttgaccaacttacatggaccaaaatcctgagggttaatcttgaagccaccacttgggtcacacgatcactcatcggaccaatgcttcaccgccgccgtggagccatcgtcaatattagctccggcgctgccgttgttgtcccttctcatcccctctacgccatctacgctgccaccaaagcttatgtggatgcactatcaagatctctacatgtggaatataagcagtttggtattgatgtccagtgccaggttcccttatacgtgtcaacaaggatggtgtcagaagtggcagctatagacaaacctagcttatttgtaccgtcgcctgaagtctacgcaaaagcggcggtggcgcagatcggaattggatcacgttgctcgccgttttgggctcattctcttcagtggtttcttgttggacttgtaccggataaccttgttgatacttggcgtctctctatcggacttcgcagaagaagtttatcttaaggcgcgcc

SEQ ID NO: 261 - DNA, 1891 bp, Arabidopsis thaliana
ttaattaagatggttctgttttggaatattgctcttgtttcttcttactttcaattgcttaaagcaaggatctttggctccaaatctacttccatatctggctccatcaatccacaaaatggatcttctagacccatttgtgttatcactggtgtaagtgaagtaatggttcaaaagtctactatctattcttgttacttcactgcttgtgtgaatcatttccttgattatgtcatgttgtaatgcctctatttttaaatgttgattactcatgtattgcattttgtgtatatggtttttgatttcaggctacttctgggcttggtaaggccactgcatttgctcttgcagagaaaggtttctacgtcgttcttggtaaaaaacatctatgatccattgcctcctaaagtactaatgtttaagtatcacaaatttagttctctgtggactaatcggatgaaatccttcttgatttttttatcagttggacggtcctctcagcttctttcagaggttatctataaatctttttgtttcggctttgtcgaattagaaatgctatctttcacattattctttgatgcaaaatctcttggcttatgacagaccctgaaggaaattaagaacaagaacaaagatgctcaactcaagtctttcgaagctgacatgtcttcatttgaatcaatcttcacgtttaaaaactctctagagcaatggctctcggactcagcgttacatccttctattcaggttttggtgaacaatgctgggatcttggcaacttctagtcgaccaaccattgatggttatgacaggtaagtctggtttgatcaaatcttttgttttcagttgtcaataacttaccttatgtattagcctatggatttgatattttaaaactgccttttctttgtctccctctttgtcaggatgattgctacaaactatgttggtccattctttttgaccaaacttcttctaccacttctgaaaaacagcaatgttccttcacgggtcgttaacgttacatctttcacacatcattcaggtaagatgtagtgatatataagatttaacaagaaccattaaagactagcttaagtgacttgatatctctttgttttctgtagcttttattcaaaagctagacaaggattctgttactggagtgtgtttttcgacatcaaaccaatatccatgcgctcgaatctacgagtattctaaatgtaagccgatatatttctcacagtcacttaattacgaaacatatatagtttcttcatactaaattttgcttcatgttcttgaccagtatgtcttctactgttctcatatgaattgcaccgacaacttcggctcatagacgactcaagccatgtctctgtaatgtatgcaacaaaacactcgttgctctctcactgattaaaagatcgtgtgttttgacttgtgagtattggttgttgattgtagagctgctgatccaggatttgtgaaaacgaatataatgcgtgagcttccttgttacataacttccatggtgtttcttggcttcaaaattcttggcctcctgcaatccccagaggatggagctgaatctatcatcgatgccgctttatccacacccgtaatatgaatgaataatgaattttattgattctctcttcttcatatatgatctgattttcttacttacacatactaaaaacatgttattgatttgcaggaaacatcaggtgcttactattttggaggaaaaggaaggaccattgaatcatcacaagtttctagagaccctaaacttgctaaacaactctgggaaacatcttgtgatttgttcaatgacttgcagcttcttcatcaccacaactaattattaaagactcggcgcgcc

SEQ ID NO: 262 - DNA, 1325 bp, Arabidopsis thaliana
ttaattaaatggatttaaacaacaagatctttaacatccttcttcctattgtcacggtttcgtttcttttagtgttcatgccattttcaatattcttcaagctcctccagttcataaggggatgcaaagagtccgagaaagtcaacggaaaagtcgtcatcatcaccggatcttcctcaggaattggcgaggttagtttgtttgtaatcctagaaaagcttggtctattttttataaattggttagttatttggtaaaaaacaaaagcaatttgaagttgatttaatggtgtagcacctagcgtatgagtatgctcgtagaggagcatacttgactctagtagctcggagagaggatcgtctccaggtggtggctgaccggtgcaggaagcttggttcaccagacgttgctgtggtacgcggtgatgtctcagtcatcaaagactgtaaacgttttgttcaagaaaccatctctcggtttggaagatgtgagttagtcactattattcgaataactaatattactacttgcttaaagaacataaaaaatataacaaaatttacatcagtggatcacttggtgaacaatgctggaattgcggaggccaaatttttcgaggactattctgaaatttcggatgttcttcccattgtggtatacatttttagatttaatacatagtgaagtcttttttacaatatatgaaccttggcaaaatttgcagaacactaacttttggggaccggtttacgcgacacatttcgctataccgcatctcaagaaaacaaaaggaaagatcatagcggttgcatcacctgctggatggtctggagtaccaaggatgagcatatatgctgtaaatgcttcttcttctttttctttctcttgttctctaaattaaccaagcgtaacatattaacataatgaatgtaacatttgtttcaggcaagcaaagcagctatgataaacttctacgagactcttaggatcgagcttcatccagaagttggtgtgacaatcgtgtttcctggtctaatcgaaaacggaaatactaatccggaccttttagctgaggtattttactatcatcatttttcattttagtctgtccaagttttatgactgaagtctcttttgcagaaacaagactggtcgcaagttgtgaccatcgagtcagcagcggaatgcgccaaagcggtagttaacggaatctgcagaggcaaaacctttgtggcagagccgtcgtgggttcgtgtcctgttctggcttagtgctatatgccctgagcttctgatctctaagcctaaaaggaattaaggcgcgcc

SEQ ID NO: 263 - DNA, 2373 bp, Arabidopsis thaliana
ttaattaaatgggaaagagttgtgttgtgactagttccttctcgcttctccttctcttccttcaaaccctaaaatatgttcatgccggtttcatttgctacggcgactttttcaatgttaactacggcgtcagtcgaacgtatctcttctcttctcttccttctaacgtcgtttctaacggcggtttctacaacgcatcgtttggcagagattccaaaaacaacagagtccacgttgttgccttatgcagacgaggctacgagaagcaagcttgtaagacatgtctcgaacatgtgattgaagacacaaaatccaagtgtcctcgccaaaaagagtctttctcgtgggtcactgatgaattcgacgacgtttcttgctctctacgttacaccaaccactcaactcttggcaaactcgagctcttaccaaatactattaaccctaaccctaacagtatagattccaaattcaacaacatggccatgttcagccaagaatggattgcaatggttaaccggacactcgaggctgcttccaccgctgagaattcctcagtccttaagtactacagcgcaacaagaacagagttcacacaaatttcagatgtttacgcgttgatgcagtgcgtgcctgatctatcgccaggcaactgcaagagatgtcttagagagtgtgtgaatgactttcagaagcagttttggggaagacaaggaggtggggttagtcggcctagctgttatttccggtgggatctttatccgtactacagagcttttgacaatgttgtaagagttcctgctcctcctcctcaagcttcttctactattatcgattacgggagagacgagaaaagttttcaaggaagcaacatagcaattattgtggtcccttcagtcatcaatctcatcatatttgtggttctaatattctcttggaagagaaagcagtcacacaccataatcaatggtaaagtcttttaaaataagcaacatatatattccttatcttactaagagtttggttttaaacttgacatgttttatttgatgacgtgcagatgtttttgattcaaataatggtcaatctatgttacgttttgatcttcgaatgattgtaactgcaaccaataacttctctcttgaaaataagcttggccaaggtggatttggatctgtctacaaggtaaagaaactagtaagaagagtcctaacaaaatcttaagatgggtcagtgatctttaattatagcatgagaattcgttttcagggaatattaccaagcgggcaagagatagcggtaaagagattaagaaaaggttcaggacaaggaggtatggagttcaagaacgaggtcttactcttgacaagactccaacataggaatctggttaagcttcttgggttttgtaatgaaaaagatgaagagattcttgtctacgagtttgtccccaattcaagccttgaccacttcatattcggtgagccttcgcgagacgagactttgcatctttgcatgttacactacttttagaaaacaagaaaaaaaaactgtttctttgagatgtgcagatgaagaaaaacgccgagttctgacatgggatgtgaggtatacaatcatagaaggagttgcaagagggcttctttatctccatgaagattctcagttgaggattatacacagagatttgaaggcaagcaatatccttttagacgcggagatgaaccctaaggttgcagattttgggatggcaaggctgttcgatatggacgagactcgaggacagacaagcagagtagttggaacatagtaagtaagctctgtttttatttttaaagattctttgatcagcatcactattaatatgatttggttaatgcagtggatatatggctccagaatacgcgacatacggacaattctcgacaaaatctgatgtttatagctttggtgtcatgcttctagagatgataagtggtaaaagcaacaaaaagttggaaaaagaagaagaggaagaagaagaagagcttccagcttttgtaagcttatcacttatgtcgatcatctttactcttcttcttcatcttcttatcgaaattttaaaaattatttgcaggtgtggaagaggtggattgaaggaagatttgcagagatcattgatcctttggctgctccgagtaacaatatctcaataaacgaagtaatgaagctcattcacataggtttgttgtgtgttcaagaggatatttccaaaagacctagcattaattcaatcctcttttggcttgagagacacgctactatcacaatgcctgtgcccacgcctgttgcttatcttacgcgaccatcgttatcacttggtcattaaggcgcgcc

SEQ ID NO: 264 - DNA, 1822 bp, Arabidopsis thaliana
ttaattaaatgaagaagatcttcatcacactcttatggcttctcttcataagctcgtttctctgttcttcttcttcagctgaagacgacgttctctgtctccaaggtttgaaaaactcactcatcgatccttcttctagactcagttcctggtctttcccaaactcttcagcttcttcgatttgtaagctcactggtgtttcctgctggaacgagaaagagaatcggattatttctcttcagcttcaatcgatgcagctcgccggtgagattcctgagtctcttaagctttgtcgtagtttacaatctctggatctctctggaaacgatctctctggttcgattccttctcaaatctgttcgtggcttccttatctcgttacgttagatctgtctgggaataagcttggtggttcgattccgactcagatcgttgagtgtaagttcttaaacgctttgattctgagtgataataagctttctggttcgattccttctcagttgagtcgattagatcgccttcgacgtctttctctagcagggaatgatctctccggtacgattccgtccgagctggctcggttcggaggagacgattttagcgggaataacggactttgtgggaagcctttatcgcgatgtggagcgttgaatgggagaaatctgagtattattatagttgctggagttcttggagctgttggatctttgtgcgttggtttagttatattctggtggttctttattagagaaggtagtaggaagaagaaaggttatggtgctgggaagtctaaggatgatagtgattggattggtttgttgaggtcacataagcttgttcaggtgactttgtttcagaaacctattgtgaagattaaattgggtgatttaatggctgctacgaacaattttagttcagggaatatcgatgtttcgtcgaggactggggtttcgtataaagcggatttacctgatgggtctgcacttgcggtgaagaggcttagtgcttgtgggtttggtgagaaacagtttaggtcggagatgaataagttaggagagcttagacatccgaatttggtgccgcttttagggtattgtgttgtggaagatgagagactgttggtgtataagcatatggttaatggtacgttgttttctcagttgcacaatggtggattgtgtgatgctgttttggattggccgactcggcgtgcgattggtgtgggagctgctaaagggttagcttggttgcatcatggatgccaaccgccgtatttgcatcagtttattagctccaatgttatacttcttgatgatgattttgatgctcggataacagattacggattggcaaagctagttggatctcgtgattcgaacgatagctcgttcaataatggggatttgggggagttaggttatgtagcgcctgagtattcgagcaccatggttgcgtctttgaaaggagatgtgtatgggtttgggattgtgcttcttgaattggttacagggcaaaagcctttgtctgttattaacggtgtggaagggtttaaagggagtttagttgactgggtgagtcagtatttgggtactggtagaagcaaagacgctattgatagaagcatatgtgataaaggacacgatgaggagatattgcagttcctgaaaatcgcatgtagctgtgttgtgtccaggcctaaggaaaggccaacgatgattcaggtgtatgaatctttgaagaacatggcagataaacacggtgtttcggagcattacgatgaatttcctctggtcttcaacaaacaagaagcttgaggcgcgcc

SEQ ID NO: 265 - DNA, 1847 bp, Arabidopsis thaliana
ttaattaaatgcaaatcttcttgttcttcttctctttgattctctgttttgttctgatttcctctcagactcttgaagacgacaagaaagctttgcttcatttcttgtctagtttcaattcttctcgtctccattggaaccagagctcagacgtttgtcatagctggaccggtgttacctgcaacgaaaacggagatcgaattgtatccgttagattgcctgcggttggattcaacggtttgattcctcctttcaccatcagtcgtctctcttctctcaagtttctaagccttagaaagaaccatttcaccggagacttcccttctgatttcacaaatctcaagagcttgactcatctctacctacaacataaccacctctcaggtccactactagctatcttctcggagttgaagaatcttaaggttcttgatctgtctaacaatggattcaacggaagcatcccaacctctctttcaggattgactagccttcaagtcttgaatcttgcaaacaattcattctcaggggaaattccaaatcttcatcttccaaaactgagtcagatcaacttgtccaacaacaagctcatcggtacaataccaaagtctcttcaaagattccaaagttcagctttttctggcaacaaccttaccgagaggaagaaacaacgcaagactcctttcgggttaagccaacttgctttcttgctgattctgtctgcagcttgcgttttgtgtgtttccggattatcattcataatgatcacttgtttcgggaagactagaatctccgggaagttgcgaaagagagactcgtcttctcctccaggaaactggacatctagagatgataacactgaagaaggcgggaagatcatcttctttggtggaagaaaccacttatttgatttagatgatttgctaagctcatctgcagaagttttggggaagggtgcttttggtacaacctataaggtaacaatggaggacatgagcacggtcgttgtaaaacgattgaaggaagttgtcgttggaagacgagagtttgagcaacaaatggagatcattggtatgatcagacatgaaaatgtagctgagctaaaggcttactactactccaaagacgataagctcgcggtttatagctattacaatcatggaagcctcttcgaaatactgcacggttagttattttcattgctctcattctgatgataaatcgaaactacaaggttccattttctttgcaggaaacagaggaaggtatcatcgagtaccgttagattgggatgctagactgcgaatagcaaccggtgcagcgagagggctagctaaaatccacgaagggaagttcatacatggaaacatcaaatcctcaaacatcttcttagactcacaatgctatggctgcataggcgatgttggcttgacgacaatcatgagatcacttcctcaaaccacttgccttacttctggctaccatgcacctgaaataacagacacaagaagaagcacacagttttcggatgtatacagcttcggtgtggtattactggagctcttgacagggaaatcaccagtgagtcaagcagaattagtaccaacaggaggtgagaacatggacttagctagctggataagatctgtggtggctaaagagtggactggagaagtgtttgatatggagatattgagtcaatcaggtggtttcgaggaggagatggttgagatgttgcaaataggattggcttgtgttgctctgaagcaacaagaaagacctcatatagctcaagttttgaaattgattgaagatattcgatcagttgatgcagagtgaggcgcgcc

SEQ ID NO: 266 - DNA, 1245 bp, Arabidopsis thaliana
ttaattaaatgatgatgagtcgtcgctatggagccaagctaatggaaactgctgtgactcacagccatcttttgaatcctagggttcctctcgtgacggaaaatattagggttccggcgatgggagtcgtgagagttttcagcaagatgacatttgagaagaagaaaactacggaggagaaaggatctagcggtggcaaggctgatcaaggtaacaaaggggagcaattaatcgttagctactggggagtgaagccgatgaagatcaccaaagaagatggaactgaatggaaatggagttgctttagggtacattacatctttggtattatattagaactctgtggtcgatttatatgtatgatttgagtttttgtgtggaataactgtagccatgggagacatataaatcagatctgactatagatttgaagaagcatcatgttccatcgactttaccggacaaactagcttattggaccgtgaaatctcttcgatggcctaccgatcttttcttccaggtgacagtcttagctttctatggttttgtcatttcaaatgctttgtatgtttggactaatcttgccaacgagttaaccgcagaggcggtacggatgcagagcaatgatgctagaaacggttgcagcggttccaggaatggttggagggatgttagtacactgcaaatcgcttcgacggtttgaacaaagcggtggttggatcaaagccctacttgaagaagcagagaacgagagaatgcatttaatgacattcatggaagtcgcgaaacctaattggtacgaacgagctcttgtgattgccgttcaaggcattttcttcaatgcttatttccttggatacctaatttctcccaaatttgctcatcgtatggttggataccttgaggaagaagcaatccactcttacactgagtttcttaaagaactcgataatggtaacatcgaaaatgtgcctgcaccggctattgccattgattactggagacttgaagctgatgcgacgcttcgtgatgtcgtcatggtggtccgtgctgatgaagcgcatcaccgtgatgttaaccactatgcatccgtaagtagtgtgaattgtattataggaaacttacttatgtttaaaagatgattagattgttttcatggttttaataaaaattgcaggatattcattaccaaggtcgtgagctaaaagaagctccagctcccattggatatcattgaggcgcgcc

SEQ ID NO: 267 - DNA, 366 bp, Arabidopsis thaliana
ttaattaagctagacatccggctaagtacagaatgctcgtgggcatggttgatgtcatattctctgatgttgctcagccagatcaggcaagaatcttggccctgaatgcctcatttttcctcaaaactggtggacactttgttatctcaatcaaggccaactgtatcgactctacagttgcagcagaagcagtcttccagagcgaggtgaagaagctgcaacaagagcagtttaagccagcagaacaggtgactctcgagccgtttgagcgtgaccatgcctgtgttgttggtggttaccgcatgccgaagaaacaaaagaccccagcctcatagaggaactgtggacagtagtgcctggcgcgcc

SEQ ID NO: 268 - DNA, 567 bp, Arabidopsis thaliana
ttaattaaaacttttcctaagtcgtcactttttacgatggcagaaacgaagaagatgatcatccttaagagctccgacggtgaatccttcgagatcgaggaagccgtcgctgttaagtcccagacgattaagcacatgattgaggacgactgtgccgataacggaattccacttcccaatgtcaccggagccatcctcgccaaggttattgagtattgcaagaagcacgttgaagccgctgctgaagctggtggagacaaggatttctatggttccgctgagaacgacgagcttaagaattgggacagcgaattcgtcaaagtcgatcagcctactctcttcgatctcatcttggctgcgaactatttgaacatcggtggacttcttgaccttacgtgcaaggccgtggctgatcagatgagaggcaaaactccagagcagatgcgtgcacacttcaacatcaagaacgattacacacctgaggaagaggcggaggttcgcaatgagaacaagtgggcgttcgagtgattggatcggatctgaagggtgtttaggaatcggcgcgcc

SEQ ID NO: 269 - DNA, 556 bp, Arabidopsis thaliana
ttaattaaaaatcaacaaaacaacaaaacaaacaatgtcttcgaacaagattgtgttgactagctcggatgatgaatcgttcgaggttgaggaagcggtggctcgtaaattgaaggtcatagcacacatgatcgatgacgactgcgccgataaagcaatcccgcttgaaaacgtcaccggaaatatcctcgctttggttatcgagtattgcaagaaacacgtacttgatgatgttgatgatagtgatgattctactgaagcaacaagcgaaaatgtaaacgaggaagccaagaacgagctcaggacttgggacgcagagttcatgaaagaatttgatatggaaacagtcatgaaactcattctcgctgttaattatctcaacgtccaagatcttcttggtctcacttgccagaccgttgcagatcacatgaaagatatgtcgccagaggaagttcgagaactctttaacattgagaatgattacacacctgaagaagaagacgcgattcgtaaggaaaacgcttgggcttttgaggatctaaagtaaaggcgcgcc

SEQ ID NO: 270 - DNA, 469 bp, Arabidopsis thaliana
ttaattaaatgtcttcgaagaagattgtgttgactagctccgatgatgaatgttttgagattgacgaagcggtggctcgtaagatgcagatggtagcgcacatgatcgatgacgattgcgccgataaagcaatccggcttcaaaacgtcactggaaagatcctcgctatcattatcgagtattgcaagaaacacgttgatgatgttgaagccaagaatgagttcgtgacttgggacgcagagttcgtgaaaaacattgatatggatacactcttcaaactccttgacgctgctgactatctcatcgtcataggtctcaagaatctcattgcccaggccattgcagattacactgcagataagacggtaaatgagattcgagaactctttaacatcgagaacgattacacacctgaggaagaagaagagcttcgcaagaagaacgaatgggctttcaattaaggcgcgcc

SEQ ID NO: 271 - DNA, 1894 bp, Arabidopsis thaliana
ttaattaaatgcctaactcgattctctttcttcttctttcattcctgtatctcacaaactgcgttgctcaatctccatcacaaacttgtcctttagatttctctcatgtcctaacaatcccatggaacacaacagattgtcaaaagtccgacaaatcagccgatagcaagaacagttgttgccaatctcttttaactctaatcggaatccctctagctcatcgtctcaaacaaacttccaatttccgtctcccaaatctcgctacttcaatctcttgtctcaacaatctccaaacgaagcttagttcactctctctatcttcgaatctcacctctctctgtttcgatccgaatcagttcgtcatcaataacgaaacctgtgctggaatccaaacgactcaagattgggtatctcgtctcggtccatctacggcgcttgactccgcctgtagcagtggtctcactgatctaacgcgatgcgacgcttgcgtggcggctgggtttagggttcaaaaacagctcatcactttggacggtaatagctctcacggtgtttattgttaccattttgtggttacttacgctgctggtattgttaacaagaaaggacctgagagtgatgatgctttgtcttgtctcttctctttgagtttgagatctccattgaactcaaagaagaaaagacacacggtggctcttgctttagggataaccggagctattttcggggctctggttattgccggtttgatttgtttgtatttccggtttggtaaagctgttaaaggaggagaggttggttgggaggatcaagggtctagaccgaaatggagaccaaacactggctctatctggttcaaaatcgaggaactagagaaagctacgaataacttctcgcagaagaatttcatcggtcgaggcgggtttggttttgtttacaaaggggttttaccagatggatcggttatcgcggttaagaaggtgatagagtctgagtttcaaggggatgcagagtttcgtaatgaggttgagatcattagcaatttgaaacataggaatcttgttccgcttagaggttgtagtatggtggatgatgatagtgagagtcagagatatcttgtttatgattacatgtctaatggaaatctcgatgatcacttgtttcctcgaggtgagactacgaagatgccattgagctggcctcagagaaagagcatcattttggatgtggctaaagggttggcttatttgcattacggtgtgaaacccgctatttatcaccgggatattaaaggtacgaacatattgttagatgtcgatatgagagcgagagttgcggatttcggtttagctaaacagagtagagaaggagagtctcatctcactaccagagttgcgggaacacacggttacttggctccagagtatgccctctatggtcaattaaccgagaaaagcgatgtgtatagcttcggggttgttatattggagatcatgtgtggaaggaaagctcttgatctgtctacttctggatcaccaaacacttttctgatcacagattgggcttggtcattggtaaaagcagggaaaacagaggaagctcttgagcagtctttgttgagagaggaaggctcagggctctcgaatccgaaagggataatggagagattcttgcaagttgggatattgtgtgcccatgtattggttgctttaaggccaacaatattagatgcattgaaaatgcttgaaggagacatcgaggttcctcctattccggaccgaccagtcccgctcgcgcatccttcgtaccgtatggacggaaacggattcacaatatcgcctgcgcttagcggactacaaatacattccggagatatgctcagatgaggcgcgcc

SEQ ID NO: 272 - DNA, 792 bp, Arabidopsis thaliana
tgtaagttcttattagatcaacaagaacttatttttttggtaagaggaaacaaaattaagatggttttggaagatgagatgaagaaaggtgaagcgtcaggagagacatcagagaaaatggggttaagcagaaagaacagtgggagctctttgtctccgacagaggatgatgaagaagatgaagacaagaagctcgaactcggtcccatgatcgctctcaaagaacaactcgagagagacaaggatgatgaaagcctgaggagatggaaggaacagcttcttggcgtcgtggatttggaggatgtcggagaaacaccggatccagtagtaaagatactagatctcacaattagatcaccagacagagaggaaatggtattgacaatacccgaagatgggttgccaaacccgaaaggcccttggtttacgataaaggaaggttctaaatacacacttgtcttcaacttccgtgtcacaaacaatatcgtttcgggccttcgctataacaataccgtgtggaaaaccggtgttaaagtggatagtacaaaagcaatgcttgggacgtttagtcctcaagctgagtcttaccaacatgtaatgcctgaagaaatgacaccgtctggtatgtttgctagaggatcctattccgcaagaactaagttcatcgatgacgataacaaatgctacttggagatcaactacaccttcgacatccgcaagagttggcaatgatccaccgtatatacattctcccaaagtctaaatcaatgctcgtttgaatatttgatcatc

SEQ ID NO: 273 - DNA, 2069 bp, Arabidopsis thaliana
ttaattaaatggctgtttcagttagtaagcagtacatgacaagtcttgtagtgatcttgctcttcatctccttatcatctctctctccaacttcaacttcacacagctgtgaccctgtcgaagaagaagaagaagcctcctccttcggttacgtttgccactcaaacctccaaaagtgccacactttcgccattctcagagccaaacctcccttctattccctctcggacctgagtcgccatcttggtctcgacgcagacgacgagtatgttccgaaaggtcagttactcttgatcccaatagagtgcaggtgtaatggaagcatctacgaggccagtctcattaaaaattgcgttaaaggagacacctttcgctctgtctctcagtctctgcaaggcttgaccacctgcctgtgagagccaaacactttttccaattaagttgtctatgactgaaatttgtttttgtttatcgattcagtactgctatattcactgcagatctatcagagagaagaatccacatatttccgaagacaagcttggcgacaacattaaactgcgtttggcgatcaggtgctcttgtccacaagaaggcgtttcaaacgctagttttctcgttacgtatccggtgggcgtccgcgacagcgtttcaagcctggcggttaggtttaacacaacagaggatgccattgtctctgcaaacaacaaatctggtgtggttccactcaagcctgctctcatccctcttgatcacaaaccagagaaacaaggatcccggaaaagaaatccatccaagaagaaacggtcaaagatgaagctcatgatcgctgtgagcagcgcgattgctggagtttgcggtcttgtcactctcatggtgtttggttacttacactggaagaaagagacgcagattcaaacgcaaacgcaaaagtggattagcaacaaagaccccgagacgcggcagctgagtctgagcatccgaaccacgagtgacaagaaaatctcgtttgaagggtcgcaggacggttccatcttggattctcacaacaccgtcggcaccacaacgccccgaaaacccgttctggagatttacgcgtttgaagagttagagaaggccacggagaatttcagttcaagcaatcacatcaaaggttcggtttatttcggttcgctcaaaggcaaagacttggctataaagcaagtcaatgcagatgaaatgaaaagattcgatttcgggcttctcaatgatcagtcacactactataaccacaatgtgattagggttcttggaacatgttttagagaaatcgatcaagattcttatctggttttcgagtatgcaaggaatgggtccctgtgggattggattcagaacaaattggccatcaagaatcaattcatcgagtcttgttactgtttcttggcatggaaacagaggatcaagatatgtcacgatgtcgccatcgcgttaaagtatatgcatcggatcaactacgtccacggcaacatcaagagcagaaacatcttcttgaacgaagatctcagaggtaaagtcggaaactttgggatgtcaaagtgcgtaaccaatgaattagccacagaagagaaccttatagagagttcactgtctccagcttctgacatatttgcttacgggataatcgtaatggaggttttgtctggacaaaccccagatatgttgcttggattgcaagaagtagagacaacatcccttgggacacaagaaacttttgtttccgaatggagtagattaagaaggcttctcggggacaaggaaaagctgagggaagtgatggacagcacattgggagagagctattcggttgattctgcgtttgaaatcgcaagtattgcaagagattgtactgcagaagaagccgagtcaaggccgagcgcggttgagattgcagagagggtttcaagattggtggatgacgatgaagatgaagaagatgaggcagtaatagatagagagagtaccttaatttcagagagttcatacaagcctttggtaaagaagagtagtataatagattaaggcgcgcc

SEQ ID NO: 274 - DNA, 1733 bp, Arabidopsis thaliana
ttaattaaatgtcggagagtttcaaagtgtgcttctgttgcagcagaagctttaaggagaaaacgaggcagccaccagtgagcatcaagagactcttcgaagcttactcaagaaacggcaagatgtctttcgatgagcttctaagatttgtgagtgaagtccaaggagaacggcacgcagggttggactacgtgcaagatatcttccacagcgttaaacaccacaacgtttttcatcaccatggacttgttcatctcaacgccttctatcgctacctcttcagcgataccaactctcctcttcccatgtctggccaggtgcatcatgacatgaaggcgccgttatcgcattactttgtgtacacgggacataactcttacttgactgggaaccaagtgaacagcagaagcagcgtagaaccgatcgtgcaggctctcagaaaaggcgtaaaagtgatcgagctcgacttatggcctaatccttcagggaacgctgctgaagttcgtcatggcaggacgcttacttcgcatgaagatttgcagaaatgtctaaccgccattaaggataacgcgtttcatgtgtctgactatccagtcatcatcactctcgaagatcatttgccacccaagcttcaagcgcaagttgctaagatgttaactaaaacatacagagggatgctgtttcgtcgtgtctcagagagttttaagcattttccatcaccagaagaacttaaggggaagatcctgatctctacgaagcctccaaaggagtatcttgagagcaaaactgtacacaccacaagaactccaacggttaaagagacttcgtggaacagagtagcgaacaagattcttgaagaatataaagatatggagagtgaagctgtaggatatagagacttgatagcaatccacgctgcaaactgcaaagatccttcaaaggattgcttgagtgatgatccagagaagcctatacgggtcagcatggacgagcagtggctagacactatggttaggaccagaggaacggatcttgtcaggtttacacagaggaatctggtgaggatatatccaaagggcacaagagtggactcgtcaaactacgatcctcatgttgggtggacacacggtgctcaaatggttgcttttaacatgcaaggacatgggaagcaactatggataatgcaaggaatgttcagggggaatggtggatgtgggtacgttaaaaagcctcgcatcttgctagacgagcacacactcttcgacccttgcaaaaggtttcccattaagaccactcttaaggttaagatttacactggcgaaggatgggatttggatttccatcatacacactttgatcaatactctcctccagatttcttcgtcaagattggaatagcaggagtaccgagagacacggtctcatacagaacggaaacagctgtcgatcagtggtttcctatatggggcaacgacgagttcctgtttcagctgtctgttccagaactggcgcttctgtggttcaaagtccaagactacgacaatgacacccagaatgatttcgcaggacagacatgtcttcctctgccggaactgaagtccggagttagagccgtccggcttcacgatcgaacaggcaaggcctacaagaacacgaggcttctcgtcagcttcgccttggatcctccttatacgtttcgttgaatctcgttttctttccgaaataggcgcgcc

SEQ ID NO: 275 - DNA, 900 bp, Arabidopsis thaliana
ttaattaaatgcgactagtctccagaattatgtgttcgatttcgctggtgttaattatgtcggagattttctcccgactctgaagctctttgatcttgatggatacagaaagagagcaaagaaactcgcttcgaaattggacaagtttatgcagaaattagtcgacgagcatcggaaaaacagaggaaaagcagagcttgagaaaacgatgatcactcgtttgctgtctcttcaagaatcagaacctgaatgttacactgatgatatcatcaaagggctcgtacaggtgatgttgcttgctggaacggacacaaccgcagtgacgttggagtgggctatggctaaccttctaaatcatccggaagttttaaggaaactcaaaacggaactaaacgaggtttcgaaagaagggcgtgtgtttgaggaatcagatactggcaagtgtccctatctcaacaatgtgatctctgagactcttcgtttgtttccggcggcgcccttacttgtcccacacgcttcatccactgactgtgaagtcgctggatttgacattccacgtcgcacctggctatttatcaatgcgtgggctattcagagagacccaaatgtatgggatgacccagaaactttcaaaccagagaggtttgaatcagagacccatcgtggtaagtttctgcctttcggaatcggtaggagagcatgtcctggtatgggcctggcccaactagtactgagcttagctttaggctcattgatccagtgtttcgattgggagagagacaatgacgttgccgttgacatgtcggaaggaaagggtcttaccatgcccaaatctgtgcctttagttgccaaatgcaagtctttaccaatcctcgacaaacttgttctttaaggcgcgcc

SEQ ID NO: 276 - DNA, 1539 bp, Arabidopsis thaliana
ttaattaactaaaaatggcgatgctaggtttttacgtaacgttcattttctttcttgtatgcctatttacttatttcttcctccaaaagaaacctcaaggtcagcctattctcaagaactggccgttcctcaggatgcttccaggaatgctccaccaaatccctcgtatctacgactggaccgtcgaggtgcttgaggcgaccaatctaactttttatttcaaagggccatggcttagtggaacggacatgttgttcaccgccgatccaaggaatattcatcacatactaagctcaaactttgggaattaccctaaaggacctgagttcaagaagatctttgatgttttgggagaaggaatcttaaccgttgattttgagttgtgggaggagatgaggaagtcaaatcacgccctattccacaatcaagatttcatcgagctctcagtaagtagcaataaaagtaagttaaaagaaggtcttgttccttttcttgataatgctgctcagaaaaacattatcatagaattacaagatgtgttccagagattcatgtttgatacttcttcaattttgatgactggttacgatccaatgtcactatccatcgaaatgctggaagttgagttcggtgaagctgcggatattggcgaagaagcaatctattatagacatttcaaaccggtgatcttgtggaggcttcaaaactggattggtattgggcttgagaggaagatgagaacagctttggccactgtcaatcgtatgtttgcgaagatcatatcttcaagaagaaaagaggagataagtcgcgccaaaacggagccatattccaaggacgcgttgacgtattatatgaatgtggacacgagcaaatataagctcttgaaacctaataaagataagtttataagagatgttatttttagtctagtgttagcaggaagggacaccacaagctcagttctcacttggttcttttggcttctttctaagcatcctcaagttatggccaagctcagacatgagatcaacacaaagtttgataatgaagatctagagaagctcgtgtatctgcatgctgcattgtccgaatcaatgagactctacccgccacttcccttcaaccacaagtctcctgcgaagccagatgtacttccaagcgggcacaaagttgatgcaaattcaaagatcgtgatatgtatctatgcattggggaggatgagatctgtatggggagaagacgcattggatttcaaaccagagagatggatttcagacaatggaggtctaagacatgaaccttcatacaagttcatggcttttaattctggtccgagaacttgcttgggtaaaaatctagctctcttgcagatgaagatggtagctctggagatcatacgaaactatgactttaaggtcattgaaggtcacaaggtcgaaccaattccttctatccttctccgtatgaaacatggtcttaaagtcacagtcacaaagaagatatgattattatgcttgcttggcttctaggcgcgcc

SEQ ID NO: 277 - DNA, 1966 bp, Arabidopsis thaliana
ttaattaaatgtcgttgtgtttggttatagcttgtatggtaacatcatggatcttcttacaccgatggggacaaagaaacaagagtggtccaaagacttggcctttggttggagcagcgatcgaacagttaactaattttgatcgaatgcatgattggctcgttgagtatctttataactcaagaacagtagtggttccaatgccattcactacttatacatacatagctgatcccatcaacgttgaatatgtcctgaaaacaaacttctccaattaccccaaggtgaaaaaagctctttatatcaatatcatgtatatgttttgttgtgactttgattttttgttgtatatcagggagagacttatcattcttatatggaagtattgttgggagatgggattttcaattctgatggagagctttggaggaaacagagaaaaaccgcgagtttcgaatttgcttccaagaatcttagagattttagtactgtagtgtttaaagagtatagtcttaaactcttcactatcctttcccaagcatctttcaaagagcaacaagtagatatgcaggtaagaatctattaatcactaaagtctacaaacttagtttctcttacataacatcctttttttggctctaggaattgttgatgagaatgactttggattcaatatgtaaagtgggatttggtgtggagatagggacattggctccagagttaccagagaatcactttgctaaggcttttgataccgcaaatataatcgtaacacttcgtttcatagatcctctttggaagatgaaaaagttccttaacataggctctgaggcattgcttggtaaaagcataaaagtagtcaatgatttcacctattcagtcataagaagaaggaaagcagagttattagaggcacaaatatctcctaccaacaacaacaacaacaacaacaacaaggtgataaacttgttatacaactcaaaaatgtaaatatatgcacttgtcacattagtaacatttttattctcatatgtaactaggtgaagcacgatatactctcgaggtttatcgagatcagtgacgatccagatagcaaagaaacagagaaaagcctaagagatattgtcctcaactttgtaatagctggaagagatacaacagcaacaactctcacttgggctatatacatgataatgatgaatgaaaatgttgctgagaaactatactcagagctacaagaactcgaaaaagaaagcgcggaagcgactaatacatcgttgcatcaatacgatacagaggatttcaattccttcaacgagaaggtaacagaattcgcaggactattgaactacgattccttaggaaaacttcactacttacatgctgtgatcacagaaacacttcgtctctaccctgccgttcctcaggtaagtaaaaatccattaaatttgtgaattgagatatcgaaacgaagaaaagaaaaaatcgtatattcgatattcgtaggatccgaaaggagtattagaagatgatatgttaccaaatgggacaaaagtaaaagctggagggatggtcacatatgtaccttactcaatgggtcgtatggaatacaattggggatcagatgcagcattgtttaaacccgaaagatggcttaaagatggagtctttcaaaatgcatcaccattcaagttcacagcttttcaggtaactataatcaaacacatacaagatttttgtttttgaacatgaaagatgatgagtttgtgtgagtgtaggctggaccaaggatatgtttgggaaaggattcagcttatctgcaaatgaagatggcaatggcaatactttgcagattctataagtttcatttggtgccaaatcatcctgtcaagtatcggatgatgacgatcttatccatggctcatggcttgaaggttactgtatccagacgttcatagggcgcgcc

SEQ ID NO: 278 - DNA, 2186 bp, Arabidopsis thaliana
ttaattaaggattataaagcagaaccaacgagctccaatggtggtggcgacgactatagcactttacgcgagtccaccaagcagcgtttgttccacgccacatcagatctcatgtgatctcgatctcacctccaggagttcgtcaacatcctcttccatggcttcctcgccgcagaaaccaatcgttggaggtctctcttcacttttctccagcgcatcagtcaaatcttcatcttcttcctcttgctcatactcaaccggagtagatgagttctcttcactacgctatgatcggagtgatgatttgaaagatctgagctttagcagctcctttggttattctccggcgaaatttgtgaattcatttagacgagatcaccaaagccctatctctgtgcttcatggtccggtctcgtgtagttgtagccctccgatgagaatgtctcgtgatcggaatctagatggttcgtttcgtttaggagctagtggattgttcaatggtttcgttaggaaagctcttggatcatgtgttgattacgagttcggatcggattctgttctcgttgatgagctaacgtttcctatggaggttgatacgataaagccatatgctagggatttgctaagacgtgcacaattgagacacaagattttcaatgatgaatctgtgatcaaagctttttatgaagcagagaaagctcatagaggacaaatgagagctagtcgtgatccttaccttcagcattgtgttgagactgctatgttgttggctaatatcggagctaactcaactgttgttgttgctggccttcttcatgataccattgacgattctttcatgagctatgattatattctcagaaacttcggagcaggagttgctgatttggttgaaggggtttcgaagcttagccaattgagcaaactcgctagagagaacaatacggcgtgtaaaactgttgaagcagatcgtttgcacacaatgtttcttgcaatggcagatgcaagagctgttcttataaaactggctgatcgattacacaacatgaagacgctttacgctttgtccccagtgaagcagcagaggtttgctaaagagacgttggaaatatttgcacctttggctaatcgtttgggaatctctacctggaaagttcagcttgaaaatctttgtttcaaacatctttacccaaaccagcataatgagatgtcaaccatgctcgaggattcattcgatgaagccatgattacttctgcaatagagaaattggagcaagctcttaagaaagcaggcatttcttatcatgttctttgtggccggcacaagagcttgtatagtatttacagcaagatgttaaagaaaaagctaacagtggatgaaattcatgacattcatgggttatgtttgattgttgacaacgaaggagattgttacaaggccttaggagtagttcatagtttatggtctgaagttcctggaaagctgaaggattacataactcatcccaaattcaacgggtatcaatctttgcacacggtagtgatggacaatggaacagttccacttgaagtccaaatacgtacacaggagatgcatttgcaagcagaatttgggtttgcagctcattggagatacaaggaaggtggctgcaaatactcttcgtttgtgcttcagatggttgaatgggctcggtgggtcgtaacctggcattgcgaagcaatgagcaaagaccgatcttccataagttcttcagattccatcaaacccccttgcaagtttccgtctcactctgaggactgcccagcttcttacaagcctaacagtagccaggatggaccagtctatgtcattgtaatcgaaaatgataagatgtctgtgcaagaatttccagcgagttcaacagtctcggatctgctgagccgggcggggccagggagctcgaggtggtccatgtatggcataccagcaaaggaagaactaaggccaagactgaaccaaatacctgtaagtgacctcaagtggaagctgaagatgggtgatgtggtggagctgactccaacaattcctgatgagtctctgactgaatacagagaagagattcaacgcatgtatgatcgaggactcgcgttttcccgccccggaaccatggtcggatggggaagctgatgggtcctcaaattgttaa

SEQ ID NO: 279 - DNA, 1548 bp, Arabidopsis thaliana
ttaattaaatggcttacgtaggcttagttgaagtctttattgccttacttgtctttttcttcttccatttcttgatccacaagaaatctcatcaaatcacacctagaaactggccagttcttgggatgcttcctggtgtccttgtcatgcttcacaggatcaatgactatgtcgcggagattcttgaggtctccaacttgacatttgccttcaaaggcccatggttctctggaatgaacatgttgatcactgcagatccttcaaatattcaacacgttttcagctccaacttctccaattacgacaaaggaccggagttcaaagagatgtttgattttctaggaaatgggatcttcactgctgactccaaactatgggaggatatgaggaaatccgcattggttgtgcttagccatcaagggtttcaaagcttctcattgaggaccatcacgtgtaaaatcaagaacgggcttgtccccgttcttgatcattttgcggaggctaatacggttttcgatttacaagacgtgttccagaggttagcattcgatgtaacccttactctggttacgggttgtgactcaagttctctttccattgaaatgccaaagaatgagtatgctaaagctatggatgatgctgaagaagtggttgtgtacagacatgtcaagcctgtggtcttgtggaagctgcaaaactggattggactcggagaagagaagaagatgaaggaagctaatgccgcttttgacagatcttgtgcaaagtatatatctgcaaagagggaggagataataagtcatcattctaatattggaggagaagctcatgcagaggatttattaagcgtctacatgaatctagatatttccaagtatgagcttttgaacccaaacgatgataacttccttaaagacatcatcaagagtttcatgcttgctggaagagacgccattgcaacaactctcacttggttcttctggcttctctccaagaaccctgaagctgtgaccaagatccgccaagagatcaacacaaatctaccaggatccggaatgagtttagatgcagacaagttaaacaagatggtatatttacatggtgcattgtgtgaatcactacgcctctacgcgccaatcccgttcgagagaaagactcccataaagcaagatgtgcttccaagtggacacatggtcgataaaaattggaagattttgttctctgtctatgcattggggaggatgaggtccgtgtggggacaggacgcgtctgaattcaaaccagagagatggatctctgagagaaatggaggcttgaaacatgaaccatctttcaagttcttcgtgtttaattctggtccaagaaactgcttggggaaaaatttatctttcttgcagatgaagacagtagctgttgagatcatacgaaattatgacatcaaggtcgttgaagggcacaagatcgagccagcttcttccataatccttcacatgaaacatggccttaaagtcacagtttctaagagaggcttggtttcataaggcgcgc

SEQ ID NO: 280 - DNA, 652 bp, Arabidopsis thaliana
ttaattaaattttgcttcatcgtcttcgtcatcgtctctctgttgaattcctcaaacaatgcctctttctctccgtctttctccttcgccgacggctttatctccgactaccggaggatttggtccatcgaggaaacagtgccggattccttactccggcgtcccgacgacgaagattggtttctgttctttggattctaggaaaagaggagattcctctgttgttaggtgtagcttagaaaccgttaatgtcagtgttggtcaggtgacggaggtcgataaggacacgttctggcccatcgttaaagccgccggtgaaaagcttgtcgtacttgacatgtacactcaatggtgtggtccatgtaaagtgattgcccctaaatacaaagctttatcagagaagtacgacgacgttgtgtttctaaagcttgactgcaatccagataaccggccattggcaaaagagctaggaataagagtggttccaactttcaagattttgaaggataacaaggttgtcaaggaagtgaccggtgcaaaatacgatgatctggttgcagcgattgaaacagcgaggtctgctgcttccggatgaaccagtctctcatgtctttaccataattgtttgtatgtaatgtgaaatcggcgcgcc

SEQ ID NO: 281 - DNA, 999 bp, Arabidopsis thaliana
ttttttcttttggcaggattttgtgttgaactcacgaggcatgaagttgttcacttgtgtatggaaaccagtgaagcaagaaccaaaggcattgctcttcctctgccatggctacgctatggagtccagcatcaccatgaacagttcagcgcagccacgaggttagccaatgccggttttgccgtatatggaatggactatgaaggacatggaaaatctgagggtctaaatggttacatcagtaactttgatgatctcgttgatgatgtctctaatcattattctacaatttgtgagagggaagagaacaaggggaagatgaggttcctacttggagaatccatgggaggagcagttgtgttgctcttagccagaaagaagcctgatttttgggacggtgccgttttggtagcacccatgtgtaagttagcagacgagataaagccacatccagtagtgatctcaatccttatcaagttagccaagtttattccaacgtggaaaatagttccaggaaatgatattattgacattgcaattaaagaacctcacatcagaaatcaggtgagggagaacaagtattgctataaaggccggcctcgcctcaacaccgcctaccaactcttgttggttagcttagatcttgagaagaatcttcaccaggtatcaattcctttcattgttcttcacggagaagatgataaagtgacggataaaagcataagcaaaatgttatacgaagtggcttcaagctcggacaagacattcaagctgtaccccaaaatgtggcatgctttgttgtatggggaaactaatgaaaattcagaaattgtgtttggtgatatcataaactggttggaagatagagccacagattcgaacggagggttagagagtcagctaaaacataagcatgatggattcttgaagcataaataagtgaacgatagcattgtttatgtacccttttttttgcagcggtttatgtacttgtgtagt

SEQ ID NO: 282 - DNA, 444 bp, Arabidopsis thaliana
ttaattaagatgaaccgtattggattgataaggggatcatcatccaaggatgtagtccggagaacgtttgcagcagcagctagtaaagccaagaaaggtggcaaaggaggtggagccagcgatgctcctaaaggttccagcttgaccaaagagatcaaatccaccactgttgttggtgccaatactctcaaagacggatctgatcccaagatcttgcctgattctgattaccctgattggctctggcatctcctcgataagcgaccagctctcagtgagcttaggaggaagaacgtcgagactcttccctacgatgatctcaaacgttttgtcaagctcgacacacggggtaaaatcaaggagaacaactccatcaaggccaaaaactgagagatgtaagatgttttcaactctctcactgttgctgttttctttgggcgcgcc

SEQ ID NO: 283 - DNA, 928 bp, Arabidopsis thaliana
ttaattaaatggtgacgaaaacggaggagatacagttaaaccaactcgagaatcaagttgagaatggaggaggaggtgtttgggagtatctgtgcctcgttcgtaagctcaaggttcgccgatcagagattgtgctcaagcatggtctctcgatcttgaacgattcgggaaagcgatccgctcttggtccagatgaatggaccctgtatgagcaggtagcaattgcagctatggactgtcaatctctcggtgttgcacagaattgcatcaaggttctaaagaagaaatttccggagagcaaacgtgttggcaagctggaggctctgctgctagaagcaaagggaatgtgggaagaggctgaaaaagcatatacaagccttttggaggataatccacttgatcaagtaattcacaaaagaaaggtggctatggccaaggcacaaggcaaatcttccttagccattgaacatctgaacaagtatcttgaagtattcatggctgatcatgatgcctggagagaacttgcagaaatttatgtttccttgcaaatgtacaagcaagcagctttctgctacgaggagctcatactaactcagcctactcttccattgtaccacttagcatatgccgatgttctctacacaataggtggactagaaaacctcatcgcagcaagaaagtactatgcagcaactatagacttgacaggtggtaaaagcacaagagcacttctcggaatatgcttgtgtggatcagcaatcgcacagatctcaaaaggcaggaacaaagaggacaaggacatggctgcaccagagcttcagtctttggctgcaactgcattggagcgagagtacaagcaaaaagctcccgctaagctcaacctcctcacttctgccttgagaaacttgaaaatcgcttagggcgcgcc

SEQ ID NO: 284 - DNA, 310 bp, Arabidopsis thaliana
ttaattaaatggcgattaacagatctttacttttgattcttcttttcatctctgtttctctatcgacggcgaggatcttacccggagagtttgttccagtcatcttctccggagagatccctcctgtttctaagtcggcggtggttggttgcggaggcgagcaggagaccaagacggaatattcttcttttgttcctgaagttgtcgccggaaagttcgggtccttggtgttgaatgctcttccgaaagggagtcgtccggggtctggacccagcaagaaaactaacgacgtcaagacttagggcgcgcc

SEQ ID NO: 285 - DNA, 954 bp, Arabidopsis thaliana
atggcaagtgaaacagagaacatcaagtatgaagagagtttcatcaagaacactcgaggaatgaaactgttcacgtgcaaatgggtaccagcaaagcaagagccaaaggctttagtctttatttgccatggatatgcaatggaatgtagcatcaccatgaacagtactgcgaggaggctggtgaaagcaggatttgcggtatatggaattgattacgaagggcatggaaaatctgatgggcttagtgcttatgtcccaaactttgaccatctcgttgatgatgtctctactcactacacaagcatttgcgagaaagaagagaataaagggaagatgaggttcttgttaggagaatcaatgggaggagcagtgcttttgttgttacacagaaagaagcctcagttttgggatggggctgtcttggttgctccaatgtgtaagattgctgaagaaatgaaaccaagccctttggtaatttcgatattggccaaacttagtggagtgataccttcgtggaaaatcatccctggccaagatatcattgagactgcttttaagcagccagaaatcaggaaacaggttagggaaaatccctactgctacaagggacgtccacgtttgaagactgcttatgagcttttgagggttagcaccgatctcgagaagaggcttaatgaggtttcattaccgttcatagttttgcacggtgaagacgataaagtcacagataaagcggtgagtcgacaactgtatgaagttgcatctagttcggacaagactttcaagttgtaccctgggatgtggcatggtttactctatggagagacaccagagaatatcgagactgtttttgctgacatcattggctggttggataagaaagttgctgatgaaagtggaggctttgaatccgagcttaaacgtaaaaatgatggtattcctttgaaagggtag

SEQ ID NO: 286 - DNA, 1333 bp, Arabidopsis thaliana
ttaattaagtgtctctcttactctatcttcttcccaagttcttgtcttttgatggccgaaaccctagaaccctccctcgtcggggaaatcgacacttctgcgcctttcgagtccgtgagagaagccgccactcgctttggtggatttggtttctggaaaccttcttcccttaacatctccgaagcttctcagaacgaagttggtatggttttgaaagcgagtgagttagagaaggaactgattgagaaagaaggagaaactttgaaggtgttgaagtcacttgagtcgaccaaagccattgttgaagagctcaaatcaaagatacagaacaaggaggataaagaaaattgtgacatgaatgttttcaaggaattgaaccaagcaaagatgaatctgtgcaagacgacaaaagatttggctgctattcgcgtgtctgttgggttactaaacaagagattggaagaggaaagagctgcacttgagaagacacgagagagactaaactctgagaatgcagctgaaatgtccatggagattcagagactaagttatgaagctaaggaatttagtagaacaggagagaatgttcggtatgcggttaataaagctgtggctgagattgaacaaacgagaaacaagattgaagctgctgagatgcgtttgatcgctgctagaaagatgaaggaagctgctagagcggctgaagcagttgcaatcgctgaaatcaaggcggttacaagaagaggaagaaggagaagaagaggaggaaatggtgaggagactatgcaggaggagattcttgagacgattgatgaaacagcaagagaaatcagaagcagtaggaggacacttgaagaaggtttggccaaaatggaagcagaagaaggaaattggtggtggacagaacagaggaggagatcatcatgttcggctaagttcaagaaccctccttatatgatggatgtaaaaggtctgaatatgatgatgaatggtgatgggacatcatcctcagttgctgtcttgaaaccaacaatgtctattgggcagatacttagtaggaaactacttcttgctgatgagtcagcgatgatgatgaatgggagagtttcgttgggtcagattcttggaaagactaactttggagatagagagaaggaaaaaaggttcaatgggaagaggaagcggttcggattcgcaaacttgtctgtgatgttaaataaagagagtaagaagaagaataagaagaagaagatagctttgaacttaagttgttaaaagagtgattgaaatggtctaatctttacattaggacttgttgtttgtgtggcgcgcc

SEQ ID NO: 287 - DNA, 734 bp, Arabidopsis thaliana
ttaattaacgaaacgacgcagtattaaggttactctctctcaaactctcgtctcctaaatgggtcttaccccaactgcaaccctactcgtcgctgttttcgcgttttgcctcgtcgctgtaacggcgcagttcgcctacgttttgtggtggaaacgtcggttccgtcgtcggagtatcgccggatcagaacgcgacgctttttcctctcgcggtggtgacctaacggctacaccaccgccatcgaaagagcttctttacttcttcttgttctgtctcgaaaacaaacagttcagaataggatctgccaccgctccgccgctccctgcagccgcaccgccggttaatgacgtggcatcaaagtggtcaataaacggagaaaatttactttgcggaccttcggagactttgtttaccatcgctgaagactatactagcgagtccgatcatcggacgggtgagattgatccacgtggaagcatctttacagaggatcatgtaaaggatgatgaagtggaagaggaggtagtcgcgacggatataagcgacgacgaggttgactttagccactataatcaaactacgccgttttctactccatgtgcttccccaccgttttacacgccgtctccttctccgattcgtgatgatctctctaagacggtacgtgaggagagtgtgtacggctgagataggtttagttctccgattagccggggatattgaccggcgcgcc

SEQ ID NO: 288 - DNA, 865 bp, Arabidopsis thaliana
ttaattaaatggtaaggaaaatgaaactcccatttctaaacaagaacacatcatcttcatcattttcttcaaattcatcatcttcttcctcttcgtggccatggccttcctctcatcaacaaaaccttaaaacaatatcttccaaagcttccttcatcgttaacaaacctaaagatgtctacgaacccgagccaccaccgagaagcttctcctcctccccctcctcctcctcctactcttccttctcctctacaagccatgctatagaaaatccaccagagatagagtctatagagaatgtgattaaaggactaaaatcatcgaagagactcatctttgaacggagaggaacatcgaactctatactcgaagaagctaccaagagagacgatcatgaagaagaagaggacggtttaatgctcttgtccttggagtcaaacgatccttacactgatttcaagaactcaatggaaaagatggttgaagtacacgtgcttcatcatgactggataagcctggagaaacttctcttttggttcttgaaagtcaacgtcaaggcaagccatagatacatcttcgccgcctttgtcgatttggtcttaaacttagcagtagggccttctaaagatgttgctggagaacctaattccgacgtcgtcgtggaggattctctttcatcttcgtggccggtctcgttgtactcgtcctccgatgagaattcgtcgacgtccgtacgattcttgccggagacttcgataggcgagaagggtagagacgtttgttgtttatcgtcgttgtttgagttagaagaaaagattaaagacaatattgatccaaatgattatgtatcttcttaaggcgcgcc

SEQ ID NO: 289 - DNA, 924 bp, Arabidopsis thaliana
atgtcggtgacatcaacggtggaggagaaccaccagaaaaatccatcaacgccggcggcggtggaggagaagaagaagaggagatgggtgttttgggatagaaggtggaggagattagattatgtgaaattctcagcttctttcactgttcattctcttgctctcttggctccgttttatttcacttggtcggctctttgggttacgtttttgttttacaccatcggtggtcttggtatcaccgtctcttatcatcgcaacttggctcaccggagtttcaaagtccctaaatggcttgagtatctcttagcctattgtgcccttctcgctattcagggagatccgattgattgggtgagtacacatcgttaccatcaccagttcacggattcagaacgtgatccacatagtcctaaggaaggtttttggtttagtcatcttctttggatctatgactctgcctatcttgtttcaaagtgtggaagaagagcaaacgtggaggatttgaagaggcaatggttttataggtttcttcagaaaacagtgctatttcacattttaggattgggtttctttctcttctaccttggtggcatgtccttcgttacttggggaatgggggtaggagcagcattggaagtgcacgtgacttgcctcataaattcactctgccatatttggggcactcgaacttggaagaccaatgacacttctcgtaatgtttggtggttatcggtattttcatttggagagagttggcacaacaatcatcatgcgttcgagtcatcggctagacaaggacttgaatggtggcaaatagacatttcgtggtacattgttcggtttttcgaaattatcggtttagcgaccgatgtgaaagtgccaacggaggctcaacgacgtcgtatggctatagttcgttga

SEQ ID NO: 290 - DNA, 2065 bp, Arabidopsis thaliana
gtttcttgtttgttgattaacccttaattaaactgatctattcactcactcaaatcgccgccggagctaaatcaatcaacaatgacgtcgacctacacgagattcgataccgtatttctcttttctaggttcgccggcgctaagtattcgccgttattgccgtctccgtcgtttactttatctacttccggcattcatatcagaaccaaaccgaattctcgttttcactcgattatagcatcctcctcatcttcatctgtagtcgccggaactgatagcattgagattaaatcgttgccgacgaagcctattgaaggacaaaagactggaactagcggactccggaagaaggtgaaagttttcatggaagataattatttagccaactggattcaggcattgtttaattcattgccacttgaggattataagaatgcaacgttggttttaggaggtgatggtcgttactttaacaaagaagcttcacagatcattatcaaaattgctgctgggaatggagttggacaaattttagttggaaaggaaggcattttgtcaaccccagcggtttccgctgtaatcaggaaaagaaaggcaaatggaggattcattatgagtgcaagccataatcctggtggacctgaatatgactggggtatcaagttcaattacagcagtggtcagcctgctcctgaaaccattactgacaaaatatatggaaatacactttcaatctctgagattaaggtggcagagattcctgatattgatctttctcaagttggagtgaccaaatatgggaatttcagtgtagaagttatagatcctgtttccgactatttggagctcatggaggatgttttcgactttgatctcatcagaggtcttctttcaagatcagattttgggttcatgtttgatgccatgcatgctgttactggtgcttatgcgaaaccaatttttgtcgacaatcttggagccaaaccggattcaatttccaacggagttcccctggaagattttgggcatggccatcctgatcctaatttgacatatgcaaaggatttggttgatgtcatgtatcgtgacaatggaccggatttcggagcagcaagtgatggtgatggtgacagaaatatggttttaggaaacaaattctttgtcactccttcagactctgtagctatcatcgcagccaatgcacaagaagcaattccatatttccgtgctggtcctaaggggctggcacgttctatgccgacaagtggtgctcttgatcgtgttgccgagaagttgaagcttcctttcttcgaggttcccactggatggaaattttttggaaatcttatggatgctggaaaattgtcaatctgtggagaagagagctttggcacaggttctgatcacatccgtgagaaggatggaatatgggctgtgttggcgtggctttcgatccttgctcatcgcaacaaggacacgaaaccaggggacaagttggtgtctgttgcagatgttgtgaaagagtattgggcgacatacggaaggaactttttttcaagatacgactatgaagaatgtgaatctgaaggagccaataaaatgatcgagtatcttagagaaatcttgtctaagagcaaggccggtgacgtttatggaaactatgtcctccagtttgcagatgacttctcatacacagaccctgttgatggaagtgttgcatccaagcaaggtgttcggtttgtgttcacggatggatccagaatcatatttcgtttatccggaactggctcagctggagctacagtgcgaatatacattgaacaatttgagccagacgtttcaaaacatgatgtggatgcacaaatagctcttaaacctttaatcgatcttgcattgtctgtatcaaagctgaaggacttcacagggagggagaagcccactgtcattacatgaagagaagtgtcacatggtcctttcgataaggcaatttgggttccatttaaatacccagcttctaaattggagctctgcagagctttcgttcgtatcatcggtttcgacaacg

SEQ ID NO: 291 - DNA, 1709 bp, Arabidopsis thaliana
ttgttgattaacccttaattaactctcactttgagggtgaattttgattttgtagaaaatggattcgaaggagatggttgtggaagaaatcatgagaattcacagatctctaccattgagaccagagatcgacgatgtagaaacggcaacttctctgatacaaaacgttgaaaaggaagatcggaatcgtttagaagccattgataaacttgttaaaacctcttcctctgaggttcctttagagcttttcaatgtgttcaaggagatgaagaaaagtcttgttcgtttccagagcacagaacagacaagagaagctacgaaaattctcgatctggaatctgtacacgttgtgttcgacgaattgattcagagagcttctttttgcattgcttctcccaacagcaccaccgctttgcctcggtctgttccggtaccggcgccggttgtttcttctgatgagattcctttcaagtcaaaggaaattatctcgcgtgacgatacgtttgtgaagaaagctaaatcttcgttttatagtgatgggttgttagctcctagtaagccccaggttctggattcaacacttcatcaggctaagaacgttgcaggcaatgatggggagaagttgagtctcataaaacttgctagtttgattgaggtatctgccaagaaagctactcaagagctaaatttgcagcacaggctgatggatcagctcgaatggcttccggattctctaggcaagttatcgagtcttgtcaggctagatctgtctgagaattgtatcatggtactaccggcaaccataggagggcttatttctttgacgaggcttgatttgcattcgaatagaattggtcagctccctgagtctataggagatttgctaaacttggtcaacctgaatcttagtggaaaccaattatcatctcttccatcgtcatttaatagattgatacatcttgaggaacttgatttgagctctaacagcctctctattctccctgaatctattggttctctcgtgagcctaaagaagctcgatgttgaaacaaataacatcgaagagattccacatagtatctctggctgttcttccatggaagaactccgtgcagattacaacagacttaaagctcttccagaagctgttgggaagttatctaccttagagattctgactgtccgttataataacattcggcagctacccacaacaatgtcctccatggctaacctcaaagagctagatgtgagtttcaacgagcttgagtcagtaccagagagtttatgttatgccaaaacacttgttaagcttaacatcgggaacaattttgccaacctaagatcactcccgggattaataggcaaccttgagaagctagaagagcttgatatgagcaataaccagatccgtttccttccctactcttttaaaacgctttcaaatctgcgtgttcttcaaacagaacaaaatccacttgaagagcttccaagggatataaccgaaaaaggcgcacaggccgtggttcaatacatgaatgatcttgtggaggcaagaaacaccaaatctcaaagaactaagccgaaaaagagttgggttaacagtatttgcttcttctgcaagtcctctaccaactagagaaaacagagcagcatggagatcctctaaaccactcatttaaatacccagctttctaaattggagctct

SEQ ID NO: 292 - DNA, 1946 bp, Arabidopsis thaliana
tgtttcttgtttgttgattaacccttaattaacaaagaacaaaaacaaaaatggatatctccgccttgtttctcactctcttcgccggaagtctcttcctttactttctccggtgtctaatctctcagcgccgctttggatcttccaaactcccactccctccgggaacaatgggttggccttacgtcggagaaactttccagctttactctcaagaccctaatgtctttttccaatcaaaacagaaaaggtcagtgctttaagaaccgaaaatttataaaaatcgaaatttttgaaagaaatttgatgatgttttatgacaggtatggatcggtgtttaagactcatgtattgggatgtccatgtgtgatgatctcgagtccagaggctgctaagttcgtgctggtgacgaaatctcatctctttaaaccaacttttccggcgagtaaagagaggatgttggggaaacaagccatcttcttccaccagggtgattatcacgctaaactcaggaagcttgttcttcgtgcttttatgcctgaatctatcagaaacatggttcctgatattgaatccatcgctcaagactctctccgaagttgggagggaacaatgatcaacacttaccaagaaatgaaaacagtaagctcctctgttttgtttttcctctgctagaaacagagctacacacataattcccctgtttttgaaaacagagcataacgttactttcctctgttttgatctttttttgtttgatcagtacaccttcaacgttgcgttgctatcgatcttcggaaaagacgaggttttatacagagaagatctaaaacgatgctactacattctcgagaaaggttacaattcgatgccagtgaatctccctggaacacttttccacaaatcaatgaaagctcggaaggaactctcacagatcctcgctagaatcttatcagagagaagacagaacggttcctcacacaacgatcttctcggatcattcatgggagacaaagaagagctaaccgacgaacagatcgccgacaacataatcggagtaatcttcgccgctagagacacgacggcgagtgtgatgtcgtggatcctcaagtacctagccgagaatcccaacgttctagaagccgttactgtaagtacatatacggacacgtatttgtcgtcttttggtaatataaaaaacagagaagtggcagtttcgtagttttgtttgtgttcttatgggtaattttggtattttaaacaggaagaacaaatggcaataaggaaagacaaagaagaaggagagtctctaacttggggagatacaaagaagatgccattaacttcaagagttattcaagaaacattaagagtcgcttcaatcttatctttcacattcagagaagctgtcgaagatgtcgaatacgaaggtactaaacatacacaattaaaccgataaatgatgacgatctcgagtcgaaattcgaactaacattctatggttttacaggatatttgatacctaaaggatggaaagtgttacccctattcagaaacattcatcatagtgctgatattttttctaatccggggaaatttgatccatcaagattcgaggtaattatcatttgtttgatagtttgtagtactgtttttaatgttttggagtatgatgttatatttaacatgatttggttgctaatataggtggctccaaaacccaatacgttcatgccatttggcaatggaacccactcgtgtcctggaaatgaattagccaagcttgagatgtctattatgattcatcatctcaccaccaagtacaggtgtgtgtgtgtgtactacttacttattaccttctctttcactcattttgttcttttctttcaaatttatgtgtagaattgtctttgataaggggggcgcgccaaaaattgagctctgca

SEQ ID NO: 293 - DNA, 3085 bp, Arabidopsis thaliana
tctcaactctcaagctcctctctttttcttccttctgcaacaacaacaactgttactgatctctctctctctctcccaagtttttattttttaattaagggagatcgagatcagctagacatggctcctgccatgaagatcgtcttcggtctcttgacatttgtcactgtcggaatggtcatcggtactttctctctatttatagtcctctacatttgatttttaattttggtcttcaaagtttatatctttttttttgttttctctcggccaaattgactctgtgagaaattgaaacggctctttcgtaaactcatggagattgtgtttctcttttgttcctggaatctgcaggttccttgttacaattggcctttattaatagattggaagattcgtacggtaactcctctttctttcttattttcttcatttatacttgtagatgtgtctttggtgatagaattgcaaatataggtatctgagctcttgagcaagggattgagaggacattgcactacaatgtcaacgaattcgtaggactagatcagggattttgattgtagtttatgcttactacaatgaagagatgatccccttttggattttctattgcttgttttgttgttgtggtgtccttttgatttctaaattctttctccttcttattcaggaactggatttccgtctctaagaggacttcgaggacagaacacccgctatctacgaggttggtgtgatcatttctatccaaaactatgcttgcatttaggttgttaacataatagtctctttctaactatttgaatctcggctttatgacaagactcttcttatagagcttgatttgtggacatgttatgataccgaatcgattaatggcaagacttgtttattttcagatgtctcccggtgggcaaatgacaaagatgcagaattgttacggattggcaatgtaagtatatcgtatccattttgcagttgtttttttttcttagggcctatggttgcctaaaaatttcatttatatacctctacagttgaagaattggtacatggaggagaaaaattaaattgtttgtagtacggacacatttcttaaatatactatctctttgtgaaactatgaaaattacacacacatgtatcgttttttgttttacttctgtaaatctaggtccgttttgtgtgcttccagctaatgtttattttctttagtgcaggtcaagcctgaagtagtcagttggtcccctcgaattattgtgcttcatgactttctcagtccggaggtatatacaccccccactaataaattctagttcattgagttagctgattgtagaatagtctgttcttgctgatgttaggcctttaagtagagaaaaaacttgttcatatcatctttattctagcaaggataagctaagatttgatagaaaagcaaaatcttaggctcagttctaagtattatcataagaattagcaaaagagcttttggctgttttttgtcttcccattaaaatagttttcttgtttctcctgatatgtatatttgcaggaatgtgaatacctaaaagcaatcgcccggcctcgccttcaagtttccactgttgttgatgtaaaaaccggaaaggtattggacaataccttccttttagttctgtagaagaagtaaaatttctattacatccactctctgccttcgattgttcagttgtttcaatcaaacattggacacaaatagaaacgctctaggtttgcctgcaaagtctaattcattctcttccatagtagacatattctagttatgctttcaaagtcttaaccatactcttccattttcttatcactttcttcttgcttagggagttaaaagtgacgtgaggacaagctccggaatgtttctaactcatgtagaaagaagttatccaataatacaggtaagtcactctctcatatcttttaaaggcgtgccattttgatcaactttacaattttgtaaattatattccttttcgtttgctattattaggcaattgaaaagcgaattgcagtcttttctcaagtaccagcggaaaatggagaacttattcaagttctaaggtgcgtgcacaaccgcaaccttactattttttaaatctaaagtaaacgaagcttttttcttgttttgatgaatcaaaatctgctgcagtgcagatatgagccgcagcagttttacaaaccacatcacgattactttgctgacactgtaagtctttggttctgttttcatatatatatatcattagtagattggtaaagaaagcttttgctctgattaaaaaaaaaactaaaaagaggctacagtatttaacttttggtttggtcaataatgtttagttggatctgtacttcatcttctccttcttcatcatcttagaacatttagtttggaagtacgtttattgtgggtgttcatcatatttcctcgtttcttttcttatggttgctacacagttcaatctaaagcgtggtggtcagcgcgtagcaactatgcttatgtatctaactgatgacgtcgaaggaggagaaacttatttccctttggtataacactttctctctgttcatgcaaatttcagaaaacaaaataaaccaatggtgtaatatctctctctctctacttgaaatgcaggctggtgatggtgattgcacctgtggtggcaaaatcatgaaaggcatctctgttaaacccaccaaaggagacgcagttctcttctggagcatggtttgtttcttcaatctctctctctatgtctctacacaaacatgaatcaattggactgctttgagttcaattacttcttgtgttattcagggactcgacggacagtcagatcctaggagcatacatggaggatgcgaagttctgtctggagaaaagtggtctgctactaaatggatgaggcaaaaagctacttcttgaagaactacttaaaactttttaaaacaaaaagaaaccacagggacttatattgaaaaatgtcatatttaatcagagttttgatttactctctttttgacccttcaattttagaatttatca

SEQ ID NO: 294 - DNA, 1211 bp, Saccharomyces cerevisiae
aactctttgtttcttgtttgttgattaacccttaattaagatgtttgcaaacgttggatttagaactttgagggtctcgagaggtcccctttatggtatgtttattgttttattcattggtgtgctaattgctaaatttgcgggacaaatgctaatcgactcagagactaacttttctcatatcataggatcctgcagtcaaatcatcagcttttccaagaggactttttactcaagtgccaagagtgggtatcaatcgaacaacagtcatggtgatgcgtatagttcaggtagccaatcaggcccgttcacctataaaaccgcggtagctttccaaccaaaagacagagacgatctgatataccaaaaactaaaggattctattagatcacctacaggagaagacaactattttgttacatcaaacaacgttcacgatatttttgccggtgtcgcagacggtgttggaggatgggctgagcatgggtatgactccagcgccatctcaagagaattgtgtaaaaaaatggacgaaataagcactgctttagcagaaaattcatccaaagaaacgcttttaacgccaaagaaaattattggtgctgcatacgcaaaaattagggatgagaaagtggtgaaggttggtgggacaacagccattgtggctcacttcccatctaatggaaaattggaagttgccaacttgggtgattcttggtgtggagtcttcagagattctaaacttgtattccagacaaagtttcaaactgttggatttaatgctccttaccaattgtcaatcattccagaagaaatgttgaaagaggccgaaagaaggggtagcaagtatattttaaacacccccagagacgctgatgaatatagcttccaattgaaaaaaaaggatattattatattggctaccgatggtgtaaccgataatattgccacagatgatattgagctttttctgaaggataacgctgcgagaacaaacgatgagttacagctattatcccagaagtttgtggacaatgttgtcagtttaagcaaggaccccaattaccccagtgtttttgcgcaagagatttctaagctaactggcaaaaactacagcggtggtaaagaagacgatataactgttgttgtcgtgagagttgactaaatttaaatacccagcaaattggagctctgcagagctttcgttcgta

SEQ ID NO: 295 - DNA, 1190 bp, Saccharomyces cerevisiae
aactctttgtttcttgtttgttgattaacccttaattaagatgtcaatatcatcaaagataagaccaactcctcgtaaaccttcacgtatggctaccgaccattcttttaaaatgaaaaacttttatgccgatcctttcgctatatcatcaatttctttggcaattgtatcgtgggtcatcgccatcgggggctccatctcatctgcatccaccaatgaatccttcccacgttttacttggtggggtatagtataccaatttctaattatttgttctttaatgctgttctattgttttgatttagtcgatcattacagaatcttcatcaccacatctattgcagtggcatttgtgtataatacaaacagtgcaacgaatttagtgtatgcggatggtcccaagaaagctgctgcttcagcaggtgtcatcttactttccatcataaatttaatctggattctgtactacggcggtgataatgcttccccaaccaatagatggattgattcgttttccattaagggtatcaggccttcgccattagagaattctcttcatagagctcgtcgaagaggcaataggaacacaacgccttaccaaaataatgtctataatgatgctatacgagactcaggctacgcgacacagtttgatggatatccacagcagcaaccttctcacacaaattatgtatcttctacggcattggctggttttgagaatactcagccaaatacttcagaagccgttaatcttcacttgaacactctacaacaacgtatcaatagcgcaagcaacgcgaaggaaaccaatgataatagcaataatcaaaccaatactaatataggtaatacgttcgatactgatttttcaaatggcaatacggaaactacgatgggagacactttgggtctgtatagcgatatcggtgatgataatttcatttacaaggcaaaagcactgtacccatacgacgctgatgacgatgatgcttacgaaatctcatttgaacaaaatgaaatcctacaagtctctgacattgaaggcagatggtggaaggcaagaagggcaaacggtgaaacaggtattattccaagcaattatgttcaactaatcgatggtccagaagaaatgcatcgttaaatttaaatacccagcaaattggagctctgcagagctttcgttcgta

SEQ ID NO: 296 - DNA, 491 bp, Saccharomyces cerevisiae
cagctttcaaactctttgtttcttgtttgttgattaacccttaattaagatgctcatgcactttattccccgaagatcttcgaaagcagttcaatttaattggctggagattggcgtttggagaggcggtgtgtatgtcaagaaaggcattgtcaacgcccggacaaataattctaatttttacaagatgccggtggtgttcggcattgtaaaaggtatgggtgctttgtgcgtccatgcatggggtatggggtatgggggcatcatcgattgttctccggtaacggaacacggcaatatttctgttctacagcttgaatacatgccgtggatctgtttatcaaagataatgtcatgtagcgtggcaagtcgacacagcaacgtgtggataatggatgagacgatagcgccactggttggttgtttgtaaatttaaatacccagcaaattggagctctgcagagctttcgttcgtatcatcggtttcgaca

SEQ ID NO: 297 - DNA, 1094 bp, Glycine max
tttgttgattaacccttaattaagatgtcctgccggaaaagacaaaagacttcgccggacaaaacctccgacgacttcttcgactctctccccgacgaccttgtcctctctatcctctgcaagctcagctccaccgcaacttccccctccgatttcattagtgtcttaataacgtgcaagagactaaactccttaggccttcactctcttgtgttatcaaaagcttcccacaaaacattctcagtcaaagccaaaaactggtgcgactctcttcaccgtttcctcaaacattgtgcagatgccggaaacattgaagcctgttacactctcggcatgattcggttttactgcttgcaaaacagagggagcggcgcgtcgctgatggcgaaggcggcgatgaactctcacgcgccggcgctgtactcgctcgcggtgatacagttcaacggaagcggcggcaccaaaaacgacaaggaccttcgagcgggtgtggcgctttgcgcacgcgctgcgttcctcggtcatatcgacgcgctgcgtgagcttggtcattgcttgcaagacggttacggcgttaagctaaacgtaacggagggacgacggtttttggtgcaagcaaacgctcgtgaactcgccgccgtgctctccgccgggaataccaagcgcccctggctgacctggagccaccaccctgtcacccacccgcggctccggtcgggttgcccgttgatgagtgattacgggtgcaatgttccggcgccggatgctcacccggcgagtcagtttatgtcggagtggtttgatatccggggcgggtttccgggtccggatatgaggctttgttctcattcgggttgcgggcgacccgagacaaggaggcacgagtttcgaaggtgttcggtttgcggtttggtgaattattgctcacgcgcttgtcaggcgcttgattggaagttccggcacaaggcggaatgtgctaccgttgagaggtggctcgatgacgacggcgaaggcgtcgccggtgagaatgacggcggcggagatgacggggtaatgatggttaatagttagatttaaataccccgcaaattgga

SEQ ID NO: 298 - DNA, 781 bp, Glycine max
aaactctttgtttcttgtttgttgattaacccttaattaagtacatttgtttgtttatcatttctttgctcgtatcaatgtctaacaccagcaacaatgtcgctggggtcgacaacacgttcagaagaaaatttgatcgagaagagtatctagaacgagcacgggagcgcgagagacaggaggaggagggtcgagcgaaacctaaagccaaaggtcctcccgtgcagaggaagcccttgaaacatagagattatgaagtggaccttgaatcccgcttgggcaagactcaggttgttacgccggttgcaccactaagtcagcaggctggatactactgctcagtttgtgagtgtgtggtgaaggactctgcaaactacttggatcatattaatggaaagaaacatcaaagagccttgggcatgtccatgcgagtagaacgtgcttctctccaacaggttcaggaacgatttgaagttcttaagaagcgtaaagatgttggcagcttcacagagcaagatcttgacgagcggattttaaaacagcagcaagaggaggaagaaagaaagcgactgcgtcgagaaaagaaaaaagaaaagaaggagaaggcagttgaagaacctgaaattgatcctgatgttgctgccatgatggggtttggaggtttccggtcatccaacaagaaatgatagcattctgcatgcggaatgaactgcgtatgaaattttggaacaatatttaaatacccagcaaattggagctctgcagagctttcgttcgtatc

SEQ ID NO: 299 - DNA, 1059 bp, Arabidopsis thaliana
atggcggctcttttaggcagatcctgccggaaactgagttttccgagcttgagtcacggagctaggagggtatcgacggaaactggaaaaccattgaatctatactctgctattaatcaagcgcttcacatcgctttggacaccgatcctcggtcttatgtctttggggaagacgttggctttggtggagtctttcgctgtacaacaggtttagctgaacgattcgggaaaaaccgtgtcttcaatactcctctttgtgagcagggcattgttggatttggcattggtctagcagcaatgggtaatcgagcaattgtagagattcagtttgcagattatatatatcctgcttttgatcagattgttaatgaagctgcaaagttcagataccgaagtggtaaccaattcaactgtggaggacttacgataagagcaccatatggagcagttggtcatggtggacattaccattcacaatcccctgaagctttcttttgccatgtccctggtattaaggttgttatccctcggagtccacgagaagcaaagggactgttgttgtcatgtatccgtgatccaaatcccgttgttttcttcgaaccaaagtggctgtatcgtcaagcagtagaagaagtccctgagcatgactatatgatacctttatcagaagcagaggttataagagaaggcaatgacattacactggttggatggggagctcagcttaccgttatggaacaagcttgtctggacgcggaaaaggaaggaatatcatgtgaactgatagatctcaagacactgcttccttgggacaaagaaaccgttgaggcttcagttaaaaagactggcagacttcttataagccatgaagctcctgtaacaggaggttttggagcagagatctctgcaacaattctggaacgttgctttttgaagttagaagctccagtaagcagagtttgtggtctggatactccatttcctcttgtgtttgaaccattctacatgcccaccaagaacaagatattggatgcaatcaaatcgactgtgaattactag

SEQ ID NO: 300 - DNA, 1001 bp, Glycine max
tttatttgtcagctttcaaactctttgtttcttgtttgttgattaacccttaattaacggatatctcaaaggtttatccttcagtgaagagaaatggcagctgaggcaaattttgatagcaaaagcagcaggtggtctttgcaggggatgacagctctcgttaccggtggttccaaaggaatcggatatgctatcgtggaggagttggcacaacttggagccactgtacacacttgcgctcgcaacgaagctgaactcaataaatccttaaatgaatggaacacaaaaggatacagagtaactggttcggtccgtgacgtggcgtctcgtgcagaaagacaagacctcatagctagagtctcaaatgagtttaatggcaaactcaatatccttgtaaacaatgtgggaacaaacatacagaaagagaccctggatttcacagaggaagatttcacatttctggtgaatacgaatcttgaatcttgtttccacctaagccagcttgcacatcctctcctaaaagcttcagaagctgcaaacatcattctcatatcctccattgctggtgtggtagcttcaaatatagtatccgttgtgtatggtgcaacaaaaggagcaatgaaccaaatgacaaaacatttggcatgtgaatgggccaaagacaatataaggactaattgcgttgcaccagggccaattagaacccctcttggtgacaagcactttaaagaggaaaaacttaataatagtctgattgcgcgaacccctcttggacggattggagaggcagaggaggtttcttcgttggtggcattcctctgcttacctgcagcatcttacataacaggacaaaccatttgtgttgatggcggcttcaccgtgaacggtctctacataagctaggcttattgtgacagtttcaatgttttgtttagtctgttacactctacttgtattagtttctctttaagttgtggagagtggatttaaattggagctct

SEQ ID NO: 301 - DNA, 1346 bp, Arabidopsis thaliana
ttaattaataacaaaacactagacacattgtgaagatagaaaaaaatggagagagcagcaattctcccgagtgttaatcaaaattacctactttgtccttcacgcgccttctccacgcgcctccactcctctactcgtaacttatcgccgccgtcatttgcctccatcaagcttcagcattcttcttcctctgtttcttctaatggtggaatctctcttactcgatgcaacgctgtttcgtccaattcttccagtacgttggtaactgaattagccgacatagattgggataccgttggatttgggcttaagccagctgattatatgtatgtgatgaaatgtaacattgatggagagttctcaaaaggtgagttgcaacgttttgggaatattgaaattagcccatctgctggtgtactcaactatggacagggattgtttgaagggctaaaagcttacagaaagaaagatggtaataacatcctcctctttcgtcctgaggagaatgcaaagcgtatgagaaatggtgctgagaggatgtgtatgcctgctccaaccgttgagcagtttgtagaagctgtgacagaaactgtactagcaaacaaacgttgggttccaccaccaggtaaaggttccttatatgttagaccattgctaatgggaacaggagctgttcttggtcttgcgcctgcaccagaatatactttcattatctatgtttcgcctgttgggaactacttcaaggaaggtgtggcacctatcaatttgattgtggagaatgaatttcaccgtgcaactcctggtggtaccggaggtgttaaaaccataggcaattatgctgcagtactgaaggcacagtcaattgcgaaagctaaaggatattccgatgttttgtaccttgattgcatttacaaaagatatcttgaggaggtctcgtcttgcaatattttcatcgtgaaggacaatgtgatatctactcctgaaataaaaggaaccattttacccggtattactcgaaaaagtatgatagacgtggctcgaacacaagggtttcaggtggaggaacggaatgtgacagtggatgaattgttagaagcagacgaggttttctgcacaggaaccgccgtggttgtctctcctgttggaagcgtcacttacaaaggcaaaagagtgtcttacggagaaggtaccttcggaactgtgtcgaagcaactctacaccgttctgacaagcttgcagatgggtctgattgaagacaacatgaaatggactgtgaatcttagttaagccaggcgaatgcattgcatcaattcggctgcttggttttgctttcttttcggcgcgcc

SEQ ID NO: 302 - DNA, 780 bp, Arabidopsis thaliana
ttaattaatcacacaacctcaagattcaagatctagatcaattactcaatcctctaaagatgaacatgagcagagttgaacaacaagtcattagatatccggccgcaaaggctactcccgtgggttacttacctgatccggcttcatttaacaagttccgagttccggcttcttccaagaaatctgaacaaagcaacgtaaaatcgattcttaaaaggaagaaaactgatgggttcaccaacggagttagagaccagagcaagataagaccaaagctaaccgaaactgtgaagagaaagctatctttgggcgctaggattcttcaggttggaggtttagagaagatcttcaagcggctctttagagttagtgaaggtgagaaactgttcaaaatgtaccagtgttacttgtcgacaaccgcgggtcccatagccggccttctcttcatctcttccaagaaaatggcgttctgcagcgagagatcaataaaggtggattcccctcaaggagacataatccgggttcactacaaagtatcaatccccttgtgcaagatcgacagagtgaaccagagtcagaacacaaagaaaccatcacagaagtacctagaagtagtcacggtcgatggttttgacttctggttcatggggttcttgagctaccagaaagctttcaattgccttgagaaggctctttcactgagctttgaagataacaaagagcaataaagccgcgatttctgtggaactatggagtttaacaagaaatatttggcgcgcc

SEQ ID NO: 303 - DNA, 1369 bp, Arabidopsis thaliana
ttaattaattggggattgttgttttctcttaaagagtcgattttgaatggcggtggagtatgtatgttgcagcccaaacttctttatacatatagctgtgattgtgtttcttgtcttgttcgctggactcatgtctggcttaacattgggtcttatgtctttgagtctcgttgatcttgaagttctcgctaaatccggtacacctgaacatcgtaaatatgcagcaaagatattgccagtggtaaagaatcagcacttgttgcttgtcactttacttatatgcaatgcagctgctatggagacgcttcctatttttcttgatggccttgtgacggcatggggtgccattttgatttcagttacattgattcttctctttggtgagattatacctcagtcgatttgttcacgttatggtttagcgattggtgcaacagtggctccgtttgtccgtgtcctagtctttatctgcttacctgttgcatggccaataagcaagttgctggactttctattgggtcatcgtcgtgcagcgctttttcgaagagctgagctgaaaacacttgtggattttcatggaaatgaggctggaaagggtggggagttgactcatgacgaaacgacaatcattgcaggagctcttgaactctctgagaaaatggtcaaagatgcaatgacaccaatatcggatatctttgtgattgatatcaatgccaaactagacagagacttgatgaacttgattcttgagaaagggcatagcagagttccagtatactatgagcagccaactaacataatcggccttgttctggtgaagaacttattaactatcaacccagatgaagaaatacctgtcaagaatgtcacgataagaaggattccaagagttccagaaatcttgcctttatatgacatattgaacgaattccagaaaggactcagccacatggctgttgttgtaagacagtgtgacaaaatccacccattaccttctaaaaatgggagtgttaaggaagcccgagtggatgtggatagtgagggaactcctactcctcaggagagaatgttaaggacaaaaagatcgcttcaaaagtggaagagctttccgaatcgagcaagttcgtttaaaggagggtcaaagagcaagaagtggtcaaaagacaatgatgcagacatcctgcaattgaatggcaatccgctgcctaaacttgctgaggaagaagaagcagtcggaatcattacgatggaggatgtcattgaagaacttctgcaggaggagatctttgacgaaactgatcaccattttgaagactcctaacacagagtgcatgaccactgaactggttatgaatgtcgaaggcgcgcc

SEQ ID NO: 304 - DNA, 807 bp, Arabidopsis thaliana
ttaattaaatcactcttttacttccggcgatctctctccgacggccaatggacgccgtcctttactctgttccactctccttcactcccctacgcgcatcatcctctccttcctcgccgtatcttcttctgccgaggtttctctccgttcagccatgtcacaaattcaccttctctcgaagcttcccttccaaatcccggattccctcagcttcttccgccgccggttccacgttgatgacgaattcctcttcgccaagaagtggagtgtacactgttggtgagttcatgacaaagaaagaggacttgcacgtggtgaaacctacgactactgtggatgaagctctggaactccttgtggagaatagaatcactggatttcctgtaattgacgaagactggaaattggttgggcttgtttcagattatgacttgttggctttggactccatatctggtagtggaagaacagaaaattccatgttccctgaggttgacagcacctggaaaactttcaatgctgtgcaaaagctactcagcaaaaccaatgggaagcttgttggagatttaatgacaccagctccactagttgttgaggaaaaaaccaacctggaagatgctgctaaaatattgcttgagacaaaatatcgccggctccctgtggtagattctgatggcaaattggttggtatcatcacaagaggaaacgtggttagagccgcgcttcaaataaagcgctctggtgataggaatgcttgattaaggtagtatatataccaaacaagaaaatggctttgtagggcgcgcc

SEQ ID NO: 305 - DNA, 2324 bp, Arabidopsis thaliana
ttaattaaattaaagaacctgaattgttctggtgttgagaataagaaactatgtggaaacagattctaagtaagcttcccaacaaaaagtcttcaaagcacgaacatcgtggacgtgaacacggtggccattcttcttcatcttctcatacttcaggtgcctctacttccaaaagcactgataatggcgccgcgaaatcgcatgctaagaacgcttctccagccggcaaatccgctgcttctgactcgggttttaaagatgggaatctaaagagtagtgggaacaacaacaacaacaacaacaacggtgtctttactccttatgaagcattgccgagttttaaagatgttccaaacacggaaaagcaaaacttgttcattaaaaagttgaacttgtgccgtgtagtgtttgatttcacggatcctacaaagaacatcaaggaaaaagatattaagaggcagacattgctggagcttgtggattatgtgaattctcctaatggaaagtttagcgaagtcggtatccaagaagtcgttcggatggtctctgctaacatatttagaacgctaaatcctcaaccacgggaaaataaagttatcgatgccttagacctggaggaggaagaaccttccatggatcttgcgtggcctcacttgcagcttgtgtatgagcttttcttgaggtttgttgcttcgcctgaaactgacaccaagctggctaagagatatatagatcaatcttttgtcttgcggttactggatttatttgattccgaggatcctagagaaagagattgtctgaaaaccattctccatcggatctatggtaaatttatggtacaccgacctttcatcaggaaatccattaacaacatcttctataggtttgttttcgaaacagagaaacataatgggattgctgagtttctagaaatcttgggaagtatcatcaatggattcgctcttcccttgaaagacgagcacaaagtgtttcttgttcgagttttgatacctctccacaaaccaaaatgcttgcaaatgtatcatcaacaattgtcttattgtatcacacagtttgtggaaaaggattgcaaacttgctgatacggttataagaggattgttgaaatattggcccgtgacaaacagttccaaagaagtcatgtttctgaacgagttggaggaagtactcgaagcaactcagccaccagaatttcaacggtgcatggtaccactgtttcgccaaatagctcgatgtttgaacagtctgcattttcaggtacctgtcattctccattctttctgaaataatagcacctcacatttgtttttaaactggcgaatttccccgtgctttgacatttcctgaaaaatgctctgttgctgttagtgttgggtttgacatttgcaggccatatcgtttcgacatactttaactgcattagtgtttcacctgtttatgttagcctattagattgttatataaaaagatcaaatgaaagagttgggtttgtggtaatgaaagtatctacgtataggactgttgtattgtgttctggataatatctgatgcagtttcttagctaaataaggcttatggttacatactttaattgtgttagtgtttcgccagtatatctgtgttaccttaccagcttatgagaagtcgttatagcctaccagttatatcaaacgagcaaatggaagagttgattttgcggtatggaaagtatcaatgtttaggactgttatattcagctctaggtgttactcaaggcaatttctaagctaaattgatatagtaaggctattgttaagtagaaagttacaaaagaagaaaaagtattgcgttgaagggtatctgttttggctaaacagtgactgcatacgatctttcacgggaaaagatcagtctagtaggttcaggatctttgtttcagtctattcatgctctgtctggttttcgcaggttgcagagagagctttattcttatggaacaacaatcacattgagaatctgataatgcaaaaccgtaaagtcattcttccaattatattcccagcgttggagagaaacgcacagaaacattggaaccaagctgttcatagcttgacactaaacgtgcgaaagatatttcatgaccttgaccctgagttatttaaagaatgcctcgcaaagttcaaggaagatgaatcaaaagcagctgaaaccgaagcaaaacgtgaagccacttggaaacgtttggaagaactcggagtgcgaaaggcttcataaagttagagttgtagagaagaaagagagagaaagagagtttctgggcgcgcc

SEQ ID NO: 306 - DNA, 1739 bp, Arabidopsis thaliana
ttaattaaaacgattcacttttctcaccatctcaatctccagaccaaaagaaacaaaaaatggattctttttcatattcttcgatgaaatccatgttgattcaagctcgtggctcgttgaactcgcgtttgtcggagtttgagccactggttctgctattggttccgcttgtctctctgtttctcgctcagattatcggatctgtgtttggcgttgttcacgagaaaggcctcaaagcttgtcttattgggtttatcatgggactcctcaaaatgattcctggagttcagaattacattgatgctgagaaacaaaaggttgttgaccaattacaatctggtagcagctctaagaaaaagaataagactgaagtattgccagtaaaaggtctaggagttgaagttttagagaaaatggagaatgagaagaggaatgatgctatttggcaaggaaaatgctctggcactgtatacataggtggagccgagtctgaaggacatttttcattgataaatcaagcatgttcaatgtttgcgcataccaatccgttgcatatagacgtattccagagtgtggtgcggtttgagtcagaagtagtcgcaatgactgctgcgttacttgggagtaaagaaacggcgtcaggaggtcaaatatgcggaaacatgacgtctggaggaacagaaagtatagtgttggctgtgaagtcatctcgtgactatatgaagtacaagaagggaatcacacggccagaaatgattatacctgagtcgggtcattcggcttatgataaggcggcccagtattttaaaatcaagttgtggcgagttccagttgacaaagacttccgagctgatgtgaaggcaacaaggcggcatattaacagaaacaccatcatgattgttggatcagcaccaggattccctcatggcatcattgatcctatcgaggagcttggtcaactggctcttagctatggaatatgctttcatgttgacctttgccttggtggttttgtgttacctttcgctcgtaaacttgggtaccagatcccaccttttgatttttctgtacaaggagttacttcaatttctgtggacgtgcataaatatggtttggctcctaaaggaactagtacagttctatatagaaatcatgagatcagaaagcaccaatttgttgctgtaactgaatggtcaggaggtctatacgtgtctccaactatcgctgggagtaggcctgggtctttggtagccggtgcttgggctgcaatgatgtcgctcggcgaagaaggttacctacaaaacacaagtaagataatggaagcatcaaagagactagaagaaggagtaagagaaatccatgaactattcgtcattggaaagccagatatgacaatcgtggcttttggttctaaagcattggatatatttgaagttaatgacatcatgtcttctaaaggttggcatttgaatgcactacagagacccaacagcattcatatatgtattactcttcaacacgtccctgtagtcgatgacttccttcgggatctgcgtgaagctgtggaaactgtaaaagcaaacccaggaccgatcacgggaggcttggctccaatatatggagcagcagggaagatgccagaccgaggcatggtgaatgagcttctggttagtttcatggacagtcaatattaagtttcttgaaggttaaagcatctagtgggtaaattgaggcgcgcc

SEQ ID NO: 307 - DNA, 1455 bp, Arabidopsis thaliana
ttaattaattggagaatggtgtttttccgcagcgtatcggcctttactaggctgaggtctcgcgtcggccaacaatcttcactcagcaattctgtcagatggattcagatgcagagctctaccgacctggacctgaagtcgcagctgcaagagttaattccggaacagcaggaccgtctgaagaaactgaagtcagaacatgggaaggtccaactgggaaacatcactgttgatatggttattggtggaatgagagggatgactggattgctttgggaaacctcattgcttgacccggaagagggtattcgctttaggggattgtcgattcctgagtgccagaaagtattacctactgcccagtctggagctgaaccattaccggagggtcttttgtggcttctcttaactggaaaggtacctagcaaagagcaagttgaagcactgtcgaaagacttggcgaaccgtgctgctgtgccagattatgtgtacaatgccatcgatgctctgccttccacagctcatccaatgactcaatttgctagcggtgttatggccctccaggtgcaaagtgagtttcaaaaggcatatgagaatggaattcataagtcaaagttctgggagccaacatatgaggattgcctcaacctgattgctcgtgttcctgttgtagctgcatatgtttatcgaaggatgtataagaatggtgattccattccctcagataaatctttggattatggtgcaaatttttcccacatgttgggatttgatgatgaaaaggtgaaagagctcatgaggctttacatcaccatccacagtgatcatgaaggtggaaatgttagtgctcacactggtcacctggttggtagtgcactttcagacccatatctgtcatttgcagctgcattaaatggtttagctgggccactccatggtttggctaatcaggaagttttgctttggatcaaatcagtcgtagaggaatgtggagaagatatatcaaaagaacagttgaaagaatatgtttggaaaacattaaacagtggcaaggttattccgggatatggtcacggtgttctgcgcaatactgatccaagatatgtatgccaaagagaatttgccttgaagcatctacctgacgaccctcttttccagctggtgtcaaagctttatgaagttgtgcctcctgttctcactgagcttggaaaggtgaagaacccgtggccaaatgttgatgctcacagtggggtcttgctgaaccactatggtctaaccgaagcaaggtactacaccgtgctctttggtgtttcaaggagtcttggcatctgctctcagcttatatgggaccgagctcttggacttgcacttgagaggccaaagagtgttaccatggactggcttgaagcccattgtaagaaagcttcatctgcttaagtcaccaccgggcgcgcc

SEQ ID NO: 308 - DNA, 1402 bp, Arabidopsis thaliana
ttaattaaatggggaaaaaagctaaatggttttcaagtgttaagaaagcattcagcccagattcaaagaagtcgaagcaaaaattggctgagggacaaaatggtgttatctctaatcctcctgttgtggataatgttagacaatcttcttcttctcctcctcctgctcttgctcctcgtgaagtgagagtagctgaagtgattgttgaacggaacagggatctttcacctccttctacagcagatgctgtgaatgttacagctactgatgttcctgtagttccatcttcatctgctcctggtgttgttcgtcgcgctacacctactcgatttgctggaaagtcaaacgaagaagccgctgctatcttgatccagactatatttagaggttatttggcaaggagagcgttgcgggcaatgaggggtttggtcagacttaagttattgatggaaggatctgttgttaagcggcaagctgcaaatactctaaaatgtatgcagactctctctcgtgtacagtcgcagatccgagctaggagaatcaggatgtcagaagagaatcaggctcgccagaaacaactccttcagaaacatgctaaagagctagctggcttgaagaacggggataactggaatgatagcattcaatcaaaggagaaagttgaagcgaatttgctaagcaagtacgaggcaacaatgagaagggaaagggcattggcttattcatactctcatcagcaaaactggaagaacaactctaaatctggaaacccgatgttcatggatccaagcaacccgacatggggttggagctggttagagagatggatggctggtaggccactagagagttccgagaaagaacaaagcaacagcaacaatgacaatgctgcctcggtcaagggctctattaaccgcaacgaagctgcaaaatctctaacccgcaatggctcaactcaaccaaacacaccatcatccgcaagagggaccccaagaaacaaaaacagtttcttctcacctccaactccctcaaggctaaaccaatcctcgaggaaatccaatgacgacgactccaaaagcacaatctcggtcctgtccgagaggaaccgcagacacagcattgctggttcatcagtcagagacgatgagagcctcgctggctcaccagctctcccgagctacatggttccaactaaatcagctcgagccaggctcaagccccaaagcccattaggtggtaccacacaggaaaacgaagggttcacagacaaggcatcagctaagaaacggctctcgtatccaacttcgcctgcattgcctaaaccacggcggttctcagctccccctaaggtggagagtggcggcgttaccgtgaccaacggagcaggcagctgaggcgcgcc

SEQ ID NO: 309 - DNA, 1204 bp, Arabidopsis thaliana
ttaattaatttgattctactagtgagctccgatttaatttagggttttgaaagatgtcagctttgaaaaattacggcttgatctccattgattctgccctccattttcctcgatcaaatcaattgcagagctataagagaaggaatgcaaaatgggtctctccaatagcagctgttgtacctaacttccatcttcctatgcgcagtctcgaggataaaaacaggacaaacacagacgacataaggtcccttagagtgatcacagccattaagacaccgtatttacctgatggaagattcgacctccaagcatacgatgacttagtcaacacgcagatagaaaacggtgctgaaggtgtgattgttggtggtacaactggtgaaggccaattgatgagctgggatgagcacataatgcttatcggccatactgtaaattgttttgggggaaggatcaaagtcattggaaacactggaagtaactcgactagggaagctattcatgccactgagcaaggattcgccatgggaatgcacggggcactgcacattaacccttactatggaaaaacatccattgaaggcatgaatgcgcattttcaaaccgttcttcatatgggaccgactattatatacaacgtgccaggtcgaacgtgccaggatatacctccccaggttatctttaaactctctcagaaccctaatatggctggggttaaggaatgcgttggtaataaccgagttgaagagtatactgagaagggaattgtcgtttggagtggaaatgatgatcagtgccatgattctagatgggatcacggtgccactggagtgatatcggttactagcaatttagttccgggtttgatgaggaagttgatgtttgaaggtagaaactcagcgttgaacgcaaagcttcttcctttaatggattggctattccaagaaccgaatcccattggtgtaaacactgctttggctcagttaggagttgcgaggccggtttttcggttaccttatgtgccattgcctctgtccaaaaggattgagttcgttaaactggtgaaggaaatcggaagggagcattttgtaggagacagagatgttcaggtacttgatgatgatgacttcatcttaatcggtcgatattagagtctcttccctgaagattggttgtgtttatactttcttcgttcaggcgcgcc

SEQ ID NO: 310 - DNA, 2445 bp, Arabidopsis thaliana
ttaattaagtgttaacccagaaagaaaaaggaagactttagaatcatggatcttgtaaagccagaggagataagtcacccaccaatggatcagcttcagggtttagagtactgtattgactcaaaccctccatggggtacttagccttgaaaccattctctgtactttattggttgacttttcactttccggaatcctgatgatgatcttattgcaggagaagctatagctttaggtttcgagcattacattctggctttaggaactgcagtgatgataccttcaattcttgttcctatgatgggtggagatgatgtgagcattatttcttacattcttcactgtttcttaatccaacgaatctctgttgtgaattttgcttgtctgactgagattaatgttcctcccaaaaacaattgagtagggtgataaagtgagagttgttcagacactactgttccttcaaggtgttaacactcttcttcaaacattatttggaactcgtcttccaactgtcattggaggctcatatgcattcatggttccaatcatttcaatcatccatgactcttctttgacccgtatcgaagatccacaattggtatgtttgttcttctctttgaatagtattctcaagatcctaactccatactaatttgaatctgaaattaaacagagatttctaagtacaatgagagcggtacaaggcgcgatcatagttgcatccagcgttcaaattatcctcggtttcagccaaatgtgggctatctgttcaaggtatatatatacatacatatttcatataaaggtttatagattttaacgagttttcatcttaattttttttcagattctttagtcctattggtatggttcctgttattgcattaacaggttttggactcttcaacagaggattcccagtggtacattactgtcattcctctctttaaacatccaacaatcatcccttttggttcttattttatactgttcgtgttgtttgcaggtgggtaattgtgttgagataggactccccatgcttattctctttgtcatcttctctcaggttattttcctatgggactgatccaattctctttgatactgcatatgtttctttttaactgattttataatctgtgctcttgtgcagtatctgaagaactttcagttcaggcaattcccagtagtggagagatttgctcttattatagcgcttatcatcgtgtgggcttacgcgcatgtcttgaccgccagtggggcttacaaacaccgaccacaccagacacaattaaactgcagaacggatatgtctaacctcatttcatctgctccttggttagttagttcatattctctagatataataaaaaaacattcaatagttgatagtgttttcatatatttatgcttctcttgacttattttaggatcaagattccttatccacttcaatggggagcacctagctttgatgctggtcatgcttttgctatgatggccgctgttttagtctcactcattgaggtaataatgtctctctgtatcagattattactcttgtctcagcatagaatgttctaaaagaattgaaatgtgattagtcaactggagctttcaaagctgctgcacgactggctagcgctacgcctcctccacctcatgttcttagccgtggaataggctggcaaggcattgggatcctcttaaacggtttatttggaacactaagcggttcaagtgtctctgtgtaagtgtaattgtgaatgttttcaaagcattttctccattagttggacaagttagtctcattgatttcttgattgttacaaattctgcagagagaacattggattactaggaagcaccagagttggaagccgcagagttatccaaatctcagcaggatttatgatattcttctcaatgctaggcaaattcggggcattgttcgcttcaatacctttcacgatatttgcagctgtgtactgcgtcttgtttggtcttgttgcttcagttggactctcttttctgcaattcacaaacatgaactctctgagaaatctcttcatcgtcggtgtgtctctcttcttaggattatcgatccccgaatacttcagagatttcagcatgaaagcattacacggcccagctcacaccaatgctggttggttcaatgatttcttgaacacaatcttcttatcttcaccaatggtcgcactgatggtggcagtgttcttggacaacactctggactataaagagaccgcgagagacagaggattgccttggtgggctaagttcagaactttcaaaggagatagcaggaatgaggaattctacactctccctttcaacctcaaccgtttcttccctccttcatagaaagttttactctctttttttttactcagaattgtgttgtttgtgtgtgggcgcgcc

SEQ ID NO: 311 - DNA, 2264 bp, Arabidopsis thaliana
ttaattaatgagcaatgaagggagcgactctcgttgctctcgccgccacaatcggcaatttcttacaaggatgggacaatgccaccattgctggagctatggtttatatcaacaaagacttgaatctaccaacctctgttcaaggtcttgtcgttgctatgtcattgatcggtgcaacggtcatcacgacttgctcaggaccgatatctgattggctcggcagacgccccatgctcattttatcatcagttatgtatttcgtctgcggtttgataatgttgtggtctcccaatgtctatgttctgtgctttgctaggcttcttaatgggtttggtgccgggctcgcggttacacttgtccctgtttacatttctgaaaccgctcctccggagatcagaggacagttaaatactctccctcagtttcttggctctggtggtatgtttttgtcatactgtatggttttcactatgtccctgagtgactcccctagctggagagccatgctcggtgtcctctcgatcccttctcttctttatttgtttctcacggtgttttatttgcccgagtctcctcgttggctggttagtaaaggaagaatggacgaggctaagcgagttcttcaacagttatgtggcagagaagatgttaccgatgagatggctttactagttgaaggactagatataggaggagaaaaaacaatgggagatcgcttagtaactttggaggatcatgaaggtgatgatacacttgaaaccgttgatgaggatggacaaatgcggctttatggaacccacgagaatcaatcgtaccttgctagacctgccccagaacaaaatagctcacttgggctacgctctcgccacggaagcttagcaaaccaaagcatgatccttaaagatccgctcgtcaatctttttggcagtctccacgagaagatgccagaagcaggcggaaacactcggagtgggattttccctcatttcggaagcatgttcagtactactgccgatgcgcctcacggtaaaccggctcattgggaaaaggacatagagagccattacaacaaagacaatgatgactatgcgactgatgatggtgcgggtgatgatgatgactcggacaacgatttgcgtagccccttaatgtcgcgccagaccacaagcatggacaaggatatgatcccacatcctacaagtggaagcactttaagcatgagacgacacagtacgcttatgcaaggcaacggcgaaagtagcatgggaattggtggtggttggcatatgggatatagatacgaaaacgatgaatacaagaggtattatcttaaagaagatggagctgaatctcgccgtggctcgatcatctctattcccggaggtccggatggtggaggcagctacattcacgcttctgcccttgtaagcagatctgttcttggtcctaaatcagttcatggatccgccatggttcccccggagaaaattgctgcctctggaccactctggtctgctcttcttgaacctggtgttaagcgtgccttggttgttggtgtcggcattcaaatactgcagcagttttcaggtatcaatggagttctctactacactcctcagattctcgaacgggctggcgtagatattcttctttcgagcctcggactaagttccatctctgcgtcattcctcatcagcggtttaacaacattactcatgctcccagccattgtcgttgccatgagactcatggatgtatccggaagaaggtcattacttctctggacaatcccagttctcattgtctcacttgtcgtccttgtcatcagcgagctcatccacatcagcaaagtcgtgaacgcagcactctccacaggttgtgtcgtgctctacttctgcttcttcgtgatgggttacggtcccattccaaacatcctctgttctgaaatcttcccaacaagagtccgtggtctctgcatcgccatatgtgctatggtcttttggattggagacattattgtcacgtactcacttcccgttctcctcagctcgatcggactagttggtgttttcagcatttacgctgcggtttgcgttatctcgtggatcttcgtttacatgaaagtcccggagactaaaggcatgcctttggaagttatcacagactactttgcctttggagctcaagctcaagcttctgctccttctaaggatatataacttgtaactttcttcttcgtcaattgctctgtgtaccatttaaat

SEQ ID NO: 312 - DNA, 3212 bp, Arabidopsis thaliana
ttaattaagatgaattcaaatggccatgaggaggagaagaagttggggaatggagttgtggggattctagctgaaacagttaacaaatgggagagacgaacaccattgacgccatcgcattgcgctcgccttttacacggtgggaaagacagaaccggcatttcccgcattgtggttcagccatctgctaagcgtatccatcatgatgccttgtatgaagatgttgggtgtgaaatttctgatgatttgtctgattgtgggcttatacttggaatcaaacaacctgagctagaaatgattcttccagagagagcatacgctttcttttcacatactcataaggcacagaaagagaacatgcctttgttggataaaattctttctgagagagtgactttgtgtgattatgagctcattgttggggatcatgggaaacgattattggcgtttggtaaatatgcaggcagagctggtcttgttgacttcttacacggacttggacagcgatatctaagtctaggatactcaacacctttcctctcgctcggtgcatcgtatatgtattcctcattggctgctgcaaaagccgctgtaatttctgttggtgaagaaattgcaagccagggactgccattaggaatctgccctcttgtatttgtcttcaccggaacaggaaatgtttctctgggggcgcaagaaattttcaagcttcttcctcacacttttgttgaaccaagcaaacttcctgaactatttgtaaaagacaaaggaattagtcaaaatgggatttcaacaaagcgagtctatcaagtatatggttgtattattaccagccaagacatggttgaacacaaagatccatcaaagtcattcgacaaagccgactattatgcacacccggaacattacaatccagttttccacgaaaagatatcgccatatacgtctgttcttgtaaactgtatgtactgggagaagaggtttccctgtcttctgagcacaaaacagcttcaagatttaacaaaaaaaggactcccactagtaggcatatgtgatataacttgtgacatcggtggctccattgaatttgttaaccgagctactttaatcgattcccctttcttcaggtttaatccctcgaacaattcatactacgatgacatggatggggatggcgtactatgcatggctgttgacattttacccacagaatttgcaaaagaggcatcccagcattttggagatattctttccggatttgtcggtagtttggcttcaatgactgaaatttcagatctaccagcacatctgaagagggcttgcataagctataggggagaattgacatctttgtatgagtatattccacgtatgaggaagtcaaatccagaagaggcacaagataatattatcgccaacggggtttccagccagagaacattcaacatattggtatctctgagcggacacctatttgataagtttctgataaacgaagctcttgatatgatcgaagcggctggtggctcatttcatttggctaaatgtgaactggggcagagcgctgatgctgaatcgtactcagaacttgaagttggtgcggacgataagagagtattggatcaaatcattgattcattaactcggttagctaatccaaatgaagattatatatccccacatagagaagcaaataagatctcactgaagattggtaaagtccagcaagaaaatgagataaaagagaagcctgaaatgacgaaaaaatcaggtgttttgattcttggtgctggacgtgtgtgtcgcccagctgctgatttcctagcttcagttagaaccatttcgtcacagcaatggtacaaaacatatttcggagcagactctgaagagaaaacagatgttcatgtgattgtcgcgtctctgtatcttaaggatgccaaagagacggttgaaggtatttcagatgtagaagcagttcggctagatgtatctgatagtgaaagtctccttaagtatgtttctcaggttgatgttgtcctaagtttattacctgcaagttgtcatgctgttgtagcaaagacatgcattgagctgaagaagcatctcgtcactgctagctatgttgatgatgaaacgtccatgttacatgagaaggctaagagtgctgggataacgattctaggcgaaatgggactggaccctggaatcgatcacatgatggcgatgaaaatgatcaacgatgctcatatcaaaaaagggaaagtgaagtcttttacctcttattgtggagggcttccctctcctgctgcagcaaataatccattagcatataaatttagctggaaccctgctggagcaattcgagctggtcaaaaccccgccaaatacaaaagcaacggcgacataatacatgttgatgggaagaatctctatgattccgcggcaagattccgagtacctaatcttccagcttttgcattggagtgttttccaaatcgtgactccttggtttacggggaacattatggcatcgagagcgaagcaacaacgatatttcgtggaacactcagatatgaagggtttagtatgataatggcaacactttcgaaacttggattctttgacagtgaagcaaatcaagtactctccactggaaagaggattacgtttggtgctcttttaagtaacattctaaataaggatgcagacaatgaatcagagcccctagcgggagaagaagagataagcaagagaattatcaagcttggacattccaaggagactgcagccaaagctgccaaaacaattgtattcttggggttcaacgaagagagggaggttccatcactgtgtaaaagcgtatttgatgcaacttgttacctaatggaagagaaactagcttattccggaaatgaacaggacatggtgcttttgcatcacgaagtagaagtggaattccttgaaagcaaacgtatagagaagcacactgcgactcttttggaattcggggacatcaagaatggacaaacaacaaccgctatggccaagactgttgggatccctgcagccattggagctctgctgttaattgaagacaagatcaagacaagaggagtcttaaggcctctcgaagcagaggtgtatttgccagctttggatatattgcaagcatatggtataaagctgatggagaaggcagaatgaatttaaat

SEQ ID NO: 313 - DNA, 925 bp, Saccharomyces cerevisiae
aaactctttgtttcttgtttgttgattaacccttaattaagatgactccttccaccccaccaaggtccagagggactaggtaccttgcgcagcctagtggcaatactagttctagtgttctaatgcaaggtcaaaagaccccccaaaagccttcacagaacctagtccctgtcactccctcaacaactaagtcttttaaaaatgcgccattattagcacctcccaattcgaacatgggtatgacctctccatttaatgggcttacgtctcctcaacgctcgccgtttccaaaatcttcagtgaagaggacactattccaatttgaaagtcatgataatggaacagtaagggaagagcaggaaccattgggtcgtgtaaataggatattgtttcccacgcagcaaaatgtggatatagatgcagcagaagaagaagaagaaggagaagttcttcttccccccagcagacctacatctgccaggcagttacatttatcacttgaaagagatgagtttgatcagacacatagaaagaagattattaaagatgtacctggtacacccagcgacaaggtgataacatttgaattggcaaaaaattggaacaacaactctccgagaaatgacgccaagagtcaagaaagtgaagacgaggaagacatcatcatcaatccagtgcgggtgggtaaaaatccctttgcatcagatgaactggtcactcaggaaattagaaatgaacgtaaaagggcaatgttgagagaaaacccagatatagaagacgtaataacatatgtcaataagaagggagaggtggtagagaaacgaaggttaacggatgaagaaaagaggagattcaagccaaaggcattgtttcaatctagggatcaagagcattgaatttaaatacccagcaaattggagctctg

SEQ ID NO: 314 - DNA, 1401 bp, Saccharomyces cerevisiae
catttatttgtcagctttcaaactctttgtttcttgtttgttgattaacccttaattaagatgggagagaaccacgaccatgagcagagtattaaaagaaattctatgatttataatgaaaatgagaggcaattgtgcaattcaaacctaaagattcttcaaaataaaagggccctttcaaaaaatgacagctctagtaagcagcaggttcaggattctaaaccaagaagggctttaacagatgtaccagtgaacaataatcctttaagccagaacaagagaatagtagcagggagcaaggcggccaaagtacgaagagaagaaaacattagatctattgttagcgccgttcaaaaaagacagatatataacgatcgaacggcagcagagcaagaagaagaagaagaagaagaaggagaagatgatgatgctgcttcgatagtgaacaaaaaacgcagaatagacgctgaaggagtgagtgaaatagtaggctggcaggacctggattatgttgaaaaagatgatactgcaatggtagcagaatattctgctgaaatttttgcatttttatatagaagagaattagaaacgttaccatcgcacaactatttactcgacaaaacgtccaagtattatttgaggccttccatgagaacaatattagtggattggctggtagaggtgcacgaaaaatttcaatgctatccggaaacgttattcctatccataaacttaatggatagatttttagctaaaaataaagttacgatgaacaagttacaattattggcagttacctcacttttcatcgcggcaaaatttgaagaggtaaatttgcccaaactagctgaatacgcttatatcactgacggcgcggcttctaaaaacgacataaaaaatgcggaaatgttcatgctcacttccttagaattcaacattggttggcccaacccactcaatttcctaaggagaatctccaaggcagaggattacgatccggttaatagaaatattggtaagtttattttagagtatgcctactgctgccaccaatttattcatttacctccatctaccgtaagcgcaatggcaatgtatatagcgagaagaataaccaacagaaacaagaacgagctatggaatggaacactacagcattacagtggtggtatcgatccaatacacgatgaagcgtttcagtctctctgcattgatctagtcaaagacatcgctagttccaaaactcatttagattcattgattttgaagtacaagaaaccaaggtatggctctgtttatttccaaactttcaagtggtgtacatccgaaatgcatagcaactttcaaaatctatttaatcttaagtagatttaaatacccagcaaattggagctctgcaga

SEQ ID NO: 315 - DNA, 2033 bp, Saccharomyces cerevisiae
tattcatttatttgtcagctttcaaactctttgtttcttgtttgttgattaacccttaattaagtcagattttattttatttcgacattacccctcaaatatatgactggtatgaatgataataatgccgctattcctcagcaaactccaaggaaacatgcgctatcttctaaagttatgcaactttttagaagcggttcaagatcatctaggcagggaaaggcctcatcgaatatccagccaccttctaatataaacacaaacgttccatcggcgtctaaatcagccaaatttggtttacataccccaaccactgctactcctagggtagtttctaatccttctaatactgcaggtgtgagtaaaccgggcatgtatatgcccgaatattaccagtcggcatcaccatcgcactctagttcatccgcatcattaaacaaccatattgatattaacacctctaagtcatcatcagctgcttctttaacttcgtcagtatcagctttatccttatcacccacatcagccataaatattagctccaaaagtttgagcccaaagttctctcatcatagtaacagcaatactgctattacacccgcgcctactcccactgcttcaaatattaataatgtaaataagataaccaatacaagtgcacctatttgtgggaggtttcttgtgcataaagatggtacccatgaacatcacttaaaaaatgctaagagacaagaaaagctaagcacaatgattaaaaacatggttggtgcgagcaaattacgtggtgaggcaaaatctgctgtccctgatataataatggatccaaagacgactttaaaatccaacaagaatcctcctactctttttgcaggcttcatgaagcaggtcgtggatatggatgataaatatccagaaggcgctcccacaagtggcgctttaaattgtcctgaaagggatatatacaggtcagatcaaaaagattccaaaaataatacgcataatatcactactactaaaaaagataggcaatgttttgccgaaaagtatggtcgctgtcaagaagtccttggtaaaggtgcttttggtgtagtaagaatatgtcaaaagaaaaatgtttcttctcaagatggtaataaaagtgaaaagctttatgcagtgaaagagttcaagcgtagaacatccgaatcagcagaaaagtattctaagaggttgacttctgaattttgcatttcttcttcattacaccatacaaatattgttactacactagatcttttccaagatgccaaaggcgagtactgtgaagtaatggaatattgtgcaggtggcgatctattcactttggtcgttgccgccggaaaattagaatatatggaagcagattgtttcttcaagcagcttattagaggtgttgtttatatgcatgaaatgggtgtttgtcatagagatttgaagcctgagaacttactgcttacgcacgatggtgtgctaaaaattacagactttggtaacagcgaatgtttcaagatggcatgggaaaaaaatattcaccttagtggaggcgtttgcggttcatcgccgtacatcgccccagaggaatatatcaaagaagagtttgatccaagacccgtagatatatgggcatgtggtgtcatttatatggcaatgagaactggtagacaattgtggagttctgctgaaaaagacgatccattttatatgaattatttaaaaggacgtaaggaaaagggaggctatgagccaatcgaaagtttaaaaagagccaggtgtaggaatgttatatattcgatgttagatcccgttccgtacagaagaattaacgggaaacaaattttgaacagtgaatggggaagggagataaaatgctgccataatgggcgcgcattgaaataaacgagtacttcactttcaaatatcacgatattttggaacaattcggtatttaaatacccagcaaattggagctctgcagagctttcgttcgtatcatcggtttcgacaacgttcgtcaa

SEQ ID NO: 316 - DNA, 1006 bp, Saccharomyces cerevisiae
cttgtttgttgattaacccttaattaagagctagaacgaacgactgcttacactagagaaaaatatggagctaagttcaccatcaaaaaaaaccacaacatcgccaataaatataccaggggggaatagagataacctaataatcggaccacattctcacagcttcaagaccgatccattttcaagtaacaatagtagtttgctgtccaaaatatctactaaccccagtttggaaagccctttctcttcgaaatctttactagattgttctcctgtacaagctgtaaagaagtctttagagtcggaagcaaaaacgcatagcctggacgaggagacaaatgaacagactgatgtaaagatcttaaacatagcagactttcccacagatgaactcatactaatgataagtgcgctacttaacagaattataacagcaaacgatgaaactacagatgtctcacaacaagtgtcggaagagaccgaagacgaactcttaactccaatccttgctttctatggaaagaatgttccagagatagctgttgttcagtacttagagagaattcaaaagtactgtcccaccacaaatgatatttttctttctctccttgtatatttcgatagaatctccaaaaattatgggcattcttctgagcgtaatggttgcgcaaagcaattattcgtcatggactccgggaacattcatagattgctcataacaggtgtcacaatttgcacgaagttcttgagtgattttttttacagtaactctcgatacgccaaggttggaggtatttctttgcaagagttaaaccatttagaattacaattcctgatactatgtgatttcaagttattggtttcagtcgaagaaatgcagaaatatgcaaacttgttatataaattctggaacgaccagtagaatgctgtcctgcgtatcattcatgcccttcccttaccgttactcgtattatttaaatacccagcaaattggagctctgcagag

SEQ ID NO: 317 - DNA, 506 bp, Saccharomyces cerevisiae
aactctttgtttcttgtttgttgattaacccttaattaagatgggtgcttggttatttatccttgctgttgttgtcaactgtatcaatttgtttggccaagtgcatttcacaatactatacgctgatttagaagctgactatatcaatccaattgaattatgttctaaagttaacaagttaattacccctgaagccgccttgcatggtgccttgtcattactattcttactgaacggttactggtttgtatttttattgaacttaccagttctagcttacaatctaaacaagatctacaataaagttcaacttttggatgctaccgaaatattcagaactttaggcaaacataaaagggagagtttcctaaagttaggtttccacttattgatgttcttcttctacttgtacagaatgatcatggctttgattgctgaaagtggtgatgacttctaaatttaaatacccagcaaattggagctctgcagagctttcgttcgtatca

SEQ ID NO: 318 - DNA, 902 bp, Saccharomyces cerevisiae
aaactctttgtttcttgtttgttgattaacccttaattaagatgccctcgttagccgaattgaccaagtcgttaagcatagcctttgaaaacggcgattatgccgcgtgtgagaagctcttgccccctatcaagatcgaacttatcaagaataaccttttaatacctgacttatccattcaaaatgacatctatttgaatgatttgatgattactaaaaggatcctggaagtaggtgcccttgctagcatccaaactttcaattttgacagcttcgagaattacttcaaccaattgaagccttactactttagcaacaatcataaattatctgaatctgacaagaaatcgaagctgataagtctgtatttgttgaacttattgtctcagaataacacaaccaagtttcactcggaattgcagtatctagataaacatatcaagaacttggaagacgattcacttttgtcttaccctatcaaactagacagatggctcatggaagggtcgtaccagaaagcatgggatcttctgcaatctgggtcgcagaatatatcagaattcgactcttttaccgatatcctaaaatcagctataagagacgaaattgctaaaaataccgagctatcctacgactttctccctctctccaacataaaggctttgctctttttcaacaacgaaaaagaaactgaaaaatttgcactagagagaaactggcctattgtcaactcgaaagtttacttcaataaccaatcaaaggagaaagctgattacgaagatgaaatgatgcatgaagaagaccaaaagacaaacattatcgaaaaagcaatggattatgccataagtattgaaaatattgtgtaaaaaattggagctctgcagagctttcgttcgtatcat

SEQ ID NO: 319 - DNA, 638 bp, Arabidopsis thaliana
atgaagatcagacttagcataaccatcatacttttatcatacacagtggctacggtggccggacaacaatgcggtcgtcaaggcggtggtcgaacttgtcccggtaacatctgctgcagtcagtacggttactgtggtaccaccgcggactactgttctccgaccaacaactgtcagagcaattgttggggaagtgggcctagcggaccaggggagagcgcgtcgaacgtacgcgccacctaccatttctataatccggcgcagaataattgggatttgagagccgtgagtgcttattgctccacgtgggatgctgataagccgtacgcatggcggagcaagtatggctggaccgccttctgcgggccggcaggacctcgtggtcaagcttcttgcggcaagtgtttaagggtgaagaacacaagaacaaatgctgcagtaactgtgagaatagtggaccaatgcagcaacggaggcttggatttggatgtagcaatgttcaatcaaatagacaccgatggttttggctatcaacaaggccatctcattgttgactaccaatttgtcgactgtggcaatgagctcattgggcagcctgattccagaaacatgcttgtttcggccattgacgcgtttga

SEQ ID NO: 320 - DNA, 3049 bp, Arabidopsis thaliana
ttaattaagggagaaatggcaagcccacataagccgtggagggcggagtatgcaaagtcgtcgaggtcttcatgtaaaacttgcaagtccgtcattaacaaggagaactttcgtcttggaaagttggttcaatctactcacttcgatggcatcatgcccatgtggaaccatgcttcttgtatactaaagaagacgaagcagataaaatcagttgatgatgttgaaggcatagaatcacttcgttgggaagatcagcaaaagattagaaaatatgtcgaatctggagcagggagtaacacaagcacaagcacaggcacaagcacgagcagtaccgctaataatgccaaactagaatatgggattgaagtgtcacaaacttctcgtgccggttgcagaaagtgtagcgaaaagatcttgaaaggagaggtacgtatattctccaagcctgaaggcccgggtaacaaaggtttgatgtggcatcacgctaaatgtttccttgaaatgtcttcctctactgaactggaaagtttgtctggatggagaagtataccagactcagaccaagaagctcttcttcccttagtgaagaaagctctgccggcagccaaaactgagacagcagaagcacgtcaaacaaattcaagagcaggcacaaaacgaaaaaatgattctgttgataacgagaagtcgaaactagcaaaaagtagttttgacatgtctacaagtggtgctttacaaccttgtagcaaagaaaaggaaatggaggcccaaactaaggaattgtgggacctgaaggatgatctgaaaaaatatgtaacatcagctgagttgcgggaaatgcttgaagtaaatgaacaaagtacaagaggatctgaacttgatctgcgtgataaatgtgctgatggcatgatgtttggcccactcgctctctgcccaatgtgctctgggcatctttctttctccggaggactttaccgatgccatggatacatctcagaatggagcaaatgttctcattccactttggatccagaccgcatcaaagggaagtggaaaatccctgacgaaacagaaaatcaattccttctgaagtggaataagtctcaaaagagtgtgaagccaaaacgtattctgcgtcctgtattgtctggcgagacatctcagggtcaaggttctaaagatgcaactgactcctcaaggagtgaaaggctagcagatcttaaagtttcaattgctggaaatactaaggaaaggcaaccatggaagaagagaattgaggaagctggtgcagagtttcatgctaatgttaaaaaaggtacaagctgtttggttgtttgtggactgacagatatcagagacgctgaaatgagaaaggcaaggaggatgaaagtggcaatcgtgagagaggattatttggttgattgttttaaaaaacagaggaaacttccatttgacaagtacaaaattgaagacactagtgagagccttgtcactgttaaagtaaaaggacgaagcgctgtgcatgaagcgtctggcctccaagagcactgtcacattcttgaagatgggaacagtatctataacacaactctgagcatgtctgatctctctaccggtatcaatagttattacatactccagataatccaagaagataaaggttcagattgttacgtatttcgtaaatggggccgagttggaaatgaaaagattggtggtaacaaagtggaggaaatgtcaaagtctgatgcggttcacgaattcaaacgtctatttcttgaaaaaaccggaaacacatgggaatcttgggaacaaaaaacgaatttccagaaacaacctggaaaatttctcccgttggacattgattatggagttaataagcaagtagccaaaaaagagccatttcagaccagtagcaaccttgctccatcattaatagaattgatgaagatgctttttgatgtggaaacttacagatctgcaatgatggagttcgagataaatatgtcagagatgccacttgggaagctcagcaaacataatatacagaagggttttgaggcattgacggagatacagaggctattgactgaaagcgacccccagcctactatgaaagaaagcttgcttgttgatgctagtaacagattttttaccatgatcccttctattcatcctcatattatccgagatgaagatgactttaagtcaaaggtgaaaatgctcgaggctctgcaggatatcgaaatagcttcaagaatagttggctttgatgttgatagcaccgaatctcttgatgataagtataagaagctgcattgcgatatctcaccacttcctcatgatagcgaagattatcgattaatcgagaagtatcttaacacaactcatgccccaacgcatacagagtggagtcttgagctagaggaagtttttgctcttgaaagagaaggagagtttgataaatatgctccccacagagaaaaacttggcaataagatgctcctatggcatggttctcgattaacgaattttgttggaatattgaaccaaggactgagaattgcacctccagaagctcctgctactggttacatgtttggaaaagggatatactttgctgaccttgtcagtaaaagtgctcagtactgctacacttgtaagaaaaatccggtgggtctaatgcttctgagtgaagttgcattgggagaaatacacgagctaacaaaagctaagtatatggataaacctccgagagggaaacactcgaccaaagggctcggcaagaaagtgcctcaagattccgagtttgccaagtggagaggtgatgtgactgttccctgtggaaaacctgtttcatcaaaggtcaaggcttctgagcttatgtacaatgagtatatcgtctacgatacagcccaggtgaagttgcagttcttgttgaaagtaaggtttaagcacaagagatgagcctgaaccaaacaagaagacgtcacttctgttaactaaatgtttttttgggaaatcgaatccaacacgaagacatttaaat

SEQ ID NO: 321 - DNA, 765 bp, Arabidopsis thaliana
gtttcttgtttgttgattaacccttaattaagatgggtatggcagcagaatcgcagtttcatgttttagctgttgatgatagtttatttgatcggaaacttattgagagattgcttcaaaagtcttcgtgtcaagtaacaactgttgattctggctcaaaggctttggagtttctgggtttaagacaaagtactgatagtaacgacccaaatgcgttttctaaggctcctgttaatcaccaggtagttgaagtgaatcttataattacagattattgtatgcctggcatgactggttatgatttgctcaagaaagtcaaggaatcatcagcttttagagatataccagtagttatcatgtcctcagagaacgttcctgcaagaatcagcagatgtttagaagaaggagctgaagagtttttcttgaaaccagtaagattggctgatcttaacaagttgaaacctcatatgatgaaaacaaagttgaagaaccagaagctggaggagattgagacaacttcaaaagtcgaaaatggagtccccactgcagtagctgatccagagattaaagattcaacaaacattgaaattgaaatcttgcctctgcaacaagatctgctattagttcaacaagaggagcaaacattgagtatcaacaacaagaggaagtcagtggaagaagggatttcaactgatagagcacgtcctagattcgacggtatcgcaaccgctgtctgaatttaaatacccagaaatacccagcaaa

SEQ ID NO: 322 - DNA, 2712 bp, Arabidopsis thaliana
ttaattaaggattcctctgcagtcgtaaagtctgcataccatggttgaaggaaagggcttcctcgtgagctcagtgactgagcttcaccgtaaagagaaacagaagaagaaaggcaaatctggaggattcgagtcactaaatctcggacctaatgtcttcaatgcaatcaagaaaaagggttacaaagttcctacaccaattcagaggaagacgatgccgcttattctctctggcgtcgatgttgtcgctatggctcgaaccggttctggaaaaaccgcagcttttctcatccctatgcttgagaagctcaaacaacacgttcctcaaggaggtgttagagcactcatcttgtctcctactcgtgacttagctgagcagactctgaagttcaccaaggaacttggcaaatttacaggttggtttaatgaattcaatttacaaactttcccttttgttgttgaaaagggatagtgattaaggaaatttgttgtgtttgttatatcagatcttcgtgtatccttactggttggtggagatagtatggaagaccagtttgaagagttaacaaagggacctgatgtgattattgctactcctgggagacttatgcatcttttatctgaggttgatgatatgacgctaaggacggttgagtatgtagtttttgatgaggcagatagtctgtttggtatggggtttgctgaacagttacatcagattctaactcagttaagtgagaataggcagactttgctatttagtgccactttaccaagtgcccttgctgaatttgcaaaggctggtttgcgtgagcctcagcttgttcgtttagatgttgagaataagataagtcccgatttgaagctttcgtttttgactgtacgaccggaagagaagtattctgcattgctgtacttggttagggagcatataagttcagatcaacagaccttgatatttgtttcgacaaagcatcatgtggaatttgtcaactcattgtttaagttggagaatattgagccatctgtatgttatggtgatatggatcaagatgcacgtaagattcatgtatcaaggttcagagcgaggaagactatgttgttgattgtgacagatattgctgctaggggtattgacataccattgcttgataatgttataaactgggatttccctccgagaccgaagatttttgttcatcgtgtgggaagagctgccagggctggtcgtacaggctgtgcatattcctttgttacacctgaggatatgccatatatgttggatcttcatctgttcctctcaaaaccggtcaggccagcgcccactgaggatgaggtcttgaagaacatggaagaagtaatgaccaaaactagtcaagcaattgatagtggagtcaccgtctatggtcgtttcccacagaaaaccattgatcttatctttaatagaaccagagaaatgattgattcatctgcagaattagattcccttgaacgaacatccaccaaagcttttcgcttgtattcaaaaacaaaaccctcaccgtcaaaagaatccattaggagagcaaaggatttaccacgagaaggcttgcatcccatcttcagaagcattattgaaactggggaattagaggcaatgtcgtttttccagaaaattaaaaatttcaggtgagtagtataatcatcgtgttctatttatgtccttgatacgaccagacttcaagatggtatgatcatatgcactttaataccaacgttattaattagaataatggctgatatgtgctagacccaagcaaacgatacttgaagcagaaggtgaagttgccaaatccaaacatgtgaaggtaccctcgctattcctatcttattttccttccctttgtttgtttgactattatagtatttatcatctttctcaaaaatctgtacttggctggtagtttatatgtgtatttctgatatttctttataattagcctaagccaaaccgttttggttcttgtgcagggtcccgctggccaatgggttgatgtgatgaagaagaaaagagctattcatgaggagatcatcaatacaagacatcagcagaatcaaaagacttccaataatcatttggagatggtatttcttgcagtttctaatattaaactgtgccacatgcttctttctttgccattagtttcactcacttaaatgttttgatatctaggaagctgaacctacaacttcttttgttgatggcacagtagagggaagcaaaggtatgcgtgctgcttgtgctcttgttattttaattctatgttaaagtctgttatagttgatcttttgaatagtttgtggtgcatggttggttttccacttctttggttaccttaccttcaaataaactctccattgttttcagtaagcggtaagaaaagaaaggcacaagaaaccttcaaggacgatgaattctttatcagctccataccagtaaatcatgtatgttattttcgttgaataaaagcattttctgtgtcagtacgcattagcagtcaaagctacaatgcttatgatcatattgagatgatgcagagtttgactctttattactcttatgcacgtagcattcagaggcagggctatctctgaggggtaacgaaggatttggatcgaataggtaaaatgatttttgatgtggctatttgtgacattccatagaaggatcaa

SEQ ID NO: 323 - DNA, 3046 bp, Arabidopsis thaliana
ttaattaagaaaaatgctttattgtcttattctcctcctatgtctctcttctacgtatctaccaagtctatctctaaaccaagatgccaccattctccggcaagccaaactgggcttatccgacccggcccagtccctatcttcatggtccgacaacaacgacgtcaccccatgcaagtggctaggcgtgagctgcgacgccacgtcaaacgttgtctccgtcgatctctcaagcttcatgctcgtcggacctttcccctccatcctctgccaccttccttctctccattccctctctctatataataactccatcaatggctctctctccgccgacgacttcgatacgtgtcacaatctcatcagtcttgatttatcggagaatctattggttggatccatcccaaagtcacttcctttcaatctcccaaacctcaagttccttgaaatctccggaaacaacttatcagacacgatcccgtcgagcttcggagagtttcgaaagcttgagtctttaaacctcgccggtaacttcctctccggtacaattcccgcctctctcggtaacgtcacgactcttaaagaactcaaactcgcttacaatttgttttctccgagtcaaatcccgagtcaactcggaaacctcacggagctccaagttctctggctcgccggctgcaacctcgtcggtccgatacctccgtctctgtcccggttaactagtttggttaacttggatttgacatttaaccaactcacaggatctatcccaagttggatcacgcagctaaaaaccgtcgagcaaatcgaactattcaacaactcgttctcaggcgagttaccagaatccatgggtaacatgacgacgctaaaaagattcgacgcgtcgatgaataagctgacaggaaaaatacccgacaacttaaatctgttaaacctcgagtcactcaatctcttcgagaacatgctcgaaggtcctttaccggagagcataactcgctccaaaaccttgtcagaactcaagcttttcaacaacagactcaccggagtattaccgagtcaactcggcgctaactcaccgttacagtacgtggacttatcgtataaccgattttccggcgaaataccggcgaatgtctgcggtgaagggaagctagagtatctaattcttatagacaattcgttttcaggagaaatctctaataatctcggaaagtgtaagagcttgacccgggtccgattgagtaacaacaagctttcgggtcaaatcccacatggattctggggattgcctcgcttgtcacttctcgaactctctgacaattcgttcaccggaagtattcctaagacgatcatcggcgcgaagaatctatcgaacctacgaatctcaaagaatcgattttcaggttcaatccccaacgaaatcggatcgcttaacggaataatcgagatttccggagcggagaatgatttctccggtgagattcctgaaagcttggtgaaattgaagcaattgagcaggcttgatctcagtaagaatcaactctccggtgagattcctagagaacttcgtggttggaagaatctaaacgagcttaatttggctaataatcatctctccggtgaaatccctaaagaagtcggaatcttacctgttctcaattaccttgacctttcaagcaatcaattctccggtgagattccgttggagttacagaatctgaagctaaacgttttaaacctttcgtataatcacctctccggtaaaatccctcctctctacgctaataaaatctacgcacatgacttcatcggaaatcccggtttatgtgttgatctcgacggcctttgtcggaagatcacacggtctaaaaacatcggctatgtatggattcttttaacgattttcttactcgccggtttggttttcgttgtcgggatcgttatgttcattgccaagtgtagaaaactcagagctttgaagagttctactttagcagcgtcgaaatggagatcattccacaagcttcatttcagtgagcacgagatagctgattgtctcgatgaaaagaacgtaatcgggtttggatcttctggtaaagtctataaagttgagcttagaggtggagaagttgtagctgtgaagaaacttaacaaaagtgttaaaggaggagatgatgaatacagtagtgattcgttgaatagagatgtttttgcagcggaggttgaaacgttggggacgattaggcacaagagtattgtgcgtttgtggtgttgttgcagctctggtgattgtaagttgttggtgtatgagtacatgcctaatgggagcttagctgatgtgttgcatggtgaccgcaaaggcggtgttgtgttgggttggccagagcggttgaggattgctttggacgctgccgagggtttatcatacttgcaccatgattgtgttcctcccattgtgcaccgcgatgtgaagtcgagtaacatactgctagatagcgattatggggctaaagttgctgactttgggatcgctaaagtcggtcagatgagtggttccaaaactccagaagctatgtccgggatcgccggttcttgtggttacattgcaccagaatacgtatacacacttcgggtgaatgaaaagagcgatatctacagctttggtgtggtgcttttggaactggttacagggaagcaaccaactgattcagaacttggagataaagatatggcaaaatgggtgtgcactgcacttgacaaatgcggtttagaacccgtgatcgatcccaaactcgatctcaagttcaaagaagaaattagtaaagtcattcacattggtctactctgtacgagtcctctccctctaaacagaccttccatgagaaaagttgtgatcatgcttcaagaagtctctggtgctgttccttgtagcagtccaaacacatctaaacgatctaaaaccggtgggaaactctcgccttactacacggaagacttgaacagcgtttgaacattccaatatgggctgagaatcgatttaaat

SEQ ID NO: 324 - DNA, 1731 bp, Arabidopsis thaliana
ttaattaagtctccctcaagagcaatcaatggatcagaattcgtacaggagaagatcgtctccgatcagaaccactaccggcggttcaaagtccgttaatttctccgaactacttcaaatgaagtatctcagctccggtacgatgaagctcacgagaaccttcactacttgcttgatagtcttctctgtactagtagcattctcaatgatctttcaccaacacccatctgattcaaatcggattatgggtttcgccgaagctagagttctcgacgccggagttttcccaaatgttactaacatcaattctgataagcttctcggagggctacttgcttctggttttgatgaagattcttgccttagtaggtaccaatcagttcattaccgtaaaccttcaccttacaagccatcttcttatctcatctctaagcttagaaactacgaaaagcttcacaagcgatgtggtccgggtactgaatcttacaagaaagctctaaaacaacttgatcaagaacatattgatggtgatggtgaatgcaaatatgttgtgtggatttcttttagcggcttagggaacaggatactttctctagcctcggtttttctttacgcgcttttaacggatagagtcttgcttgttgaccgagggaaagacatggatgatctcttttgcgagccgtttctcggtatgtcgtggttgctacctttagatttccctatgactgatcagtttgatggattaaatcaagaatcatctcgttgttatggatatatggtgaagaatcaggtgattgatactgagggaactttgtctcatctttatcttcatcttgttcatgattatggagatcatgataagatgttcttctgtgaaggagaccaaacattcatcgggaaagtcccttggttgattgttaaaacagacaattactttgttccatctctgtggttaataccgggtttcgatgatgaactaaacaagctattcccacagaaagcgactgtctttcatcacttaggtaggtatctttttcacccaactaaccaagtatggggcttagtcactagatactacgaagcttacttatcgcatgcggatgagaagattgggattcaagtaagagttttcgatgaagacccgggtccatttcagcatgtgatggatcagatttcatcttgtactcaaaaagagaaacttctacctgaagtagacacactagtggagagatctcgccatgttaatacccccaaacacaaagccgtgcttgtcacatctttgaacgcgggttacgcggagaacttaaagagtatgtattgggaatatccgacatcaactggagaaatcatcggtgttcatcagccgagccaagaaggttatcagcagaccgaaaaaaagatgcataatggcaaagctcttgcggaaatgtatcttttgagtttgacagataatcttgtgacaagtgcttggtctacatttggatatgtagctcaaggtcttggaggtttaaagccttggatactctatagacccgaaaaccgtacaactcccgatccttcgtgtggtcgggctatgtcgatggagccttgtttccactcgcctccattctatgattgtaaagcgaaaacgggtattgacacgggaacactagttcctcatgtgagacattgtgaggatatcagctggggacttaagctagtatgattttttgtgtgccttactctgttttt

SEQ ID NO: 325 - DNA, 2276 bp, Arabidopsis thaliana
tattattcatttatttgtcagctttcaaactctttgtttcttgtttgttgattaacccttaattaagatgtctctctttctctccttcttcatttcaatcttgctctgtttcttcaatggagctacgacgacacagtttgatttctccacgctagccataagcaacctcaaactcctcggtgatgcacgtttaagcaatggaatcgttggcctcacacgtgacctctctgtacctaattccggcgccggaaaagtcttatactctaacccaatcagattccgacaacctggaactcactttccgacaagcttctcttcttttttctccttctctataaccaatgtcaacccttcttccatcggcggtggtctcgctttcgtcatctctcccgacgcaaactcaatcggcatcgctggtggctctcttggtctaaccggtccaaacggttccggttcaaaatttgtcgccgtcgaattcgatactttaatggatgtagatttcaaggacattaacagtaaccatgttggattcgacgtaaatggcgtagtttcctctgtttccggtgatcttggcaccgtaaacatcgatctcaagagcggcaacaccatcaattcatggatcgaatacgacggattgactcgggtcttcaacgtatcagtctcttactcaaatctgaaaccgaaagttccaattttgtctttccctctcgatttagatcgatacgtgaacgatttcatgttcgttggattctccgggtcaactcagggaagtacagagattcacagtatcgaatggtggagcttcagttcatcattcgggtcgagtctcggatccggatccgggtcacctcctcctcgggctaatttgatgaatccgaaagctaattcggtgaaatctccgccgccgttggcgtcacaaccgtcgtcttcagcgattccgatctcaagcaacactcaattaaaaacttcgtcgtcgtcgtcttgccacagccgtttctgcaaagagaatcccggaacaatcgccggagtagtaaccgccggagctttcttcttagcactattcgccggagctttattctgggtttactccaaaaagttcaaacgtgtcgagagatctgattcattcgcatctgaaatcatcaaagctccgaaagagttcagctataaagaactcaaagccggcacaaagaacttcaacgagagtcgtatcatcggacatggagccttcggagtcgtatacagaggaatattaccggagaccggagacatcgtcgccgtcaaacgatgcagccatagctcacaagacaaaaagaacgagtttttatctgaactatcaataatcggaagcttaagacacagaaacctcgtgagattacaaggatggtgtcacgagaaaggtgagattttgttagtctacgatctaatgcctaatggttcgcttgataaagctttgtttgagtcacgattcacgttaccgtgggatcatcggaaaaagatcttgcttggtgttgcatctgctttagcttatttacatagagagtgtgagaatcaggtgattcatagagatgttaagagtagtaatataatgttagatgagagttttaatgccaagcttggagatttcggattggcgagacagattgagcatgataagtcgccggaagcaactgttgccgccgggacgatgggatatttagcgccggagtatcttctgacgggtcgtgcttcggagaagacggatgtgtttagttacggagcggtggttttggaagtggttagtggaagaagaccgattgagaaggacttaaatgtgcaaagacataatgttggggtgaatccgaatttagtagaatgggtgtggggtttgtataaagaagggaaagtttctgcagctgctgattctaggcttgaaggtaagtttgatgaaggtgagatgtggcgggtcttggttgtgggcttggcttgttcgcatccggatccagcatttaggcccactatgaggtcagtggtgcaaatgctgattggtgaggctgatgtaccggttgtgcctaagtctagacccaccatgagttttagcacttcgcatttgttgctgagtttgcaagatactctctctgattgtaataccgtggctttgaactctagtcgatcgtcttcgtggtcggtgcccgaacataacgttatcattcgaagcgacgatgaccatttggtatagatttaaatacccagaaatacccagcaaattggagctctgcagagctttcgttcgtatcatc

SEQ ID NO: 326 - DNA, 1651 bp, Bacillus halodurans
atttatttgtcagctttcaaactctttgtttcttgtttgttgattaacccttaattaatccgggcgcgcctgatttatcacaagtttgtacaaaaaagcaggctcctgcaggaccatggctttacaaacagaacaattcaacgcaaacattctaaggaatggtgagtgggtggaaagtcgaactggcgaacgcatttcgatttctgctccagcatctggcgtagctcttggatctatcccagccttatcccaagaggaagtaaatgatgcgattcaaggagcaaaagatgcacagaaaatttggaagattcgcccgattcatgaacgtgtagacttgctttacgcttgggctgaccttttagaggaacgaaaagagatcattggcgaactcatcatgcatgaagtggccaaaccaaaaaaatcagcaattggtgaggttagtcgaacagctgacattatccgtcacacagctgatgaagccctccgtttaaatggagaaaccctcaaaggggaccagttcaaaggaggaagttcgaagaaaattgctctggtggagcgcgaacctcttggtgtcgttttagcgatttcaccatttaactacccagttaaccttgcggcagcaaaaattgccccagccctcgtgacaggaaatactgtcgtctttaaaccggcaactcaagggtcattaagcggtattaaaatggttgaagcacttgcagatgcaggagcaccagaaggaatcattcaagttgtaaccggccgtggttctgttatcggtgaccacttggttgaacacccagggattgacatgattacatttacaggtggaacaactactggagagcgtatttccgaaaaagcgaaaatgattcctgtcgttttagagcttggcggaaaagatccagcgatcgttctcgacgatgccgacttaaagcttacagctagccaaattgtgagcggagctttttcctactctggtcaacgttgcacagcgattaaacgtgtgttcgttcaagacagtgtagcagatcagctcgtagctaacattaaggagctagtcgagcaactaacggtcggaagccctgaggacgatgcggacattactcccgttattgatgaaaaaagcgccgcgttcattcaagggttaatcgatgatgccctcgaaaatggagcaaccttactatctggcaacaagcgtcaaggcaacctcttgtcaccgacactgttagatgatgtcacacctgcaatgcgtgtagcttgggaagagccattcggccctgtccttccaatcattagagtgaaagacgcaaatgaagccattagcttgagcaatcaatcagactatgggcttcaagcgagcatctttacgaaagacaccgatcgcgcgatcaacatcgggaaacatttagaagtcgggacggtccatattaacgcaaaaacagagcgtgggcctgatcacttcccattcttaggtgtaaaaaaatctggtctaggtgtacaaggcattaagccaagccttttatccatgactcgcgagcgcgtgaccgtacttaacctgtaactcgagacccagctttcttgtacaaagtggtgataaattggagctctgcagagctttcgttcgtatcatcggtttcgacaacgttcgtca

SEQ ID NO: 327 - DNA, 1508 bp, Bacillus halodurans
aactctttgtttcttgtttgttgattaacccttaattaatccgggcgcgcctgatttatcacaagtttgtacaaaaaagcaggctcctgcaggaccatggccattttgaaggagccacagcgaacgcaagtagatgaaataaaagagatcaccgaattaagcttattacagtcaacacaatccgtcatcaaagaagcgctcgacctcctcggttattctgaggcaacatatgagcttttaaaagagccgattcgaatgctaacggtccgcattcctgtacggatggatgatggaaacgtcaacatattcaccggctaccgagcccaacacaatgatgcagtaggcccgacaaaaggcggtgttcgcttccatcccgacgtgaatgaaaatgaagtaaaagccctctccctttggatgagtttaaagtgcgggatcgctgacctcccatatggaggcgggaaaggcgggattatttgtgacccgcgtacgatgtcgttcggtgaattggaacgattaagccgtggctatgtacgggcgatcagtcaaatcgtcgggcctacgaaagacattccggcacctgacgttttcacgaactcacaggtgatggcgtggatgatggacgaatatagccgcattcgggaatttgattcccctggctttattacaggaaagccgattgtccttggtggctccctcggacgggaaagcgcaacagcaaaaggagtcatcatttgcattgaagaagcggcgaagagaaaccagcttgacctcaaaggggcccgagtgatcattcaagggtttgggaatgctggcagcttcctagcaaaattccttcacgacgctggtgccctcattgtcgggatttccgatgcgtacggcgcactttatgatcaggctggccttgacatcgaatacttgttagataaacgtgatagttttggaacggtcaccaacttatttaagaagacgattagcaatcaagagcttttgatttcggattgtgacattcttgtcccagctgcgatttcaaatcaaattacaaaggaaaacgcccatgacattaaagcaaaagtagtcgttgaggctgcgaacgggccaacgacgctagaagcgacccggattttaaccgagcggggcatttttttagtacccgatgtgttggctagttcaggaggggttacggtctcttactttgaatgggtacaaaacaaccaaggttactactggaatgaagaagaaatcgatcaaaagttccgcaacatgatcgtaggttcgtttgagaaggtatgcaccttttcaaaccagcaccaagtcgacatgcgtctcgccgcctatacggtcggcgttaagcgaatggctgaagcttctcactttagaggctgggtataagaaagggtgtgtgaggctcctaccgttaggaggggtctcatttctcatttctcgagacccagctttcttgtacaaagtggtgataaattggagctctgcagagctttcgttcgtatcat

SEQ ID NO: 328 - DNA, 1756 bp, Bacillus halodurans
tattcatttatttgtcagctttcaaactctttgtttcttgtttgttgattaacccttaattaatccgggcgcgcctgatttatcacaagtttgtacaaaaaagcaggctcctgaggaccatggtaacaccttataagcatgaaccgtttacagattttagtgtagaagaaaaccgcagcgcgtttgaggctgccttaaagaacgttgaaggggaattagggaaagactacccgttagtgatcaatggggaacgtgtgacgaccgatgataaaatcgtttccgtgaatcctgccatgaaagagcaagtgatcggcgtcgtctcaaaagcaagtcgcgagatagtagatgatgcatttaaatcggcagagacggcatttcatacgtggaaaaacgtcaatcctgaagagcgagcgaacatcttaatcagagcggccgcgatcattcgccggagaaagcatgagttttcggcatggctcgtgaaagaagcgggtaagccttggaaagaagccgatgcagacacagcggaagcgatcgactttttagagtactacgcccggcaaatgattacgctaaaggatggaaagccagtcaatagtcgcgagggtgagcataatcgctacttctatacaccgatcggggtatgtgtcacaatctcgccttggaatttcgccttggcgattatggctggaacgacggtagcgccaattgtaacagggaacaccgtcttactgaaaccagctagcacgacccctgttgtcgccgcaaagttcgtcgaagttcttgaagaagcaggtttgccaaagggtgtggtcaacttcgtcccaggaagtggaacagacatcggtgactacttgatcgatcatccaaaaacaagcttgatcacatttaccggttcgcgtgacgtgggagtccggctttatgaaagggcagcggttgttcatccaggtcaacagcatttgaagcgcgtcattgtagagatgggaggaaaagataccgttgttgtcgataaggatgccgatctcgatttagctgctcaatcgatcgtgacctcggccttcggcttttctggacaaaaatgttctgcaggttcgagagctgtcatccatcaagacgtctatgatgttgtgttagagaaggccgtggccctcacgaaacaactctcagtaggcgaaccgacggcacctgacgtctatatgggacctgtcgtcgatcaaggagctttttcgaaaattatgagctatatcgaagtggggaaagaggaaggccgattgatggtcggaggtgaaggagatgattcaaaaggcttcttcattcaaccgacgatctttgctgacgtagatccccatgcgcgaatcatgcaggaagagattttcggtccagtcgttgccttcagtaaggcaagggattttgatcatgcgctagaaatcgccaataataccgagtacggtctgacaggagctgtcattacaacgaaccgtcaccatatcgaaaaagcgaagcgagacttccatgtaggaaatctatactttaaccggaattgcacaggcgcgattgtcggctaccacccattcggcggctttaaaatgtcaggcaccgattcaaaagctggaggacctgattatttggcccttcatatgcaagcaaaaaccgtctccgaaatgtattaactcgagacccagctttcttgtacaaagtggtgataaattggagctctgcagagctttcgttcgtatcatcggtttcgacaacgttcgtc

SEQ ID NO: 329 - DNA, 1099 bp, Bacillus subtilis subsp. subtilis str. 168
aactctttgtttcttgtttgttgattaacccttaattaatccgggcgcgcctgatttatcacaagtttgtacaaaaaagcaggctcctgcaggaccatggtatgccagcataatgatgagcttgaagccttagtgaaaaaggcgaaaaaagtaacggacaagggggaggtagccagctatattcccgccttggcaaaagctgataaacacgacctgtcagtggcgatttattattccaataatgtttgtctgtcagcaggtgacgtagaaaaaacatttacgcttcaaagtatatcgaaagtcctttcccttgctttggtgttaatggaatacggcaaagataaggtcttcagttatgttggacaggagccgaccggtgatccgtttaattcaattatcaagctcgaaacagtgaatccgagcaagccgttaaaccctatgattaatgccggggcattggtagtgacaagtctgataaggggaagaacggtaaaagagagacttgattatttgctttcttttatcagaaggctgacaaacaaccaagagattacatactgccgggaagtggctgaatctgaatacagcacttcaatgattaatcgggcgatgtgttattatatgaagcagtacggcatttttgaagatgatgtagaggcagtaatggatttatatacgaagcaatgcgcgattgagatgaacagcttggatttagcgaaaatcggatctgtattcgcattgaacggcagacatccagagactggggagcaggtcatctcaaaagatgtcgctagaatttgcaaaacgtttatggtgacgtgcggaatgtacaatgcaagcggggaattcgcaattaaggtcggaattcctgcgaaaagcggcgtatccggcgggataatgggcatttcgccttacgatttcgggatcggcatattcggccccgcattagacgaaaaagggaacagcattgcaggtgtaaagcttttggaaataatgtctgagatgtacaggctgagtattttttaactcgagacccagctttcttgtacaaagtggtgataaattggagctctgcagagctttcgttcgtatcatcggt

SEQ ID NO: 330 - DNA, 1148 bp, Escherichia coli K12
aactctttgtttcttgtttgttgattaacccttaattaatccgggcgcgcctgatttatcacaagtttgtacaaaaaagcaggctcctgcaggaccatggtagatgcaaacaaattacagcaggcagtggatcaggcttacacccaatttcactcacttaacggcggacaaaatgccgattacattccctttctggcgaatgtaccaggtcaactggcggcagtggctatcgtgacctgcgatggcaacgtctatagtgcgggtgacagtgattaccgctttgcactggaatccatctcgaaagtctgtacgttagcccttgcgttagaagatgtcggcccgcaggcggtacaggacaaaattggcgctgacccgaccggattgccctttaactcagttatcgccttagagttgcatggcggcaaaccgctttcgccactggtaaatgctggcgctattgccaccaccagcctgattaacgctgaaaatgttgaacaacgctggcagcgaattttacatatccaacagcaactggctggcgagcaggtagcgctctctgacgaagtcaaccagtcggaacaaacaaccaacttccataaccgggccatagcctggctgctgtactccgccggatatctctattgtgatgcaatggaagcctgtgacgtgtatacccgtcagtgctccacgctcctcaatactattgaactggcaacgcttggcgcgacgctggcggcaggtggtgtgaatccgttgacgcataaacgcgttcttcaggccgacaacgtgccgtacattctggccgaaatgatgatggaagggctgtatggtcgctccggtgactgggcgtatcgtgttggtttaccgggcaaaagcggtgtaggtggcggtattctggcggtcgtccctggagtgatgggaattgccgcgttctcaccaccgctggacgaagatggcaacagtgttcgcggtcaaaaaatggtggcatcggtcgctaagcaactcggctataacgtgtttaagggctgatcatgatgaacacggaaggtaataacggtaacaaacctctcggtcgctcgagacccagctttcttgtacaaagtggtgataaattggagctctgcagagctttcgttcgtatcatcggt

SEQ ID NO: 331 - DNA, 1486 bp, Nostoc punctiforme PCC 73102
aactctttgtttcttgtttgttgattaacccttaattaatccgggcgcgcctgatttatcacaagtttgtacaaaaaagcaggctcctgcaggacatggtaagtatccctattaacttaaatttacctcgtataccccatttaataacttccttacctggacctcttgctcaagcaattgtacagcgcgatcgcgccgtaacttccccttcttacacccgtgattatccgttagttgtatctcgcggacaaggctgtatggtagaagatgtggatggcaatgtatttctggatatgaccgcaggtattgctgttaccgccaccggacacgcccacccggaagtcgtcaaagcaattcaagaacaatccgaacgtctgctgcacatgtcagggacagatttttattatgaaccgatggtggaactggcggaacaactagcgattcgcgccccttttcctcaaccacagggtaacagtgcattcccggcaaaagtatttttcaccaattctggggcagagtcaaatgaaggagcgctaaaactagctaaatattacaccaagcgatcgctaattgtggctttcttaggcgcatttcacggacgcacttatggggcaatgtctctcacgggttctaaagcagtgcagcgagcgaattttgggcctttagttcctggggtaactcatatcccttatgggactcacgccagcttagattacctggaacaacagctatttgggacaattttaccaccgcaagaagtagccgcgattgtagttgagccgattcaaggagagggtggttatatcgtaccagaggatggttttttaaaacggattcgggatatttgcgatcgccacggtattctgatggtagtggatgaagtgcaagcgggaatggggcggacaggtcgcttatttgcgatcgagcattggggagtgatgcctgatattattactactgctaaaggtatcgccagtggtttgccattaggagcgatacttgcaaaacctgagttaatgacttggcctcctggttctcacgctactacatttggcggaaatcccgttgcttgtgctgccggtattgctacactgcgattgttagaaagtggtttgatggcaaacgctacccaaatgggagaacttttacaagctagccttagtgagttgcaccaaagatttccgagagtatcgccgccacgaggtaaaggtttgatggttgcagtggatttattggatgaacaaggtaatctagatcgtgaattgcgcgatcgcattattcaagaagcttttttacgcggtttattattactaggttgcggtaaagcagcaattcgtttctgtccccctctagttatcgacagcgaccaaattcaaatagcccttcagattatcagcaacattctaacttcttaactcgagacccagctttcttgtacaaagtggtgataaattggagctctgcagagctttcgttcgtatcatcg

SEQ ID NO: 332 - DNA, 1993 bp, Arabidopsis thaliana
ttcttgtttgttgattaacccttaattaagcgatgagttcatcaacaagaaagcttgaggttgtttcaccagttcccgccgatatcgacatagctaattccgtcgagcctttacacatctctgagattgccaaagatcttaatatcaaccctcttcactacgatctctatggcaagtataaagctaaggttttgttgtctgcgtttgatgagcttcaaggacaagaagatggatactatgttgttgttggagggattactcctactcctcttggagaaggcaagagtactaccactgttggactttgccaagccttaggcgcttacctcgataagaaggttgttacttgtcttcgccaaccgtcacaaggacccacctttggaatcaaaggaggtgcagctggtggtgggtatagtcaggtgattcctatggatgagttcaatcttcatctcactggagatattcacgcgattaccgcttccaacaacctcttagctgctgcaatcgacactcggattttccatgagacgtctcaatccgacaaggctctttttaataggctgtgccctccgaataaagaagggaagcgtagtttcagtgacattatgttcaggagattgacaaagcttgggatatccaagaccagtcctgaggagcttactcccgaggagataaagaagtttgcgaggcttgatattgatcctgcttctatcacttggagaagagtgatggatgttaatgatcggttcttgaggaagattactattggtcagggacctgaggaaaaggggatgactagagaaactggttttgacatttctgttgctagtgagattatggctgttttggctttgacaacctcactaggtgatatgagagagaggcttggtaaaatggtgattggtaacagcaaggcaggggatccgataacagcagatgatctcggtgttggaggagccttgactgttctgatgaaagacgctattaacccgacactcatgcagacactggaagggacccctgttctagtgcatgctggtccttttgcaaatatagctcatggaaattcatcgattgttgctgataaaatcgctttgaagctggtgggacctggtggatttgtggtaactgaagcgggttttggttctgatattggaacagagaagttcatgaatattaagtgccgttacagtgggctaacgcctcagtgtgcaattgttgtggcgactgttagggctttgaaaatgcatggaggtgggcctgatgttgttgccgggagacctcttgatcgtgcttatgtaagcgagaatgtttccttagttgaagctggctgtgtgaatctggcaaagcacatctcaaacacaaaggcctacggtgtgaatgtaattgttgctgtgaatatgttcgcaacagataccgaagcagaactaaatgcagttaggaaattttcaatggatgccggtgcttttgatgctgtggtctgctcccaccatgctcatagtggtaaaggagcggtggatcttggtatcgcggttgaaaaagcttgtcaaaacattacacagcccctcaggtttctctacccattggacattggtatcaaagacaaaattgaggcaatagctaagtcatatggagccagtggtgttgaatattcagaccaggcagagaaacagattgagatgtacacacaacaaggcttctcgaatcttcccatatgcatgtcgaaaacacagtactcattctcacatgatgcatcaaagaaaggagcaccttcagggtttgtattgccaattagggatgtaagaggaagcattggagctggtttcatatatccactggttggtacaatgagtacaatgcctggacttcctacaagaccttgtttctacgagattgatattgacactgaaactggaaaagttcgtggcctttcttaagtttggcgcgccaaaaattggagctctgcagagctttcgttcgtatcatcggtttc

SEQ ID NO: 333 - DNA, 1558 bp, Sinorhizobium meliloti
aactctttgtttcttgtttgttgattaacccttaattaatccgggcgcgcctgatttatcacaagtttgtacaaaaaagcaggctcctgcaggatcatgaacgcccacaacaagcccaacgctccggttctcgacagctactggatgcccttcaccgccaaccgccagttcaaggcggcaccccggctgctcgccgccgccgagggcatgcactacaccagcgtcgacggccggacggttctcgacggcaccgccggcctctggtgcgtgaatgccgggcacggccgccggcagatcgccgccgcggtcgagcggcagctttcgaccatggacttcgcgccgtccttccagatgggtcatccgatcgccttcgacttcgccgagcggctggccgagatcgcgcccggcccggctggcgccaagctcgaccgggtgttcttcaccggctcgggctcggaatccgtggacaccgcgctgaagatggcacttgcctatcaacgttcgatcggccaaggcacgcgcacccgcctcatcggccgcgaacgcggttatcacggcgtcggcttcggcggcatctccgtcggcggcatcgtcaacaaccgccgcgtcttcccgcagcttcccgggtccgaccatctgcgccacacccatgatccggcgaagaacgccttcgtcaaagggcagccggagcatggtgcggagcttgccgacgacctcgaaaggctcgtggcgctccacggcgccgagacgatcgccgcctgcatcgtcgagccagtcgccggctcgaccggcgtgctgatcccgccgaagggctatctcgagcggctgcgcgcgatctgcgacaagcacggcattctcctgatcttcgacgaggtgatcaccggtttcggccggctcggtgcggcctttgcgaccgactatttcggcgtcacgccggacatcgtcaccaccgcaaaggggcttaccaacggtgcgatcccgatgggcgctgtctttgccagccgcaaggtgcacgacgcgctgatgcacggccccgaaggccagatcgagctcttccacggctatacctattccggccatccggccgcctgtgccgccggcatcgccacgctcgacatctatcgcgacgaaggcctgatgacgcgcgccgccgaaatcgagggcgactggcacgaggcgatgcattccatgaaaggcctgccgcacgtcatcgacatccgcaccatcggcctcatcgccggcatcgagctccagtcgcgcgacggcgcgcccggcgctcgcgcctatgacgtcttcgtcgattgtttcgagcggggcctgctgatccgcgtcaccggcgacatcatcgccttctcgccgcctctgatcgcggaaaagcagcatttcggcgagatcgtctcgatccttgccgatgcgttgaagcgggtgaagtaacagcggttcgcgcgcggaatgacccctccccacgtttgggaggggcaattctcgagacccagctttcttgtacaaagtggtgataaattggagctctgcagagctttcgttcgtatcatcggtt

SEQ ID NO: 334 - DNA, 1631 bp, Xenorhabdus nematophila
aactctttgtttcttgtttgttgattaacccttaattaatccgggcgcgcctgatttatcacaagtttgtacaaaaaagcaggctcctgcaggaccatggccgttgaacatgttttgtccatgattgaagaacatcaggtgaagtttattgacttacgttttactgataccaaaggtaaagaacaacatatcaccattcctgcccaccagattgatgaagacttcttcgaagatggcaaaatgtttgacggttcatctatcggtggctggaaagggatcaatgaatccgacatggtgttaatgccagatccaacgaccgcaatgcgggatcccttctttaatgatgccacactgatcctgcgctgtgacatcctggaacccggcactatgcagggttatagccgtgatccgcgttctattgccaaacgtgcggaagatttcctgcgtgcaagcgatattgctgatacggttctgtttgggccagagcctgagttttttctgttcgatgacattcgtttcggtagttccatttcgggtagttattaccatattgatgatgttgaagccgcatggaacagtggaacacgctatgaaggcggtaacaaaggccaccgtccgggcatcaaaggcggttattttccggttcctcccgtggactcctctcaggatctgcgttcagccatgtgtctgacaatggaaaaaatggggctggtggttgaagctcaccaccatgaagtggcgaccgcaggccagaatgaaatcgcgacccgctttaatactatgaccaaaaaagcggatgaaacccagatttacaaatatgtggtgcacaatgtggcccattcattcggtaagaccgcaacgtttatgccaaaaccgctggtaggcgataacggctctggtatgcactgccacatgtcgctgtccaaaaatggcaccaacctgttcgcaggtgataaatatggtggcctgtccgaactggcgctttactacatcggcggcgtaatcaaacatgcccgtgcattgaatgcctttaccaacccaaccaccaactcgtacaaacgtctggtaccgggttttgaagcaccagtgatgctggcttactcagcccgtaaccgctctgcttccatccgcattccggttgtggcaagcgccaaagcccgccgtattgaagtgcgtttccctgatccggccgcaaacccttatctgtccttctctgccctgctgatggcaggtcttgatggcatcatcaacaaaatccaccctggtgatgcgatggacaaaaatctctatgacctgccagcagaagaagctcaagagatcccaaccgtagcctcttctctggatgacgcgttagccgctctggatgcagaccgggaattcctgactcgtggaggtgttttcactgatgatgccattgatgcttatatcaaattactgcatggtgaaatcgaacgcgtacgcatgacgccacatccgctggagtttgaactgtattacagcgtgtaatgcttgatggcattacgactatccttttttgttgccgtgaaacttttgctcgagacccagctttcttgtacaaagtggtgataaattggagctctgcagagctttcgttcgtatcatcggtttcg

SEQ ID NO: 335 - DNA, 699 bp, Nitrosomonas europaea
gctttcaaactctttgtttcttgtttgttgattaacccttaattaatccgggcgcgcctgatttatcacaagtttgtacaaaaaagcaggctcctgcaggaccatgtcaatcaaatcacgtatccgtaccatcccgcattacccccatgaaggcatcatgttccgggatatcaccacactcctgaaagatccggctggactgcgctcgaccatcgacggaatcgttcaacgctatcaaaccgaaaagatcgataaagtcgtcggcattgaatcacgtggattcatcattgctgcaccggttgcgtatgcactgagcgccggattcgttcctgttcgcaaacaaggtaaattaccggccgaaaccattggctgcgattatcagctggaatacggttatgacaaagtcgagattcacgtggatgcgatcgataaaggggatcgcgtattactgatcgatgatctgattgcaacaggtggaacgatggaagctgcaatcaagctggttcaggaggcaggtggagaagtgattgaatgctgtttcgtgatcgatttgcctgatatcggtggaagcaggcgactgcgtcagcaaggtcatcgactgttttcgctctgcagttttgaagattgactcgagacccagctttcttgtacaaagtggtgataaattggagctctgcagagctttcgttcgtatcatcg

SEQ ID NO: 336 - DNA, 915 bp, Nostoc punctiforme PCC 73102
caaactctttgtttcttgtttgttgattaacccttaattaatccgggcgcgcctgatttatcacaagtttgtacaaaaaagcaggctcctgcaggaccatgacaggaacagatcccgtaaagttgatgaagcaagaagttggcaaagccgctgccgccctagtaaaatcgggttctatcgtcgggttgggtacggggtcaactacagcatatacgattcagtttttaggcgatcgcctcaagtctggtgaactcaaagatatcattggcatacctacctcgtttcaatcagaagtgctggcgaaacagtatggtgtccctcttgctaccttggattctattgaccacatcgatattgccattgatggggcagatgaagttgatccgcagaagaatttgattaaaggcggtggtgcagcacatacccgcgagaaagtcgtagactacctggcagaacagtttatcgtcgtggtagatagtggtaaattagtagatcgcttgggttctagttttgctgtacccgtggaagtgattccaatggcaattactcctgtaaccaatgccattaaaaaactcggtgggaaacccgaactccgcatgggtgtcaaaaaagctggcccagtgatcactgaccaaggtaactttgtcttagatgtcagatttgactctattgaagatccagtcagcctagaaaaaacattgaataacattcccggtgttctggagaatggtatttttgttaactgtgtcgatttagttttgattggtgaagtcaaagatggtcagccattagtgcggcaactgtaagagttatagattttggattttagattttagatgtctctctcgagacccagctttcttgtacaaagtggtgataaattggagctctgcagagctttcgttcgtatcatcg

SEQ ID NO: 337 - DNA, 723 bp, Pseudomonas syringae pv. tomato str. DC3000
gctttcaaactctttgtttcttgtttgttgattaacccttaattaatccgggcgcgcctgatttatcacaagtttgtacaaaaaagcaggctcctgcaggaccatgaccttcgatcaatcgaacttcaaatccctgatacgcccggtcgtagacttccccaagccgggtgtggtttttcgcgacatcacgcccctgttccagtcgcccaaagccacccgtcaggtaatcgacagtttcgtgcagcgctatatcgatgccgatttcagccacatcggcgtcatggatgcacggggttttctgattggttcagtggtcgcgtatcagttgaacaagccgctggtgctgtttcgcaagcagggcaaactgccagctgacgtgctgtccgaggcctatcagaccgaatacggcgaagcgtatctggaagtgcacgcagacagtctgtgcgagggtaattcagtcatcatgttcgatgacctgattgctaccggcggcacgctgatcgccgccgccaacctgatccgccgtatgggcgcccaggtgcacgaagccgctgcaatcatcgacttgccggaactgggtggctccaagcgtcttaacgacctgaacatcccgacgttttgcctgacggaatttgcgttggacgagcagtaactcgagacccagctttcttgtacaaagtggtgataaattggagctctgcagagctttcgttcgtatcatcg

SEQ ID NO: 338 - DNA, 621 bp, Xenorhabdus nematophila
tcatttatttgtcagctttcaaactctttgtttcttgtttgttgattaacccttaattaatccgggcgcgcctgatttatcacaagtttgtacaaaaaagcaggctcctgcaggaccatgacgattgaacgtactttttccattattaagcctaatgctgtgaagaaagatgctatcggttctatttatgcccgttttgaaagtgcagggtttaaaatcatcgcagccaaaatgctgtatttaacacgtgagcaggctgaaggtttttacgctgagcacaaaggccgtcctttctttgatggtctggtagaatttatgacttctggcccaattgtggtacaggttctggaaggtgaaaatgcggttcagcgccatcgtgatctgatgggtgctaccaacccggacaatgcactggccggtactctgcgtgcggactatgcagatagctttactgaaaatgcggttcacggttcagactccattgaatctgcaaaccgtgagattgcttattttttcagtgatgatgaaatcttcccccgccactgactcgagacccagctttcttgtacaaagtggtgataaattggagctctgcagagctttcgttcgtatcatcggttt

SEQ ID NO: 339 - DNA, 1645 bp, Saccharomyces cerevisiae
tttatttgtcagctttcaaactctttgtttcttgtttgttgattaacccttaattaatccgggcgcgcctgatttatcacaagtttgtacaaaaaagcaggctcctgcaggaccgatactaggctgccctgatcaaacaaggaaattgacagatgatgcttgaagggtatacggtacaacctccacagtctactttgataggtgacattgaaattcaggacgaaaatgcaaaccaagaagttaagaacgtactttaccaaggagttcaaaagggtataaaaaggctagaaaaaagacaaaggagggttgcattaggtgatgtaacctctcaaaaggcaaacaaaatacacaatgctatacataataaattccatcagacgaagaacaattttgaaatagagaacatacgctcatcggccttggtaaaagaacaacaacgagacgtaaggcatgaagatagcgactattttttaattgatagttctgaaggctcttctactgatgacgaacaagttaatgaagatgctattgatgatttgttaagtcgaagagtaaatgatcagcagattcaagccgatgaagtgtatgaagatttcgatggagaaatgcaagatgtcattgaagaggatgttgatagtcaaattgaaccactatcaccaataaacaacgatgaaattcagactgagctggacagggcgtttgaaaaatattttcggtcggttcccaatccgctggatgatgatacccatgatgttgtgatggttgtggagtacgcttccgacatattctattacttgagagaacttgaagtgaaatataggcctaatccctactatatgcaaaatcaagtagagcttacatggccgttcagacgaactatgatagattggctagttcaactgcattttagatttcaacttttaccagaaacgctatacctgacgattaatatagtggatagatttctgtcaaagaagaccgttactttgaacaggtttcaattggttggtgtatcggctttatttattgctgccaagtttgaagagattaactgccccactttggatgatctagtttacatgctggaaaatacatacactagagatgacattattagagcggaacagtatatgatagatactctggaatttgaaataggttggccaggacccatgccatttttaagaaggataagtaaagcagatgactatgacttcgaaccaagaacattagcaaagtacttattggaaactacaatagtagaacccaaactagtggctgcggcaccaagctggttagctgctggcgcgtattttctgagcagaacaattcttggttcaaatgattggtctttaaaacatgtattctactctggctatacatccagccaaataattcctttagcatcactgatattggagaattgcaagaacgcatctcgacgccatcattcaatttggaaaaaatactttgaccaaaagcattaccgctgttctcaaattgtagaagaatggattgtttcgacagaagcctaacttactcatcttaacaccatttgcttcagttttggtctcgagacccagctttcttgtacaaagtggtgataaattggagctctgcagagctttcgttcgtatcatcggtt

SEQ ID NO: 340 - DNA, 1778 bp, Saccharomyces cerevisiae
ttcatttatttgtcagctttcaaactctttgtttcttgtttgttgattaacccttaattaatccgggcgcgcctgatttatcacaagtttgtacaaaaaagcaggctcctgcaggaccatggatagaacgtggctattactgacgtggctgttgctactctgtggggtagttcaagggaaccaagaaagcataaatcaaaaatatcacgatgtctgttcagggatgtattccaaggaggatttcaatggaaaagttgacccctatatatcgtttacgttggaggaattgtcacttgctgatgaagacgatgatggcgagggggttagtgttgctgtgtttgatttccaagattatgagcatattggtgtgcggttaccaaatggagaaattcagtatatttgcgatgactacgcattggatttgggcctctgtgaggattcgtcggaggggcaatttatcattcaagagacagccatcgatccgttcaccagtaaggaacataagctaacgagtcagattttgactttcactcaacaagaattgggcactaacgacaaggtatactcaattaacaaaactggttactattgtgtgaccacgtcatctttcatttcttccagttccaagtttaaggctacagtgaattttaggaacgcttacggtcaattggacgcttcagaggcgtacaagatgcctatttatgcctttttggccgtcgcttatgccgtctgtacattagtgtactcttggctatgctggaagcatagacatgagttactgcctttacaaaggtacattttggtattttgtattttcctaacagctgatactattttcgtctggatgtactatattattgagaaccagaagggaaactccagcgtcgctcttcatgtctatatggttttcatatcgatctttagcgccggtaagatgactttcacgcttctcctcgccttgctgatatctcttggatatggtatagtatatccaaaactggaccgtacattgctaagaagatgtcaaatatttgcgatatttacgtttgcagtgtgcgttgcattcctggtccaaaaatattcccagaattctgagtctttatccaatttgattttgattactgctatccccttagtattatgtctattcgctttctattatttgacactgtcttcaatgaacaaaacaatgacttatttgagggaacaaaaccaagtggtgaaattaaacatgtacagaaaactgatcatattgtgttatatttcgttgtttatactcttcttaggcttactagtctctacttttgcatacgtcggtatggacactgttgacatgatagaacaatattggaaaacagaattcctcatcacagatacttggcctagtttcgtttacttcttggtcttcgtcattttcgcattcttctggagacctacaagtacatcatatttactagcgtgctcgcatcaattaccaactgacatggaaaatgtatcagaattcgatttagatgacataaattccttgtctgatgaggcattgcctaatagagagccacgtaatgactaccaggaacacgatcacaatatggatattgatttagcatccgattttgaagaagtgccaagtgtaaatgcaaatacgaacgcaaataatgacgtattgttcgacgtagattacgacagagatgcaaaaaatgatagaagtactacataactcgagacccagctttcttgtacaaagtggtgataaattggagctctgcagagctttcgtt

SEQ ID NO: 341 - DNA, 481 bp, Saccharomyces cerevisiae
ttcatttatttgtcagctttcaaactctttgtttcttgtttgttgattaacccttaattaagatgagcaacgaagttgacaggatggatgttgatgaagatgaatcgcaaaatattgcgcaaagctcaaaccaaagtgcgccagtggaaaccaaaaagaagagatttgaaattaagaaatggaccgcagtggcgttttggtcatgggatatagctgttgacaactgtgctatttgcaggaaccatataatggaaccatgcattgaatgccagccaaaggccatgacggacactgataatgaatgtgtagcagcctggggtgtctgtaatcacgctttccatttgcactgtattaataaatggatcaagacaagagacgcatgcccattagataaccaaccttggcagttagcaagatgcggtaggtgaatttaaatacccagcaaatacccagcaaattggagctctgcagagctttcgtt

SEQ ID NO: 342 - DNA, 1690 bp, Saccharomyces cerevisiae
ttcatttatttgtcagctttcaaactctttgtttcttgtttgttgattaacccttaattaatccgggcgcgcctgatttatcacaagtttgtacaaaaaagcaggctcctgcaggaccgcacatcacagctagaataaacttccaaaaatcacccgcttgcaatgctgtccattttaagaaattcggtgagactaaattcaagggctcttagggttgtgccatctgccgccaacaccttaacatcggttcaagcatccagaagacttttaacaagttattcaagttttttacaaaaagaaacaaaagacgacaagcctaaatccattcttacagatgatatgctgttcaaggccggtgttgacgtcgatgagaagggccaaggcaaaaacgaggaaacatcaggagaaggaggagaggacaagaatgaaccttcttccaaaagtgaaaaatctagaagaaaaagacaaacttctacagatattaaaagagaaaagtatgctaactggttttacattttttcgttgtctgcgttgacaggtactgcaatctacatggcaagggattgggagcctcaagagtctgaagaattgaagaaagacatcgataatggctacactttatcacttatgtataaaagattcaaggccaggttcaactcaatgttcacctacttccaagagccacctttccctgatttactacctccaccaccaccaccaccgtaccaaaggccattaactcttgttatcacattggaagattttttggttcattctgagtggtctcaaaagcatggttggagaacggccaaaagacctggtgctgactacttcttgggttacctatcgcagtattacgaaattgttttgttttcatccaactatatgatgtactctgacaaaatcgctgaaaaattagatccaatccatgcattcgtatcttataatttgttcaaggaacactgtgtttacaaagacggtgtgcacattaaggatctgtcaaaattgaatagagatttgagtaaagtaatcattattgacactgaccctaacagttacaaattgcaacctgaaaatgctattccaatggagccatggaatggtgaagctgatgacaaattagtaagattgattccatttttggagtaccttgccactcaacaaaccaaggatgttagaccaatcttgaacagctttgaagacaagaagaacctagcagaagaatttgatcatcgtgtgaaaaaattgaaggataaattttacggagatcataaatctggtggcaactgggcaatgacggcactaggtctcggaaattccctgggcggcagcaccaagttcccgctcgatttgattcatgaagaaggacaaaagaactatttaatgttcatgaagatgattgaggaagaaaaggaaaaaattagaatacagcaggagcaaatgggcgggcaaacatttacgctgaaagactatgttgaaggtaacttgccttcgccagaagaacaaatgaaaatacaattggagaagcagaaggaggtagacgccttatttgaagaggaaaagaaaaagaagaagattgctgaatccaaataattttcatgtaaaccctcttctcatgtatctacgtatcctcgagacccactttcttgtacaaagtggtgataaattggagctctgcagagctttcgtt

SEQ ID NO: 343 - DNA, 1500 bp, Saccharomyces cerevisiae
tttatttgtcagctttcaaactctttgtttcttgtttgttgattaacccttaattaatccgggcgcgcctgatttatcacaagtttgtacaaaaaagcaggctcctgcaggaccatgcaatctatgaatgtacaaccgagggtattagctgtaggaggtgagcagtttttctctcagaggcaggcttctgaacaacaccagcagcaaaacatgggacctcaggtgtattcgccaaaggttaatagagcaagaatgtttcctcaagggatgcctgtaaatacaattaatggctctgttaatcaggagatgaacaatgcctatcttttgaagcagaagaacgagccactgttaactcagcaacaacagcaacagcaacaacaacagcagccatttaatataggaacgcctgtttcggtggctagtttgccgcccggactgaacgttctgcagcaacaacaacagcagcaacaacaacagcagcaacagcagcagggagtgggactcaatcgtcccttggcttcccagctacccaagcatttaaccaaccaaagtatgccaccgatctttttaccacccccaaattatcttttcgttcgcgatgtctggaagtccaacctttacagtgaattcgccgttataagacaactggtctcgcagtataatcatgtgtcaatcagtactgagtttgtggggactttggctaggccgatcggcactttcaggtcgaaggtcgattaccactatcagacaatgagggccaacgtagacttcttaaacccaatacaacttggtctttccttgagtgacgccaacggcaataagcctgacaacggtccctcaacgtggcagttcaattttgaatttgacccaaagaaggaaatcatgtccacagaatcgttagaattactcagaaaatcaggtatcaacttcgaaaaacacgaaaatttaggcatcgatgtatttgaattttcgcagcttctaatggactctggtttaatgatggatgattctgttacttggatcacataccatgcggcatatgatctaggtttcctgatcaacattctaatgaatgactccatgcccaacaacaaggaggatttcgagtggtgggtccatcaatacatgcccaatttctacgacttaaacctggtgtataaaataatccaggagttcaagaaccctcaattgcaacaatcttcacaacagcaacagcagcagcaatattcactaaccacacttgccgatgagttagggctaccaagattctctatatttactactacaggcggccagagtctattgatgcttctatccttctgccaattgagcaagctgtctatgcataagttcccaaacggtacggatttcgccaagtaccaaggtgtcatatacggtattgatggggaccaatgactcgagacccagctttcttgtacaaagtggtgataaattggagctctgcagagctttcgttcgtatcatcggtttcgacaacgt

SEQ ID NO: 344 - DNA, 1355 bp, Saccharomyces cerevisiae
gctttcaaactctttgtttcttgtttgttgattaacccttaattaatccgggcgcgcctgatttatcacaagtttgtacaaaaaagcaggctcctgcaggaccatgaagcattcccaaaaataccgtaggtatggaatttatgaaaagactggtaatccctttataaaagggttgcaaaggctgcttatcgcttgcttgttcatttcaggctcgctgagtattgtcgtttttcagatctgtctacaggtgcttctcccttggagcaagattagatttcaaaatggtataaatcaaagtaagaaggcttttatcgttttattatgcatgatcttgaacatggtggctccctcttctttgaatgtcacttttgaaacatcgcggccattgaagaactcttctaacgccaagccatgctttagatttaaagacagggctataataattgcaaatcatcaaatgtatgcagactggatttatctctggtggctttcctttgtttcaaatttgggtggtaacgtttatatcatcctgaagaaagctctgcagtacataccattactgggatttggcatgcgaaattttaagtttatatttttaagtaggaactggcaaaaggatgagaaagctttaacaaatagtttggtttctatggacttaaacgcgaggtgcaaggggccccttacaaattataagagttgttattccaagacaaatgaatccattgccgcttataatttaatcatgttccctgagggtacaaatctaagcctcaagacaagagaaaaaagcgaggcattctgtcaaagagcacatttggaccatgtccaattaagacatttgttattaccgcactctaaaggcttgaagtttgcagtagaaaaactagctcctagtttagatgctatctacgatgtcactattggatattctcccgccttgagaacggaatacgtcggcaccaaattcaccttgaagaaaatattcttaatgggtgtctatccggagaaagtagatttttatattagggaatttagagttaatgagatccctttgcaagatgacgaagtttttttcaattggttactgggcgtgtggaaagaaaaagatcaactgctagaagactactacaacacaggccaatttaaaagtaatgctaaaaatgacaaccaatccatcgttgttacgacacaaacgactggatttcagcacgaaacattgacaccccgtatcctttcatattacgggttcttcgcttttcttattcttgtatttgtgatgaaaaaaaatcattgactcgagacccagctttcttgtacaaagtggtgataaattggagctctgcagagctttcgtt

SEQ ID NO: 345 - DNA, 1732 bp, Saccharomyces cerevisiae
ttcatttatttgtcagctttcaaactctttgtttcttgtttgttgattaacccttaattaatccgggcgcgcctgatttatcacaagtttgtacaaaaaagcaggctcctgcaggaccatgcgtaactatttagttaaatttttgtatattttttattctatgacttcacttatccattatttccatcgtcaaaaaaaggaaataaatactgttgctcgaacgaacagcaagataaagtggaaacgaaaagtaagcagcttcctcaatatgccgtcaaacgtacgttcgggagtcttaactttgctccatacagcatgtggagcaggcgtacttgcaatgccgtttgcattcaagccatttgggttaatgcctggtctgataacgctaacattttgcggaatatgttccttatgtgggctgctattacagactcgaatagcgaagtacgtacctaaatctgagaacgcctcgtttgctaaactcacccaactaatcaatccgtcaataagtgtagtgttcgattttgccattgctgttaaatgttttggcgttggtgtatcttacttaattattgttggtgacttagtgccacagatagtgcagtcaattttttatcgtaacgatgataacatgagtggttcgcaagagcatcacatgttcttagacaggcgtttgtatataactctgatcatagtgtttgttatctcccctttatgctttaaaagaagtttgaattctctacgatatgcttctatgattgccattgttagtgtcgcatatttatctggtttgattatttaccattttgtaaatcggcatcagctagagagagggcaagtatattttatggtacctcacggagattctcagtctcattctcccctgactacattgccaatttttgtgtttgcttacacttgtcaccacaatatgttcagtgtaattaatgagcaagtggataagagcttcaaggtaatcaggaggattccgatttttgccatcgtgttggcctattttttatacatcataattggtggtacaggttatatgacatttggtgagaatattgtaggaaatatcctcactttatacccgaattccatctccaccaccatcgggaggttagcaatgctgctattagttatgttagcatttccattgcaatgccatccttgcagatcatcggtaaaaaacataattatattcattgaaaatttcagaaaaggtaagttatacgataacagagctagctttattccattagacaactttaatagtgaagatccgcaggaggcgccaacccaacaaaacaacgaagagccaaatctgcgtagtgagtctttacggcatatcaatattatcaccctttgtatcttactgttctcatatctactggctatttcaattacgtctctagcaaaagtcctagcaatagttggtgccacgggatctacgtcgatttctttcattttgccaggcctttttggttataaattaattggctcagaatttacgggcacgaatgaaagagtaccgacaagcataaaaatattcaaatacttaagtttatctctattcatctgggggatagcagtaatggtagcttcactatcagcgattgtatttttgggcacatcatcacattgactcgagacccactttcttgtacaaagtggtgataaattggagctctgcagagctttcgttcgtatcatcggtttcgacaacgtt

SEQ ID NO: 346 - DNA, 1832 bp, Saccharomyces cerevisiae
ttcatttatttgtcagctttcaaactctttgtttcttgtttgttgattaacccttaattaagatgaattcaactccagatttaatatctccacaaaagtcaagtgagaattcgaatgctgacctgccttcgaatagctctcaggtaatgaacatgcctgaagaaaaaggtgttcaagatgatttccaagctgaggccgaccaagtacttaccaacccaaatacaggtaaaggtgcatatgtcactgtgtctatctgttgtgttatggttgccttcggtggtttcgttttcggttgggatactggtaccatttctggtttcgtcgcccaaactgatttcttgagaagattcggtatgaagcataaagatggtagttattatttgtctaaggttagaactggtttaattgtctccattttcaacattggttgtgccattggtggtattattttggctaaattgggtgatatgtacggtcgtaaaatgggtttgattgtcgttgttgttatctacatcatcggtattattattcaaattgcatccatcaacaaatggtaccaatatttcatcggtagaattatttccggtttgggtgttggtggtattgccgttttatctcctatgttgatttctgaagtcgctcctaaggaaatgagaggtactttagtctcctgttaccaactgatgattaccttgggtattttcttgggttactgtaccaacttcggtactaagaactactccaactctgtgcaatggagagttccattaggtttgtgttttgcctgggctttgtttatgatcggtggtatgactttcgttccagaatccccacgttatttggttgaagctggtcaaattgacgaagcaagagcatctctttccaaagttaacaaggttgccccagaccatccattcattcaacaagagttggaagttattgaagctagtgttgaagaagctagagctgctggttcagcatcatggggtgagttgttcactggtaagccggccatgtttaagcgtactatgatgggtatcatgatccaatccctacaacaattgactggtgataactatttcttctactatggtactaccgtttttaacgctgttggtatgagtgattctttcgaaacttctattgttttcggtgtcgtcaacttcttctctacttgttgttctttgtacactgtcgatcgttttggacgtcgtaactgtttgttatatggtgccattggtatggtctgctgttatgtagtttacgcttctgttggtgtcaccagactatggccaaatggtgaaggtaatggttcatccaagggtgctggtaactgtatgattgtctttgcctgtttctatattttctgttttgctaccacttgggctccaattgcttatgttgttatttctgaaactttcccattgagagtcaagtctaaggctatgtctattgctacagctgctaattggttgtggggtttcttgattggtttcttcactccatttattactggtgctattaacttctactacggttacgttttcatgggctgtatggttttcgcctacttctacgttttcttctttgtgccagaaactaagggtttgactttggaagaagtcaatgatatgtacgctgaaggtgttctaccatggaagtctgcttcatgggttccaacatctcaaagaggtgctaactacgatgctgatgcattgatgcatgatgaccagccattctacaagaaaatgttcggcaagaaataaatttaaatacccagcaaattggagctctgcagagctttcgttcgtatcatcggtttcgacaacgtt

SEQ ID NO: 347 - DNA, 1913 bp, Saccharomyces cerevisiae
ttcatttatttgtcagctttcaaactctttgtttcttgtttgttgattaacccttaattaatccgggcgcgcctgatttatcacaagtttgtacaaaaaagcaggctcctgcaggaccatgactgatcgtaaaaccaacttgccagaagaaccgattttcgaagaggcagaagatgatggctgcccttcgatagaaaattcttcacatctgtcagtacctacagtggaggaaaacaaggacttttccgagtataatggggaagaggcagaggaagttgttgttccagaaaagcctgcttcagcctatgctactgtttctatcatgtgtttatgtatggctttcggtggatttatgtccggttgggacacaggtacgatttctggtttcgtcaatcagactgattttttaagaagatttggtaattatagccattccaagaacacttactacttatctaatgtgagaactgggttgattgtgtccatcttcaatgtgggaagcgccattggctgtcttttcttgtctaaattgggtgatatttacggccgctgcatgggtttgattatagttattgtcgtttatatggttggtattgtcattcaaattgcctctatagataagtggtatcagtattttattggaagaattatcgctggtataggtgctggttccattagtgttcttgccccgatgcttatttcggaaactgcgccaaagcatatcagaggtacgttgctagcttgttggcaattgatggtgactttcgcaattttcttgggttattgtaccaattatggtaccaagacttactcgaattctgtccagtggcgtgttccgcttggtctatgttttgcatgggctattattatgattggtggtatgacgtttgttccggaatctcctcggtttttggtgcaagtcggtaagattgagcaagctaaagcttcttttgccaagtcgaacaagcttagtgttgacgatcctgctgtggttgcagagattgatcttcttgttgctggtgtggaggcagaagaagcaatgggaactgcttcatggaaggaattattttcgagaaagactaaagtttttcaacgtttaacgatgacagtcatgattaactctctgcagcaactaaccggtgacaactatttcttctactacggtactactatcttcaaatctgtcggtatgaatgactcttttgagacttcaattgtcttgggtattgtgaattttgcttcttgcttcttttcactttattctgttgataagttgggccgtcgtagatgtcttttacttggagcagccaccatgacggcgtgcatggttatttacgcctccgttggcgtcacaagactatatccgaacggtaaaagtgaaccatcatctaaaggtgctggtaattgtacgattgttttcacgtgtttttacattttctgcttttcctgcacctggggacctgtatgttatgtgattatttctgaaacatttccattaagggtgagatccaagtgtatgtccgttgcaacagcggccaacttattgtgggggttcctaatcgggtttttcactccttttattacttcggcaattaatttctactacggttacgttttcatgggttgcttagcgttttcatatttttacgtctttttctttgttccagaaacaaaaggtctaactttagaagaagttgatgagatgtggatggacggtgtattaccttggaaatctgaatcctgggtaccagcttctagaagggatggtgattatgataacgaaaaattacagcatgacgagaaacccttctacaaaagaatgttttagctcgagacccagctttcttgtacaaagtggtgataaattggagctctgcagagctttcgttcgtatcatcggtttcgacaacgtt

SEQ ID NO: 348 - DNA, 2011 bp, Saccharomyces cerevisiae
tatttgtcagctttcaaactctttgtttcttgtttgttgattaacccttaattaatccgggcgcgcctgatttatcacaagtttgtacaaaaaagcaggctcctgcaggaccatgtcagatcctatagtaacgtcttccaaaatggaaaaaagtgcagagtttgaagtaacagactctgctttatataataacttcaatacatcaacaacagcttcactaactccggagattaaggaacattctgaggaatctcgcaatgggttagttcacagattcgtcgactcattcagaagagccgaaagccaacgtttagaagaagacaatgacttggaggatggtaccaaatcgatgaaatctaataaccacttaaaaaagtcaatgaaatctagacatgttgtaatgatgtctttaggtacagggataggaacaggtcttctagttgccaacgccaaaggtttgagtcttgcaggcccggggtctttagtcatcggttacgttatggtgtccttcgtcacgtattttatggtccaagcggctggtgagatgggtgtcacttatccgacgcttccaggtaacttcaatgcatacaattcaatctttatttcaaagtcgtttgggttcgcgaccacttggttattttgcattcagtggttaactgtgctaccgttggaattgattacttcttccatgaccgtcaagtactggaatgacacaattaatgctgatgtattcattgtcattttctatgtgtttttattgtttatccacttttttggtgttaaggcatacggtgaaacggaatttatcttcaattcctgtaagatattgatggttgcaggattcattattttatcagtcgtcatcaattgtgggggagccggtgtggacggctatattggcggcaaatattggcgcgaccctggttcatttgcagaaggcagcggtgccactcgtttcaaagggatatgttatattctagtatctgcatatttctccttcggtggtattgaattatttgttctttccatcaatgagcagtctaaccctagaaaatccactcctgtagccgcgaagagaagtgtatatcgtattttgatcatttatttgctgacaatgattctaattgggttcaatgttcctcacaataacgatcaattgatgggttccggtggctccgcaacgcacgcttcaccatatgtcttggcagcctctattcacaaggttagggtcatcccccatatcattaatgctgttattttgatatcagtcatctctgttgcgaactctgccctttatgccgcaccgagattaatgtgttccttggctcaacagggctatgctccaaaatttttgaactatattgatagggagggaagacctttaagggccttggtagtgtgctctcttgttggtgtcgttggcttcgtcgcctgttctccacaggaagagcaagcatttacatggttggcagccattgcaggtttgagtgaacttttcacatggtcaggcattatgctttcacacattcgattcagaaaagcgatgaaagtccaaggaagatcacttgatgaagtcggctataaggccaataccggtatatggggttcatactatggggtttttttcaatatgcttgtctttatggcccaattttgggtcgcactgtctccaataggaaatggcggaaagtgtgatgctcaggcattcttcgagagttatctggctgccccgctatggatattcatgtatgttggatacatggtttacaaaagagattttacctttttaaacccactggacaagatcgacttggactttcatagaagagtttacgaccctgaaataatgaggcaggaggacgaagaaaataaagaaaggttaaagaactcttcaatattcgtcagagtctacaaattttggtgttagctcgagacccagctttcttgtacaaagtggtgataaattggagctctgcagagctttcgttcgtatcatcggtttcgacaacgt

SEQ ID NO: 349 - DNA, 1602 bp, Arabidopsis thaliana
atgcaaaacccttcaacggtaacccaggaatcagccgcaccggtctttgatttcttcccacggctcagaggtttaacctctagaaatcgatccccgtgttcgaattcagatgggtatgctctctcatcgtccaatgccttgtacttcaatggtttccggactttaccctcccgaaggatgggaaaaaccctagcttccttgagcttcaacactaagagcagtgctggttcgagtctccgtaggtttatcagcgatttcaatagctttattaggtttcactgcgataaagtggttccggagagctttgcctccgtcggaggagtcggattatcgagtgatgagaatgggattagggaaaatgggactggtggggttttgggtgaggagggattgccgttgaatggtgttgaagctgatcggccgaagaaagttttgattttgatgagtgatactggtggtggtcacagagcttctgcggaagccattagagctgcttttaatcaggagtttggagatgagtaccaggtgtttattacggatttgtggacagatcatacgccctggccgttcaaccagcttcccaggagctataattttctggtgaaacatggaactctgtggaaaatgacttattatggtacatctccacgcattgttcatcaatctaattttgctgcaacttccacttttattgccagggaaatcgcccaagggttaatgaaatatcaaccagatatcataatcagtgttcatccgttgatgcaacatgtcccacttcgtgtcctaagatcaaaaggcttgcttaagaaaatcgtgttcaccacggttattacagacttaagcacttgccatcctacatggtttcataagcttgtgacaagatgttattgcccatcaacagaagtggcaaaaagggctcaaaaagcaggacttgaaacatcacaaatcaaagtttatggcctccctgttcgaccttcctttgtgaaaccagttcgcccaaaggttgaattaagaagggagctagggatggatgagaatcttccagctgttttgttaatgggtggaggagaagggatgggtcccatcgaggcaacagcaagagcacttgcagatgctttgtatgataagaatcttggtgaagcagtaggtcaggttcttataatctgtggacggaacaagaaactccaaagcaaattaagttccttagactggaaaatccctgtccaggttaaggggtttataacgaaaatggaggaatgtatgggtgcctgtgactgcatcataacaaaggctggtccaggcactatagctgaagctatgataagagggttaccgataatcttaaacggttacatcgctggtcaagaggcagggaatgtaccgtacgtggtggaaaacggatgtgggaaattctcaaaatcaccgaaagagatatcgaagattgtagcggattggtttggaccggcatcgaaagagttggagataatgtcacagaatgcattgaggctggctaaaccagaagcagtgttcaagatagtgcatgatatgcacgagcttgtccgtaaaaaaaatagtcttcctcaactctcttgcactgcctaa

SEQ ID NO: 350 - DNA, 1805 bp, Saccharomyces cerevisiae
ttcatttatttgtcagctttcaaactctttgtttcttgtttgttgattaacccttaattaagatggcagtccttaacttgaaacgtgaaactgtcgacattgaagagacagcgaagaaagatatcaaaccttattttgcttcgaatgttgaagcggttgatattgatgaagatcccgatgtttcaagatacgatccccagacaggagtgaaaagggcgctcaaaaataggcatatctcattgctagctttgggtggtgttattggcccaggttgtcttgttggtgcaggaaacgcactcaacaaaggtgggccacttgctttacttttaggctttagtattattgggatcattgctttctcagtgatggaatctataggtgaaatgatcactttatatccctcgggcggtggatttaccactttggctcgaagatttcatagcgatgcactgcctgcagtttgcggttatgcttacgttgttgtgttcttcgcagttttggcaaatgagtacaacactctctcctccatactacagttttggggcccacaagtccctctatatggttacatcttgatattctggtttgcatttgaaatttttcaactagttggcgttggtctttttggtgaaacggagtactggcttgcttggttgaaaatagtaggattagtagcctattatattttctcgattgtttacatatctggggatattaggaatagaccagctttcggctttcattattggaatagtccaggtgcattatcacatgggtttaagggaattgcgatagtgtttgtgttttgttcgaccttctattctggaacggaatcagttgccttggctgcaacggaatcaaaaaaccctgggaaggctgtgccacttgctgttcgacaaactctgtggagaattttagttgtttatattggaattgctgttttctatggagcaactgttccgtttgacgacccaaacctctctgcttctaccaaagtcctaaaatctcccattgctatcgccatatctcgtgctggttgggccggcggagctcatctggttaatgccttcattttgataacttgcatctccgccattaatgggtcactttatatagggagcagaaccttgacgcatttagcacatgaaggcctagctccaaaaattctggcttggaccgatcgaagaggcgttcccatccccgccatcactgttttcaacgccttgggcctaatatcattgatgaatgtgagcgttggagctgcaaatgcgtactcttatatcgttaatctttctggtgttggcgtctttattgtctggggtgtaataagttatacgcacctgagaataaggaaggcgtgggttgctcaaggaagatccatagaagagctaccttatgaagcgctattttatccgtggacgccagtacttagtctggccgctaacatttttctagcactcatccaaggatggagctatttcgtaccttttgatgcgggcaattttgttgatgcttatatccttctgcctgttggaattttattgtatattggcatatgtgtttttaagagcaatcattttagaactgttgatttgcggtcaatcaacctagacgaaggacgaagaaaagacatggaggctgatctttctgatcaagagagtagcttagcatcttcggaaacgatgaaggattataaaagtgcaacttttttcagatacctcagcaacattttcacctgaatttaaatacccagcaaattggagctctgcagagctttcgttcgtatcatcggtttcgacaacgtt

SEQ ID NO: 351 - DNA, 3104 bp, Arabidopsis thaliana
agagacggatctcacataatcaccagatcaattttctcgagaaaaagaaaatgtgattatccattcgattttttcgcagaagaagacgaaagagagaagaagagaaagagatttgaaatcatggcgaatgtagtgggacagctaaaacgaggaatctcgagacaattctcaactggatcgcttcgtcgtacgcttagtcgtcaattcacgcgtcaagcttcacatgatcctcgccggaacaatatgcgatttagttttggtcgacaatcgtctttagatccgattcgtcggagtcctgatggttctaacggtccgcagcttgctgtaccggataatctcgacgctactatgcagcttctatttgtggcttgtagaggtgatgttgaaggtgttcaggatctgcttgatgaaggtattgatgttaatagtatcgatcttgatggtcgtacggctcttcatatcgctgcttgtgaaggtcatgtcgatgttgtcaagcttcttcttactaggaaggctaatattgatgctcgtgatcgttggggaagcacggtaatgtgataaatttctattgttgtctcttattggttaggttttgtgcttttggttttgaaattatgtttgtgttgtgtggataggcagctgctgatgctaagtattatggtaacatggatgttttcaacattttgaaagcccgtggagctaaagttccggtatgttgctgcatttttcattgattcaagctctgttcttttcatatcttaatatgtttatagttacattttcttcttggttttagaaaaccaaaaggacacccatggttgtggcgaatcctcgtgaagttcctgagtacgagttaaatccgcaggaacttcaagttcggaaagctgatggtatctcaaaggcaagatctctctttgctttactttcctgtaataatgtcttagtttccatttatagatttttaacaagatactacatcacttttccacttgccagggaatatatcaagtggctaaatggaatgggactaaggtttctgtaaagatacttgataaggatctctacaaggattctgacactatgtaagattactcttctcttcagtgagtaatatgtctatgttagctaacaggtcaagaaggagtttgaatttcttcttgagtgaagctatagatcgttgaaatcatctttgttatgttcatagtgatgatgatatgagctgtaacattattcaatcatagttcttatagaatcttctatgttggaattgtgcatttccagtaatattttctggaatccacttcattccctctgtgttaatccttgtttttcttttcatatattacgtttgttctgcaatcttctcatctgacttttattatgtacccacagaaatgccttcaaacacgaacttactttattcgagaaggtacgtcatcctaatgttgtgcaatttgttggagctgttactcaaaatgtccccatgatgattgtgtccgagtatcatcctaaagtaagcttctccctctttttacaccttaaaagatttttccctcattaagcaatatttggatggtaggaactaatgttgtccacttggtggtaacttgcagggggaccttgggagctatcttcaaaaaaaaggtcgtctttctccagccaaagttctaagatttgccctcgatatagccaggcatgtgacttttttggcaagattgtattcaacttacaactacattttttttaataatcttttgaacgaatcatttggctcttctcaggggaatgaattatcttcacgagtgtaaaccagaaccagtaatccactgtgatctaaaacccaagtaagataactaaataaagaagcatttgcacgttaagtttttcgagaacatatatttggaccctcgttatctaatttttgcaacttcttgtaaggtgccagaaatattatgctcgatagtggaggacatctgaaggtggcgggatttggtttgataagttttgcaaagttatcatctgataaatcaaaaatccttaatcacggggcccatatagatccttcaagtaagtcctaaatgcttatttcctcctgagaaactttgatacaagtattaagtatagaaactgtttctactattgatatactcataagttataagaatggtccatttccatgaggcaatagtttaaacagatgattttttttgttgtttgcagattactgtatggcacctgaggtttacaaagatgaaatatttgacaggagtgtggattcttactcttttggtgtcgtattatatgaggtagtaccttatggattcatacgttttggtgtcatcttatatccggtacctattagttacgttaatggtcaaacattgtgctcctcggcatttcttgatggctgtatctagtctggttttattccactcactgttctatatgctctctaaaagtacttcattctgtttctcaaccattctagctgattatgtttttcctagcattgactgattgaggccaataagcttctctagcaaatctcatgcatcaattctctgatgagtttatcttaaaaatttcagatgattgaaggagtacaacctttccatcctaaacccccagaagaggcagtgaagctaatgtgtttagaaggaagaagaccttcgtttaaagccaagtccaaaagttgtccccaagagatgagagagtaagtgtactaagctttatcaactttaaaacagaacttgttttacactttaagttacagtaacatcatttgcttggtccttgatcctttacccaacctctttgagcttatttggttcaattgttatttaaacagattgattgaggaatgctgggatacggaaacttttgttagaccaacattttctgagatcatagttcgattggacaagatctttgtacactgctcaaaacagggatggtggaaagatacattcaagttcccttggtaaaaaaactttctcttaacaactctttatcatttatgtttttgcatttctacttccaccttagttaagccgacttcttctaagatcgtgatttttcttatccataacggactagagccaagc

SEQ ID NO: 352 - DNA, 2976 bp, Arabidopsis thaliana
aaaccgcaacagcaatagtttcatcattcaccggagatccgaatcacaataaccggcgccggtttaagagatagttccggtacacatgtgttgttgacgcggaggagcgaaattctgggaatgggttgtgtcaactcgaagcagactgtttctgtaacgccagcgatcgatcactctggtgttttcagggacaatgtttgttctggttccggtagaattgtggttgaggatcttcctccggtgacggagacgaagcttttgtcgtggtggagcaagagcgggaagaagagtagtagtaaaaagagcggtagtgagttgggtagcgatttcggtgagttgagtgagtctggtcgagcgagttcgaattgtaggagtgagtcggtgagtttccgcctcggtaatttgagcaagtaccttgaagctgagcaggtcgcagctggttggcctgcgtggcttagcaacgtcgctggtgaagctattcatggttgggttccatttcgatccgacgctttcgaaaaactcgaaaaggttccttttttatatactctctttgtatattatgtaatacttttgaaatgttgttgtctctgaaaatgatttggttttgtttccttgaagattggacaagggacttatagtagtgtgttccgtgcaagagagactgaaacagggaggatagtggctttgaagaaagttagatttgacaattttgagccagagagtgttaggttcatggctagagagattttgatacttaggaaactcaatcatcccaacattatcaaactagaaggtattgttacttcaaagctatcttgcagcatacatctcgtgttcgagtatatggagcatgatctcactggtcttctttctagccctgatatcgacttcactactccacaggtcattttgatttttagtgattaaaaacgactttactcttgtaatgcaagattttgtccgggtttttctaatacaatgaatgttgctctggacttgcagattaagtgttatatgaaacaattgttgtctggacttgatcactgtcacgcacgaggtgtgatgcatcgggacattaagggctcaaatcttttggtgaataatgaaggaatattgaaggttgctgattttgggctagctaatttttgcaatgcttctgggaataagcaacctcttacaagtcgagttgtgactttgtggtaccgtccacctgaacttttgctcggggcaacggaatatggagcatctgttgatttgtggagtgttggctgtgtttttgctgaacttctaattggaaaaccggttctgcaagggagaactgaggtaacccacaaactgttgtcttgtaaatatatgttacatgtagcttcatacctctggatcctgtatattgctctgtttttacttggggaaaaaatataactcaaagagtgctgtttcttgaatgtatattacaggtcgagcagttgcacaagatattcaaactttgtggatctccacctgaagattactggaaaaagtccaaacttcctcatgcaatgcttttcaaaccacagcaacattatgatggttgtctccgagaaaccttgaagttgaaaggtttatccgatgctgacatcaatcttatagaaactcttctttctatacagccccacaaacgtgggactgcgtctactgcccttgtttctcaggtaaccattttatccttcagctattataacagcatcttgtttgaagatttggaactttgattttcaggaagatgttattttgttgtattgccacatcttttaaaacattccctttgttcttttcagtattttacttcaaagccttttgcttgtgatccctcaagtttgcctgtatactcgcctagcaaggagattgatgcaaagcatcgagaagacacaacaaggtcagaatttcattcattaccatcattgtcactatatcttacaagaaacatacagtgaaaacacagtttacccttgggagttacttggttaatctcagcaccataatttttttggacttaatttctgaagtgtcttgtcctgtaagcacttattcattatcctccaacgttattgtggaattccaggaaaaaaatcagcgggaatgggagacgtggtacagaatcgaggaagccaacacgaaagccccctgcatttgctaaactggcaccagctgaggtacaccaacacgaattccctgcatttactatctgcatctctcagaagggaattccttacgccaaaaaaaacaaaaaaaataacaaaaaccctctcctttctctacttgcaggatgtacggcaccactcccagaagtttcagaaacgtaatggtcattcagttcataattcgattgatagtgattccactttatttgagaaaatgcaaaagccatcaaatcatgaaaaggatgaagcttctcatgtgaagaacgcatcacaaggagatgtgcctttctcagggcctttgcaagtctctgtatcaagtggttttgcgtgggcaaagcgacgaaaagatgatatatgtgttagatcacataatagatctctttcaagaggtcatattcctaacctgttgggaccttctcctgctttcagtgagaatactgacgttgactctaaaaacaatgagaaagaaaaggaagaaaaacatggggaaagaacggattctcaagaccgtgaggcgtatgagatgttgaaactttcaatgctaaagaagtggaggcaacttgaacgaccagattcttttggtggttctgacgagtatcattcacaggaactgtcattggaactttatcagcgagaagaaaaggcagcaaagctgggtcatttggtacgtttgtagattatagaagcaacccttttttcagcttattatagaaattccagttgagatactagagaccaagtatacttagttttgcacatctctactgagagaaattaagaacctagctttaccttt

SEQ ID NO: 353 - DNA, 990 bp, Arabidopsis thaliana
ttaattaaaaatatgagaattgatctttctgttccaaaggtgggggcagagttagaactcaacaaggttctcggaaaaggttcgtctggttcggtgagtctcatcaagtacaagagtcgactcgacggccaaacactttacgccgcggtgaaaacctccaacataattcacgccgactctctcctcaaagagtttcagatcttgtccgaattcaaaggctgttcgagaatcgtccaatgctatgggacaaaagtacaagagacaatcaacgaagaaggtgacgtagagttcacgattcccatggaatatgcatctggaggaagcttgagacattttatgagtagattcaaggacatgaaattgcctgatgctttgatcagaaggtttacgcgtatgatcctcgagggtttagcagttattcatggacacggttatgttcactgcgatctaaaacccgaaaacatccttgttttcccgagtttcgagttaaagatttctgatttcgggttgtctaaaagagaaggagatagtaaatggtggcttcctagtcatccgtttgcgggaacaccggtatatatgtcgcctgaatcgatttctaacggcgaaacaaggagaggtttggatttatggtcattaggatgtgtggtgttggagatgtacactggaaagagaccatggtgggataagaactatgacttgggagatcttaagaaaggttccatgccattgatttcgaaagatattccttgtgatgcaaaactctttgtgatgacttgcttcgcgtcggagactaacaagagaaaaaacgctttcacattgttgaggcattgcttcttgcgtggggatgttaataagatcatagagcctctcgtgaagagtaagaattctaatgatatagcactagagttggagaatattgaacacaggctttcgcaacttaggtgtattagtggtggatagacttacattcttagctcaaaatggcgcgcc

SEQ ID NO: 354 - DNA, 1327 bp, Arabidopsis thaliana
ttaattaactggtttcatctaaggcaatgaaatgtttctacttcagcaaagacaaaactcaggatgatgaagctaagactagaaagtttggttcagctacgatggctagaggaggatcagggtctgagtttaattcagatacaagtactgctacttccattacttcttccttgcacgtcctctcagagacacacagtaataatctcaaagtatttgtcctcgatgaccttaaaaccgctaccaagaacttcagccgctccttgatgatcggtgaaggtggctttggtggtgtctttcgtggcgtgattcagaaccctcaagattctcgtaaaaagattgatattgcagttaaacaacttagtagaagaggtctacaggggcataaagaatgggtgacagaggtaaatgtattgggagtagtggagcatccgaatctggtgaagctgatcggttattgcgctgaggatgatgagagagggatccaacggctacttgtttacgaatacgtacaaaacagaagtgttcaagaccatttatccaatcgttttatagtcactcctcttccttggtccaccagactgaagattgctcaagacactgctagaggactcgcttatcttcatcaaggcatggagtttcagatcatctttagggatttcaaatcctctaatatccttcttgatgagaactggaatgcaaaactctcggatttcggactggctcgaatgggtccttcagatggaatcactcacgtttccaccgcggttgtagggaccattggttatgcagcaccggaatacatccaaacaggacacctcacggctaagagcgacgtgtggagctacggaatctttttatatgaactcatcacaggaagacgaccttttgaccgtaaccgcccaagaaacgagcagaacatcttggagtggatcagaccacacttatccgacataaagaagttcaaaatgatcatcgacccaagacttgaaggaaactactacctcaagtcagcattaaagctagctgcagttgctaaccggtgtttgatggtaaaagcgaaagcaaggccaacaatgagtcaggtttcagagatgttagaaaggatagtggaaacatcatcagatggtgctccttcaggactgccattgatgaaaagcttgacacctaaagatgcattcgaagcctcaagaagggagagagttaagagaagatttgttgaactgttaattggagaaaatggttgtcccaatttacctacttggtctcataaacttgttacttctatttgatttttttgagagaacaaactgataatcacaggcgcgcc

SEQ ID NO: 355 - DNA, 1374 bp, Arabidopsis thaliana
ttaattaagtgctggatctatgttttccagtagcgccagaagctcaggctcagattctttgatgtcttccatggctacatgtgctttatcagttaagaccttcacactctccgagcttgagaaggctactgatagattcagtgccaagagggttttgggcgagggcggatttggtcgtgtttatcaggggagtatggaagatggaactgaggttgcagtgaaactgctaactagggacaatcagaatcgagaccgtgaatttattgccgaagtcgagatgctaagccgtttgcaccaccgcaatcttgtgaaactgattggaatatgcattgaaggtcgtacacgttgcttgatttatgagctcgtccacaatgggagtgttgagtcccacttacacgaaggaacgcttgattgggatgcgcggttgaagattgcacttggagcagcgagaggactggcttatctccatgaagattcaaatccccgagtaatccaccgtgatttcaaggctagcaatgttctcctagaagatgactttaccccaaaagtctcagactttggactggcaagagaagcaaccgaaggaagtcaacatatttcaactcgagtcatggggacctttgggtacgtggctcctgagtatgcaatgacggggcatctccttgttaaaagcgatgtctatagttatggtgtagttctactagagcttctaaccggtagaagaccagtagacatgtctcaaccttcgggagaggaaaaccttgtgacatgggcgagacccttactagccaacagagagggcctggagcaactggtggaccctgcattggctggaacctacaactttgatgacatggcgaaagtggctgcgattgcctccatgtgcgtccaccaagaggtctcacacagaccattcatgggtgaagttgtgcaggcactaaaacttatatacaacgatgcagatgagacctgtggtgattattgcagccaaaaggactcatcagtaccagactctgctgacttcaaaggcgatctggctccttcggatagcagctggtggaatttgacacctcggttaaggtatggtcaagcttcgtcgttcataacaatggattatagctcaggaccactagaggacatggagaaccggcctcactctgcctctagcattccaagagtaggaggtcttattctaccaaacagatcaggtccgttaagacccatgcgtagtagaagaaacttctttagactgagaggaagcatgagcgaacacggtggaccgtcgtcgtctagacatctctggtccggcaatggtgactggctctgagaaaccagaaaatgtacagtgaagaaaagggaaaaggagggcgcgcc

SEQ ID NO: 356 - DNA, 654 bp, Arabidopsis thaliana
atggcgatttctactttaacactcacacaatctctctatacacgttccttcagaccaaccatcttcttttcttcttcttcttcctcgtccttttcgtgtctctgttcttcttcctccgattgcgagccgaaactctccgtcaagaaacgcgttttcggagtgggtttagggttcctagcttcttcgattctctctctaacgcctctggacgcagacgccacgaggattgactactacgccactgtaggagatcctctctgcgaatacagctacgcaaaatcaggacttggattttgcgatctcgatgttggatttggtgatgaagcccctcgtggcgtactcgtcaatatccattacacggcgaggtttgcagatggaacgttgtttgacagtagctataagcgtgcaagaccacttactatgcgaattggagtcggcaaggtaattaggggactagaccaggggattcttggaggcgaaggagtacctcctatgcgagtaggcggaaagcgtaaacttcagattccacctaagttagcttatggaccagagcctgcaggatgcttttctggtgactgcaacatacctggcaatgcaactttgctctatgatatcaactttgttgagatctacccaggaagtaatacaagatga

SEQ ID NO: 357 - DNA, 1207 bp, Arabidopsis thaliana
ttaattaaatgggttggttgtggaggaagaagaaaaagaataagaagctagaattggagagaggagccaagttgttagaagagctcatcgaatgttgcgatggcaaatccaatcccatcaaattcttctctgctgatgagatccgcaaagccaccaacattttcagccactctaatcttgttcatcaggaagaattttactgccaatggtattcaggtaagaacgagaaccatcccatgatactcatcaggaaagattctaatgtgaggggaggagatcttgtgtgccgcaacatagcagtttcatcgatggtgagtggtcacaagaactttatgaaattggttggatgttgtcttgagttgaaatatccagtcacggtctatcatggtgttaagaaacattatggattagaaatagatgagaagccgtggaaaagaagaatgaagatagcagaagatatcgccactgctttagcttaccttcacactgccttccctaggcccctcgtatatatgattttgtctcatcggaatatcttattggatgaagatggtgtcgcgaagctgactgatttctctcactgcgtctcaatcccagaaggagaaacatttgtccgggttgaggcagaagatggattctatagttactttgctgataattacgttaacagtgttgtagtctcagagaaaacagatgtctttgcctttggaatctttatgggtctaacgcttctattaggatacaaaagctatttcgagcattatcgaggagaagaaaaagaaagtgaagaagaagaccctgaagatactgatgaattagattattttaacaagaaaagacatgctcgatattggctgtcaaaattaaagaaagaccgaccaatggaagagattgcagatcgaaagatgataaaaaatatgggtcaaatcttagaacaagagctctttcaaatgaaagctttccggatgctctcactgagatgcatgggtcctagtgaagaagttccaacgatggtggaggtggccaaagaactaaagaagatccaaaaatctcttaataaagattcttatcgaggagaagaagaagaagaagaaagtgaagatgaatttaacgactcttcttctctttcttcaggtcaaacccaattcgactctgcccaagacatttcttccacagtggtcctctcaaaccaaacttaaggcgcgcc

SEQ ID NO: 358 - DNA, 1776 bp, Arabidopsis thaliana
ttaattaagaacgctttcaatattctctctgcttttgccggcgaaaacgaaaccatgggtggttgttgcttctcgacgcctcttgataacaatcaacaacctccacaacagccacagattcctcccggcgaacgcaagaacgacggattcgtcaactggcctgtcacagagttcttcctctccgatatcaccacggcgaccaataacttcagttccgacgagatcatatcagagaacgcagaagaatcttccaatgttgtctacaaaggttgtttattagagaatcttggcttcgtagctgtcaagagattcaagaatacgccttgggatgatcctgactacttcacggtaccttttctttgcttttaaaggttatcaaagtttgcaacgttcatttgatctcttttgtttcttcaggaagacgcaaaaacagctggggagctaaagcacaagagacttgtcaagttgttgggatattgctgcgaggaagatgaaggacttcttgttgcagagtttatgccaaatgatactcttgctaagcgtttattccagggtatgattccttctcttctttcgttttcagatatagaattggtgaatatgagcttaagagtctggattgttagtcgatctgttctatagatgtatgtgctctgttttgaatcttggcagagaggctgcattgttggtttttgtggcatgattgtgggtgtagaatggtataaacgtatctgaagatagagagagtgcattgttgttggtttatgtgacatgctatagaatggtgtaaatgtatctgcttgtagaattgattgaaacagaacttattagcattctctgtttgaggtttcttttttcttttgtgatgcacagagaagaacatggaatggtcaatgaggttgcgagtggcgtatcatatagttgaagcattggattattgcaattctgtacgttttgacgagtacgataatctaagtgcttacactgttctgtttgataaggtatgttaaacaacatttttcatgcctatgccttgtcatgtgatctaaggatgctaaactgtttttactggtgttgaaggatggtgatgcctgtctttctagtttcggcttggtgaaagagatcatccgttacaatcgaagagaaggaggtaaccaattcgctcttgtatcttcagactattcatatcagaatgtaatgttttatattctcattgtagggaacgtgaggactgggaatgtgacatacagatttggtactatccttgtgaatctgctaactggattgcaaatttctccgagccatgtaagtaattctgttcaagcttgactttgtggaatccttggtttcttgcaacacaagttacattttactgagtggttatttatcctctgtttctaggctcctgagatgatcaatggaaaggatgtcactgagctcatggatccaaatctgaagggaaagttctctacagaagaagctactatagttttaaaactcgcctctgaatgtttgcagtggaagggttatatagagaatggcatcactaaaaagcttgttgcaacacttaaagccttgcaggctaaaaaagaagtaaggaggcttactgttacaataatttcatccctgaagatttttcgcattcatgttataaaaccaaatctttttgcttgtagatttcatcttctgaaatgcatgaagtaacaaagcagcacgatgtggcatcatcttcgagtcaacaacaacttccaccctgaatctgctaataggcgcgcc

SEQ ID NO: 359 - DNA, 1749 bp, Arabidopsis thaliana
aaaaatgatattttctgtttcttttttgtttaccaatcttttctaacggtaactaaaagaagcagattgattataaataatcaacctcatctacacaaaaaaatattgaatcggaaaaaaatggcgaacatctgcatagcgacgacggcaactaacaatcaggtgattctccgtgactacgtgagtggattccctaaacaatccgacctctacattgccacaaccaccattgacttacgtgtacctcccggatccatggcggttctagtcaagaatctctacttatcttgcgatcctcatagccgcactcgcatggggaagcctgatccctcatcccaggcttccatggctcatgctttcactatcggcaaggtaaaatattcgaatctctagtgaaagtttttcagtatgattattttcattgtgttgtgtgtgttgtagccaatctctgggtttggagtggctaaagcaatagattcagggcacccaaattacaaaacaggagatttactttggggaagagttggttgggaagagtatagtgttattactccaactccttcttcacatttcaagattcatcacaccgatgttccattatctttctacactggacttcttggtatacacttagtaaatgaatctttttttttgttttcattactatacttaaaactatgtgttttcctatgttttgttcttataaggtattccgggtctcactgcgtatgttgggttttacgagatatgttctccgaagaaaggagagactgtatttgtatcagctgcatctggcgcagtaggtcaacttgtgggacagtttgcgaagatggcgggatgctatgtcgttggaagcgctagcagtaaagagaaggtctctatcacttgtttaagagtaatacagttcacattttgatttaggttttctagcaagagagtgtgatatacatgtccacttgattttataggttgatcttctcaagactaagtttgggtatgatgacgctttcaattataaggaagaaaaggatcttagtgctgccctaaagaggtcagtgaataaatacatctttacatgtttcaagggatgtgattcagttgtgggtttgatttttgtattaatcaataattaatatatatatattgtttgtaattttaaaatgaaattatctagtttattcatttcgactgcaataagttgggttttgtaagaaaatatggtgtggttttggtgtttgtggatcgatcaggtgtttcccagaaggaatagacatatactttgagaacgtgggaggcaaaatgttagacgcagtgctccaaaacatgaggacacatggccgaatcgcagcgtgtggaatgatttcacaatacaatctaaaggaaccagaaggtttacataacacagccaccattgtccacaaacgcatccgtgttcaagattttgcagctgtcgaattttttgatagatactccaagtttttggacttcatacttccacacgtaagagaagggaagataacatatgttgaggatatagcccaaggacttgagaatggaccttctgctttgatcggactcttccacggtaagaacgtcgggaaacaacttgtcgaagttgctcgcgagtgagattaaaattaacaaatgttttattaccgtttggttttagttgttgctggaaataagatcggtttgtacaagctgtgacaatgttttgtttgttggtcagaaataaatggactttgtttg

SEQ ID NO: 360 - DNA, 1255 bp, Arabidopsis thaliana
ttaattaatctccactaggtctctccaaaccggagcctccggcgatgattctcaatcgatgggtgggtatcacgtgagccccggcggattcatgcgtggagccgtgtatcgcgagcccaataagcctctaaccatcgaagaatttcatattccccgccccaaatccaatgaaattctcatcaaaaccaaagcttgtggagtttgccactctgatcttcatgtgatgaaaggagagataccgttcgctagtccttgtgttattggtcatgagattactggtgaagttgttgaacatggtccacttactgatcacaagatcattaatagatttccaatcgggtctcgtgtagttggagctttcattatgccttgtggaacctgttcttattgtgctaagggccatgatgatctatgtgaagacttctttgcttacaacagagccaagggaactctttacgatggcgaaactcgtctctttttgcgacatgatgattcaccagtgtatatgtatagtatgggagggatggctgagtactgtgttacaccagctcatggtttagctcctctaccagagtctttgccctactctgaatctgccattctgggatgtgctgtttttacagcatatggtgctatggctcatgctgctgagatccgtcctggagattctattgcagttattggaattggtggtgtgggctccagttgtttgcagatcgcaagggcttttggagcctcggatatcattgctgtggatgttcaggatgataaattacagaaggccaagacacttggtgctactcatattgtcaatgctgctaaagaagatgctgttgaaaggataagagaaataaccggtgggatgggtgttgatgttgctgttgaagccttgggaaagcctcaaactttcatgcagtgcacactaagtgtgaaagatggtggaaaagctgtgatgattggactctcacaagctggttccgttggagaaattgacataaatcgacttgttcgtagaaagataaaagttataggatcttatggaggaagagcaagacaggatcttcctaaagtagtgaaattggcagagtcagggattttcaatctcacaaacgcagtctcaagtaaatacaagtttgaagatgcaggaaaagcatttcaagatctcaacgaaggcaaaatcgtgagccgaggtgttgttgagatactataaccaatatagccttttgattctggtttgtgaatgactgggcgcgcc

SEQ ID NO: 361 - DNA, 2278 bp, Arabidopsis thaliana
ttaattaaatgagggcgttgaattcgcggctagttctgatcgacatcaacagctcctggcaagcttcgcgccggttaatctcagccaccgcaaccgctttttcatctgattcctcttcctcattccgtcggacacgtggtgcgcgtcagagaatcgcttcatcgaaatccccggcgtcgtcaccgtctcctgttcggagaccatctgatggattcagtttcgatgttcggtcaccgtcatctgattcatcgatctcatcacggaagtcaccgacgacggctccgcctacggtggagctcgacgctttcctagagattcttcctccggcgacgaggaaggagcttgttaagcacgaggcgattgaggaattgatcgaagtagtgatggatttagggagaaagccacttgctagattcccttccggcgattgggtgatctcagagcagcctgtgacacaccaggatctggagcttgcggtatcaaaggtatgtgtgtctctgatctaagacatgcaactaatttctcaaatgttttagcttattgcagttcttcaagactgataagacttgcttatactgattatggtctcttctgtgtctgaatcaaaatgttttgaatttaggttggtgatttttcggatgataaccgatccgggattgacagatctttgcatcgtataagcgctatacgtaatcgcaaactgcaagtaattggtctaacatgtcgagtgggtcgagtagtctctggaagtgcagaaattataagagacttgattgaaggaggaggatccatcttggtcattggatctcctggagttggcaaaacaactttaatcaggtacatcaatatgaacttataatgtgatgatctttctgttaaaactgtgattgataaatggtatatgacaagattggtttgttttgtacagagaaattgcacggatgttagctgatgaacacaggaaacgtgtagtgattgttgacacgtcaaatgagattggaggtgatggtgatgttcctcattctggaattggtcgtgccaggcggatgcaagttccaaatgtgaatttacagcacgatgtatgtctcgcaactttataaccttgtaataatatggtgtaggatggaatcaaaaggatcttgctgtattaacaagttctttatgcaggttatgattgaggcggttgagaatcatatgcctgagacaatcatcattgacgagataggaactgagcttgaagctttagctgctagcactattgctcaacgaggtgttcagcttgttgcaactgctcatgggatgactatagacaacataatcaaaaatccttctttgcagattcttattggtggaattgaggtaaaaccttagacaacaactttgcttcttattttgttctgttgtttatcttctctaaccttaatttgaatttattttgcccagagtgtgactcttggtgatgaagaagcaaggaaaagaaaagtgcagaagacaattcttgaaagaaaaggacctccgacattcacttgtgctgtagagatgatatcgagaactgagtgtcgtgttcatcaaagactagatgttaccgttgatgctatactagctggtaagttaaaacttaaaagacttcctctcccaataaagtgtaattgagttaacaaatggtaaaaccaaaccgaacaaacttctttgttattatagggaaatccgctccatttgagatccgtcaaattcgtggcgaagacgatgttcctcataagttagtgactcccattcctttggagaaccttgaagaggagcctgcaccattgctcaacagagatttcgtaagtgaattgctgtctgacgatgaagatgaagattttcttctcattcggtctaataaggccagaagtaacacatacacgagcccaagaagctcaccggttcatgtgtatacttacaatgtaaagaacctgatcttttattgcctagtttctaaatgttccttttcttatccttggaaaataatcttcatcttaaacaaccaaagatactgactatagatgtggtatcatctgattgttttctaggtccttgaagctgatctcctccaagtagctgaagttatgggtctagacgacgaaatagaagtgacagatgatgttggagaagcagatgtcattctagcctcaagttctgaattgaaacagaattcatcaatccgtcgtgttgccaaattacacaagctaccgatatttgtcattaaggtatccttctttttgcatggctgaggcgc

SEQ ID NO: 362 - DNA, 2017 bp, Arabidopsis thaliana
ttaattaaatgctgagcttatcattgagtaatcatgttcctccattaacgctcttgagccatgaacgaagaatcctcaagctccaaagtcgatcgtctattctctttcaccaactcttccacactaagttccttctcctgtcgaattcttcctctttgtcttcttcacatggagttgttgctatttcggcatctccgtcttcagtcgcagttccggaattagaagacgaggaccacttcgatgacgaattacgtcgtctattggcgctcgtaccggaggagatacgccagacactgaaggagcaccctgaaattagtgaactcatagagatagtgttggatttaggtcgtaaacctctggcgcgattcccttcaggtgactttgttatctccgacgatgctgttagagttaaagatctggaattcgctgtttctcaggttggtgagtttactaatgataatcgagctggaatcagccggacgttgcatcggattagtgcgataaggaatcggaaaggagaaattattggattaacttgccgtgttggtcgatctgttagaggaagcgctaatttgctgcgtgatcttgttcaagatgggaactcattgttgcttattggtcctccaggtgtggggaaaactacaatgattagggaggtagcacgaatgctaggaaatgactatgagaagagagtaatgattgttgatacttccaatgagattggtggtgatggtgatatacctcatccagggatcggtaatgctaggcggatgcaagtccctaactctgacatacaacacaaggtgctgattgaggcagtagaaaaccatatgccccaagtaattgtgattgatgagattggaactaaacttgaagcgatagctgcaagtactatagcagaacgtggaatccagttagtcgccactgctcatggagccactatcgagaatttgattaagaatccttcattagaccttctggttggaggtgtacagagtgtaactcttggagatgaggaagcgaccagaagaggtggccagaagactgtccttgaaagaaaaggtccttcaacatttaactgtggtgcagaaatagtttcaaagactgaagttcgagttcatcgtagtcttgaagcaactgttgatgctatcctcgcaggtcgcttaccaaacgttgaaatccgcaaaataaagtctcatggagtggaagtgattatggagaaggaacctttcatcgacgagaagactgtggataagaaacatgaagaggaaacattagatgtttcgaagctcaccaaggaggaaactgtctctgaagtccttcaaactaaggagataactgaagcagaatcttcagagaaagatacattgatgtatctatatgtctatgggattgcagaatcaactgttcttcaggcaatcaaacaactagagatggaaactgcggtagagttaactgacgacattagtgaagcagaagccttactcgcgttgcaagcaaagatcaggaagaatccccggattaaatcatttgctacatctcacggtatacctgtttatgtaacaaagactaactcaggtatccaagtggccaaggcgatacgggcattactaacagattacgaagacggactcggagagtttggatcagaagatcgtctaaaactatctgaaaaaatggacgccttagaagaagcgagattagcgatagagcggatagtgataccgaaaaaggaaacaaccgatttactcccgaggccacctaggattgtgtctcttcaaggaaagctagtcaggaagtataatttacgatcagaaagaaaatggagaggggatgagatgtatctacggattctcccttatagcacggaagaagatagagacgaccgtgaagatgaaggagagtttggagaagcgaacggggaagagcttgacgagttaggtttcgccaccggcgagtctaatgactcaccctctggcatcgataggttacctctattgcctgattagggcgcgcc

SEQ ID NO: 363 - DNA, 1983 bp, Arabidopsis thaliana
ttaattaaaaatggcgaggaagatgtctcttgaagcttttgtgtcaacaatggctccacttatagacatggagaaagaagctgagatctcaatgtctttaacctccggtgcttcaaggaacattgaaactgctcagaagaaaggcacaacgattctcaatttgaaatgtgttgatgttcaaacaggtctaatgggtaaatctcttattgagtttcaatccaacaaaggagatgtgcttcctgctcacaagtttggtaaccatgatgttgttgttttgaaactcaacaaatctgatcttggttcgtctcctcttgcgcaaggagttgtttaccggttaaaggattcttcgattactgttgtgtttgatgaggtacctgaagaagggttaaacacgtctcttaggttggagaaacttgcgaatgaggtgacgtatcgtaggatgaaagatacgttgatacagctgagtaaaggtgtgttaagaggacctgcttctgatttagtgcctgtcttgtttggtgagagacaaccatcagtgtctaagaaggatgttaagtcctttacgccttttaacaagaaccttgatcaatcgcagaaagatgcgattacaaaggctttatcctcaaaggatgtgtttttgctacatggtcctcctggtactgggaagacaacaacggtggtggaaatagtcttgcaagaagttaaacgtggttcaaagattcttgcttgtgcagcttcgaatattgcagttgataatattgttgagagacttgttccacataaagttaagctggtgagggtgggacatcctgcacggcttttacctcaagtgctggatagtgctctagatgctcaggtcctaaagggagataacagcggtctagcgaatgatattagaaaggaaatgaaggccttaaacgggaagttgttgaaagcgaaagataaaaacacaaggagactaatccagaaggagcttcgaactctgggcaaggaagagcgtaaaaggcagcaattagctgtatcagacgtgatcaagaatgctgatgtaattctcacaactttgactggtgcattaacacgaaagctcgataatagaacttttgacttggtgatcattgatgaaggagcacaggctcttgaggtagcatgttggatagctttgctaaagggttcaagatgtatacttgcaggagaccatctccaactcccacctacaatccaaagtgctgaagctgaaaggaaaggattagggagaacactctttgaacgactagcggatctttatggagatgagatcaagtccatgcttactgtccagtatcgtatgcatgagcttataatgaactggtcatccaaagagctttacgacaacaagataacagcgcattcaagtgttgcctcacacatgctttttgacttggagaatgtaacaaaatcttcttcaacagaggcgactctactcttagtggataccgctgggtgtgacatggaagagaagaaagatgaggaagagagcacctataatgaaggtgaagcagaggttgcaatggcacatgccaaaagactaatggagagtggagttcaaccttctgatattggaattattacgccttacgctgctcaggttatgctgcttaggattctgaggggcaaagaggaaaagctaaaggacatggagatctctacagtggatggtttccaaggtcgagaaaaagaagctatcatcatttccatggtccgatcaaactcgaagaaagaagttggattcttaaaggaccaaagacgaatgaatgtggctgttactcgctctagaagacagtgttgtatcgtctgcgatacagagacagtgagcagtgatgcgtttctcaaacgtatgatcgaatactttgaggagcatggcgagtatctcagtgcctcggagtacaccaactagtagccgcaagtttcttaaaatctcaggccagttgatagatacaagggcgcgcc

SEQ ID NO: 364 - DNA, 1628 bp, Arabidopsis thaliana
ttaattaagtgctcttccattagttagaaaagttgcttttgatcggagcaactatggggtcgtcttttgagaccatcgatatcgctaccagtgctcggagaattggcgtagataatcgtatttctctcaaattttacttcaggatcgctgataatatcctcaaacaggccaacatatttcgggcagagaagaatgttattgatttatatgtcatgcttctgcggttttcaagcttggctctcgagactataccgtcccatcgagattacagaacatctctaaaaagcaataaagagtatttgagaatgagactactagatgtcttgacggagctggagaagttgaaaccagttgtacagcaaaggattgatgaactgtatcccaagctcaaacctcgatataacgttcaagctcatccagcaaatggttccctaggctggtcttctgccgtgaaaccgtcatttaatagctatgatcatgcaaaggtaagaaatcctcctggacataattctggctacatgggttccaggggtcagcaatttttgaacgctgcaccacttgaagagcgtttccgaaagatgtcggtgaacttccgaccaaatgaagaaaccctttccaagcattctatcttgggtccaggtggactctctgcacagtggcagccaccaaagtatgatacaaaggttcaatatccaagcaatatagatttttcgcctgttgtaatcccaagcttccaacaacttgtggacagcaaaccaatgataacgaatggcagtaacgatgaacctgaaaagccaattgtggaacccagtgttgcatctaatgaaaaaatccagaaaaattacactgaagagctttcttccatgatttctttcgaagagccagaaagcgttaatgagaacaatctcattaggcaaccttcaccacctccagtgctagcagaagttcaagacttggttcctgctttatgtcctgaagttagagaaccggaatgtatgatagaaaactctctgccggatgagtctctacggtcggagtctcctcttgaacttcatattgcgacttcaatgatggatacctttatgaggcttgccaagtcaaacactaaaaagaatttagagacgtgtggtattcttgccggttcactaaaaaacagaaaattttacattacagctctcatcataccaaagcaggaatcgacatctgactcgtgtcaggccacgaacgaagaagagatatttgaagtacaggacaagcaatcccttttcccactcggatggattcatacgcatccgacacagtcttgtttcatgtcatccattgatgttcacacacactattcataccagattatgttaccagaagctgtggcaatcgttatggcgccacaagactcttcaaggaatcacggaatatttcggctgacgacgccgggaggaatgacggtgataaggaattgtgaccggcgtgggtttcatgcgcacagttcaccggaggacggagggccaatttacaatacctgtaaggaagtttacatgaacccaaatctcaagtttgatgtcattgatctcagatagcatcacttgcgcgtttgaaagtgaaactatgttctcaaggccaggcgcgcc

SEQ ID NO: 365 - DNA, 1342 bp, Arabidopsis thaliana
ttaattaaatggcggaagagaaaagctacaagtacgtgatcattggaggtggtgtagccggcggttacgcggcgagagagtttagtaatcagggcctgaagcctggtgaactcgcaatcatttccaaggaaccagtgcctccttttgagcgtcctgaactaaccaaggtatatattgacctcgaagtcaatccgacccttgcaaatatctatgtttgtgctggaactggagaagcgaagcagtaccctaactggtacaaagagaaagggattgatctaattgtgggcacagagatagtcaaagcagatcttgcttcaaagacacttgttagtgatgatggcaaaatttacaagtaccaaactttgctaattgcaaccggttctactaacataagattgtcagaaattggcgtccaagaagcagatgttaagaatatattctacctaagagaaatcgaggatagtgatgagcttgccttggctatggaactatatgtgcaaaggggaaaggccgtcatcattggcggcggtttcttagggcttgagataagttctgctctaagggctaataatcatgaagtgaccatggtttttccagaaccttggcttgtacaccggtttttcaccgctgagatagcttcattctatgagagttactatgccaacaagggaatcaaaatcatcaagggaactgtagcaactggatttagcaccaactcagatggagaggtcactgaggtgaaactagaggatggaagaaccctagaagctaacatagttgtcgctggtgtcggtgctagaccggccacctcactcttcaaaggccaacttgaagaggagaagggtggaataaagactgatgggttcttcaaaacaagtgtgcctgatgtatacgcacttggagatgtagccacattcccaatgaaaatgtatggcgggacgaggcgtgttgaacacgccgacaatgctcgcaaatctgctgcacaagcagtcaaagcaatcaaagcgggtgaagaagggaaaacgatcccagattacgattatcttccctatttctactctcgatttttcaaactatcgtgggaattctatggggaaaacgttggagaatctgtactgtttggagataatgacccgaaatctccaaagccaaagtttgggacgtattgggttaaagatgggaaagtagtaggagtgttcctagaaggaggtactcaagaggaacacaaggctattgctaaagtggcacgagcacaaccttccgttgagagtcttgacgtgttatccgaggaaggcctttctttcgccaccaagttctatagcacctctctttgaggcgcgcc

SEQ ID NO: 366 - DNA, 1396 bp, Arabidopsis thaliana
ttaattaaaaagacaaatcaaagagagacgattcgatcgcatcaatggcagaagaaaagagcttcaagtatgtgatcgtcggaggtggtgtcgccgccggatacgcggcgagagagttcttcaaccaaggtgtcaagcctggtgaacttgctatcatttccagggaacaagttcctccatatgagcgtcctgcacttagcaagggatatatccacctcgaaaataaagctacacttccgaatttctatgttgctgctggaattgggggagagagacagttccctcaatggtacaaagagaaaggtattgagctgattttgggcacagagattgtcaaagcagatcttgctgcgaagacacttgtcagtgggactggacaagtcttcaagtaccaaactttgctagctgcaactggttcttctgtcataaggttgtcagattttggcgtcccaggtgcagatgctaagaatatattctacctgagagaactcgaagatgctgattaccttgcttatgcaatggaaacaaaggaaaaaggaaaggctgtggttgttggtggcggttacatcggtcttgaactcggtgctgctctgaaggctaacaacctcgacgttaccatggtttatccagaaccttggtgcatgcctcggcttttcaccgctggcattgcttccttctacgagggttactatgccaacaaaggaattaacattgtcaaaggcactgttgcatctggtttcactaccaactcaaatggagaggtcactgaggtgaaattgaaagacggaagaacgttagaagctgatattgtgatagtgggtgtcggtggtagaccaattatatcactcttcaaagatcaagttgaagaagagaagggtggtttgaagactgatgggttcttcaaaacaagccttccagatgtatacgccattggtgatgtagccaccttcccaatgaaactctacaatgaaatgagacgcgttgaacacgttgaccatgctcgcaaatccgctgaacaagccgtaaaggcaatcaaggcggctgaggaagggaactcaattccggaatatgactatcttccatacttttactctcgagcctttgatctctcatggcaattctacggtgacaacgttggagaaagcgtattgtttggggacaatgacccggaatcgccaaagccgaaattcgggagctactggattaaagaacggaaagtggttggagcatttttagaaggtggaagtcctgaagagaacaatgcaattgctaaacttgcacgagcacaaccttctgttgagagccttgaagtgctatctaaggaaggcctttccttcgccacaaatatataaattgcctttctaggttgtgtgttagtgtgagctttgggcgcgcc

SEQ ID NO: 367 - DNA, 1432 bp, Arabidopsis thaliana
ttaattaaatgacgattaagcctaaatcgccggcgagattcaagctaggtaggcagtcttcgcttgcgccggaatcaagaaccccgattgatacgttaacggaagatgaggacgacgacttggctgcggcggctacagctgggatcggggatccgacgattcgtttaatgtatttagccaacgaaggtgatatcgatggcatcaataagatgcttgattcgggtactaatgttgattaccgtgacatcgatgcccgtactgctcttcacgtcgccgcttgtcaaggacgaaccgatgtcgttgagctgctgcttagccgtggtgctaaggttgatacgaaggaccgatggggtagtacgcctcttgcagatgcagtgtattacaaaaatcatgatgtgattaaacttttggagaaacatggtgctaagcctacgattgctcctatgcatgtcctaactgataaagaagttccagagtacgagattcatcctacagagcttgatttttccaactctgtcaaaatttcaaagggtacctttaacaaggcttcatggcgtggaattgacgtggctgttaaaacctttggagaggaaatgttcactgatgaagacaaagtgaatgcatttagggacgaacttgcactgcttcaaaagatacgccatccgaatgttgttcagtttctaggggcagttactcagagtacccccatgatgattgtcaccgagtatttaccaaagggagatcttcgacaatatctagacaggaaaggacctctaatgccagcacacgcagtgaagttcgcccttgaaattgctaggggaatgaattatttgcacgaacataaacctgaagcaataatccattgcgacctagaacctccaaacatactgcgggatgattcgggacatctgaaagttgcagactttggagtcagcaagctgctggtagttaagaagacagttaaaaaagacagacctgttgttacatgcttggacagttcatggcgatatatggctccagaggtttataggaatgaagagtatgatacaaaagtagatgtattctctttcgctttaatcttacaagagatgatagaaggttgtgaaccatttcatgagatagaagaccgcgaagttcctaaagcatatattgaagatgaacgtccaccattcaatgctccaacaaaatcatatcctttcgggttacaagagctaatccaggattgttgggacaaagaagcatcaaaaagaccaacatttagagtaatcatctctactttggagttgataagtgatcgaattgcacgcaaaaggagctggaaggtgatgctaggaagatgccttccaagattcagattgtttacaaagcgagattatgtgaatcccggtggtagtaaccgctcatcaggctcattcaacagatgaggcgcgcc

SEQ ID NO: 368 - DNA, 1648 bp, Arabidopsis thaliana
tctttgtttcttgtttgttgattaacccttacctaataaatggcggctacaggatctggacggtctcaattcatttccagttccggcggtaaccgaagcttctccaattctccactcatcgagaactctgattctaatcagattattgtctctgagaagaagagctggaagaatttctttgcttacttaggccctggttttcttgtttcaatcgcatatattgatcctggaaactttgagactgatctgcaagctggagcacactacaagtatgaattactttggatcatattggtggcctcatgtgcggctttggtgattcaatctctggctgctaatcttggtgttgtcacaggaaaacatttggctgagcaatgtagagccgagtactccaaagttccaaactttatgttatgggtcgttgctgaaattgcagtagttgcttgtgacataccggaagttatcggaacagcttttgctctgaacatgctctttagcataccggtgtggatcggtgttcttctgacaggcttaagtacgctgattcttctcgcacttcaaaaatacggggtgagaaagctggagttcttgatagcgtttcttgtgttcacaattgcaatatgcttctttgttgagcttcattactcaaagccagacccaggagaagtcctacatggtctctttgttcctcaacttaaaggaaatggtgcaactggtctcgcaatctctttgctcggagccatggttatgccgcataatctcttcctccactcggccttggttctctcgaggaaaatccctcgttccgcttctggtatcaaggaagcttgcaggttttacttgatagaaagtggattggctctaatggtggcctttctcataaacgtctctgtaatatcagtaagcggggctgtttgtaatgcccccaacttaagccctgaagatcgagctaattgtgaggatttggacttaaacaaggcttcgtttctgctacggaacgttgtgggaaaatggagctcaaagctatttgcaatcgcgcttcttgcttctggtcagagctcgacgataaccggaacttatgctggacaatatgtaatgcagggctttcttgatctcagactcgagccatggctcagaaacttactaacaagatgtttagctataatcccgagtctaattgttgctctcatcggtggttcagctggagctggaaagttaatcatcattgcctcgatgatcttatcctttgagctcccgtttgcgttggttcctcttctcaaattcacaagttgcaaaaccaagatgggttcacatgtcaacccaatggcgattacagctttgacttgggtcattggtggtttaatcatgggaataaacatatactatctagtaagcagtttcatcaaactgcttatccacagtcatatgaagcttatcctcgtcgtcttctgtggaattcttgggttcgcaggcattgctctctatttagccgccatagcttaccttgtcttccggaaaaacagagtagccacttctcttcttatttcaagagactcacaaaatgtggagacacttccaagacaggacattgtcaacatgcagttaccatgtagagtatctacctccgatgttgactgagtggcgcgcc

SEQ ID NO: 369 - DNA, 1248 bp, Arabidopsis thaliana
ggcgcgcctataagtttgattttctgggtttcttctgtattatctcgatatttgaaaaaaatggcgaaggaaattgaatcagcgacagatttaggtgatactaacatcaaaggagttcttgttcatggaggaagatattttcaatacaatgtttatggaaacttgtttgaagtttctaataagtatgttcctcctattcgacctattggtagaggagcttacggttttgtctgtgctgcagtagattcggagacacacgaagagattgcgataaagaagataggtaaagcctttgataataaagtagatgcaaagagaacattgagagagattaagctacttcgtcatttagaacacgagaacgttgttgttataaaagatatcattagaccaccaaagaaggaagatttcgttgatgtttatatagtttttgagttaatggatactgatcttcatcagattattcgatcaaaccaatctttgaatgatgatcattgtcagtacttcttgtatcagattctacgaggactcaaatatattcattcagcaaatgttttacatcgtgaccttaagccgagtaatttgcttttgaattcgaattgcgatcttaagattactgactttggtttggcaaggactacatcagaaacagagtatatgacagagtatgttgtaacacgatggtacagagcaccagagctgcttcttaatagttctgagtatacatctgctattgatgtatggtctgttggttgcatatttgctgagattatgacaagggaaccgcttttcccggggaaggattacgttcatcagcttaaacttatcactgagttgataggatcacctgatggagcgagtctagagtttctcagaagcgcgaacgcgagaaaatatgttaaggagctacctaagttcccaagacaaaacttttcagctaggtttcctagtatgaattctacagctatcgatctactagagaaaatgctcgtgtttgatccagtaaaacgtatcacggttgaggaagcactgtgttatccttacttgtcagctcttcacgaccttaacgacgagcctgtttgttccaaccatttcagtttccattttgaggatccgtcttccactgaagaagagataaaggagcttgtgtggctcgaatctgtgaagttcaatcctctgccgagcatttaaaacattatttaagaaggggaaagcaagttttatactctgacattgagcaggcgcgcc

SEQ ID NO: 370 - DNA, 1456 bp, Arabidopsis thaliana
ttaattaaatgacgtttagggagaaaatgccgacgagtcctaaatcgcctctgagaagacgacgttcgagctggaccggtacatggttaaaccatcagacgacgtcgtttaagcaagcagtctccgccgttattcaagctcaatcaccaagatccaggtttaaatccctatcttctgatttctccgacgtcgatcgaactctttcgttgtcagattctcttcttctcaagatccttgagaagcttcctgaatctcagaacgaagatgtttcactcgtgtgtaaacggtggttgagtgttcagggacggcgtttacggagtatgaaggtttttgattgggaatttttattgtctgggaggcttgtttcgaggtttcctaagcttacgagtgttgatttggttaacgcgtgtttcaatccgtcgagcaattcagggattttgctatgtcatacgtcgatttcgtttcatgtatcaaccgattcgtcgttgaatttgaattttgttgaggagagtctgttggataatgaaatggttgataaagggcttagggttttaggaagagggagttttgatttgattaagcttgtagtgattaatgctactgaattgggattgctgagtttagctgaggattgttcggatttgcaggagttagagttgcataagtgtagcgataatctcttgcgtggtattgctgcttgtgagaatctgaggggattgagattggttggaagtgttgatggattgtatagttcatcggtttctgatattggtttgacgattttagcacaagggtgtaagagattggtgaagcttgagcttagtggttgtgaaggtagttttgatgggattaaagcaattgggcaatgttgtgaagtgcttgaggagctgagtatttgtgatcatagaatggatgatggttggatagctgcgctttcgtattttgagagtttgaagactttgttgatttcgtcttgtagaaagatagattctagtcctggaccgggaaagttgctgggatcttgtccagctctggagagtttgcaactcaggaggtgttgtttgaatgacaaggaggggatgagagcgttgtttaaggtgtgtgatggagtaactaaggttaatattcaggattgttggggattggatgatgattctttcagcttggctaaagctttcaggagggtgcggtttttatctttggaaggatgctcaatcctaacaacaagcggtttagagtcagtaattctacactgggaagagcttgagagcatgagagtagtatcatgtaagaacataaaagacagcgaaatttcagccgcactctcgtctttgttctcccttctcaaagaactaacgtggagaccggacacaaggtctcatctctcatccagtcttgaaggtaccggaattggtaagagaggtagcaaattcttcaagaagagatgaggcgcgcc

SEQ ID NO: 371 - DNA, 865 bp, Arabidopsis thaliana
ttaattaaatgtacagattcagcaacacagttattggggtcttaaaccttctcaccttactagcctcgattccaatcatcggaaccgctttatacaaggcaagaagcagcacgacatgtgaaaacttcctccagacgccgctacttgttataggattcatcatactcatagtttcccttgcgggattcataggagcctgcttcaacgtggcatgggctctttgggtgtacttagtggtcatgatcttcctcatcgctaccctaatgggtctaacgctatttggtctggtggtgacgagccaaggaggtggagtggaagtgccagggaggatttataaagagtataggcttggagactatcatccatggttgagagagagagttagggatcctgagtattggaactccattagaagctgtatcttgagttccaagacttgtactaagattgagtcttggactacacttgattatttccaaagagacatgacttctgttcagtcgggatgttgtaagccaccgacggcgtgtacgtacgaagctggagtagtggacggaggaggagattgcttcagatggaacaatggagtggagatgttatgctacgagtgcgatgcttgcaaggctggtgttctcgaagagatccgtctcgactggagaaagttatcggttgtcaacattctcgtcctcgtcctcctcatcgcggtctacgccgctggttgctgcgccttccacaacactcgccacgcagctcatccttaccatccatctgatgataaccgcatgaccagagtccgtcctcgttgggactattactggtggagatggtggcacgaaaagaaagagcagctttactaaggcgcgcc

SEQ ID NO: 372 - DNA, 1349 bp, Arabidopsis thaliana
ttaattaaaatggaaatggaatcatgtaagctcttcatcggtggtatatcttgggaaaccagtgaagatcgtcttcgtgactattttcacagttttggtgaggttttagaggctgttattatgaaggatcgtgccactggccgtgctcgtggctttggtttcgttgtctttgctgatcctaatgttgctgaaagagtcgtcttgcttaaacatatcattgatggtaaaattgttgaggcaaagaaggctgttccaagagatgatcacgtagtatttaataaaagtaacagcagccttcagggatcacctggcccatcaaactccaagaagatctttgtgggaggtttggcatcatccgtgacagaggctgagttcaaaaagtattttgctcagtttgggatgatcactgatgttgtggtgatgtatgaccacagaacccagcggcctagaggctttgggttcatttcatatgactctgaggaagctgttgacaaagtactgcagaagacattccacgaactcaatggtaagatggtggaggtcaaactggctgttcctaaggatatggctctcaacacaatgcggaaccaaatgaatgtaaatagctttggcactagtagaatcagttcattactgaatgagtacacccagggattcagcccgagtccaatctctggttatggagtgaaacctgaagttaggtacagtccagcagtaggtaataggggaggattctcaccgtttggacatggatacggaatcgagctgaattttgagccaaaccagactcagaactacggttctggttccagtggaggctttggacgaccctttagccctggatatgctgcgagtctcggcaggttcggtagccaaatggagtcgggaggagctagtgttgggaacggttctgtcctaaatgcagcaccaaagaaccatttatggggaaatggtggtctaggttacatgtcaaactctccgatatcaagaagcagcttcagtggaaactctggaatgtcttcactaggcagcattggtgacaactggggaacagttgcacgtgcacgcagtagctaccacggtgagagaggaggtgtaggattagaagcaatgagaggagttcatgttggtggttacagcagcggctcaagcatcttggaggcagactctctgtacagcgactcgatgtggctttcgctgcctgcaaaggcagaggaaggattgggaatgggaccattggacttcatgtctagaggaccagctggatacatcaacaggcaaccaaacggaggaattgcagcttagagaagtgacaaatctataccatggagatcagatgatggcgcgcc

SEQ ID NO: 373 - DNA, 946 bp, Arabidopsis thaliana
ttaattaaatggcttttttgagtaaattcgggaacatattgaagcagaccacaaacaagcaactcaatgctcaggtttctttatcaagcccttcgctttttcaagcaataaggtgtatgtcatcttctaagctctttattggaggtatggcttatagcatggatgaggatagcttaagagaagctttcaccaaatacggtgaagttgtcgatactagagttattttggatcgtgaaactggtaggtcaaggggatttggatttgttacattcacctcttcagaagcggcatctagtgctatccaggctttggatggccgggatctccatggccgggttgttaaagtaaactatgcaaatgatagaacaagtggtggtggttttggaggtggtggctatggaggcggtggtggtggttatggtggtagtggtggctacggaggaggtgctggtggctacggaggaagtggtggctatggaggcggtgctggtggctacggaggtaattctggtggtggctacggaggtaatgctgctggtggatatggaggcagtggtgctggtggctatggaggcgatgctactggtcacggaggtgctggtggaggttatggttcaagcggtggctttggatctagcggcaacacttatggggagggttcaagtgcaagcgcaggtgctgttggtgactataatggaagtagtggttatggtagcgccaatacttatggtagcagcaatggtggattcgctggagacagccagtttggaggaagccctgttggcaacagctctcagttcggtggtgacaatacccagtttactgctggtggccaatttggcggtgaggatcaatttggaagcatggagaaaagtgaaacgaagatggaagatggaccaataggtggagaattcgaagatgttgccaaaagagcttgaggcgcgcc

SEQ ID NO: 374 - DNA, 1812 bp, Arabidopsis thaliana
ttaattaattgtcttctcagaatcaaacctctgaagacttttcaccaaaatgacattactttcctctctcggaagagcctctcgatctgctccacttgcctctaagctcctcctcctcggcactctcagcggtggaagtatagtggcatacgctgatgctaacgaagaagctaacaaaaaggaggagcataagaagaagaaagtagttgtgcttgggactggttgggctggtataagtttccttaaagatctcgacataacttcctacgatgttcaggttgtgtctccccagaactactttgcctttacgccattgttacctagcgtcacttgtggaactgttgaagctagaagcattgtggagtctgtccgtaatataaccaagaagaaaaatggggaaattgaattgtgggaagcagattgttttaagattgatcatgttaatcagaaggttcactgtcgaccagttttcaaggatgatcctgaagcaagccaagaattttcccttggatatgactacttgatcgtagcagtgggagctcaagttaacacatttggcactcctggtgtacttgagaattgccattttctcaaggaagtagaggatgcacagaggattcgtagaggagtgattgattgctttgaaaaagcaatccttcctggcctcactgaggaacaaagaagaagaaagcttcattttgtaatcgtgggaggaggtcctactggtgtggagtttgcagctgagctacatgactttattatagaggatatcaccaaaatatacccttcagtcaaagagctcgtaaaaataacactcattcaatctggagaccatattctgaatacgtttgatgaacgtatcagttcatttgctgaacaaaagttcacgcgagatggtattgatgttcagactggaatgcgtgtaatgtctgtgactgataaagatatcacagtgaaagtcaaatcaagtggagaactcgtaagtattcctcatggattgatattgtggtccactggagttggaacccgtccagttatcagcgacttcatggagcaagttggccaaggaggcagacgtgcggtggcaactaacgagtggttacaagtgacaggatgtgagaatgtatatgcagttggcgattgtgcttccatagctcaacgaaaaatcttgggggatattgcaaacatattcaaagctgcagatgcggacaactcaggaaccttgaccatggaagagttagaaggcgtggttgatgatattattgtgaggtatccgcaggtggagctctacctgaaaagcaagcatatgaggcatattaacgatctgctggcagattctgaaggaaatgcaaggaaagaagtagacattgaggcattcaaattggctctctcggaggctgattcacagatgaaaaccctgcctgcaactgctcaggtcgctgcccagcaaggtgcttatcttgcaaaatgcttcaacaggatggagcagtgtaaagagctacctgaaggtcctaagcgcttcagaactggcgggcatcatcagtttcgccccttccagtacaagcactttggacaatttgctccactaggaggggaccaagcagcagctgaactacctggagactgggtttcagctggaaaaagcgcccagtggctctggtattctgtttatgccagcaagcaagttagctggcgaacgagggctctggtggtgtcggactggacaaggaggtacatattcgggagggattcaagccgcatctgactcaatactgcattttgtaatgtgtttaagaggaaaccaggcgcgcc

SEQ ID NO: 375 - DNA, 438 bp, Arabidopsis thaliana
atggcgtcttttgcaaccatcgccgccgtacaaccttctgccgccgtgaaaggacttggaggtagctctcttgccggagctaagctcttcatcaaaccttctcgccaaagcttcaaaaccaaatccaccagagctggtgctgtggtggctaagtatggagacaaaagtgtatactttgatttagaagatttgggtaacacaacaggacaatgggatgtgtatggatctgatgctccttctccttataacccacttcagagcaagttctttgagacatttgctgctcctttcacaaagagaggtttgcttctcaaatttttgattcttggaggaggctctttgcttacatatgttagtgcgaactctaccggcgatgttcttccgattaagagaggtcctcaagagccacctaagctcggtcctcgcggcaagctttaa

SEQ ID NO: 376 - DNA, 694 bp, Arabidopsis thaliana
ttaattaaaatacgtttcaccgaacacacaaagaaaaacgtaattgccaaagctatggagaagaagttgttggatataactcggactgactcggctgagaaaaagcgagtcagagacgagtcattcgacgaagcggttcttgactcgccggaggtgaagaggttgagagatgatttattcgatgtcctggatgactcggatcctgaaccagtgagtcaagatctcgactcggttatgaaaagtttcgaagacgagttatcaacggtcaccaccacgacggcgcaaggttcctctaccgccggcgaaactcagcctgatctcggatatcttcttgaagcttccgatgatgagcttggtttaccaccacctccatcgatttctccggttcccgtcgcgaaggaggaggtaacgacggagacggtaacggatttggtacgagcgtcttctgattcgtcaggaatcgacgagatttggggatttgaagatcacgtgtcgaattacggtggtttagattttggttccggcgtcggagatggtggagattacgtggctgttgaggggttgtttgaattttccgacgattgttttgactccggcgatctgttttcgtggcggtcggagtcgttaccggcggaataaataaataacaaacttttttttaattaggtgggaaatgaaaacatatcggcgcgcc

SEQ ID NO: 377 - DNA, 1458 bp, Arabidopsis thaliana
atggctatggcgagtttatatcggcgatctcttccttctcctccggccattgacttttcttccgccgaaggcaagctaatcttcaatgaagcgcttcagaaaggaactatggaaggatttttcaggttgatttcgtattttcagacacaatccgaacctgcgtattgtggtttggctagtctctcagtggtgttgaatgctctttctatcgatcctggacgtaaatggaaagggccttggaggtggtttgatgaatcaatgttggattgctgcgaacctctggaagtagtgaaggaaaaaggcatttcatttggaaaagttgtctgtttggctcattgttcaggagcaaaagttgaggctttccgtacaagtcagagcaccattgatgatttccgcaaatttgtcgtcaaatgcacgagttctgagaattgtcatatgatctcaacatatcaccgaggtgtatttaagcagactgggactggtcacttttcacctattggtggctataatgctgagagagatatggctttgattcttgatgttgctcgtttcaagtatccccctcactgggttcctcttaaacttctttgggaagccatggacagtattgatcagtcaacagggaaacgtagagggttcatgctcatatctagaccacacagagaacccggattgctctatactctgagctgcaaggatgaaagctggatcgaaatagccaagtatttgaaggaagatgttcctcgtcttgtaagttcacagcatgtagattctgtggagaaaatcatatcagttgtgttcaagtcacttccatcaaatttcaaccaattcatcagatgggtggctgagatccgaattacagaggactcaaaccaaaatctcagcgcagaggagaagtctaggctgaaactaaagcaattggtgctgaaggaagtgcacgaaactgaactgttcaaacacatcaataagttcttatccacagtgggttatgaagacagtctgacttatgctgctgcaaaggcttgttgccaaggagctgaaatcttatccggaagcccatcaaaagagttttgttgtcgggaaacttgcgtgaaatgcatcaaaggtcctgatgactctgaaggcacggtggtgactggagttgtggtgcgtgatgggaatgaacaaaaggttgatctgttagtgccatcgacgcaaactgagtgtgaatgtggtcctgaagcaacttatccagcaggaaacgatgtgttcactgcacttctattggctttacctccacagacatggtcagggatcaaagaccaagctcttatgcatgaaatgaagcagctcatttccatggcttccctcccaactttgcttcaagaagaggtattgcatcttcgacggcaacttcagctgctaaaacgatgccaagagaacaaggaagaggatgatctcgctgctcctgcctattag

SEQ ID NO: 378 - DNA, 1260 bp, Arabidopsis thaliana
ttaattaataaaccctgatttcggattctcacaatcgaacttggctgcagagaaggatggggactaacgaagtaacaaggattgtgactgatgaagaaaagagagaagcgaagaacttcaacatatttgatctccctgacgttcctaccggacttcctccgcatcttgagctccagcgaactcgcgttgtctgtaagaaggattctaatattcatcctacggctatcactttctcgggtgcctattcctctatgggagtggacaacagtgtgagactagaaaacttctctgaggatttcaaagttgatgtgattagtctcacagagacagatatggtattcgatatgatcggtgtccatgcaggaatcgctaatgctttccgaagaatcctcttagctgagcttccttcaatggctattgaaaaagtgtatgtagcaaacaacacatcggttattcaagacgaagttcttgctcacaggttgggtcttattccaattgccgcagatccgagactctttgaatatttatctgaaaacgatcagccaaatgaaaagaacaccattgttttcaaactccatgtgaaatgtctaaaaggtgacccgcgtcgtaaagtcttaacaagcgaattgaaatggttaccaaatggaagtgagcttatcaaagaatctggaggttcaaccacaacgccaaaaacttacacttcattcaaccatagccaagattccttccctgaatttgctgaaaatcctatcaggccaaccttaaaagatatcttgatagcaaaacttggccctggccaggaaatcgagcttgaggctcatgccgttaagggcattggtaaaacacatgcaaagtggtccccagtagcaacggcttggtatcgaatgcttcctgaggtggttctactaaaggaattcgagggtaaacatgccgaagaactcgtaaaagtctgccccaagaaagtttttgacattgaagacatgggccaaggtaggaagagggcaacagtagctcggccgcgtgattgttcgttgtgtagagaatgcataagagatggagtggaatgggaggaccaagtggatctgcgccgtgtcaagaaccattttatatttacaattgagtccacgggatcacagcctccggaggttcttttcaacgaagcagtgaagatattggaagataaatgtgaaagagtaatctctgaactctcctgaaaagagattaaattggtttagctctaccggcttggttcggcgcgcc

SEQ ID NO: 379 - DNA, 577 bp, Arabidopsis thaliana
ttaattaaacaatgccttcaaattcaggagatgataatgttcttcaagttctcataaagaactttgatgtccttgctctcccattggttacactcgtctatcctctatatgcatcagtgaaagcaatagagacaagatcattaccagaagatgaacaatggcttacttactgggttctttacgcacttatctctctctttgaactcactttctccaaacctctcgagtggtttcctatatggccatacatgaagttgtttgggatctgttggttagtgttaccacaattcaatggagcagaacatatctacaaacatttcattagaccattctacagagatcctcaaagagctaccaccaaaatttggtatgttcctcacaagaaattcaatttcttccctaaacgcgacgacgacgacattctcactgctgctgaaaaatacatggaacaacacggtaccgaagcgtttgagcgaatgatcgttaagaaggatagttatgaaagaggtaggagtagtagaggaatcaataatcacatgatctttgatgatgactataggtactaataaatttaaat

SEQ ID NO: 380 - DNA, 994 bp, Arabidopsis thaliana
ttaattaaatggcgtcgtttgtctttgtgatttctcttcttcttctctctttttcgtcggctgttttctccgatgatgcttcttttcagaaacttccggtgcctgacaagaggtcaggccctgaatctttcgcctttgactctaccggcggattctacaccggagtctccggtggtaaaatcctcaagtacgttcctgggaagggttatgtcgattttgcccagatcacagattcctcgaactcggcatggtgcaacggagcattaggaaccgctttcgccggaaagtgtggtcgaccagcgggaatagccttaaacagcaaaacaggtgatctctatgtcgccgatgctccgttgggtcttcacgttatctctcccgcaggaggtttggccacaaagctggccgacagtgttgacggaaagcctttcaagtttcttgacggtcttgatgttgatcccaccaccggcgtcgtctacttcacttccttcagttccaagtttggaccccgggaagtgttaatcgcagtgggattaaaagacgcgagcggaaagctgttcaaatacgacccagcgaccaaagccgtgactgagttaatggaaggtctaagtggtgctgctggttgtgcagtgagctcagatggttcattcgtgctagttagcgagttcataaagagtaacatcaagaaatattggattaaagggcccaaagctggaactattgaagacttctcaagtcttgtctcgaaccccgacaacatcaggagggtaggttctaccggaaatttctgggtcgcctctgtcgtgaacaaggttgttatgcctaccgaccctagggcggtcaaactagacgctaatggaaaagtgctccagaccattttcctcaagaatgagtttgggaatactttgcttagtgaagtcaacgagttcaacggccatctttacatcggaactcttactggacctttcgccggagtcatgaaactttaaggcgcgcc

SEQ ID NO: 381 - DNA, 607 bp, Arabidopsis thaliana
ttaattaaatgagtgcttcgaggtttataaagtgtgtcaccgtcggcgatggtgccgtcggaaaaacttgtatgctgatttcttacacaagcaacactttccctacggactatgttccaactgttttcgacaacttcagtgctaatgtggttgtagatgggaacacggtgaatcttggattgtgggatacagctggtcaagaagactataacaggttaagaccgttgagttaccgtggtgccgatgtcttcattcttgcattctcgcttattagcaaagctagctacgagaatgtagccaagaagtggattcctgagcttaggcattatgcccctggtgttcctataatcctcgttggaacgaaactcgatcttcgagatgacaagcaattcttcatagaccatcctggtgcagtgcctattactacaaaccagggagaggaactaaagaaactgataggatcaccaatctacattgaatgtagttcaaagactcagcagaatgtgaaagcagtctttgacgcagccataaaagtggtgcttcagccaccgaaacagaagaagaagaaaaagaacaagaaccgctgcgtgttcttgtgaggcgcgcc

SEQ ID NO: 382 - DNA, 1206 bp, Arabidopsis thaliana
ttaattaataagttatcggacaaaaagagaagtagacgccgccatggataggcttttgcaacctccttcttctcactcaattgctccctccaaattccaatcaagaccatctcccttattactccaccgtctccactcaacgaatcttagtacttttccctcctctcgccgtctcgagtcacgccgaatcagctccatttcctgcttcttccgtcagaatccatcgccggatacatctccaggattgaatcagagtagtaatttcttgattgcttcttctcaaaccgatgcgtcgaaacctaatccaggatttatccaacggatcgtgagcagttttgagcaacgcaagaccatatcggcaggaatggttatattagtctctgctatagctgcgcttttgcttaatcccattcttgtgccgcctgctttcgctagctttcaaacggctactaattctggtggagctgctgtggttggtggaaaactcctcaggactgaagtattgacaagtgcttggactggtttctttgctggttgcttacacacgttatctggacctgatcaccttgctgctttggctccactttcgattggacggacgagaatggagagtgctgcggttggagctctttggggatgtggtcatgacgctggtcagctcatctttggtttattgtttctgcttctaaaagataggctccacattgaagttataagaacttggggtacaagagttgttggtttgactctccttgtgattggtgctatgggaatcaaagaagcttctgagatgccggaaccatgtgttgttactttggagaatggggaaacagatgagaaaagcttaaagaagaaaaagatagggtttgcgacatttgcgactgggattgttcatggcctgcaaccggatgctctgatgatggtattgcctgcattggctcttccttctcggatagccggtgcttcgtttctcatcatgttcttgattgggacggtgattgcgatgggaagctacacagtttttattgggtcgtgtagcgaagcgttgaaagagaaagttcctaggatcactgagaaactaacgtgggcatcttctcttgtggccattggacttggattggcaattattgtcagccagttctttggattcagcctgtattgaagaaaacatcgtcaagtctttgtagctctctctgtaggcgcgcc

SEQ ID NO: 383 - DNA, 442 bp, Arabidopsis thaliana
ttaattaaatggcatattcaactaaactttatcttcctcttaaaacaccatgttttgttccaaagacagtaagagcaaagactttgatgcttcaacagagtcaagttcatgttaaagtcaagaaagccacagtttcacagcctcagccgatcagatactccaccaagaacattgtttttgaagatccgatacaagggatcatctgttacacagatgataatggagaggttatatgtgaaggatacgatgaaggtcctcgttgtcccacacagagtccaatggtagcttcttactcaagagaggtggagattcttgatcttctgcaaagaagttatcaggagctgagcgattcaaacaaggatggtcaaagaccgataattgcttcagaacaagagttcatgatgatcaaatggagcagctttgacttcctctaaggcgcgcc

SEQ ID NO: 384 - DNA, 619 bp, Arabidopsis thaliana
ttaattaaatgggagattccgtttcttcttcatcccgcgtttctgttcatcaatctcttggtgctggttctgttgctgatttgctgctatggagaaaccggactggtgcagtcattttgctaatctcttctactgggttttggttcttattcgagagagctggatacaatctcttgtctttcgtctccaatgttctgcttcttctcgttgcgatcttcttcttatgggccaagtctgctacagttctcaaccgaccgctacctccagttccgaatatggaaatccctgaggagtttgcaaataaggctgctgatgatcttcgggtttggatcaattatgtactgtcaattgcaagtgatatcaccatagctagaaatccgattcgtctccttcaggtttctcttgtcttgtgggctatatcctatgttgggactttaatcaactccctcactcttgtttacattggagttcttctcagtctttcttttcctattgtgtatgagaagtaccaagaccacattgatgagaaagtgaactcgacttctaaattcgttcgaaatatctcaaggaagtttccattgcccataaacaaagagaagaaacatcagtagggcgcgcc

SEQ ID NO: 385 - DNA, 828 bp, Arabidopsis thaliana
atggcatcacacgaccaccatcatcatcatcacgatcatgagcatgaccacgagaaatcagacggcggagaagggaaggcgtcgtgggtggggaaggacgggaaggtgtaccatagccacgatggactcgcacctcactcacacgaacccatctactctcctggctacttcagtcgccgagctcctccgcttcacgaccgtaacttctctgagagagcttttaccgtcggtattggcggtcccgttggcactgggaaaacggcattgatgcttgctctttgtagattcttgagggacaaatatagtcttgctgctgtgacaaatgatatattcacgaaagaggatggtgagtttctggtgaagaatggggctcttcctgaggaaaggattagagctgttgaaacaggtggatgtccacacgctgctatccgtgaagatatcagtatcaatttgggtcctcttgaggagttatctaacttattcaaggctgatttgcttctttgtgaatccggtggagataatttagctgctaatttcagtagagaactagctgactatatcatctacatcatcgatgtatcggctggtgataaaataccccgtaaaggcggccctggaatcactcaagctgatcttctggtgataaacaagactgaccttgcagcagctgttggggctgacttatcggtcatggaaagggattcactacgcatgcgtgatggagggccatttgtctttgctcaggtgaagcatgggcttggagtcgaggaaatcgtgaaccatgtcatgcactcatgggaacatgcgaccgggaagaagcgccagtga

SEQ ID NO: 386 - DNA, 587 bp, Arabidopsis thaliana
ttaattaagtcaaaaatggctctccgatctgtcaaaacgccgaccttgataacttcggtcgccgtcgtctcctcctccgttaccaacaagcctcactctatcagattctctcttaaaccaacgtcggcactcgtcgtccataaccatcagctatcgttctacggttcgaatctcaagctgaaaccaactaaattccgatgctcagcgtcggctcttacgccgcaacttaaagacacgctggagaaactggtgaattcggagaaagtggttctgtttatgaaaggaacgagagacttcccgatgtgtggattctccaacactgtggttcagattttgaagaatctgaatgttcctttcgaagatgtgaatattctggagaatgagatgttgaggcaaggacttaaagagtattcgaattggccgacgtttcctcagctttatatcggcggtgagtttttcggtggttgtgatattactcttgaggcgtttaagactggagaattgcaggaagaggtggagaaagctatgtgctcttgatcctgatttcaatacttggtttttgtgatgatggaatttgatggcgcgcc

SEQ ID NO: 387 - DNA, 712 bp, Arabidopsis thaliana
ttaattaaaacatatggcttcggtttcacctttggcaaagtttaaactggtgttcttaggagaccaatctgtcggaaaaaccagcatcatcactcgtttcatgtatgacaaattcgacaccacgtaccagcctaccattggaatcgattttctatcgaaaacaatgtacctcgaagatcgaacagttcgtttgcagctatgggatactgctggacaagaaagattcaggagtctaatcccaagttacatcagagattcttctgttgccattgttgtatacgatgtatccaataggcaaacgtttctgaatacctcgaaatggattgaggatgttcacagagaaagaggtcaaagcaatgttatcatcgttcttgttggaaacaaaactgatcttgttgaaaaacggcaagtatcaatcagtgaaggagaagacaagggtaaagagtatggagtgatgttcattgagaccagtgccaaagaaaacttcaacattaaggctttgttccggaagattgctgcagctttacccggggtagactcatattcattggcaacaaaatcagatgacatggttgatgtgaatctaaagaccacttcaaattcatcacaaggtgagcaacaaggaggagcaggtggtggtggaggctgttcttgttgattcaaaaatacataattccaaaacttgtgaagcaaacaaaagggatggcgcgcc

SEQ ID NO: 388 - DNA, 691 bp, Arabidopsis thaliana
ttaattaaatggccggaggaggcggatacggcggcgcatcggggaaagttgattacgtcttcaaagttgttctaatcggagattcggctgttgggaaatcgcaactacttgctcgattcgctagagacgaattcagcatggattctaaagccaccatcggcgtcgagttccaaactcgtaccctctccattgaacaaaaaagcattaaggctcagatctgggataccgctggtcaggaaagatacagagccgttacaagcgcatactacagaggagcagttggcgcaatgctggtttatgatatgacgaaacgtgagacctttgagcatattccgcgttggcttgaagaactgagggcgcacgctgataagaacattgtcatcatccttattggaaacaagtctgatctagaagatcaaagagctgttcccactgaagacgctaaagagtttgctgagaaggaaggactctttttcctcgagacctctgctttaaacgcaaccaatgtcgaaaactccttcaacactctaatgactcagatatacaataccgtgaacaagaagaatcttgcatctgaaggcgactcaaataaccccggttcattggctggtaagaagattctcatcccaggttctggacaggagattcccgctaagaccagcacttgttgtacttcttcttgaggcgcgcc

SEQ ID NO: 389 - DNA, 649 bp, Arabidopsis thaliana
ttaattaaatgggatcttcttctgggcaaagtggatacgatctgtcttttaagatcttgttgattggtgattctggtgttggtaaaagcagtttgcttgtcagcttcatttctagctccgttgaagatcttgctcctactattggtgttgatttcaagatcaaacaattgacagtaggaggcaaaaggctaaaactcacaatctgggacacagctggacaggaacggtttagaacactgacaagctcttactacagaggcgcccaaggaatcattctcgtttatgatgtgacgagaagggagacatttacaaacttagtagatgtgtggggtaaggagattgagctttactccacaaaccaagaatgtgtaaggatgctcgttgggaacaaagtcgatagagaatctgagagaggagtaagcagagaagaagggattgctctagcaaaagaactcaactgcatgtttcttgagtgtagtgctagaactcgacaaaacgtggaacagtgtttcgaagagttggctttgaagataatggaggtacctagtctcttggaagaaggatcaagtgctgtgaagagaaacatcttgaagcagaaaccagaacaccagactaatactcaatccggctgttgcagctagggcgcgcc

SEQ ID NO: 390 - DNA, 1030 bp, Arabidopsis thaliana
ttaattaaatgcattcacttccggtgaatctcgtcctcaccgtacttacggtgttcctaacatcaccggcgcaagttatcggataccgtccatatccaccaaaaaccaacggctccgatcaaatcttcgacgcttcaaaaaaattcgaaggctcatcgaatctcgtccgcctccgttaccacatgggtccagtcttaaccaacaacatcaccgttcacccaatctggtacggcacgtggcaaaaatcccagaagaaaatcatccgtgagttcattaactcaatctcagccgttggatctaaacacccttcagtctccggttggtggaaaaccgtacagctttacactgaccaaactggatctaacattaccggtacggttcgtctcggtgaagagaaaaacgaccggttttattctcatggtaaatcacttacccggttatcgattcaatccgtgataaaatccgccgtcacttctaggtctcgcccgttgccggttaatcccaaaagcggtttatatcttctcctcaccgccgatgatgtctacgtgcaagatttttgcggccaggtttgtggatttcactatttcacgtttccgtcgattgttggattcacgttaccgtacgcttgggttggaaactcggcgaagctttgtcccggagtttgtgcttatccgttcgccgtaccggcgtttataccgggattaaaaccggttaaatcgcctaacggagatgttggagtagatgggatgataagtgtgatagctcacgagattgctgagctggcgacgaatccgttggttaatgcttggtacgcaggacccgacccggtagctccggttgagatagcggatctttgtgagggtatttatggaacaggaggtggtggttcgtacacaggacagatgttgaacgatcatagtggtgccacgtataatgttaatgggatccgacggcggtatttgatccagtggttatggagccacgttgttagttactgtaccggacccaatgcgcttgattagggcgcgcc

SEQ ID NO: 391 - DNA, 1963 bp, Arabidopsis thaliana
ttaattaattccttcctctgcttcttctccggtggatgtcctctttcatcaatggcggcgaggataaacacttcgcttcataacgccctctcttttttaaagccttttaacactcccctcaataccaaaccattctcttttagaagaaacagcttcagattttccaaaaagcttccttattattctcagttttcctcagggaagagagctctctattgcacttccagttcccaggaaagtaccgtcgatgaaggcgagacatttgtcctcaccactcctctttattacgttaatgcccctccccacatgggtagtgcttacaccactatcgccgccgattcaattgctcgtttccagagactgcttggtaagaaggttatctttatcacaggaacagatgaacatggtgagaagatagctacttcagcagctgctaatggacgtaatcctcctgaacattgtgacctcatttctcaatcttatagaactctttggaaagatctcgatatagcttatgacaaattcattagaactactgatcctaagcatgaagctattgtaaaagagttctacgctcgtgttttcgcaaacggtgatatttacagagctgattatgaaggtctttactgtgttaactgcgaggaatataaggatgagaaagagttgcttgaaaacaattgttgccctgtccatcaaatgccatgtgttgcaaggaaagaagataactacttctttgctttgtcgaaatatcagaaaccacttgaagacattttggcccagaatcctcgttttgtgcagccttcgtatcgtcttaatgaggtacaaagttggataaagagtggcttaagagatttttccatttctcgagcattagtggattggggaattcctgttcccgacgacgataagcaaaccatatatgtttggtttgatgctctacttggttacatatcagctctaacagaggacaacaaacaacaaaatctagaaactgctgtttcatttggctggcctgcttcattgcatttgatcggaaaggatattctacgatttcacgctgtctactggcctgccatgctaatgtctgctggtcttgaacttcccaagatggtgtttggccatgggtttctgacaaaggatggaatgaagatgggaaaatcgttggggaatactctagaaccgtttgagttggttcagaaatttgggccagatgccgtgaggtatttcttcctacgggaggttgaatttggaaacgatggggactattcagaagaccgatttataaaaatcgtcaatgcacatctcgccaacactataggaaatcttcttaaccgtactcttggtcttcttaaaaagaactgtgaatccactttagtggtagactcgacagttgcagccgaaggagttcctttgaaagacacagtggagaagctggttgagaaggctaggacaaactatgaaaatctgtcactatcatcagcgtgtgaagctgttttagagattggaaatgcgggaaatacctacatggatcaacgagcaccatggtttctgttcaaacaaggtggtgtctcagcagaagaggcagccaaggatctggtgattatactggaagtaatgagagtcatagcggttgcgttatcccccgttgcaccttgcctaagtctgaggatctattcacagcttggctatacagaggatcaattcaatagcataacctggagtgacaccaaatggggagggctaaagggaggacaagtaatggagcaagcgagtcccgtatttgcaaggatcgagctgaatccagagaaagaagaagatgagaagaagccaaaggttggtaagaaaactggcaaagccaaggtcaaagtagtagagcaaactcctacagtagctgaagcttaaaaccaactccacaaaatcctgaaaaactgattacagcattccatttaaatacccagcaaat

SEQ ID NO: 392 - DNA, 1289 bp, Arabidopsis thaliana
ttaattaatctgaatctttgtctttgtatccgttatctgaattctattcgccatggaagctgtgcttctctgctcgaagcttgttcctagagcggcgtcgttggaagggaaccaaaagttttcgttcaggcatttgaacaaacaccttaagtgcaattcccttcgtgctgattccagagacactccgttgctccgaggttttgaagcgataaagagtccgtctatctggagttgtgcgccgttcccagtgagaaaaggttcatgggttccacccagatgctcgatttctagctcgactgtttccgattccgataaccctttccttagccaatttcgaaccttctcttttgggtcaatggtgaagaaagttcgtgagttgaaagtgaagcccatggatgttgtgaagttaactcttttgctatcgattttgactgtggctgcaaaaaagactttgactttggtcttggacccattcttctggatgtattttagctggacatggttgttctggccttggtttatcgctgtgggtcttgcgggttatggaatttactgtttccgtaagcattggcttggcgaagccaatgcctttgagcagcttggtattgtaacttcagtcttcacatggctaacacttgtgcctcctgcttatttcaatggttatcttgaaggctggccttatgtgttcttcttggcgtatcattacttctttttcttcaatgttagcgtgagaaaacgcctctatggagatttctatgctcgcactcatgatcccaaatgggatgtgaacacgcctctgtggtctcggattttgtttggtgttggcatcatggttggacattggcttgcagcttttgaagggcctgagcttcaccgattaccagggggttgggccaatgtagggatatggattttgattgtgattacaatgcttatgcattatgattcaacgctatatcttgctagatattctgaaaaggttgttgttccaacggctgttgtgcaatttggtccttatagatgggtcaggcatccgatatatgcttctacgatgcttcttttcgctgcatactgcactgctctgcgtgcgcctttgagtctgttgtttcttttagcggtttgtttggtttactacaacaagaaggcaaagatggaagaagaattgatggtggagagtttcggacaaagctattcggattatgctgataaggttaggcacaagttcattccttttgtttactagtagtggtatagaggaacctgtgttgtgtctaattttctggtggcgc

SEQ ID NO: 393 - DNA, 1283 bp, Arabidopsis thaliana
ttaattaaaaaataataagctttggtaaaaccctaaactttcgtttccaagatgcaatttctagcttctctcgtttccaattccagaaagtttggtcggagatgggatcgagctctctcgttgcatcatttctcttcgaatgcgacaccagcttcgatatcaaatccagcgttcgtcgagtttctcagggacaatgggttccagaaacctctagcaattgccatcgcaatgcgttaccctaacctcaaatccctagaacaacctcggtcagtgattcaaatgcttaaaagttacagtttttccgatacccagatccagaaatcgatccgggtccatcctcgaatgatgttctacaacgtggagaaaattctagaacccaaacttcgattctttaaagatattggatttactggctctggtcttggtaagttcgtctctcaaaactcatcagtcgttggtgtaagtctagtgaagaaattgattcctaccgttgagattctgaaatcgattgttgccccaaaacatgaagaccttcctgtcattcttagtagatgtggttggcttcttctcagtagagaccctaacttgtttctcttaccaaacatctcataccttgaaacctgtggaattgttgggtctcagcttgcttctttacttagaagacagccaagaatcttcaatctctctgaggaaaaactcagaggatatgtctctcgtgctttggatcttggttttactttgaactcgaggatgcttgtgcacgctgttatctcgttaagttctttgagcgagaaaacgtttgatcgaaaggttaagttgtttatggctaatggattctctgaagatgagataacagatattatacgaagatctccaggtttgatccggtgctcagaagataagcttacactggggtttgagttttacttgaagagaatggggttagagagggaagctttggcgaaacgtccttgtgtgttgtcgtataatcttgagaagagggtgattcctaggcttaaagttttgcagatcttgagggaaaaagggttgttgttaaaagaggagaagaagaagaagaacatggttggcattgttgagatgactgaggaagcttttctagagaaatatgttgtgagatttggagatgagattgctgaggaactgctggttgcttacaagtgcgtgtgtttagtcgatgaaacgctacttgatcgtatcaagatctaattgtagatttcacaagtccaaacttgaaattttgtcattgtatccaaaggcgcgcc

SEQ ID NO: 394 - DNA, 1200 bp, Arabidopsis thaliana
atgtcgagctcaggccaaactcagttccgttatacacagacgccgtcgaaggtggttcatctgcggaatcttccatgggaatgcgtcgaagaggagctcatcgacctttgcaaacgattcggcaagatcgtcaataccaagagcaatgtcggcgccaatcgcaatcaagctttcgtcgaatttgctgacttgaatcaagctatatcaatggtttcgtattatgcttcatcttcagagcccgcacagattcgtgggaaaactgtctatattcagtactctaatcgccatgagattgttaacaatcagagtcctggagatgtccctggaaatgtcctcttggttacctttgaaggagtggaatctcacgaagtcagcatcgatgttatccatctggtattttctgcttttggatttgtgcataaaattgccacatttgagaaagctgctggtttccaggcactagttcaatttactgatgtggagactgcatccgcggcaaggagtgcgttggatggcagaagtatacccaggtatctgctttccgcacatgttggttcgtgcagtttgcgaatgtcttattcagctcatactgatctcaacatcaagtttcagtcccaccggagcagagattacacaaatccataccttccagtgaatcagaccgcaatggatgggtctatgcagcctgctttaggtgctgacggcaagaaagttgaatctcagagcaacgtccttctcggtttgattgagaatatgcagtatgctgtcactgtggatgttcttcacacggtgttttctgcatatggaactgtccagaagattgctatatttgagaagaatggttcaacgcaagcattaattcaatactctgatataccaacagcagcaatggccaaagaagcactggaaggacactgcatttatgacggtggctactgtaagcttcgactatcatactctcgtcatactgatctgaatgttaaggcttttagcgacaaaagcagagactatacacttcctgatctaagcctacttgtggcacaaaaaggtcccgcggtgtcgggttctgcaccaccagcaggttggcagaacccgcaagcgcaaagtcaatactcaggttatggcggaagcccatatatgtacccatcatctgatcccaacggggcttcaccctcaggtcaacctccttactatggatga

SEQ ID NO: 395 - DNA, 1479 bp, Arabidopsis thaliana
ttaattaagtgtttcttgttcttaattagggtttgattgaagaaaatggaaggagagaataatatggagaaaggattgttattggcaaaaaaggaagacagtgcaaatacaactccacttcttatcttctccaccttcatcattgtctctgcctccttcacctttggcgctgccataggttatactgcagatacaatgtcctccattatgtcagacttggatctttctctcgcacaattttcgctgtttggttcgttgtcgacgtttggaggaatgatcggtgcaatattcagcgccaaagctgcaagtgccttcggtcataaaatgacgttgtgggtggctgatttattctgcataactggttggcttgcaatttcactagccaaggatattatttggcttgacatggggcgatttttggtgggaattggagttggtctcattagctacgtggttcctgtatatattgcagaaataacacccaagcacgtaagaggggcttttacatttagcaatcagcttttgcaaaactgtggagttgcagtcgtatattactttggaaatttcttgtcatggagaactttagccataataggtagtattccatgttggatacaagttattggtttgttcttcatacctgagtctccaagatggctggcgaaaaaaggtcgtgataaagaatgtgaagaagttcttcaaaagttaagaggaagaaaatacgatattgtgcctgaagcttgcgaaatcaagatttcagttgaagcttcgaagaaaaattcgaatatcaacattcgtagtcttttcgaaaagagatatgctcatcaacttacaatcggcattggtttgatgcttctgcaacagttatgtggaactgcaggaataagttcttacggaagcactctatttaaacttgccgggtttcctgctcggattgggatgatggtgttatctcttatcgtcgtaccaaaatctttaatgggtctaatcctcgtggatcgatggggaagacgcccacttcttatgacttcagcgttggggttgtgtttaagctgtatcacattggcagtagcgtttggagttaaagatgtcccgggaattggaaaaattactccaattttctgtttcattggaatattgtcgtttacgatgatgttcgcaattggaatgggagcgttaccatggattataatgtctgagatatttccaatggatataaaggtattagctgggagtttagtgaccatagcaaattggttcactggttggatcgccaactatgctttcaattttatgttggtttggagcccaagcgggacttttataatatccgctataatctgtggagcaacaattgtattcacatggtgcttggtgccggagactcgaagattaacgttagaagaaatccaactgtcgtttgtcaatgtttagggttcatcggaagcattcatatatacatcataaaggtggcgcgcc

SEQ ID NO: 396 - DNA, 1764 bp, Arabidopsis thaliana
ttaattaaatggctgttgttgtgtctaatgccaatgctccggcctttgaggccaagatgactgtctatgtattcatctgcgttatgattgccgctgtcggcggtttgatcttcggttacgacatcggaatttccggttacttctctttctctgtaccaaatttcattttacttgcatttcaagaaaaagtcttaacttgtatctcaagttaactgttttggtttgcttttagctaatgttactgatctgtaaattaaaaggtggagtaagtgcaatggacgatttcctgaaggaatttttcccagcggtgtgggagaggaagaagcacgtacacgagaacaactactgcaagtacgataaccagttcttgcaactgttcacctcgtctctttacctagctgcactcgtggccagtttcgtcgcgtccgccacctgttctaaacttggacgcaggccgacgatgcagtttgcttctatcttcttcttgattggtgtcggtctcactgcaggagccgttaacctcgtcatgttgatcattggaagactctttcttggctttggtgttggatttggcaatcaggcagtgcctcttttcctgtctgagattgctccagcacagctccgaggaggtctcaacattgtattccaactcatggttacaatcggaatcctaattgccaacattgtcaactacttcactgccacggttcacccttacggatggaggattgctctcggtggagctggaattcccgctgttatcctcctcttcggttcactacttatcattgagactcccacaagtctcatcgagcgcaacaagaacgaagaaggaaaagaagccctaaggaagatcagaggagttgatgatatcaatgacgagtatgagtctatcgtccatgcatgtgacatcgcgagtcaagtcaaggacccttacaggaaactgttgaagcccgcgagtcgcccaccgttcatcatcggaatgcttctccagcttttccaacaatttaccggaatcaatgcgattatgttctatgcgccggtcttattccaaactgttgggttcggaagcgacgcagcccttctctctgcggttatcaccggatcgatcaatgttctcgccacgttcgttgggatttacctcgttgacagaaccggcaggaggttccttcttctccaatcttccgttcacatgctcatctgccaggttctaattaaatctctcatctctttgtttcttatgcctcaagtaacttaaaggtaggtttcttgtcccagaagtaaactaactaacctcttaaaacagttgatcattggaatcatcctagcaaaggacttgggcgtaacgggaacactcgggaggccacaagccctagtagtggtgatctttgtgtgcgtttacgtgatgggatttgcatggtcatggggacctttgggatggctaattcctagcgagacgtttcctctagaaacacgtagcgcaggattcgctgttgcagtctcatgcaacatgttcttcacttttgtaatcgctcaagccttcctatcgatgctttgcgggatgagatctggaatattcttcttcttcagcggttggatcattgtgatgggactgtttgcgtttttcttcataccagagacaaaaggaatcgccattgatgacatgagggagagtgtgtggaagccacattggttctggaaaaggtatatgcttccagaggacgaccaccatgacatagagaagagaaatgcttgaggcgcgcc

SEQ ID NO: 397 - DNA, 1649 bp, Arabidopsis thaliana
ttaattaaacagacagaagtcaacaaatctttcatttgttttttagcaaatcaaagaaatggccggagggttcgtcagtcaaacgccgggtgttcggaactacaattacaaactgacaccgaaagtgtttgtgacatgtttcatcggtgcttttggtggtctcatcttcggatacgatctcgggatctcaggaggggtaacctcaatggagccattcttggaagagttcttcccttacgtctacaagaagatgaagagcgcacatgagaacgagtactgtcgatttgatagtcagcttctcactctcttcacttcgtctctctatgtggcggctttggtgtcttctctctttgcctccaccattactagagttttcggaaggaaatggtcgatgtttctcggtggtttcaccttcttcatcggttctgctttcaacggctttgcccaaaacatcgctatgcttctcattggtcgtatcctacttggtttcggagtcggattcgccaatcaatctgtaccggtttatttatcagaaatggctcctccgaatctaagaggagctttcaacaacgggtttcaagtagcgattatctttggtattgtggttgcaacgatcatcaattacttcaccgcacagatgaaaggaaacatcggatggagaatctctctcggattagcttgtgtccctgcagtgatgatcatgatcggagctctgatccttcccgacactcccaactctctcatcgaacgtggctacaccgaagaggccaaggaaatgcttcagtccatccgaggaaccaatgaagtcgatgaagagtttcaagatctcattgatgcaagtgaggagtccaagcaagtgaaacacccatggaagaacatcatgcttcctcgttacagaccacaattgatcatgacttgcttcattcctttctttcaacaacttaccggaatcaatgtcattaccttctacgccccggttttgttccaaaccctcgggttcggtagcaaagcttccctcctatcagctatggtaacgggtatcatcgagctcttgtgtaccttcgtctctgtttttacagtggataggtttggaagaagaatcttgttcctccaaggaggtatccagatgcttgtctctcagatcgctattggagccatgattggagtcaaatttggagtggctggaacaggaaacatagggaaaagtgatgccaatctaatcgtggcactgatctgcatctatgtagcgggtttcgcctggtcatggggaccgttgggatggttggttcctagtgagatatctccactagagatccgatcagcagctcaagccataaacgtttcggtcaacatgttcttcacattccttgtggctcagctcttcctcactatgctttgtcacatgaaattcggactattcttcttcttcgccttctttgttgtcataatgacaatattcatctacttgatgttgcctgagacaaagaatgtgccaatcgaagagatgaacagagtgtggaaggcacattggttctggggaaagtttattcctgatgaagctgtcaatatgggtgctgctgagatgcaacagaagtccgtatgatgatgatcaagaatgaagttttctttgggcaataaagaggcgcgcc

SEQ ID NO: 398 - DNA, 1959 bp, Arabidopsis thaliana
ttaattaacattataactccatttgccctcctggttcatcttgttctctaccatggctgattcaaaatctggtgacacggaagtagcgcatcgctctagcgatccaagcgaaaagcgtggtggctggatcactttaccgttcatgctaggtttgttttttgtttttttttgaaaccaaaacatatatagatgttgatactggtgaggttttatgttgtgcagttacattattaggcatgtccataacttctttcggatggggaatgaacttgatcgtcttcttgatcgaggaattccacatcaagaacatcgctgctgctcagatttcaaatgttgtcaatggagttgtcaacatgttacctgttgttgcagccatcctagctgattccttttttgggaacattcccgtcatctccacctccactttcatttctctggctgtaagttaaacactcactaattctattctatgttctgatatacaaagcttaccagctttaaaaccattttttcagggaacctctctcttgaccttaatcacatctttgaactacttgatgcctagaccgtgtgaaacggggtcaattctatgccagtcgccatcaaaactacagcttgggatcttgtatgtagccttagctctagtgatcattggatcagctgggacgcggttcaccttggcagccgcgggtgcgaaccaatataagaagcctaaagaacaaggaagattcttcaactggttcttccttgcactgtatattggagctattactggcacgacagcgattgtatatacacaagacaatgctagctggaaacttgggttcggtctatgtgccgttgctaacttgatcagtttcatcgttttcatcgccggggttagattctacaagcatgacaaacccttgggaagtccttatacaagcctgatccgtgttttagttgctgctacaatgaaaagaaaggcagtgatttcatcaaaagacgaagactatcatcaatatggtctcgggaaagaggccaagacttatactacaatgccctccaagagctttaggttaagaccaaaaccttgcttgattcatgaaagtttaaccagaactaaaaagagctttacattttcaggttcttgaaccgtgcagcattaaagaacaaagaagatttaaacacgagtggtgactcaagtaataacatgtggaggctatgctctgttcaggaagtagaagacttcaaagccattctccgacttgtacctctctgggcagccgtcatgttcctcagcactcccgtggcagtacaaatgagcatgacggttctccaagctttggtcatggaccgcaaacttagcccgcacttcgaagtctctgccgggtctctacaagtcatagtactcgtctttggttgtgtctttatcatgctcaacaactggatcatctatcccatgtaccaaaagctaatcggcaaaccactgacaccacttcaacaagttgggatcggtcacgttttcaccatcctaagcatggcgatatcagctgttgtggaagcaaagagactgaaaacagttgaaaatggaggccatcccatgtcagtgctatggctagttcctgctcttgtgatggttggaataggcgaggcgtttcattttcccgcgaatgttgcagtattctatggagaattccctgagtctctgaagaacaccgcaacttcattgacctcagtggtgattggaatctctttctatctgagcacagctgttatcgacgtgatccaaagaaccacctcgtggttaccaaatgacataaaccatggaagagttgacaatgtttactgggttgtagtcataggaggagtcttgaatctcggctatttccttgtctgctcttggttttacaaatacagaaacctcaaggatgatgatcatgaacaagatcctaaagatgttaaaacctagggcgcgcc

SEQ ID NO: 399 - DNA, 1833 bp, Arabidopsis thaliana
ttaattaactgcgggccggttattttggttaattagtctaaatccatggcaggaggggcatttatagacgagagtggccatggaggagactacgaaggtcgtgtaaccgcgtttgtcatgataacctgcattgtagctgcaatgggtggtctcctctttggttacgacattggtatctcaggtttgtttcttgccagccaagtaaaccaaaattcttctctctgcttctttctttgttttcatggcggacatattatatgttttcaggaggagtgatatcaatggaggactttctaacgaaattcttccctgacgtgcttcgtcaaatgcaaaacaaaagagggcgtgaaacagaatattgtaaatatgacaatgagcttcttactctcttcacttcctctctttacctcgctgctttgttcgcttctttccttgcctccaccattacaaggctttttggccggaaggtctcaatggttatcgggtctctcgcttttctctctggagctcttctcaacggtttagctatcaacctcgagatgttgatcatcgggcggttatttctcggtgtaggtgtcggattcgctaaccaatctgttcctctttacctctctgagatggctcctgctaagatcagaggagctctcaacattggttttcaattagcaatcacgatcgggatcttagccgcgaacattgtcaattacgtgaccccaaagctccagaacgggatcggatggagattatctctcggtttagctggagttccggccgttatgatgcttgtcggatgctttttcttgccagatacgccaaactcaatccttgaacgtggaaacaaagaaaaggctaaggagatgctgcagaagatcagaggaaccatggaggttgagcatgagtttaatgaactttgcaacgcgtgtgaagccgcgaagaaagttaagcatccatggacgaacataatgcaagctcgttatcgaccgcagctcacgttttgtaccttcatcccattcttccagcagctaaccgggatcaatgtcattatgttctatgcacctgttctgtttaagaccatcggttttggaaatgacgcctctctcatatccgcagttatcaccggtcttgtcaatgtcctttccaccattgtctccatctactccgttgacaaattcggacgaagagctttgtttcttcaaggtggttttcagatgatcgtgacccaggtgcgtacaaaccctaaaacaatgaaaatactctgtttttcaaaacagagtatcttgctctgctttctaaaaccgaggtaggtaacaatgatttgttttgctttggcttcagatcgcggtcgggtcgatgatcggatggaaatttggattcaacggggaaggaaatttgtcaggggttgatgcggatataatcttggcactgatatgtctctatgtggcgggtttcgcgtggtcatggggaccgttgggatggttagtgccgagtgagatatgtccattggaaattagatcagcaggacaatcgttaaacgtttcggtgaacatgttctttacattcttcattggacaattcttcttgacgatgctttgccatatgaagtttggtttgttctatttcttcgcgggtatggtcttgatcatgaccattttcatttacttcttgttgccggagacaaaaggtgttccgattgaggagatggggaaagtgtggaaagagcatagatattgggggaaatatagtaataatgatgatggtgatgatgttgatgatgatgcttatttttagttgatgattatttgggatttaaggatatgttaggattggcgcgcc

SEQ ID NO: 400 - DNA, 2143 bp, Arabidopsis thaliana
ttaattaaatggctggaggagcctttgtatcagaaggtggtggtggaggaaacagctatgaaggcggagtcaccgtctttgtcatcatgacatgtattgtggccgctatgggaggtctcctctttggttatgacctcggtatctcaggttcgtaaattccacattcgcctttttcttcttcgggttgagttattttggttcgctttcgctgtccactctagcttcggggaatgtaacgtgacttcttttgttgtataggtggagtgacatctatggaggagtttctgagcaagtttttcccggaggtggataagcaaatgcacgaagcaaggcgcgagactgcttactgcaaattcgataaccaattgctacagttgttcacttcctcactctacctcgcggcactcgcgtcttcctttgtagcttcggctgtcacaaggaagtacggacgcaaaatctccatgtttgttggaggggttgctttcctcataggttctctattcaacgcatttgctaccaatgtcgcaatgctcatcgttggtagattgttgctcggagtcggtgttggatttgccaatcaggtgagtcaacaactcaacatggtcatggtgtgtttattatgtggtttagctcaagacattctggttctggactcggtttggttcaaaaatttctcaatttttcagagtggttccaatttccaaactagaatcaacttacatctaaggttcagttttaaaatacaaataaataattaatactatcaaaatttagttgcggtttattttggtttattcgttgctgtttggttgcacgatatttgatttgttagctataaaaatattgttagcgcttagtatgaaataaagtaaggtatatttggtttcagtatggctcatccatctttaactttgtttttccagtctacgcctgtttatctctcggagatggctccagcgaagatccgaggagcacttaacatcgggtttcaaatggctataaccatcgggattttgattgcaaacttaatcaactacggaacatctcaaatggctaagaacggatggagagtatcattgggtttagccgctgtaccggcagttattatggttattggatcttttgtcttgcccgatacaccaaactcgatgctcgagagaggcaagtacgaacaagcgagagagatgttgcaaaagattcgtggagctgataacgtagatgaggagtttcaagatctgtgtgatgcttgtgaggctgctaagaaagtggataatccatggaagaacattttccaacaggcaaaatacagacccgctcttgttttctgttctgcgattcctttcttccaacagattactggtatcaatgttatcatgttctacgcccccgttctctttaagactctcggttttgcggatgatgcctcgctcatctcagcggttattacgggtgcggtcaatgttgtctctacccttgtctccatctatgcggttgacaggtacggaagaaggattctcttccttgaaggaggcatccaaatgattgtttcccaggtaaaaatgctagttccgagtttgcgtatacatgtggaaaaatgaaacgttttcagttcataatgtatataaatgatgattgcgtaccttacatatattgtttgatgggtcattttgcagatcgttgttggtaccttgattggtatgaagtttggaaccacgggatcagggaccttaacacctgcaacagcagattggatcctggctttcatatgtttgtatgttgcaggatttgcatggtcatggggtccattaggatggttagtaccaagtgagatctgtccattggaaatcagaccagcgggacaagccatcaacgtctctgtcaacatgttcttcactttcctcattggacagtttttcctcacgatgctttgccacatgaagtttggtctcttctacttctttggaggaatggttgcagtcatgaccgtcttcatctacttcttgttgccggagacaaaaggggttccaattgaagaaatgggaagagtatggaagcaacatccgttctggaaacgttacatgccagatgatgctgttattggaggaggtgaagaaaactacgtcaaggaggtttgaggcgcgcc

SEQ ID NO: 401 - DNA, 1600 bp, Arabidopsis thaliana
ttaattaaatggcagaaccaactcagccgcttctgaccgattccaactcgtcatcaccgagatctctcgacgacacaatcgagagttacattggaagctttgggtgggctcagtttcttcaagcggctttagtctcattctccggtgttttcgacgctcaacaaactttcatctctgtgtttacagactccgaacccacgtggcactgcaccgactcgaactcgatctgccatgaatccatctccaacatctgtatcctccccaaaaccgcatggtcttgggattactctcctcacgtctctgttatatccgaatggggtctccaatgcgccggctctttcgtcaagggcttaccggagagttctttcttcgtcggatgtttaatcggaggtttggttctctcaacacttgctgattcttccttgggtcgtaaaaacatgttgtttctgtcctgtctcgttatggcgatatcaacgatgctaacggttttctcaccaaacatttgggtttacgctgttcttcgattcgttaatggatttggtcgagcgacgatagggacatgtgcgctcgttctttcgacggaattagttgggaagaaatggcgaggacgagtagggataatgagtttcttcggattcatgcttggctttttgtctcttcctttgatggcttacatgaacagaggaagttcttggaggattctctacgcatggacttcgattccaacgataatatactgcgttcttgttcggtttttcgtttgtgagtctccaaggtggcttttcgttagaggccgtagagaagaagctatttcgattctcaaaagggttgcttcgattccgtctactgatgtaagcagtggtggtgcaatatctatgagtttttcgagcttaccttttgaagaagatgaagagaagcctagtactaatgttaacatcttcacgaccatgaaggtgttggtagagaaaagatgggcgcttaagagattatccgcggtaatggccattgcgttcgggattggtttggtctattacgggatgcctttagcgttatcgaatcttgatttcaacatctatttaagtgcagcgtttaatgcgttgatggatttaccagcgaacctcatcacgcttttcctagtcgataaactcagtaggagaaacgcgcttatcggatttacggctttaggtggagtctctagcgttctcatatttgcgttacataatatgagaattggaaaccacggggcgttacagttggcgttagagctaatctcttactttagcgcgtgttcggcttttaacatggagatgatatacacgatcgagctgtttccgacatgtgtgagaaactcggctatcgcaatggctagacaggctttggtgcttggtggagttttcagccctattatggtagcagctggtcggaaaaacgcgttctggtcgttcggattgtttggtcttgctataggtttgttgggattgtttgcagttggattgccagagactagagggagtgatctatgtgacactatggacgaggaagagtgcaaagaccggcggagtaaagtcgccgttaataatgtcattgcatgaggcgcgcc

SEQ ID NO: 402 - DNA, 1902 bp, Arabidopsis thaliana
tgcaagtggtggacatatatagttatgtgtatatatatactagtaaatgcacacaatcgatataacaagttattctaaaatttaacccaaaaaaaaaaaaagagaagaaaaagactcaacatggttcatgctgatggtcataattttcccggttcggatccaaaccctcatatgaacaagttcgctttcgggtgtgccattgttgcttccatcatttctatcatctttggatatggtaacatactaacattctctacatatcaaacaaaagttttctacatatatcatataaagatatattcaatggaattatattaatgattttatattaacgaatatttttttttttgtaatggtgtgttgtccttagatacgggagttatgagcggagctcagatatttataagagatgatctaaaaataaacgacactcagattgaagttttggccggaatcttgaatctttgtgcactcgtcggatcactaacggcggggaaaacgtctgacgtcatcggccgacgttacaccatagctctctccgccgtgatattcttagtgggctcagttcttatgggttacggcccaaactatcctgttttgatggtcggacgatgtattgccggagttggtgtagggtttgctctcatgatagctccggtttactctgccgagatatcctctgcgtcacatagaggctttctcacttctctacctgagctttgtattagtcttgggattttactaggctatgtctcgaattactgttttgggaaactgacgttgaaacttggatggagattgatgcttggaatcgcagcgttcccgtctttgatattggcttttgggattacaagaatgcccgagtcgccgaggtggcttgtgatgcaaggtaggttagaagaagccaagaaaataatggttttggtatccaatacggaagaagaagctgaagaacggttcagagacatcttaaccgctgcggaagtagatgtgacagagataaaagaagttggtggcggcgttaagaagaagaatcacggtaaaagtgtttggagggagttggtgataaaaccgcgacctgcggtgcgtttgatcttgatagcggccgttgggatacactttttcgagcatgcgacggggattgaggccgtcgtgttgtacagcccgagaattttcaagaaagccggagttgtttcgaaagacaagctcttactagccacggtcggtgtaggtttaactaaggcctttttcataataatagccactttcttgctcgacaaggtaggtcgtagaaagctcctgttgaccagtacgggtgggatggtcttcgcattgaccagtttagcggttagtctcacgatggttcagcgatttgggcggttagcgtgggcattgagtttaagcatcgtctctacgtatgcatttgtagcttttttctccatagggcttggacctatcacatgggtgtacagctccgagatattcccgttgagacttagggctcagggagcgagtataggtgttgcggttaataggatcatgaacgcgacggtctcaatgagttttctgtcgatgacgaaggcgatcacgacagggggcgtgttcttcgtattcgccggaatagcggtggcggcatggtggttcttcttctttatgttgccggagacgaaaggattgccattggaggagatggagaagctttttggtggtgggggtcctcgtggtgatcgtgacggacttgagattcaaactaaaaccatctctattgggggtttctcataagagtttctcacaattaaaaaaataaaaataataaaaatgaaggagagagagtgtagaaagattctcagaaactttgagatactctctacaacccatcatgacaattcgcttctcactatt

SEQ ID NO: 403 - DNA, 1475 bp, Arabidopsis thaliana
ttaattaaaatgggagatgggagttccagtagatccaacagctcaaacagcactagtgagaaaccagagtggctgcaacagtacaatctcgttggtaagattggtgaaggcacttatggtcttgttttcttggctagaaccaagactccgcctaaaagacctattgctatcaagaagtttaagcagtccaaagatggagatggagtttccccgactgctatccgcgagatcatgttgcttagagagatttcccatgagaacgtcgtgaagcttgtgaatgtccacatcaattttgcagacatgtctctgtatcttgcctttgattatgccgagtacgatctctatgaaatcatcaggcaccacagagacaaagtcggccattcgttaaacacatacacagttaagtctttgctctggcagcttctcaacggattgaactatcttcacagtaattggattatacacagagatttgaaaccgtcgaatatcttggttatgggtgatgcagaagagcacggaatagtgaaaatagctgatttcgggctcgcaaggatatatcaagctccgttgaaaccactatcggataacggagttgtggtcacaatctggtaccgagcaccagagctgcttcttggttcgaagcactacacgagcgctgttgatatgtgggcagttgggtgtatattcgcggagttactaactcttaaaccgttgtttcaaggagcagaagcgaaatcgtctcaaaaccctttccagttagatcaacttgacaagatattcaagatcttaggccacccgacgatggataaatggccaacactagttaaccttccacactggcaaaatgatgttcaacacattcaagctcacaaatacgacagtgtgggtctccacaacgtggttcacctgaatcagaaaagtcctgcgtatgatctgttatccaaaatgctggaatatgatcctctaaagcggatcacggcttcacaagcactagaacacgagtatttccgaatggatcctctcccaggacggaacgcatttgtagccagccaaccgatggagaagaatgtgaattacccaactcgtccagtagatacaaacaccgatttcgaaggcacgacaagcatcaatccgcctcaagcagtagcagcaggaaacgtagcagggaacatggcaggagctcatggaatgggcagtagatcgatgccaagaccaatggttgcacataacatgcagaggatgcagcaatctcaaggcatgatggcttataatttcccggcacaggcagggcttaacccgagtgttccgctgcagcagcagcgcgggatggctcaaccgcaccagcagcaacagctaagaaggaaagatcccggaatgggtatgtcaggttacgcacctcctaacaaatccagacgcctctaaaggtaaaatcgagatcatcagtctcgggttagaatctgtgtgtttggcgcgcc

SEQ ID NO: 404 - DNA, 1345 bp, Arabidopsis thaliana
ttaattaaatggtagattctgacccggtggaatttccgccggagaaccgccgtggacagctcttcggcaaatacgaggtcggaaaattggtgggatgcggcgccttcgcgaaagtgtaccacgggaggagcacagcgacgggtcagagcgttgcgatcaaagtggtgagcaagcaacggctgcagaaaggaggactcaatggcaacattcagagagagatcgctatcatgcaccgtctgcgccacccttctatcgtgcgcctgttcgaggtcctcgccaccaaatccaagatcttcttcgtcatggaattcgccaagggcggtgagctattcgccaaagtctccaagggcaggttctgcgaggatcttagccgtcgttatttccagcagctcatctccgccgtcggatattgccactcccgcggcatctttcaccgtgatctcaaaccggagaatctcctcctcgacgagaagctcgatttgaagatctctgatttcggactcagcgctcttaccgatcagatccgacccgacggcctcctccacacactctgtggtacgccggcgtacgtggcgcctgaggttttggcgaagaaagggtacgacggtgctaaaatcgacatatggtcatgtggaatcatactgttcgtcctcaacgccggttatctccctttcaacgaccataatctcatggttatgtaccggaaaatctacaagggagaatttcgcattcccaagtggacctcaccggatctccggcgactgctgactcggcttttagacacgaatccgcagacgaggatcactatcgaagagatcatccacgatccatggttcaaacagggctacgacgatcggatgtctaaattccatctagaggactccgatatgaaactcccggcggacgagaccgacagcgagatgggagcaaggaggatgaacgcattcgacatcatctcaggatctccagggttcaatctctccggtcttttcggagacgccagaaagtacgaccgagtggaacggttcgtgtcggcgtggacggcggagagggtggtggagaggctggaggagatcgtgtcggcggagaatctgacggtggcgaagaaggaaacatgggggatgaagatcgaggggcaaaaaggtaacttcgcaatggtggttgagataaaccagctaacggacgagctggttatgatagaggtgaggaagagacaaagagccgctgcatctggacgagatttatggacagatacactcaggcctttcttcgtcgagcttgtgcacgaatcagaccaaacggacccagaaccaactcaagtacatacgacgtcgtagggcgcgcc

SEQ ID NO: 405 - DNA, 1432 bp, Arabidopsis thaliana
ttaattaaatcctctgctttttcatcaagttcctttgttccctcaaaagcgtcaataaatggataaaaacggcatagttttgatgcgaaaatatgaattaggtcgtcttctaggtcaaggcacattcgcaaaagtgtaccacgcacgcaacataaaaacaggagaaagcgtagcgatcaaggtgatcgacaaacagaaagttgcgaaagtcggattaatcgatcaaatcaaacgagaaatatcagtgatgcgtctcgttcgtcacccccacgtcgtcttcctccatgaagtaatggcgagcaagacaaagatctatttcgctatggaatacgttaaaggcggtgagctttttgataaagtctctaaaggaaagcttaaagaaaacattgctcgaaaatatttccagcaattgatcggagcaatcgattattgccatagccgcggagtttaccaccgcgatctcaaaccggagaatcttcttctagacgaaaacggcgatttgaaaatatcggattttggccttagcgcgttgagggagtcgaagcagcaagatggcttgcttcacacgacatgtggaacacctgcttacgtggcacctgaagtgataggcaagaaaggttatgatggagctaaagccgatgtttggtcttgcggggttgtgttgtacgtgctattggctggatttcttccgtttcacgagcaaaatcttgtggaaatgtatcggaaaatcacgaaaggcgaattcaaatgtccgaattggtttcctcccgaggtcaagaagttgttgtctcggattcttgaccctaaccctaattcaagaatcaagattgaaaaaatcatggagaattcctggtttcaaaagggtttcaagaagatcgaaacgcctaaatctcccgaaagtcatcagatcgactcactgatcagcgatgtccacgcagctttttccgtaaaaccgatgtcttacaacgcgtttgacttgatctcttcgctgtctcaaggattcgatctctcgggtttgtttgagaaagaagagagatcagaatcgaagtttacaacgaagaaagatgcaaaagagatagtgtcgaaattcgaggagatagcaacaagtagtgagagattcaatttgacgaagagcgatgtaggagtgaagatggaagataagagagaaggaagaaaaggacatcttgcgattgatgttgagatatttgaagtgacaaatagttttcatatggttgagtttaagaaaagtggaggtgatacaatggagtataagcaattttgtgatcgtgagcttaggccttctttgaaagatattgtttggaaatggcaaggaaacaacaacaatagcaacaatgagaagattgaagtgatacattaaatgtgtttttcatcttatatttttctggatttggttgtttttctttggcgcgcc

SEQ ID NO: 406 - DNA, 1558 bp, Arabidopsis thaliana
ttaattaatctttcaatcttccttaaatctttcaaaaccccaaaatgggacctcgttgctctaagctctctctctgttggtggccgacccatctcaaatcaactcacaacgaagcttctgatctagataacggaacggacgatttgccgtcgtttacggagtttagtttcgaccaactacgagctgctacttgtggattctctacagacagtattgtctccgaacatggtgttaaagctcctaatgttgtgtataaaggcagacttgaagatgaccgatggatcgctgttaaacgattcaatagatccgcttggcctgatactcgtcaatttcttgaagaagcaaaagctgtggggcagttgaggaatgagaggttggcgaatttgattggattctgttgtgaaggagacgagagattgctcgttgctgagtttatgccttttgaaactctctcgaagcatctctttcactgggatagtcagccaatgaagtggtctatgaggttgagagtggctttgtatcttgcacaagcacttgagtattgtagcagcaaaggtcgcgccttgtaccacgatcttaatgcttacaggatcttgtttgaccaggatggtaacccgagattatcttgctttggtcttatgaagaatagtagggatgggaagagttacagtacaaatttggctttcacacctcctgaatacctaagaacagggagagtgattccggagagtgtggtctacagcttcggaacgctgttgctagatcttctcagcggcaaacacataccaccaagccatgcgcttgatctgattcgtgggaagaatttcctgatgctgatggactcgtgtctagatggccatttctcaaacgatgatggaaccgatttggttcgtttagcttcccgttgtttgcagtatgaagctcgtgaaaggccaaatgtgaaatctctcgtgtcctcactcgctcctcttcagaaagaaactgatattccgtctcatgttttaatggggattccacatggagctgcttctccaaaggaaacaacttcgcttacccctcttggtgacgcttgttcacgacatgatctcacagcaatacatgaaattctcgaaaaggttggatacaaagatgacgagggtgtagcaaatgagctctcgttccaagtgtggaccgaccagattcaggagactctaaactccaagaaacaaggagatgctgcgttcaaaggcaaagactttgtcactgctgttgaatgttacacgcagttcatcgaagatggcacaatggtatcgccaacagtttttgcaaggaggtgtttgtgttatctgatgagcaatatgcctcaagaggctcttggtgatgcaatgcaggcgcaagtagtgtctcctgaatggccaacggctttctatcttcaggccgctgctctcttcagccttggaatggataaagacgcctgtgaaaccctaaaagatggaacttccttggaagccaagaaacataacaacagaaactgaaaacttcaagtgtataggtttcttctctcttccgccggcgcgcc

SEQ ID NO: 407 - DNA, 2377 bp, Arabidopsis thaliana
ttaattaattttggttttaggctatttagattattgaattgattttgaatgataatcatgatgaattgttttccgtgtttcacttcacaaaagagcagaaacgctccatgcacgacgaacgagactaacgatgataacgttgaacacgacgaattcagaccacctggtacgtttttcaaatttagaaaaaaaaatatgttagctttcttatcacggaactgtgaattagaaaacctattttctaaaaatgttgtttggggggtttgtttggtttcagttgttgcgacgacgaaacggactgaagaaagagaacctgcagagcaacaaccaccggtgaaaacattcaatttccgggagttagcgacggcgaccaagaatttccggcaagaatgtcttttaggagaaggtggattcggtagggtttacaaaggaactcttcaatctactggccaggtttgttaccataccaaagttcaaacctctggatacaattttcggagattttctttgaagttgttttctattgctttgtgagtgtagttggtagctgtaaagcagctagacaagcatggattacatggtaacaaagagtttctagctgaagtcttgtcattggctaaacttgaacacccgaatcttgttaagcttataggatactgtgctgatggagatcaacggcttttagtctttgagtatgtctctggaggttcccttcaagaccatctttacggtataattgaactcctttcacaatgttttatggagatacctttaggcttggtttagaggctgacaatgtatttgatatgcagaacaaaagccaggccagaagccgatggattggataacgaggatgaagattgcgtttggtgcagcgcaaggattggattacttgcacgataaagttactccagcggtgatataccgagatttgaaagcttctaacatcttgttagatgctgagttttaccctaagctttgtgattttggtctgcataatctagagccaggaacaggtgatagcttgtttctttcttcccgggttatggatacttatggttattcagcacctgagtacactcgaggggacgatctcactgtcaagtcagatgtttatagcttcggagttgtgttgctcgaactcatcaccggtagaagagctattgacaccactaagcctaatgatgagcaaaatctagttgcttgggtaacactccattaaacctcttctctatgaatcatcaagttgggatcttttgaatgatatatgttttgggttttgcgcaggcacaaccgatatttaaagacccgaaaagatatccggatatggcagatcctcttttgaggaagaatttctcagagagagggttaaatcaagcagtggcaataacatcaatgtgtctacaagaggaaccaactgctcgtcctttgataagtgatgtaatggttgctcttagcttcctttcaatgtctacagaagatggtattccagccacggttccaatggaatcgttcagggacaaaagtatgtccattgctttaagcagacacggttcttgttctgtaactccattttgtatttctcggaaagatgtaggcaacaaatccagttcttcatcagactcggaggatgaagaagaagaaaaggaacaaaaagcagaaaaagaagaagaatcaacaagtaagaaaagacaagagcaggaagaaaccgcgacagattcagatgatgagtctgattcaaactccgaaaaggatcaagaagaggaacagtctcagttagagaaagccagggagtctagtagctcatcctctgactctggaagtgagagaagatcaattgatgaaacaaacgcaactgctcagagcttgaagataagttacagtaattatagctctgaggaagaagataacgagaagctaagcagtaaaagcagctgtaaatcaaacgaagaaagcactttttcgcggtatgacagcggtagagatcacgatgattcgtcaagaaacacaagcatgcgaatcaatagtcttgctcatgatgataaggaggaagacgaggaggagaatcatgaaacacggagctatagtgatcacgatgattcgccaaggaacactagcatgcgaatcaatagtctttctcatgatgatgatgaggaagaggaggaggagaatcatcaaactcggcttgagcacattcatagctcgaaatctgaagaccaaagtgtttattcagatgatgatgccggcgaaagtggtgagtcgtctttgcataggatcgaagcaaaggaagaagaacatatttcttctgaccatgattaatcttttgcaacgaggaaaaaaatgttgcaacttttcgttttggaacaaacggcgcgcc

SEQ ID NO: 408 - DNA, 1135 bp, Arabidopsis thaliana
ttaattaagtgttcaaagaggaaaactgaaacaacagtatttgtttgatgaaatcgatggtgaagaagttgaagcagagtctgagatctggatcgttagagaaaaggaaggaaaaggaaaaagacattcaggaagaaaagtggttcttagacaacggaagcatcttcttgaaagaacttattgctgattgtaacggtaaatccattcctatacgtaacttttcttctgaccagatcttgaaagctacaagtaacttcggttccagttgttttgtaaccgcagaggggttttatgtatggtacaaaggtatcatagaagatagatcttacatgatcaagagattctctgagtataaagttactcaatacagagtagcagaggtttacaacgaaattgtcttgtctgctcggatgagcaaccacaacaactttcttaaacttataggattctgtcttgagtttagtcttccggttcttgtgtttgaatatgcagaacatggagttttgaatcacagaggaggtgttatagtcaatggggaggaagttatattgcctttgagtttaaggttgaagattggaaaggagattgcaaatgctgtgacttatcttcacatggcattccccaagatcctcatacatagacacattaagccaaggaatgttttcttggacgagaattggaccccaaagttgtctgatttctctatctctataaacctccctgagggaaaatcaagaatagaagttgaatgtgttcagggaacaatcgggtaccttgatccagtatattataccacgaaaatggtgacggaatataccgacgtgtacagctttggagtcttcttgatggttattctcactggtaaaccagcacttgcatccactagctctgatggggactacaaacatattgctagctacgtgaaaggctttcatgagaatgggcagcttgatggagtaatagatcctaaggtgatggaagacattacaagtgctcaaaaagtgcatgtggaagcgtgtgtggtgttggcgctgagatgctgcgagctgagagatgaaaacagaccaaagatgatccaaatagctaaagaactcaagcagattgagacattatttcggagatcatagggcgcgcc

SEQ ID NO: 409 - DNA, 1558 bp, Arabidopsis thaliana
ttaattaaatgtctatcctttcgtttcctcacactttctttaacatctctccttcactcttctacactatccttatatccagtttagttctactgatcctcacgcgccggagtgctaaatcaaagatcgtgaagcttcctccaggtcctccggggtggccggtggttggaaacctcttccaattcgcgcgctccgggaagcagttttacgagtacgttgacgatgtaaggaaaaaatacggtcctatctacacgttgaggatgggaagtcgaacaatgatcataatctctgattcagctctcgtccacgacgttctgattcaacgtggaccaatgttcgcaacccgacccaccgagaatccgacccgaaccatcttcagctccaacactttcaccgttaacgcttcagcgtacggtccagtatggcgatccctgagaaagaacatggtacagaacatgttaagctcgatccggttcagagaattcgggtcgttgagacaatccgcaatggataaactcgtcgagaggatcaaatcagaagctaaagacaacgacggtcttgtttgggtcctaagaaacgcaagattcgctgcgttttgtattcttttggagatgtgttttggaatcgaaatggatgaagaatcgatattgaatatggatcaagtgatgaagaaagtgttgatcacactcaatccaagactcgatgattatctcccgattcttgctccgttttattccaaggagagagcaagagctctcgaggttcgttgtgaacaagttgatttcatcgttaaactcatcgagagacgacggagagcgattcagaagccggggactgataaaacggcgtcgtctttttcttatcttgatacactctttgaccttaaaaccgaaggtcgtataacgacgccgtctaatgaagagcttgtgtcgctctgctctgagtttcttaacggtggtacggatacgacggggacggcgatcgagtggggtatagcgcaactgattgtgaatcctgagattcaatctcggctctacgatgagattaaatcaacggttggagatcgtgaggttgaggaaaaagatgtggataaaatggtctttttacaagccgttgttaaggagattttacggaaacatcctccgacatactttacgttgactcattccgtcacggagccgacgacggtcgccggttacgatgttcccgttgggattaacgttgagttttatcttccgggaataaatgaggatccaaagctttggtctgatccgaagaaatttaacccggatcggtttatttcgggtaaggaggaagcggacataaccggtgtaaccggagttaaaatgatgccgttcggtattggccgtcggatctgtccggggctagcgatggcgaccgtacacgtgcatttgatgctagcgaagatggttcaagagtttgagtggagcgcttatccgccggaaagtgaaattgatttcgccgggaaattggagtttacggtggtaatgaagaaaccgttgagagccatggttaagccaagggtctaaatttaaat

SEQ ID NO: 410 - DNA, 2108 bp, Arabidopsis thaliana
ttaattaaatgggttttagatcggtttatcaatctctcacggagttatttccacaggtaaaacaagctcttaatcattatctctgtttcactcatgattgttgtggttgcaaagccactggtttgtttgtttttgttgttcgttgtttcttcatgaaatcaagttgagtagttatttggtattactatatttgatccaacagcgaaaccaagaaagctatctgtatttaatatttcaattaatgttattttatagtatgagcaaatgattgatggcaacaaatctcacgtgctaccaaatgttgttgttgagttctgctgtttcattttggtgcttaaataatgtcacattgtttttattatacattacagattgatccaaagattctaagaggtgttgcaattgagcaccaacatgatgctgatgaagctgcctctgttgttatctctgagattttccctttctcttccccaaattccactcaacctcacaacaagaacaagaccaaggtttccgacaatccccctaacttgaaaggtatacttgttctatagtatctgtatgacattttgaacatttcaggcttgtggttacttgctccacctagattagcaccattctctttcaacactgatcaaagtcggttgttggaaatgcagtaaaatgtgacgatgggagtttgtctctgtctcaatggcttcaaccatctaagcttccacatagttaccttgctttgctcaacgaagattctacacctgatgttaaacctcctctcgattacgtcgtggagaaagttgttctgccaagtcgtggccctgcaactggtctaggaggagggatccgaaccatgtactcttctgacaacattggtggttcttccttggtgaaaccctctattcgtgtacaaagccgcaccaacaatgaactctctgtaagtatctcataacatctctactttttgtcttttctttcgattttacatcctttggcggatctgaaagtagtataatctacttgcatatattatatcagggaagcagcagtaaggttcctggacgtagacgatcctctcgcaagtctgtgcagccttggtccccagactactctgaggtcaagtttcatcacattatttaagtaatgtctgatctggaaagtctctcttttcaggagctaacacttctgtttattgtatcagaagcttagaagttggaaaaaacggagcaacaacaacaaccgtgacttctcacagctctttgacaatgacatagatgtaccctcgacacgatccaacaaatgttataccaatgagcgtgtaagtatcacgtatgatgattccatctgttgtttgatgttatatgaaccattggttctacgttttataggagcgcaagcagagaattgccgataacatcaaggcattagggaaattgctcccacataaagttgaggtaacattgttagaattatatatttcatatttttgcaaccagagcttgtccacatatagcttatgagagattgaatcttaattgttgattttatgtgatcttgtagggggataaccatgaattgacactgaatgccatggttgatcatgttaagcttctgcatctacagatgaaggtattgtcttgcttctcctatcttttttcttctttctcaacttgtttattgaggacaaataggtttgatagagaaagccaaatccaaaccaaaagctcccaatccaaaacctgacattctaagttattacgtatataggaattaagtcgaagcaggttgggaggagaaccaatatctcatcctatggcattcattgaggtaatacatttatgtatctgaagcaaagatacacgatatagtatatgtttgtttcttagagtgaatgtgttgtttgtgatagggatacggtcactacatacatcacgagcagacgatggcaaaatctctggaggaagtaatggaagatctgcttacaaaggactttgatgctgcggctaacttgttggagagcaaaggcctttacttaacgcctttgtcctctgtccaaggctcctgctgactcctctcacaatctcaaacacatggaatcaaaaacaaggcgcgcc

SEQ ID NO: 411 - DNA, 1859 bp, Arabidopsis thaliana
ttaattaaatgacgactacttcagaaatttctcttcaagaagaatacgtcaccgacgccgttgaccaccgtggacttgccgccagaagatccaataccggtagatggagagccgccttgttcataatcggtaagctccaatcacaaactgctctgtttctcaatttcttcctctttgaatctctctgagaatatatttgcaggtgtggaggtggctgagaggttcgcttactatggaatcggatcaaacttaataagctacttgactggaccacttggtgaatccacggctgtagccgccgctaatgtcaacgcgtggtcaggaattgccactcttcttcctgttcttggagcttttgtcgccgacgcatttctcggtcgttaccgaacaattatcatctcttctcttatctacgtcctggttcgttctcttctctttagtctttttttcttttggtttacttgttcttcatgattgagaagtaacttaaagaagaatttgaatttgatgtgttagggattggcgtttctgactttatctgcgtttctgattcccaatactactgaagtgacatcttcaacttcttcttttctcaatgtactcttcttcttctctctgtatttggtggctattggacaaagtggacacaagccttgtgttcaagcttttggtgctgaccagtttgatgaaaaagactctcaagagaaatctgacagaagctccttcttcaactggtggtaccttagtctgtctgcaggaatctgctttgcgattttagttgttgtatacatccaggaagagttcagctgggcttttgggtttggaatcccatgtgtgttcatggtgatctctcttgttcttttcgtgtcagggagaaggatttataggtacagtaaaagaagacatgaagaggaaataaacccttttacgaggataggtagagtcttctttgtagcactcaagaaccaaagattgagttcatcagacttgtgcaaagttgagctagaggcaaatacatccccagagaaacagagttttttcaacaaagcattgcttgtacccaatgattcttctcaaggagaaaacgcatccaagtctagtgatgttgaagatgccacagctcttatcaggctaattccagtatggtttacgactctggcttacgcgataccctacgcgcaatacatgacatttttcactaagcaaggcgtcacaatggatagaacaattcttcctggtgttaagatcccacctgcttctcttcaggtctttatcggcatatcaatagtcctctttgtccccatctacgaccgagttttcgtccccatcgccaggttaataaccaaagaaccttgtggcatcacaaccctcaaaagaattggaactggaattgtactgtcgactatcactatggtaattgcagctctggttgagttcaagcggctcgagactgcgaaagaacacgggcttatagaccaaccggaagcaactcttccaatgtcgatatggtggttaatccctcagtacttgttgctgggattggctgacgtatatactttagtgggaatgcaagagttcttctacagccaagtccctactgagctgagaagcatcggtctcgcgctttacttaagcgcgttgggcgtgggaagcttattaagcagcttactcatctctctgatagacttggccactggaggagacgcaggaaacagctggtttaacagtaatctgaacagagctcatcttgattacttctattggttactagcgattgttagcgccgttgggttctttacgttcttgttcatttccaagtcgtacatctatcgtcgagtggatcgagtgtagggcgcgcc

SEQ ID NO: 412 - DNA, 2581 bp, Arabidopsis thaliana
ttgtcttctcttccttcttcttataaattcctctactcctccttcaccatttcctcctcctcaccttctctctctcaacatctctctctttctctgtcttctctctgtctcaacgagaatatgactaaccagaatgtcatcgtttccgacaggaaacccatcttgggtttgaaaaccatcactgtctctgtctctaactctcctctgttctctaattcctttcccacttactttaacttccctcgtcgaaagctcttgaaacttcttgaagcagccgacaaaaacaacttagttgttgctccaaagattacgtctatgatcgattccatgcgtgattcttcccctacacgtctcagatcctcttcctatgactctgtttcagataacgacgacaaaacatcttggatcgtacgttaaatattcgtaccttaaatctaaattaattaacccttttcaagattttggaatctgatcatatatgtcttgttttgtttaggttcgttttccttcggctttaaatatgtttgatgagattgtgaatgctgcgaaagggaaacagattgtcatgtttcttgattacgacggaactctttctcccatagttgaagatcccgacaaagctttcataacccatgaggtttttattctcttcctacaaaatatctttttgtggttaatttatttattaattatttttgttattagatttaataatgtatttttttcttacagatgagagaagtcgtaaaagacgtggcttcgaatttcccgactgctattgtcaccgggagatccattgagaaggtacattacatttttaccaaatattgactattttctatataacagatcatttaatttacatattaatggtaaagacgatatataacgtacgagtatgtttttgttataggttcgtagttttgtccaagtaaacgagatttactacgccggaagccacggcatggacattgaaggtccgaccaacgaaaatagtaacggccaggtgaggacacaatgcagaaaatcgacacaccacaaattttcttattttatttctaaaagttttttttttttttgttgttgtaatgaccacagagtaatgaaagagtgctattccaacctgctcgtgaatttttaccgatgatcgagaaggtacattttgagatcttttaacataacaaaacgaattacgtacacgaggtaaaacagtaaaaaaagtatatttaactttgtcggatataaataatttcaggtggttaatattttagaggaaaaaacaaaatggatccctggggctatggtggagaacaacaagttttgtctgtccgtacattttcgacgtgttgatgagaaggtaagaacaaaactgatgatgacaaagaaactttctcttacttgtaaaaattaagtggtccaaattattatttttgtttcttaacccaaagtacttaagaaccttacaagactttttccttgaaacgaagtattttttggtaatgtgacacctaagtttcaaataaagattattcgatatttcatttttccgcactaatcacaaagcaaaacatgcactagtgttatttttcgtattgatcatgatgttaatgtgaccgtttaccatattactcatatttatcagcaatgactcgtttcatttagtaaacaaattatttatttacatgtttctttgtaacagagatggcctgcattagctgaagtagtaaaatcagttcttattgattatccaaagctgaaactaacccaaggtagaaaggtaaaattaatcttaatctccctctttttactagtcactaggctaattaagtatttattacatctttatttaatctatttcatttataaaatcaggtacttgaaatccgccccacaatcaaatgggacaagggccaggcactcaattttttactaaaatcattaggtgagagagcccctcataaatcttatttatttttcatttcgatatgagaatttaaagatctcaagttctcatatcatttatcgactaattaaaataggatatgaaaattcggatgatgttgtgccggtgtatatcggggatgaccgtactgacgaagatgcgtttaaggtatagtgacacttaacttatacgtattcgtaacatcagttaattaagtctttttacattttgaacaatttgattctattactgacgtaataaatgaactgtgtaattcgataggttttacgtgaaaggggacaaggttttgggattcttgtctcaaaagtaccaaaggacaccaatgcctcttattctcttcaagacccttctcaggtaaattaaatcttactcttctataaataatttgaagtttattgttaattaatttattaaattggaaaccattttattgtacaggttaacaagtttctggaacgtttagtagaatggaagaggaagacagtgggagaagagtgaaagacatgcaacataattacacaaataacacctgagttttgagtagattattaatttatataaacaccctttttaaattagtagatgcctggagggtgtttcggccagaagtttttcttt

SEQ ID NO: 413 - DNA, 948 bp, Arabidopsis thaliana
ttaattaagttttccggcaccgatctcggtggatctccgattcacatggcggcggataatgcttatctgatgcagtttgttgacgaaacctctttttacaaccgaatcgttctgagtcatcttttgccggcgaatctatgggaacccttacctcattttctccagacatggctccgaaattacctcgccggaaccctactatacttcatctccggtttcctctggtgcttctacatctattaccttaaaatcaacgtttaccttcccaaagatgcaattcctacaataaaggctatgcgtttgcaaatgtttgtggcaatgaaggctatgccatggtacactcttcttccaactgtctccgagagtatgattgaacgtggttggaccaaatgttttgctagcataggcgaattcggctggattctgtattttgtttacatcgccatctatcttgttttcgttgagtttggtatttattggatgcacagagagcttcatgacattaagcctctctataagtatctccatgccacccatcatatctacaacaagcagaatacactctctccatttgccgggcttgcatttcacccagtagacgggatacttcaggctgtaccgcatgtgatagcgctgtttatagtgccaattcatttcacaactcatataggtcttttgttcatggaagcgatatggacggcgaacatccatgactgcatccatggcaacatctggccagtaatgggtgcaggataccatacgatacaccacacgacatacaagcataactatggtcattataccatatggatggattggatgtttggctctcttagggatcctctcttagaagaagatgacaacaaagacagcttcaagaaagcagagtgagaatgcccacttgggttttgttcttctgttttgtcttgtgttgttgttgggcgcgcc

SEQ ID NO: 414 - DNA, 1924 bp, Arabidopsis thaliana
ttaattaacagatctctacatcaccggagagacgagaaacactcaccgtgagaaaaccatgattccttacgctacagtcgaagaagcttcaatcgcactgggacgaaacctcacacgtctcgaaactctatggttcgattactccgccacgaagtccgattactatctctactgtcacaacattttgttcttgttcctcgtcttctctctcgttcctctccctctcgttttcgtcgaattggctcgatctgcttctggtttgtttaatcggtataagatccagcctaaggttaattactctttatctgatatgttcaaatgttacaaagacgtcatgacgatgtttatcctcgtcgttggtccattgcaactcgtttcttatccttcgattcaggtaatttgagaacacacttggtttttaatttgaatttgaatgaatttcacttaaaaattgtgtgtttttgaattgaatcgcttcgaatttgataatgaatttgacactattgtaaccgaattaccaagtgtcaatagctcaactggcatagaggtcgctggttcgagtggcacttgttacagttacagaactaattttgattatgtgttgttgaacagatgattgagatacgatctggattaccattaccaacaattacagagatgctgtcacagttagtagtctacttcttgatagaagactacactaactactgggtacatagattctttcatagtaaatggggatacgataagattcatcgagttcatcacgagtacacagctcctataggatatgctgctccttatgcacattgggctgaagttttgcttctcggaatcccgacgtttatgggaccagctattgctcctggtcatatgataaccttttggttgtggattgctttaaggcaaatggaagctattgagactcacagtgggtaagtaggcgtggtttaaagaatcatataacaaatcctttgctttttaactttacagagtctttttttctttctttattatatagtatgtgtgactgcatcatactaaatttgaattgtttgttagtatatgtatttattgtatataaagagcttaaggtgtgtagattcattagtggctcacctttttacaacttgagctaagttaggtattaggttttttgtctgaatgctttttaggcttttttaagctattgtggtttgttttggaactggttagatatataccttttgatgaacaattagataggcttattttttttaatttgattaacttttggggttacccaaaacatactaaagtaaagaggactaggtcccttagtttattgtttgtttttttactttacactcctgtgagaatgagaaatgtttcttgcttgcttgagtttggtgttagtaaagcataatattcaatttgttccattgcagatatgattttccatggagtccaacaaaatacatccctttctacggtggtgctgagtaccatgactatcatcactacgttggaggacaaagtcaaagcaacttcgcttcagtgttcacgtactgtgattacatttatggaactgacaaggttagtattcatcaaaagtttaatcaaaaactcaccaaattaggtttccatttttccggtttctatatactaattctggctgaaaacatttgatcatgtggctatatcagggttacagattccaaaagaagcttcttgagcaggtaaatctatggatgccacttttacttttccgaagacctgtaaaatgtttctatttaaccgtgattttcatgtatgcttcattcatttcagatcaaggagtcgtcgaagaagagcaacaagcataacggaggaataaaatccgattagtaaaaaccggagaagaagattttaacctttcaaagaatagctaagcatgcggcgcgcc

SEQ ID NO: 415 - DNA, 2268 bp, Arabidopsis thaliana
ttaattaaatgaattcgttaaccgttgaacaagtattgaaagagaagaagaccaatgacccagattccgtcaaggaacttaatctcggccataaagctctcaccgacgtgagtattgtttctgttctgaaactctgttcccaagtagaaattgatacgaaaccctaattgtttaattgtatatttaggtgtcttgtttgagcaagttcaaaaacttggaaaagcttgatcttcgtttcaacaatctaacagatcttcaggttgattgatacataaatctcattttataagcataaatagcatccaaagttttgatttttaagttgctagagcttattatatgttgatgtgttaattggtttttagggactcaagtcttgtgtgaacttgaaatggctttcagttgtggaaaacaaattgcaaagcttaaatggaattgaagcactcactaagcttacggttagttccactgatatcactgagcttgtttctttgagatttgtatcacttaccaatagtgaggttctccaggattaagctttgttttgacagaaaacgagttaatatgtgtgctttatttgactgtgtgatgttgttttctatcaggtgcttaatgctggaaagaataagctcaaatccatgaatgagatctcttctcttgtcaatttacgggccttgatcttgaatggtaagttgtcaacggttttatgtctttgcatccacaagctactgtttgattacttactcgttattgtttcacttgttgtagacaatgaaatctcctccatttgcaagcttgatttactcaaagacttgaacagtctcggtatgttcttttacatcaaaatcaacatgttactgtttagatgttacacctaatttcattctacttaaatgtgtatggattcattcatgcagttctttctaggaacccaatcagtgaaataggtgactcactttcaaagttgaaaaacctctccaaagtaagctcttgttttcctcccgtttcggaatcacaactaaactgatccttgtctaatcccatctcggtttcagatttctttgtctgactgcagaataaaagctattggctcttctctcaagtcatgctctgatttgaaagagctgcggctcgcgaacaatgaaatcaaggtgatctttcttacatttatgcaatctacagaacaaacctgcctcttctcacaatcttttgtttatattgctaatcgttatttcatttacgcttaactgttcaggctctcccagcagaactagcagtcaacaaaagactactcaatttggatgtgggaaacaatgtgattacgcaactctctggtttagaggtatagtctaattcatataggtgaaagcaaatttgttagccttccctagcttgtggcaagtttttgtggtgatcgtgtaataaaccatcaaatttgtgtgctcccaaatgataggttttgggtacactatcttgcttgcgaaatctgaatattcgaggaaacccgatttctgataacgataagtcagctaagaaggtaaaacaactttttctacttcttttttccattgtgattagtgtaactgcgtgaagaaatcgtataagaatgaggaaaattgttttgatgtcgcaggtgagaacgttgcttctcccttcagtgaatgtattcaacgctcaacccttagaaaaaagctcaaggaatgcaaagcatattcggcttgataccgatgatgaaacctttgatgcctatcacaataaatcagcagaagaggaacaatctaaagaagatcgaaaacgcaagaagagctctaagagaaataagtcagaagaagaagaagtcaacaatgaggatcacaaaagcaagaagaagaagtctaagagcaacacaaatgtagatcaagttgaaacaaaaaagaaagaagaacataaagagaagacaatcccaagtaacaatgatgatgatgatgatgctgagaagaaacagaaaagggctactccaaaggaggaactcgatgctatagatgatgctgaaacctctttcgcagaaatcttttcccgggaaaatgtgccaaagggttctgaagacggtattgagaagaagaagaaaagcagcgtccaagagacaggtttagtaaaagtgatagatactaaagctaacaagaagaagaagaagagtgaaaagaagcaaagcaagagtgtagtgattgatcttcccatggaggttgagatcgggttaggaggagagtctaagtgggagtaaggcgcgcc

SEQ ID NO: 416 - DNA, 1073 bp, Arabidopsis thaliana
ttaattaatttttctagggtttcgaaaagatgccggcgacagcaggaagagtgcgtatgcccgcaaacaatcgggtgcatagtagtgcagcgcttcagactcatggaatatggcagagtgcgattggttatgatccttatgcaccaactagtaaagaagagcctaagacgacacaacagaaaaccgaagatcccgagaactcgtacgcgagttttcagggacttttggctcttgctaggattacgggttcgaataacgatgaggctcgtggttcttgtaagaagtgtggccgtgttgggcatttgacgtttcagtgtaggaatttcttgagtactaaggaggataaggagaaagatcctggtgcgattgaagctgcggttttgtcggggttggagaagattaggagaggtgttggtaaaggtgaggttgaggaggtgagtagtgaagaggaagaggagagtgagagttctgattctgatgttgattctgagatggagaggattattgctgagaggtttgggaagaagaaaggtgggagtagtgttaagaagacgagttcggttaggaagaagaagaagcgtgtttctgatgagtctgattctgattcggattctggagataggaagagaaggcggaggtcgatgaagaagcggagttcgcataagagaaggagtttgagtgagtctgaggatgaggaagagggaaggagtaagagaagaaaggagaggagaggaagaaagagagatgaagatgattctgatgagtctgaggatgaagatgacagacgtgtgaagagaaagagtagaaaggagaagaggagaaggagaagccgtcgtaatcattctgatgattctgattcagagtcttctgaagatgatagaagacagaagcggaggaacaaagtcgcagcttcttctgactcagaagcaaatgtttcaggcgatgatgtttcacgcgttggacgtggttcttctaagcggtctgagaagaagagcaggaaacgtcatcacaggaaagagcgagagtaggaaatcgatctatatgagccattttcactctccatttggcgcgcc

SEQ ID NO: 417 - DNA, 1722 bp, Arabidopsis thaliana
acaccacggggtttaatttgtgaaatccgaaactagggagactaaatccgaatagatatagatagcctaagggattcggggctgcaacaaaatcactcccactcactgcgaagctcgactatggcggcgacgtcgctggttctgacgtgcgcatcccctctattcagcagccctcgggttatttctgctacgaagaagctgactacagagttgtcgatttctacaggtcagtttcgcggggtttaatttgtgaaatccaaaattagtttgtttcatctaaaatgatcctctgccgatgtctcagctaaattccgaagaagatgctcgggaaacaatgatgaagtgcttctagaaggaatgccaccggagtattacgatgatgttcgtctcctcatcctttttttgtctctcagtctgattttttctaagtcggttggttttttgataccaggaatggcaagctcgacagagagagaagaccaaagaactgcggcggatgcagcgggaggaagaagaagaagaggagagaaagattgaagaataccgtgaaattggcacgaggttgaaggaatttcccgagcaagacttaaggaaagccagaaagctcgtctccagcttcatcagagctgccgaggaagtcgaagaggtaaaaatcaaagtccccttccttccttatacaagcaggcaattattattattatgtataagacaatttctgtagagaattgaagaagcagccgagaaaggagaacttgacgagcttgtcctcatgatcatatggaaccggcttgaccttgctaggcgcgatgtaacatttttttccttgtgagttatgcgttttcatgatgaaatgttcccttagatcctgtgttgcttactttcaggatgagaaggacgccatcagaagtcttgatcttttgtatagaagagtcgaggtaattgtttctcttcattcttttctatgctataagatcttgagctgctgatgctttatatcaccatcttcaaacttactcatttgtcaaggaagattatcaactcgtattagtcagctttaggtgaaagtgaatccttatatcgggtgtttctctatccagacagagatcttaaaacggcaagcaagtcctgcaatgaaactgctgaatgatcttctaaatatgcatgatggctttgaagacgatgcttggctcaaggactgcagaaaacgaatggctgagaccttcccccgagaagaccccttcagcattctaatgccaccgggattcgacattgatatggtgcgtccctttttctcttttttgtttttttttattgataaaaacctctcaacagcaagaatcaatgctgtgtttgtagcatcaaggacagttgcgaccgcccattgagactgagacagacaacacccttctgagagtagactttgtaagagaagtggatgcactgctacaggaagtgaggatagaggaagacgctacaactggtagcaaaggagaagggcttgatcctgaagctatagcacttaagtttaagcaacaggagaagcaacgaaccatccgccaaattgaagccattcttgatttagccctcaacttgaagtggtaggcagttaactagaatatcaatctatacgccataataatttttttaagatagaccctagagttagattgattcaggcgtttttgtttagaaatgaatggagtctaaataataggttttggc

SEQ ID NO: 418 - DNA, 1182 bp, Bacillus subtilis subsp. subtilis str. 168
gctttcaaactctttgtttcttgtttgttgattaacccttaattaatccgggcgcgcctgatttatcacaagtttgtacaaaaaagcaggctcctgcaggaccatggcagtaaaagtcggtattaacggttttggtcgtattggacgtaacgtattccgcgcagcattaaacaatcctgaagttgaggtagtagcggttaacgatttaacagatgctaacatgctggctcaccttttacaatatgattctgtacacggaaaattagacgctgaagtttcagttgacggtaacaaccttgttgttaacggcaaaacaattgaagtttctgcagaacgcgatcctgctaaacttagctggggcaaacaaggcgttgaaatcgtagttgaatctactggtttcttcacaaaacgcgcagacgctgcgaaacacttagaagctggcgcgaaaaaagtaatcatctctgctcctgctaacgaagaagatatcacaatcgttatgggtgttaacgaagataaatacgatgcggctaaccacgatgttatctctaacgcatcttgcacaacaaactgccttgcgccgtttgcaaaagtacttaacgataaattcggcatcaaacgcggtatgatgacaactgttcactcttacacaaacgatcagcaaatccttgatcttccgcacaaagactaccgtcgtgcgcgtgcagcagctgaaaacatcatcccaacatcaactggtgctgctaaagcagtttctctagttcttcctgaactaaaaggcaaactgaacggtggagcaatgcgtgttccaactccaaacgtttctctagttgacttggttgctgaactgaaccaagaagtaacagctgaagaagtaaacgcagctcttaaagaagcggctgaaggcgaccttaaaggaatccttggctacagcgaagagccattagtttctggcgactacaacggaaacaaaaactcttctacaatcgatgctctttctacaatggttatggaaggcagcatggtaaaagtaatctcttggtacgataacgaaagcggctactctaaccgcgttgttgaccttgcagcttacatcgcaaaaaaaggtctttaactcgagacccagctttcttgtacaaagtggtgataaattggagctctgcagagctttcgttcgtatcatcg

SEQ ID NO: 419 - DNA, 1185 bp, Desulfitobacterium hafniense
gctttcaaactctttgtttcttgtttgttgattaacccttaattaatccgggcgcgcctgatttatcacaagtttgtacaaaaaagcaggctcctgcaggaccatgggtgtgcgaattgcaattaacggctttgggcgaatcggtcggctttccatgcgggcaatcctggaacgaaaaagttccctggacattgttgctgttaatgatctggggagtccggatctgttaggtcatttattcaagtatgattcaattcatgatatcctgccttatgatgttgaggtcaaggaaaacacccttgaagttttggaccaaaaggtggcttttttggcggaaaaagatcctgggaaacttccctggcgggagctgggggtagatctggtgattgaagctacggggcgctttaccaagcgggagcaggcggcgttgcatctccaggccggagcgaaaaaggtgatcatttccgctccgggaaaacacgaagatatcacgattgtgatgggggtaaacgaacatctctataaccccgctgagcaccatatcctctccaatgcctcctgtaccaccaatggtttggcccccctagccaaggttttactcgaagaatttgggatcgagcagggcatgatgaccaccacccattcggtgaccaatgaccagcggattctggatttggagcataaggattggcggcgggcccgggcggcctacgaatcgatgattcctacgaccacaggagcaaccaaggcggtggaactggtgcttcccgacttaaagggcaagctcaaaggattagcggtgagggttcctacccctaatgtctcgcttattgattttgtggctaatttaagccgttccaccaccaaagaagaagtaaatcaaaaacttagggaagccgccgagggaagcctcaaaggctacctggcttattccgagctgcctttagtttcccacgactttaatggcaaccctcacagtgccattgttgacgggttgtctacgctgatgctgggagagcgcatggtcaaggtcctggcctggtatgacaacgagtggggatactccaatcggattgtggacttggtggaatacatcgccggccaaggactataactcgagacccagctttcttgtacaaagtggtgataaattggagctctgcagagctttcgttcgtatcatcg

SEQ ID NO: 420 - DNA, 1442 bp, Pseudomonas fluorescens PfO-1
aactctttgtttcttgtttgttgattaacccttaattaatccgggcgcgcctgatttatcacaagtttgtacaaaaaagcaggctcctgcaggaccatggctgaacaaggttcgccgcgccgctttgcgcgcattgatcgactccccccttacgttttcaacatcaccgccgaactgaagatggccgcgcgacgtcgtggcgaagacatcatcgacttgagcatgggcaaccccgacggcgccacaccgccgcacatcgttgaaaaactggtgcaggttgcacaacgcgaagacacccacggctactccacgtccaagggcattccgcgcctgcgccgggcgatttccaactggtacaaggaacgctacgaggtcgagatcgacccggaaagcgaagccatcgtcaccatcggttccaaggaaggcttggcgcacctgatgctggcgaccctggatcagggcgacaccgtgctggtgccgaacccgagctacccgattcacatctacggtgccgtgattgccggcgcccaggtgcggtcagtgccactggtgccgggcgtggatttcttcgccgagctggagcgggcgattcgcggctcgatcccgaaaccgaagatgatgatcctcggcttcccgtcgaacccgaccgcgcagtgcgtggagctcgacttcttcgaacgggtgatcgccctcgccaaacagtacgacgtgctggtggtgcacgacctggcttacgccgacatcgtctacgacggctggaaagccccgtcgatcatgcaggtgccgggcgccaaggacatggcggtggagttcttcaccctgtccaagagctacaacatggcgggctggcgcatcggcttcatggtcggcaacccggaactggtcagcgccctggcgcggatcaagagctaccacgactacggcaccttcaccccgctgcaggtggccgcgattgctgcgctggaaggtgatcagcaatgcgtgcgcgacatcgccgaacagtatcgccagcgccgcaacgtgctggtcaaaggcctgcatgaactgggctggatggtcgagaacccgaaagcctcgatgtacgtgtgggcgaagattcccgaagcctacgcgcacctcggctcgctggagttcgccaagaagctgctggccgaggccaaggtctgcgtctcgccaggtgtcggctttggcgagtacggcgacgatcacgtgcgcttcgcgctgatcgaaaaccaggaccggattcgccaggcggtacgcgggattcgcggaatgttccgggcggatgctctgggcaccaagtaactcgcgaattgcacccacaaaaaaaccgcatcactgcggtttttttgtgtctgcatcttcttgactcgagacccagctttcttgtacaaagtggtgataaattggagctctgcagagctttcgttcgtatcatcggt

SEQ ID NO: 421 - DNA, 1532 bp, Synechocystis sp. PCC 6803
aactctttgtttcttgtttgttgattaacccttaattaatccgggcgcgcctgatttatcacaagtttgtacaaaaaagcaggctcctgcaggaccatgtgttgttggcaatcgagaggtctgcttgtgaaacgtgtcttagcgattatcctgggcggtggggccgggacccgcctctatcctttaaccaaactcagagccaaacccgcagttcccttggccggaaagtatcgcctcatcgatattcccgtcagtaattgcatcaactcagaaatcgttaaaatttacgtccttacccagtttaattccgcctcccttaaccgtcacatcagccgggcctataatttttccggcttccaagaaggatttgtggaagtcctcgccgcccaacaaaccaaagataatcctgattggtttcagggcactgctgatgcggtacggcaatacctctggttgtttagggaatgggacgtagatgaatatcttattctgtccggcgaccatctctaccgcatggattacgcccaatttgttaaaagacaccgggaaaccaatgccgacataaccctttccgttgtgcccgtggatgacagaaaggcacccgagctgggcttaatgaaaatcgacgcccagggcagaattactgacttttctgaaaagccccagggggaagccctccgggccatgcaggtggacaccagcgttttgggcctaagtgcggagaaggctaagcttaatccttacattgcctccatgggcatttacgttttcaagaaggaagtattgcacaacctcctggaaaaatatgaaggggcaacggactttggcaaagaaatcattcctgattcagccagtgatcacaatctgcaagcctatctctttgatgactattgggaagacattggtaccattgaagccttctatgaggctaatttagccctgaccaaacaacctagtcccgactttagtttttataacgaaaaagcccccatctataccaggggtcgttatcttccccccaccaaaatgttgaattccaccgtgacggaatccatgatcggggaaggttgcatgattaagcaatgtcgcatccaccactcagttttaggcattcgcagtcgcattgaatctgattgcaccattgaggatactttggtgatgggcaatgatttctacgaatcttcatcagaacgagacaccctcaaagcccggggggaaattgccgctggcataggttccggcaccactatccgccgagccatcatcgacaaaaatgcccgcatcggcaaaaacgtcatgattgtcaacaaggaaaatgtccaggaggctaaccgggaagagttaggtttttacatccgcaatggcatcgtagtagtgattaaaaatgtcacgatcgccgacggcacggtaatctagggccagtttctttcctcgcaccatagccatgaccgctcccgttaagcctcgagacccagctttcttgtacaaagtggtgataaattggagctctgcagagctttcgttcgtatcat

SEQ ID NO: 422 - DNA, 1275 bp, Bacillus subtilis subsp. subtilis str. 168
aactctttgtttcttgtttgttgattaacccttaattaatccgggcgcgcctgatttatcacaagtttgtacaaaaaagcaggctcctgcaggaccatgactcacacagtacctcaaaacatgaaagcggctgttatgcacaacacaagagagatcaaaattgaaacattgcctgtgcctgatatcaatcatgatgaagtgttgattaaggtgatggctgtcggaatttgcggatctgatctgcattactatacaaatggccgaataggcaactatgttgtggaaaaaccatttatccttgggcatgaatgtgcgggtgaaattgccgctgtcggatcatctgtcgatcaattcaaggtgggagaccgcgtcgctgtagagccgggtgttacgtgcggacgctgtgaggcgtgcaaagaaggacgctataatctttgcccggatgtacagtttttggctacaccgccggtagacggtgcgtttgtccaatatattaaaatgcgtcaggactttgtttttttaatcccagactcactttcttatgaagaagctgctttgatcgagccgttttctgtcggtatccatgcggcggccagaacgaagctacagcccggatcaacgattgcgattatggggatgggccctgttgggttaatggctgttgccgcagctaaagcatttggggcaggcacaatcattgtcaccgacttagagccgctgcggttagaagctgcgaaaaaaatgggagcgactcacattattaatatacgtgaacaggatgcacttgaagagattaaaacgatcacgaatgatagaggcgttgatgttgcttgggaaacagcagggaatccagcggcattgcaatccgcactggcttctgtgcgccggggcggaaaattggcgattgtcggtttgccttcacagaacgagattccgctcaacgtgccgtttattgcggataatgagattgatatttacgggatcttccgttatgccaatacgtatccaaagggaatcgaatttcttgcttcaggcattgtggacacgaagcatctagtaacggaccaatattcgctggagcagacgcaagatgcgatggagcgggcgcttcaatttaagaatgaatgtttaaaagtgatggtgtatccaaatcgctgagtgaacagggaggatcttcgtattctccctcttgtttactggaaatgctcgagacccagctttcttgtacaaagtggtgataaattggagctctgcagagctttcgttcgtatcatc

SEQ ID NO: 423 - DNA, 1279 bp, Escherichia coli K12
aactctttgtttcttgtttgttgattaacccttaattaatccgggcgcgcctgatttatcacaagtttgtacaaaaaagcaggctcctgcaggaccatgaaatcacgtgctgccgttgcatttgctcccggtaaaccgctggaaatcgttgaaattgacgttgcaccaccgaaaaaaggtgaagtgctaattaaagtcacccataccggcgtttgccataccgacgcatttaccctctccggcgatgacccggaaggtgtattcccggtggttctcggtcacgaaggggccggcgttgtggttgaagtcggtgaaggcgtaaccagcgtcaaacctggcgaccatgtgatcccgctttacaccgcggagtgcggcgagtgtgagttctgtcgttctggcaaaactaacctctgtgttgcggttcgcgaaacccagggtaaaggcctgatgccagacggcaccacccgtttttcttacaacgggcagccgctttatcactacatggggtgctctacattcagtgaatacaccgtagtcgcggaagtgtctctggcaaaaattaatccagaagcaaaccatgaacacgtctgcctgctgggctgtggcgtgaccaccggtattggcgcggtacacaacacagctaaagtccagccaggtgattctgttgccgtgtttggtcttggcgcgattggtctggcagtggttcagggcgcgcgtcaggcgaaagcgggtcggattatcgctatcgataccaacccgaagaaattcgatctggcgcgtcgcttcggtgctaccgactgcattaacccgaatgactacgacaaaccgataaaagatgtcctgttggatatcaacaaatggggtatcgaccatacctttgaatgcatcggtaacgtcaacgtgatgcgtgcggcgctggaaagtgcgcaccgcggctggggtcagtcggtgatcatcggggtcgcggttgccggtcaggaaatctccacccgtccattccagttggtcactggtcgcgtatggaaaggttccgcgtttggcggcgtgaaaggtcgttcccagttaccgggcatggttgaagatgcgatgaaaggtgatatcgatctggaaccgtttgtcacgcataccatgagcctggatgaaattaatgacgccttcgacctgatgcatgaaggcaaatccattcgaaccgtaattcgttactgatcgagacccagctttcttgtacaaagtggtgataaattggagctctgcagagctttcgttcgtatcatcggtt

SEQ ID NO: 424 - DNA, 1195 bp, Nostoc punctiforme PCC 73102
aactctttgtttcttgtttgttgattaacccttaattaatccgggcgcgcctgatttatcacaagtttgtacaaaaaagcaggctcctgcaggaccatgactttattactagcaggagacatcggcggtacgaaaactattttgcaattggttgaaacatcagattcacaaggtttacatactatttatcaggaaagttaccacagtgctgattttcccgatttagtacctatagtgcagcagtttttaatcaaagctaatacaccaataccagaaaaggcttgttttgcgatcgcagggcccattgtcaaaaatactgccaaactgaccaatttagcctggttcctagataccgaacgtctacaacaagaattgggtatcccacatatttatttgattaacgacttcgccgccgttggctatggcatttcaggtttacaaaaacaagacttgcacccgttgcaagttgggaaacctcaacccgaaaccccgattggaattattggtgctggtactggcttagggcaaggatttttaattaagcagggaaacaactatcaagtttttccttcagaaggtggacacgctgacttcgcgcctcggaacgagatagagtttcaattgttgaaatacctgctggataaacatgatatccagcgcatttctgtagaacgggtagtttctggaatgggaattgtggcgatttaccaatttttgcgcgatcgcaaatttgccgccgaatcaccagatatcgcccaaatcgtcagaacttgggaacaagaagccggacaggaagagaaaagtgtcgatcccggtgctgctattggtacagctgcactagaaaaacgcgatcgcctttccgaacaaaccttgcaattatttatagaagcttatggtgcagaagccggcaatctcgcccttaaactcctaccttatggtggcttatacattgctggtggaattgcgcctaaaattctccccttaatccaaaatagcggtttcttattaaacttcacccaaaaaggcaggatgcgccccctcctggaagagatacctgtgtatattatcctcaacccacaagtggggctaataggtgctgctttatgtgctgctaggttataactcgagacccagctttcttgtacaaagtggtgataaattggagctctgcagagctttcgttcgtatcatcggt

SEQ ID NO: 425 - DNA, 1305 bp, Pseudomonas syringae pv. tomato str. DC3000
ttatttgtcagctttcaaactctttgtttcttgtttgttgattaacccttaattaatccgggcgcgcctgatttatcacaagtttgtacaaaaaagcaggctcctgcaggaccatgatcaagtcacgcgccgctgtcgcctttgaagccaaaaagccactggagatcgttgaagtcgatgtcgccatgcccaaagcgggagaagtgctgctcaaagtagtggcatccggcgtctgccataccgatgcgtacacgctttccggcgccgaccctgaggggatctttccgtcgattctcggccatgaaggcggcgcgattgtcgaagccatcggcgagggcgtgacctctgtggcggtcggtgatcacgtcattccgctgtacaccccggaatgccgtcagtgcaaattctgccggtcggggaaaaccaacctgtgtcaggcgatccgttcgacccaaggcaaaggcctgatgccggatggcaccacgcgcttctcttataagggcgagccgattttccactacatgggcacctcgaccttctccgaatacaccgtgctgccagaaatctcggtggccaaaatcgacaagaaagcccccctggaaaaagtctgcctgctgggttgcggcgtcaccaccggtattggcgcagtgctcaacaccgccaaggtcaagccgggcgataccgtagcggtcttcggtctgggcggtatcggcctctcggcggtgattggcgcggtcaaagccaaggcggcgcgaatcatcgccatcgacatcaacccggccaagttcgagattgccaaacagctcggcgcgaccgattgcgtcaatccgaaggatttcgaccgtccgatccaggaagtcatcgttgacatgaccgatggcggcgtcgacttttcgttcgagtgcatcggcaatgtgcagctcatgcgttcagcgctggaatcctgccacaagggctggggtgagtcggtgatcattggcgtggccggtgccggtcaggaaatctcgacccgtccattccagttggtgaccgggcgcgtctggcgcggttcggcgttcgggggcgtgcgtggccgtaccgaattgccaagctacgtcgacatggcgcagaccggcgaaattccgctggacacgttcatcacccacacaatgggcctggaagacatcaacaaggcattcgatctgatgcatgaaggcaaaagcatccgcaccgtcattcatttttgactcgagacccagctttcttgtacaaagtggtgataaattggagctctgcagagctttcgttcgtatcatcggttcgaca

SEQ ID NO: 426 - DNA, 1260 bp, Xenorhabdus nematophila
aactctttgtttcttgtttgttgattaacccttaattaatccgggcgcgcctgatttatcacaagtttgtacaaaaaagcaggctcctgcaggaccatgaaaaaaacgtttaaaattgcagcaattccgggtgatggaattggtcatgaagtgcttcctgaaggtattcgggttttgcaggcggtggctgaaaaatgggatcttcatttatcgtttgaatattttgaatgggctagctgcgattattatctcaggcacggcaaaatgatgccggatgactggtttaatcaattaatgcagtttgatgctatttattttggcgcagtaggctggcctgaaaccgtgcctgatcatatctcactttggggctcattacttaagtttcgccgtgattttcagcagtatgttaatttgcgtcctgtgcgtttgttaccgggagtgccttgtccattagcgaataagaaaccggaagatatcgatttctatgtcgtccgggaaaatactgaaggggaatattccgctattggggggcgtttcaatgaaggtacagagcatgaagtggtgattcaggagtcggtttttacccgccgtggtgttgatcgcatcctgaaatatgcgtttgaattagcccagagccgcccgcgcaaattattaacttccgcgacgaaatccaatgggttatccatcagtatgccttactgggatgagcgggttgaaaagatggcaaaacagtaccctgatattaaatgggataaacagcatattgatattctttgtgcccgctttgtgttgaatccagagcggtttgatgttgttgtcgcttccaatttatttggcgatattctttccgatctagggccggcatgtaccggaactattggaatttccccttctgctaatttaaatccggaaaggaatttcccttctttgttcgaacctgtgcatggctctgcaccagatatttatggcaaaaatattgctaacccgattgctatgatctgggcgggagccatgatgttacagtttttgggggagggtgagcagcgctatcaggatgctcatgatgatattttagcggcgattgaagcggtaattgtgcaaggcattgtaaccccggatatgaaaggaaaggcatcaacacagcaggtgggagaagccatcgttaatcatttgaatgcttaactcgagacccagctttcttgtacaaagtggtgataaattggagctctgcagagctttcgttcgtatcatcggtttcga

SEQ ID NO: 427 - DNA, 1210 bp, Xenorhabdus nematophila
aactctttgtttcttgtttgttgattaacccttaattaatccgggcgcgcctgatttatcacaagtttgtacaaaaaagcaggctcctgcaggaccatgaaagcacttgtttatcatggcacaggcaaaaagcagtgggaaacaaaatcccctcctcaacttattgagtcaaccgatgcaatcgtccgcattatcaaaaccaccatttgcggaacagatctacatatcctcaaaggggatgttccaactgtggatgcagggcgaacattgggtcatgaagggattgggatagtcgaatccgttggagaatctgtccgtaatatcaaagtgggtgataaagtaattatttcctgcatcaccgtttgtggtcgttgtcgttattgtaaacgccagctttattcccattgtgaagatggcggttggatacttggacataagatcgatggcacgcagagtgaaaaagtgcgtattccccatgcagataacagcctacatcgtctgccggaaggcattgatgaagaggcggcattaatgctcagtgacatcctgcctacgggtcttgagattggtgtcatcaatggcaaggttcaaccgggcaataccatcgccttgatcggcgcaggccctgtagggctttctgcgttactggcatcccagttctattcacccgcccatatcatcatgattgataccgatgataaccgccttcatgttgcacaacagtttggtgctgacacagtcatcaaccccacacatcaaaatgtggtggaagtcatccaaaagctgactgatgggattggtgtcgatgtcgcaattgagtgcgttggtatccctgcaacattcaagatctgccaagatatcattactgctggtggatatatcgctaacgttggtgttcatggaaaatcagttgaattgcacttagaagatctttggatcaagaacatcactatcacgacaggattagtgaacacaagcagcacaccgatgctgttgaaaagcctccaatccggcaaaatttcacccgaaaagctggtcactcatcgctattcgctaagtgaaattaaaaccgcctatgaagtttttggtaacgctgagaaggaaaaagcactgaaaattgttcttaccgcagagtaactcgagacccagctttcttgtacaaagtggtgataaattggagctctgcagagctttcgttcgtatcatcggt

SEQ ID NO: 428 - DNA, 1383 bp, Saccharomyces cerevisiae
gctttcaaactctttgtttcttgtttgttgattaacccttaattaatccgggcgcgcctgatttatcacaagtttgtacaaaaaagcaggctcctgcaggaccatgtttcaacagctgtcggcatccattaggcacaatgcacacataatttttttatgcataagttggtattttatttcatcgttggcatctcaggtaacgaagcaggtactaacggtttgcccattaccactttttttgggtgagtttcagttcatttatactgctgtgctagcatggtttacgtgttatattgcatatagtttcccaggattctatcgcatatttcctaatggtacttttccggaatattatatcgacgacagagaaactagccgtgcagctaggaaagaatcaaaactatcctccctcattataccgccctctaaaccaatcctgcaaacagttctacctttaggtcttttccaatttgtagggaaatattttgggcatacagctacctctttggtgcctgtttccacggttgcaagtataaaaacgctatcccccatgtttatccttttgctccaaaagattttgaaaatatccactttgaaaattactttaactcttatctttagtttatgcactttagttcttggagtttggattatagttcaagaagataatcgttcaccggcctcttccaatgagctgagagaattctctaaatacggcgtaatatgcgctatgatatcaatgttcatttttgtcttgcaaaatatatatggcaagaccgtgttcacgtacagatctcaaacagatgaatctcaaagtaattctggattctcacggcaagaatcacctttacccttatatgaaaagttggatgagaaacttgttgcgaaaaagaaacctaaatcatatgacaaattgactttaatgatttatatttcccttgttggattttgtttatcgtttggctggtttatcactctagaatttcctgtactatttaggtatttttttcaaattaacagctcttctacagtaataaaagcttttccagtctctttatttttactgaacgggacattccacttcattcaggcaatgattacatttcatttactgggtgaggtctcaactttaacatattcaatagcgaatctgatgaagcgctttgccattattgcggttagttgggtctttattggaagaagaattacttggctgcaagtgttcggtttggttctgaacacattagggttattcctttatgaaagatgcacatcacaatcgaaaataaaagcgaaaatacgtcctgagtagctcgagacccagctttcttgtacaaagtggtgataaattggagctctgcagagctttcgttcgtatcatcg

SEQ ID NO: 429 - DNA, 1751 bp, Bacillus subtilis subsp. subtilis str. 168
ttatttgtcagctttcaaactctttgtttcttgtttgttgattaacccttaattaatccgggcgcgcctgatttatcacaagtttgtacaaaaaagcaggctcctgcaggaccatggcagtcacatacgcgcacgaaccatttaccgattttacggaagcaaagaataaaactgcatttggggagtcattggcctttgtaaacactcagctcggcaagcattatccgcttgtcataaatggagaaaaaattgaaacggaccgcaaaatcatttctattaacccggcaaataaagaagagatcattgggtacgcgtctacagcggatcaagagcttgctgaaaaagcgatgcaagccgcattgcaggcatttgattcctggaaaaaacaaagaccggagcaccgcgcaaatattctctttaaggcagcggctattttgcgcagaagaaagcatgaattttcaagctatcttgtgaaggaagcaggaaaaccgtggaaggaagcagatgcggacacggctgaagcgatagactttttagagttctacgcgcgccaaatgttaaagctcaaggaaggggctccggtgaagagccgtgctggcgaggtcaatcaatatcattacgaagcgcttggcgtcggcatcgtcatttctccatttaacttcccgctcgcgattatggcgggaacagcggtggcagcgattgtgacaggaaatacgattctcttaaaaccggctgacgcagccccggtagtggcagcaaaatttgtcgaggtcatggaggaagcgggtctgccaaacggcgttctgaattacattccgggagatggtgcggagatcggtgatttcttagttgagcatccgaagacacggtttgtctcatttacaggttcccgtgcagtcggctgccggatttatgagcgagctgccaaagtgcagccgggccaaaaatggctcaaacgggtaattgcagaaatgggcggaaaagacacagtgcttgtcgacaaggacgctgatcttgaccttgctgcatcctctatcgtgtattcagcatttggatattcaggacagaagtgttctgcgggctcccgcgcggtcattcatcaggatgtgtatgatgaagtggtggaaaaagctgtggcgctgaccaaaacgctgactgtcggcaatccagaagatcctgatacgtatatgggtcccgtgattcatgaagcatcctacaacaaagtgatgaaatacattgaaatcggcaaatctgaaggcaagctattggccggcggagaaggcgatgattcaaaaggctactttattcagccgacgatctttgcagatgttgatgaaaacgcccgcttgatgcaggaagaaattttcggcccggttgttgcgatttgcaaagcgcgtgatttcgatcatatgctggagattgccaataacacggaatacggattaacaggtgcgcttctgacgaaaaaccgtgcgcacattgaacgggcgcgcgaggatttccatgtcggaaacctatattttaacagaggatgtaccggagcaattgtcggctatcagccgttcggcggttttaatatgtcaggaacagactcaaaagcaggcggtcccgattacttaattcttcatatgcaagccaaaacaacgtccgaagctttttgactcgagacccagctttcttgtacaaagtggtgataaattggagctctgcagagctttcgttcgtatcatcggtttcgacaacgttcgtca

SEQ ID NO: 430 - DNA, 1706 bp, Rhodobacter sphaeroides
actctttgtttcttgtttgttgattaacccttaattaatccgggcgcgcctgatttatcacaagtttgtacaaaaaagcaggctcctgcaggaccatggtgcaagagatcgactggcacgcccgcgccaaagccgtggcccttccgaaccgtcccttcatcgacggccagtatgtcgacagcctgtcgggcgagaccttcgcctgcatctatcccggcgacgggcggccgctgaccgatgtggcctcgtgcaatgcggcggatgtggatgtcgcggtgcggtcggcccgcaaggcgttcgaggcgggggtctggtcgcggatggccccggccgaccggcgccgcatcctgctgcgcttctccgagctgatcctcgccaaccgggaggagctggcgctcctcgagacgctgaacgtgggcaagcccatcgccaatgcctacaacggcgacgtggtgagcgctgccgcctgcatcgcctggtatgccgaggcgatcgacaaggtctatggcgaggtggcggccacggcttacgacatgacgacgctcgtcatgcgcgagcccttggggatcgtggcggccgtggtgccgtggaactatccgatgtcgatggccgcctggaagctcgggcctgcgcttgccaccggcaattcggtgatcctgaagcccgccgaacaatcgcccttcaccgcgctgaagttcggcgagctcgccatcgaggcggggatgcctccgggggtgctgaacgtggtgccgggcctcggccatatcgcgggcaaggcgctcgggctgcatatggatgtcgattgcgtgggcttcaccggctcgaccgaggtcggcaagtatttcatgcagtattccggccagtcgaacatcaagcggatcgggctcgaactcggcggcaagtcacctcaggtcgtgctggcggattgcgatgatctcgatgcggcggcggccgggattgcggccggcatcttcgccaacaccgggcaggtctgcaacgcgggctcgcgcctgatcgtggacgagaagatccacgaccagctcctcgagaagatcgcggctcaggccaaggtcttcgcgcccggcgatccgctcgacaccgccacccgcatgggctcgatggtgagcgaagagcagatggaccgcgtgctgggctacatcgacgccggccgcgcggacggtgcacgtccggtcatcggcggcggccgggtgaagaccgaaaccggcggcttctacatcgaacccacgatcttcgagggcgtgcgcaacgacatgaagatcgcgcaggaagagatcttcgggccggtgctgtcggccatcccggtgaagggcttcgacgaggcgatggcgacggccaatgacacggtctacgggctcgcgggcgcggtctggaccgggtcggtgaagaacgcgcaccgggcggccaagtcgctccgcgcgggcgtggtctgggtcaactgcttcgaccgcggctcgctcgccgtgccgttcggcggcttcaagcaatcgggcttcggccgggacaagtcgctgcatgcgatggataaatacaccgacctgaaggccgtctggttcgcccactgacctcagcgcccgcccatcgggcgggcacttcttcctgttgcccacgctcgagacccagctttcttgtacaaagtggtgataaattggagctctgcagagctttcgttcgtatcatcggtttcg

SEQ ID NO: 431 - DNA, 1622 bp, Pseudomonas syringae pv. tomato str. DC3000
gctttcaaactctttgtttcttgtttgttgattaacccttaattaatccgggcgcgcctgatttatcacaagtttgtacaaaaaagcaggctcctgcaggaccatgctcaagaatcagttgaaagaccccagcctgctggtggaccgcgcctacgtcgatgggcaatggatcagcgctgatgatggtgcaacgctggccatcagcgacccggcgaccggcgaagtgatcgcgcaggttccggccttgcaaggcgctgaaacccgccgcgccatcgaggccgctgatcgtgcctggcctgcctggcgcgcgcgtcctgccgccgagcgtgcggcgctactggagcgctggcatcaggcgatgctcgacaacgtcgaagacctcgcgctgatcatgacccttgagcagggcaagccgctgaacgagtcgcgtggcgagatccgctatggcgcaagcttcgtcaaatggttcgctgaagaagcgcgccgctcgtacggtgaaaccattcccacgcccagcgctgatcgtcgtttgatgacgctcaaacagccggtcggtgtctgcgccgcgatcaccccgtggaatttccccaacgccatgatcacccgcaaatgcgcgccagctctggctgcaggctgcacgatcatcgtcaaaccgtcggacctcacgccgctgtcggcgctggcgctggcagtgctggccgagcgcgcgggcattcctgttggtgtgttcagcgtcgtcaccggcatgccgaccgccatcggcgaagagctgaccggcaacccggtggtgcgcaagatttccttcaccggctccacgccgatcggccgtctgctgatgcgccagagcgccgaacacatcaagcgcctgagcctggaactggggggcaacgcgccgttcatcgtgtttgacgacgctgatctggagcaggctgtggccggcattatgctcagcaaattccgcaacgccgggcaaacgtgcgtgtgcgccaaccggattctggtgcagagcggcatttacgaccgtttcgctgcgcggctggtggaagaagtcgccaaactcaaggtcggcaacggtctggaagagggcgtgaccatcggcccgttgattaatccggcagcggtcagcaaaattgcccggcacatcgacgatgcgctgagccagggcgcgaagttgctgtacggcgggttgcccaacggtgacggccagttcgtccagccaacggtattgggtgatacccatgcgggcatgctgctggccaacgaagaaaccttcggcccggttgccccgctgatgcgtttcaccgacgaagccgaggccctcgcactggccaacgcaacgccctacggccttgccgcttactacttcacccaggacctgcgtcgctcatggcgtttcggcgaagcgctggaattcggcatggtcggcctcaacaccggcatcatctccatggaaatcgcccccttcggcggcatcaaacaatccggcctgggccgcgaaggctccagctacggcctggatgaatacctggaagtgaaggcgtttcatgtgggtgggttgtagctcgagacccagctttcttgtacaaagtggtgataaattggagctctgcagagctttcgtt

SEQ ID NO: 432 - DNA, 1204 bp, Bacillus halodurans
gctttcaaactctttgtttcttgtttgttgattaacccttaattaatccgggcgcgcctgatttatcacaagtttgtacaaaaaagcaggctcctgaggaccatgtataggaagggagttatcgagatgaaccgaggtgttatctgcttaggtgaagcgttgattgattttattccgatggattctactaatgaaatctaccaaaaaagtcccgggggtgctccggcaaatgtggctgtaggattagccaagcttggggcaaagtcaacgtttgtcggcaaggtgggggacgacttgctcgggcgatttttaaaagaaactttgacgaaagcgaatgtaaacactgagcacatgctgtttagcaaggaggtccgtactggggctacgtttgtaacccttgcagctaatggcgaacgaagctttgatttttatattaatccgagcgcggatcgttttttagaaaaaggtgagattgcccctactctatttgaagagcatggtgttctccattttggttcaattagtttaataagtgaaccggcacgaacggcgacaagacatgctgtgtcgttagcaaagaaaaatggactgatgatctcctatgatccgaatttacgcctaaacctttgggaggatgaggagcaagcacgattgctcatcacttcaatgctaggggaagcagatgtgctgaaaatcagtgaggaggaattggcgttcatcacgggcgaacagacaattgaggcgggtttggatcagcttgtagcttacaacattccgcttgtttttgtcacattaggggaaaaaggtagcatcgtttcgtataacggcatccagcgtaagattccggcgatggcagtacaaacagttgatacgaccggtgcaggtgatgcatttgtttcagctattcttttcaaactgcaagaggaacggaagcaagtagctgagttgtctatcaaagaagtagagcagatggcccgatttgctagcgtgtctggagggttagcggctgcaacgaaaggggcgatgacggcattgccgacccttgagaaagttaatgacatcctacgaaatgaacagatggagtgaagtgttgatgacgaatcgagatcaagaattacgacaaaaggcgaaagctcgagacccagctttcttgtacaaagtggtgataaattggagctctgcagagctttcgttcgtatcatcg

SEQ ID NO: 433 - DNA, 1165 bp, Escherichia coli K12
gctttcaaactctttgtttcttgtttgttgattaacccttaattaatccgggcgcgcctgatttatcacaagtttgtacaaaaaagcaggctcctgcaggaccatgattaagaaaatcggtgtgttgacaagcggcggtgatgcgccaggcatgaacgccgcaattcgcggggttgttcgttctgcgctgacagaaggtctggaagtaatgggtatttatgacggctatctgggtctgtatgaagaccgtatggtacagctagaccgttacagcgtgtctgacatgatcaaccgtggcggtacgttcctcggttctgcgcgtttcccggaattccgcgacgagaacatccgcgccgtggctatcgaaaacctgaaaaaacgtggtatcgacgcgctggtggttatcggcggtgacggttcctacatgggtgcaatgcgtctgaccgaaatgggcttcccgtgcatcggtctgccgggcactatcgacaacgacatcaaaggcactgactacactatcggtttcttcactgcgctgagcaccgttgtagaagcgatcgaccgtctgcgtgacacctcttcttctcaccagcgtatttccgtggtggaagtgatgggccgttattgtggagatctgacgttggctgcggccattgccggtggctgtgaattcgttgtggttccggaagttgaattcagccgtgaagacctggtaaacgaaatcaaagcgggtatcgcgaaaggtaaaaaacacgcgatcgtggcgattaccgaacatatgtgtgatgttgacgaactggcgcatttcatcgagaaagaaaccggtcgtgaaacccgcgcaactgtgctgggccacatccagcgcggtggttctccggtgccttacgaccgtattctggcttcccgtatgggcgcttacgctatcgatctgctgctggcaggttacggcggtcgttgtgtaggtatccagaacgaacagctggttcaccacgacatcatcgacgctatcgaaaacatgaagcgtccgttcaaaggtgactggctggactgcgcgaaaaaactgtattaatgatttcggaaaaaggcagattcctttaccctgaaaccgatctcgagacccagctttcttgtacaaagtggtgataaattggagctctgcagagctttc

SEQ ID NO: 434 - DNA, 1695 bp, Escherichia coli K12
aactctttgtttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatgagtaagtctgaaaatctttacagcgcagcgcgcgagctgatccctggcggtgtgaactcccctgttcgcgcctttactggcgtgggcggcactccactgtttatcgaaaaagcggacggcgcttatctgtacgatgttgatggcaaagcctatatcgattatgtcggttcctgggggccgatggtgctgggccataaccatccggcaatccgcaatgccgtgattgaagccgccgagcgtggtttaagctttggtgcaccaaccgaaatggaagtgaaaatggcgcaactggtgaccgaactggtcccgaccatggatatggtgcgcatggtgaactccggcactgaagcgaccatgagcgccatccgcctggcccgtggttttaccggtcgcgacaaaattattaaatttgaagggtgttaccatggtcacgctgactgcctgctggtgaaagccggttctggcgcactcacgttaggccagccaaactcgccgggcgttccggcagatttcgccaaatataccttaacctgtacttataatgatctggcttctgtacgcgccgcatttgagcaatacccgcaagagattgcctgtattatcgtcgagccggtggcaggcaatatgaactgtgttccgccgctgccagagttcctgccaggtctgcgcgcgctgtgcgacgaatttggcgcgttgctgatcatcgatgaagtgatgaccggtttccgcgtagcgctagctggcgcacaggattattacggcgtagtgccagatttaacctgcctcggcaaaatcatcggcggtggaatgccggtaggcgcattcggtggtcgtcgtgatgtaatggatgcgctggccccgacgggtccggtctatcaggcgggtacgctttccggtaacccgattgcgatggcagcgggtttcgcctgtctgaatgaagtcgcgcagccgggcgttcacgaaacgctggatgagctgacaacacgtctggcagaaggtctgctggaagcggcagaagaagccggaattccgctggtcgttaaccacgttggcggcatgttcggtattttctttaccgacgccgagtccgtgacgtgctatcaggatgtgatggcctgtgacgtggaacgctttaagcgtttcttccatatgatgctggacgaaggtgtttacctggcaccgtcagcgtttgaagcgggctttatgtccgtggcgcacagcatggaagatatcaataacaccatcgatgctgcacgtcgggtgtttgcgaagttgtgactcgagacccagctttcttgtacaaagttggcattataagaaagcattgcttatcccccaaatacccagcaaattggagctctgcagagctttcgttcgtatcatcgg

SEQ ID NO: 435 - DNA, 1780 bp, Bacillus subtilis subsp. subtilis str. 168
ctctttgtttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatgacaaagtacactagagaagatatcgaaaaattagtaaaagaagaaaacgtgaagtatatccgccttcaatttactgacattcttggaacaatcaagaatgttgagattcctgtaagccagcttggaaaagcgcttgataataaagtcatgtttgacggttcttctattgagggattcgttcgtatcgaagagtcagacatgtacctgtatccagatctaaatacatttgttatcttcccatggacagctgaaaaaggtaaagtagcacgtttcatctgtgatatttacaatccggatggcacaccttttgaaggtgacccgcgaaacaacttaaaacggattctgaaagaaatggaagacctcggcttcagtgattttaaccttgggcctgagcctgaattcttcttattcaaattggacgaaaaaggcgagccgacgcttgaactaaacgacaaaggcggatatttcgacttagctccaactgatttaggagaaaactgccgccgcgatatcgtacttgagcttgaagagatgggctttgaaatcgaagcgtctcaccacgaagtagcacctggtcagcacgaaatcgactttaaatatgctggagcagtccgctcttgtgatgacatccaaacatttaaactagttgtcaaaacaattgcccgtaaacacggcctgcatgcgacatttatgccaaaaccattgttcggtgtaaacggttcaggtatgcactgcaatctatcactcttcaaaaatggtgttaacgcattctttgacgaaaacgcagatcttcagttaagtgaaacagcgaagcacttcattgcaggtatcgtgaagcacgcaacaagctttacagcagtaacaaacccgacagtaaactcttacaaacgtcttgttcctggctatgaagcaccttgttatgtagcatggagcgcgcaaaacagaagcccgcttatccgtatcccggcttctcgcggcatcagcacacgtgttgaagtacgcagtgtagacccagctgcaaacccataccttgcacttagcgtattgcttgctgcaggattagacggaatcaaaaacaaactggaagcgccggctccaatcgaccgcaacatctatgtgatgagcaaagaagagcgcatggaaaacggaatcgttgaccttccagcaacacttgcggaagcactagaagaattcaaatcaaacgaagtcatggtcaaagcgctgggcgagcacctattcgaacacttcatcgaagcaaaagaaatcgaatgggatatgttccgcacgcaagtacatccttgggaacgcgaacagtatatgtctcagtattaatatctcaatcccttggcactaaaggtgtcaggggatttttctcgagacccagctttcttgtacaaagttggcaagaaagcattgcttatcccccaaatacccagcaaattggagctctgcagagctttcgttcgtatcatc

SEQ ID NO: 436 - DNA, 1330 bp, Escherichia coli K12
aactctttgtttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatggtagatgcaaacaaattacagcaggcagtggatcaggcttacacccaatttcactcacttaacggcggacaaaatgccgattacattccctttctggcgaatgtaccaggtcaactggcggcagtggctatcgtgacctgcgatggcaacgtctatagtgcgggtgacagtgattaccgctttgcactggaatccatctcgaaagtctgtacgttagcccttgcgttagaagatgtcggcccgcaggcggtacaggacaaaattggcgctgacccgaccggattgccctttaactcagttatcgccttagagttgcatggcggcaaaccgctttcgccactggtaaatgctggcgctattgccaccaccagcctgattaacgctgaaaatgttgaacaacgctggcagcgaattttacatatccaacagcaactggctggcgagcaggtagcgctctctgacgaagtcaaccagtcggaacaaacaaccaacttccataaccgggccatagcctggctgctgtactccgccggatatctctattgtgatgcaatggaagcctgtgacgtgtatacccgtcagtgctccacgctcctcaatactattgaactggcaacgcttggcgcgacgctggcggcaggtggtgtgaatccgttgacgcataaacgcgttcttcaggccgacaacgtgccgtacattctggccgaaatgatgatggaagggctgtatggtcgctccggtgactgggcgtatcgtgttggtttaccgggcaaaagcggtgtaggtggcggtattctggcggtcgtccctggagtgatgggaattgccgcgttctcaccaccgctggacgaagatggcaacagtgttcgcggtcaaaaaatggtggcatcggtcgctaagcaactcggctataacgtgtttaagggctgatcatgatgaacacggaaggtaataacggtaacaaacctctcggaaatacccagcaaattggagctctgcagagctttcgttcgtatcatcg

SEQ ID NO: 437 - DNA, 1661 bp, Pseudomonas syringae pv. tomato str. DC3000
caaactctttgtttcttgtttgttgattaacccttaattaatccgggcgcgcctgatttatcacaagtttgtacaaaaaagcaggctcctgcaggaccatggagattttcatgtatccagacgtacagctttatatcgatggccaatggcgcgcgagccgcgatggtcgctccattcctgttatagaccctgctaccggccagtcgctgggcagcgtggcgcatgccggtatcgccgatcttgatgaagcactctcagcagcggagcgtggctttgccacctggcgcgcgacctcggcgtatgaccgttacaagctgatgcagaaagccgccgatctggttcgtgagcgggcggacagcatcgccagaatcatgactcaggaacaaggcaagccgctggctgaggcgcgcatggaaaccctgtcggctgctgacgtcatcgactggctggctgaagagggccgtcgcagctatggccgtatcgtgccgtcgcgtggcgtgtccatcgagcagaaggttatcaaggagcccgtcggcccggttgctgcgttcacaccgtggaacttcccgatcaatcaggtggtgcgcaagctgtcttcggcgctggcagccggttgctcgatcatcgtcaaagccccggaagaaactccggggtcacctgccgagctgattcgggcgtttgccgatgcgggcgttccggcaggcgtcattggtttggtgtatggcgatccggcggaaatttccggctacctgattccgcacccggttattcgcaaagtgacttttaccggctctacgccggtcggcaaacaactcgcggcattggccggcaagcacatgaagcgcgccaccatggagctgggcgggcatgcgccagcactggtgttcgacgacgccgacattgacctggcggctcgcgtgctggccaccgccaagttccgcaacgccgggcaggtctgcgtatcgccgacgcgtattctggtgcagcgcaaggtgttgcaggcgtttaccgagaaattcgtcggcctgacccgtgagatcaaagtgggcaacggtctggagtcgggtacgaccatgggcccggtggccaatgatcgacgtatcccggcgctggttgatctgattgaagacgcagtcagtgctggcgcgaccgtttctgcaggtggcaaggctgtcgagggacagggctacttcttcgagccgaccgtactcagtggcctgacgccagccatgcgcatcatgaacgaagaaccgttcgggccggttgcgctactggtgccgttcgacaccgtggaagaagccattgtcgagtccaaccgggtgccgttcgggctggcgtcctacgccttcacgacctcgatgaagaccgctcaggcgctgagcacctacatcgaagcgggcatgctgtcgatcaaccaccagggcatcggcttgccggaagtgccgttcggcgggatcaaggattccggctacggttccgaaggcggcaccgaggccatcgaggcctacctgaacaccaaactggtcactcaatacagctgagtgcggttcggttaaaacaaaacggtcgcgatgtgcctcgagacccagctttcttgtacaaagtggtgataaattggagctctgcagagctttcgttcgtatcatcggtttcgacaacgt

SEQ ID NO: 438 - DNA, 1651 bp, Pseudomonas syringae pv. tomato str. DC3000
catttatttgtcagctttcaaactctttgtttcttgtttgttgattaacccttaattaatccgggcgcgcctgatttatcacaagtttgtacaaaaaagcaggctcctgcaggaccatgcagcttaaagattccaccctgttccgccagcaagcctacatcaacggccagtggctggatgcggacggtggtcagtcgatcaaggtcaacaacccggcgaccaacgagatcctcggcactgtgccgaaaatgggcgcggccgagacgcgtcgggcgattgaggcggctgacaaggcgctgccggcctggcgtgcgctgaccgccaaagagcgcggtaacaagctgcgtcgctggttcgagctgatgatcgagaatcaggacgacctgggtctgctgatgaccctggagcagggcaagccgctggctgaggccaagggcgagatcacgtatgcagcgtcgtttatcgagtggttcgctgaagaagccaagcgcgtgtacggcgatgtgatccccggtcaccagccggacaagcgtctgattgtgctcaagcagccgattggtgtgacggcggcgattacgccgtggaatttcccggcagcgatgatcacccgcaaggccggccctgcgctggcggcgggttgcacgatggtgctcaagcctgcgtcgcaaacgccgttttctgcgttggcgctggctgaactggccgagcgtgcgggtattccggccggcgtgttcagcgtggtgacgggcagcgcgggcgatatcggcagcgagctgaccggtaacccgatcgtgcgtaaattgtccttcacgggttcgaccgagatcggtcgccagttgatggctgaatgcgccaaggacatcaagaaagtgtcgctggagctgggcggtaacgcgccttttatcgtgttcgacgacgccgacctcgacaaggccgtcgaaggcgcgatgatctccaagtaccgcaacaacggtcagacttgcgtctgcgccaaccgcatctatgtgcaggacggcgtgtatgacgcattcgccgagaagctcaaggtggcggtcggcaagctgaaaataggtaacggcctggaagacggcattaccactggcccgttgattgatgaaaaggccgtggccaaggtcaaggagcacattgccgacgctgtcagcaaaggtgcgaccgtgctgaccggtggcaacagcctggaaggctcgttcttcgagccgactattctggtcaatgtgtcgaaagatgccgccgttgcccgagaagagacgttcggtccgctggccccactgttccgtttcaaggacgaggctgaggcgattgcgctggccaacgataccgagttcggtctggcgtcgtacttttatgcgcagaacatgagccgcgtgttccgggtggccgaggcgctggaatatggcatggtgggtatcaacaccggcctgatctccaacgaactggcaccgttcggcgggatcaagtcgtccggcctgggccgtgaaggttccaagtacggcattgaagattatctggaaatcaaatacctctgcctgtcggtctgactcgagacccagctttcttgtacaaagtggtgataaattggagctctgcagagctttcgttcgtatcatcggtttcgacaacgttcgtcaag

SEQ ID NO: 439 - DNA, 1676 bp, Pseudomonas syringae pv. tomato str. DC3000
ctctttgtttcttgtttgttgattaacccttaattaatccgggcgcgcctgatttatcacaagtttgtacaaaaaagcaggctcctgcaggaccatggatgatcttcttaccgcagatgaatatgccgccatcgcccaatcgatttcgtttccctccaatgcgttcatcaatggcgcctataaacccgcgatctctggcgccaccttttcaaccatcaacccggcgaccggtgagttcctgagtgatctggcggcctgccgcgccgaagacgtggatgacgctgtcagcaaggcaaaaaaggcttttgatgacggacgctggcggctgctcgcaccaggcgagcgaaaaagcgttttattgaaattcgccagattgctggaagacaaccgtcacgaactcgccgtgctggagagcctcgacagcggcaagccggtacgggaatgccaactggtagacgtgccggacaccattcataccctgcgctggcatgccgagttgatcgacaagctgtatgaccacacggcgcccgttggaaacgacgcgttgaccctggtggtgcgcgagcctatcggcgtggtcggttgcgtattgccgtggaattttccgctgctgatgctggcctggaagatcggtccggccctggccgccggctgttcggtgatcgtcaaacctgccgaacaaaccagcctgaccacactgcgcgtcgctgagctggcgtttgaagccggtgtgcccgccggagtgttgaacattatcaccgggaccggcaaagacgtaggcgaacccattggcctgcacaaagatatcgacatggtgagcttcaccggttctaccgtgaccggtcgacgcttcctgcattactccgccgattcaaacctcaagcgtgtggtgcttgaatgcggcggcaagaacccggccgtggtgatggaagatgccgaagacctggacctggtagctgaacaagtcgtcaacggcgcgttctggaacatgggcgaaaactgctcggcaacgtcccggctattggtgcatgcgtcggtcaaggacgaactgcttgagcgcatgggcgcctatattcgcgaatggaaaatgggcgatccgctggacccgcaaacccgcgtcggcgcgttggtcagcagcgatcacttcgccaaggtgaagtcgtatctcgactacgccaacgccgacaaactggacatcgtctacggcggcgacacccaagagggggctttcgtccagctgacggtggttgatggcgtcgagcgtgacagccgactgttccaggaagagatcttcggcccgatcctgtccgtgaccaccttcaactcgatctctgaggcaatcgccctggccaacgacacggtgtacggcctggccgcatcggtttacaccggcagcctgcgtaaggcgatcaagctgtcacgggaaattcgtgcaggtatcgtcaccgtgaactgtttcggtgagggcgatgcttctaccccgttcggcggcttcaaggaatcgggattcggtgggcgcgacaagtcggtttttgctcacgatcaatacaccgaaatcaaaactatctggatcgatgtgtctgatcggtcggttgacgagaccgtaaaatgactcgagacccagctttcttgtacaaagtggtgataaattggagctctgcagagctttcgttcgt

SEQ ID NO: 440 - DNA, 1441 bp, Acidithiobacillus ferrooxidans
actctttgtttcttgtttgttgattaacccttaattaatccgggcgcgcctgatttatcacaagtttgtacaaaaaagcaggctcctgcaggaccatgagtgccattgtccgcatccaagcccgtgaagttctcgattcgcgcggcaatcccactgtggaggccgaggtctatctcgataacggcggcatgggccgtgcgatcgtccctagtggcgcttccaccggtgagcgcgaggccgtggagttgcgcgatggtggccagcgctacggcggcaaaggagtgcgcaaggccgttgaacacgtcaacggcgagattcaggatgcgcttcttggcatggaagccgaagagcaggagcatattgatgcggctctctgtgccttggatggcaccgaaaataaggcacgcctcggcgccaatgcgatcctgagcgtctcattggcgacggcccatgcggctgcccatgcggctggccagcccttgtaccgctacatcggtggcttgggcccgctgcagttgcccgttcccatgatgaatgtcatcaatggtggtgcccatgccgataacgacgtggacatgcaggaattcatgctgatcccggcgggcgcggagtcgttctctgaggctttgcagatgggggtggaggtgttccacagcctgaaagccgtgctgcaatcgcgcggactggcaacgacagtcggcgacgagggcggcttcgctccgaatctgccctccaacgaggctgccctggagctgctcatggacgccatcaacaaggcgggttatcagccgggtaaagatatctggctgggcatggacgtcgcttccagtgaattttatcgggatggacgttatcacttggctagcgaaaggcgtgaactcgatagtgcccagttcgtggattatctggcggcgctggctgatcgttatccactgatcagcattgaagatggcatggatcagaatgactgggaaggctggatcactctcaccgaccgccttggtgaccgtttgcagttggtgggtgatgatattttcgtaacgaatacgacgatcctgcgtgagggcatcgagcgcggcgtcgccaatagcatccttattaaactgaatcagatcggtacgttatccgaaaccctggcggccatcgagatggcaaaagtccatagttatacggctatcgtgtcgcaccgatccggagagaccgaggataccacactggccgatgtggccgtggctacgggttgtggccagattaaaacaggctctttgtcgcgcacggatcgggtggcgaaatacaaccgcctattgcgtatcgaggaagatttgggggatgccgcccgttaccccggccttgcaactttttataatctcgactaactcgagaccagctttcttgtacaaagtggtgataaattggagctctgcagagctttcgttcgtat

SEQ ID NO: 441 - DNA, 1981 bp, Escherichia coli K12
tttatttgtcagctttcaaactctttgtttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatggcagtacccgttcaacatcctatgtatatcgatggacagtttgttacctggcgtggagacgcatggattgatgtggtaaaccctgctacagaggctgtcatttcccgcatacccgatggtcaggccgaggatgcccgtaaggcaatcgatgcagcagaacgtgcacaaccagaatgggaagcgttgcctgctattgaacgcgccagttggttgcgcaaaatctccgccgggatccgcgaacgcgccagtgaaatcagtgcgctgattgttgaagaagggggcaagatccagcagctggctgaagtcgaagtggcttttactgccgactatatcgattacatggcggagtgggcacggcgttacgagggcgagattattcaaagcgatcgtccaggagaaaatattcttttgtttaaacgtgcgcttggtgtgactaccggcattctgccgtggaacttcccgttcttcctcattgcccgcaaaatggctcccgctcttttgaccggtaataccatcgtcattaaacctagtgaatttacgccaaacaatgcgattgcattcgccaaaatcgtcgatgaaataggccttccgcgcggcgtgtttaaccttgtactggggcgtggtgaaaccgttgggcaagaactggcgggtaacccaaaggtcgcaatggtcagtatgacaggcagcgtctctgcaggtgagaagatcatggcgactgcggcgaaaaacatcaccaaagtgtgtctggaattggggggtaaagcaccagctatcgtaatggacgatgccgatcttgaactggcagtcaaagccatcgttgattcacgcgtcattaatagtgggcaagtgtgtaactgtgcagaacgtgtttatgtacagaaaggcatttatgatcagttcgtcaatcggctgggtgaagcgatgcaggcggttcaatttggtaaccccgctgaacgcaacgacattgcgatggggccgttgattaacgccgcggcgctggaaagggtcgagcaaaaagtggcgcgcgcagtagaagaaggggcgagagtggcgttcggtggcaaagcggtagaggggaaaggatattattatccgccgacattgctgctggatgttcgccaggaaatgtcgattatgcatgaggaaacctttggcccggtgctgccagttgtcgcatttgacacgctggaagatgctatctcaatggctaatgacagtgattacggcctgacctcatcaatctatacccaaaatctgaacgtcgcgatgaaagccattaaagggctgaagtttggtgaaacttacatcaaccgtgaaaacttcgaagctatgcaaggcttccacgccggatggcgtaaatccggtattggcggcgcagatggtaaacatggcttgcatgaatatctgcagacccaggtggtttatttacagtcttaatgagtgaaagaggcggaggttttttcctccgcctggggggataagcaatgctttcttataatgccaactttgtacaagaaagctgggtctcgaggcacaggcgcagccatggtcctgcaggagcctgcttttttgtacaaagttggcattataaaaaagcattgctcatcggggaaatacccagcaaattggagctctgcagagctttcgttcgtat

SEQ ID NO: 442 - DNA, 1757 bp, Escherichia coli K12
aactctttgtttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatggatcagacatattctctggagtcattcctcaaccatgtccaaaagcgcgacccgaatcaaaccgagttcgcgcaagccgttcgtgaagtaatgaccacactctggccttttcttgaacaaaatccaaaatatcgccagatgtcattactggagcgtctggttgaaccggagcgcgtgatccagtttcgcgtggtatgggttgatgatcgcaaccagatacaggtcaaccgtgcatggcgtgtgcagttcagctctgccatcggcccgtacaaaggcggtatgcgcttccatccgtcagttaacctttccattctcaaattcctcggctttgaacaaaccttcaaaaatgccctgactactctgccgatgggcggtggtaaaggcggcagcgatttcgatccgaaaggaaaaagcgaaggtgaagtgatgcgtttttgccaggcgctgatgactgaactgtatcgccacctgggcgcggataccgacgttccggcaggtgatatcggggttggtggtcgtgaagtcggctttatggcggggatgatgaaaaagctctccaacaataccgcctgcgtcttcaccggtaagggcctttcatttggcggcagtcttattcgcccggaagctaccggctacggtctggtttatttcacagaagcaatgctaaaacgccacggtatgggttttgaagggatgcgcgtttccgtttctggctccggcaacgtcgcccagtacgctatcgaaaaagcgatggaatttggtgctcgtgtgatcactgcgtcagactccagcggcactgtagttgatgaaagcggattcacgaaagagaaactggcacgtcttatcgaaatcaaagccagccgcgatggtcgagtggcagattacgccaaagaatttggtctggtctatctcgaaggccaacagccgtggtctctaccggttgatatcgccctgccttgcgccacccagaatgaactggatgttgacgccgcgcatcagcttatcgctaatggcgttaaagccgtcgccgaaggggcaaatatgccgaccaccatcgaagcgactgaactgttccagcaggcaggcgtactatttgcaccgggtaaagcggctaatgctggtggcgtcgctacatcgggcctggaaatggcacaaaacgctgcgcgcctgggctggaaagccgagaaagttgacgcacgtttgcatcacatcatgctggatatccaccatgcctgtgttgagcatggtggtgaaggtgagcaaaccaactacgtgcagggcgcgaacattgccggttttgtgaaggttgccgatgcgatgctggcgcagggtgtgatttaactcgagacccagctttcttgtacaaagttggcattataagaaagcattgcttatcccccaaatacccagcaaattggagctctgcagagctttcgttcgtatcatcg

SEQ ID NO: 443 - DNA, 1551 bp, Bacillus subtilis subsp. subtilis str. 168
acaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatggaaataacaccgtccgatgtcatcaagacacttccaaggcaggagttttctctcgtttttcaaaaggtaaaggaaatggaaaaaacgggagcccatatcattaatctcggacaggggaaccctgaccttcccactccgccgcatattgtcgaggctttgcgggaggcttctctgaatccttcgtttcatggatacggccctttcaggggctatccttttttaaaggaagcgatcgccgctttctataaaagggaatacggagtgacaatcaatcctgaaacggaagtcgcgcttttcggaggcgggaaagccggattgtatgtgctgacacaatgcctgctcaatccgggagacatcgctttagtcccgaatccaggctatcctgaatatttatcagggattacgatggcgcgagctgagctttacgaaatgccgctgtatgaagaaaatggctatctgccggattttgaaaagattgatccagccgtgctggaaaaagcgaagcttatgtttttaaactatccgaacaaccccactggagctgtggctgatgcggctttttatgcaaaagctgctgcttttgcgaaagagcataacatccatttgattcatgattttgcatacggggcgtttgaattcgatcaaaaaccggccagctttcttgaggcagaggatgccaaaactgtcggagcagagctttattcattttcaaaaacatttaacatggccggctggagaatggcgtttgcggttgggaacgaaaaaatcattcaggccgtcaatgaatttcaggatcatgtatttgtcggcatgttcggcgggctgcagcaggcagcgagtgcggcgctttctggagatccggagcatacggaatcgttgaaacgaatttataaggaacgaattgacttttttacggcgctttgtgaaaaggaactgggctggaagatggaaaagccaaaaggaaccttttacgtatgggctgaaattccgaatacgtttgagacatctcaccaattttccgattacttgctggagcatgcccatgtcgtagtcacaccgggcgaaatttttggaagcaacggaaaaaggcatgtcagaatctcaatggtgtcgaagcaggaggatctgcgggaatttgtcacgcggattcaaaagctgaacctgccgttcgggtcattacaagaaacatcccgctaactcgagacccagctttcttgtacaaagttggcattataagaaagcattgcttatcccccaaatacccagcaaattggagctctg

SEQ ID NO: 444 - DNA, 1946 bp, Bacillus halodurans
ggattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatgagcaagaaacccgttgcattgatcattttagatggctttgcgatgcgcgacgaggcgaaaggaaacgcggtggctcaagcgaataagccgaactttgatcgctattggaatcagtatccacacgcattattaaaggccgatggggaagcggttggcttaccggaagggcaaatggggaactccgaagtcggtcacttaaacatcggtgccggccggattgtttaccaaagcttaactcgtgtcaacctttccatccgcgaaggcgaatttttcgaaaatgaaacgtttttaaatgcgatgaaccacgtgaaggaaaaagggtctagtcttcacatttatggccttgtgtcagatggaggcattcatagtcacattaaccatctatatgcactgcttgaacttgcgaaaagagagcaggtggaacgggtgtacatccatggtttcttagatggtcgtgatgttggtccaacctcagcagaatcgtatctcgttgacctagaagcgaaaatgaaggagctcggtgtcggtgagcttgcgactctacatggccgttattatgcgatggatcgcgacaagcgctgggatcgtgtggaaaaatcgtatcgggcgatggtatatggcgaaggaccagcttattcatcagctcttgacgtcattaaggacagctatgaaaactcgattcacgatgagtttgttatcccttctgtcattacgaacgaagatggctctccagtagcgacgattgaagatgatgatgcaattattttcttcaacttccgtccagaccgggccatccaaatgtcacaagtgtttacgaataaagatttccgtggatttgatcgtggtgaaaaacttccgcaaaatgtatactatgtatgtctgactcatttcagcgagacggttcaaggagacgtggcatttaagccgaccaacttggataatacccttggtgaagtgttggcccagcaaaattacaaacaactgcggattgcggaaacggaaaaatatccgcacgtcaccttcttctttagcggtggacgagaggagccgttcccaggagaagagcgaattttaatcgattctccaaaagtggcaacctatgacttaaaaccggaaatgagtgcctatgaagtgacggacgctttgttaaacgaaattgaggcggacaagcacgatgtaatcattttaaactttgcgaatcctgatatggttgggcattctggtatgcttgagccgacaattaaagcggtagaagcagtcgatgagtgcttagggaaggtcgtggacgcgattctagctaaaggtggtgcagctgtcattaccgctgatcacggaaacgcagacgaggtcgtcacattggaagggaagccaatgacggcgcacacgacaaacaaagtgccggtcatcgtaacagaggaaggattgaacttgcgagaagatgggattttagccgatctttctccaacggttctcgacctccttggcggaaaacaaccagccgaaatgacaggaaaaacattaattaagtaactcgagacccagctttcaaatacccagcaaattggagctctgcagagctttcgttcgtatcatcggtttcgacaacgttcgtcaagttcaatgcatcagtttcattgcgcacacaccagaatcctact

SEQ ID NO: 445 - DNA, 1421 bp, Desulfitobacterium hafniense
ctctttgtttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatgggtgtgcgaattgcaattaacggctttgggcgaatcggtcggctttccatgcgggcaatcctggaacgaaaaagttccctggacattgttgctgttaatgatctggggagtccggatctgttaggtcatttattcaagtatgattcaattcatgatatcctgccttatgatgttgaggtcaaggaaaacacccttgaagttttggaccaaaaggtggcttttttggcggaaaaagatcctgggaaacttccctggcgggagctgggggtagatctggtgattgaagctacggggcgctttaccaagcgggagcaggcggcgttgcatctccaggccggagcgaaaaaggtgatcatttccgctccgggaaaacacgaagatatcacgattgtgatgggggtaaacgaacatctctataaccccgctgagcaccatatcctctccaatgcctcctgtaccaccaatggtttggcccccctagccaaggttttactcgaagaatttgggatcgagcagggcatgatgaccaccacccattcggtgaccaatgaccagcggattctggatttggagcataaggattggcggcgggcccgggcggcctacgaatcgatgattcctacgaccacaggagcaaccaaggcggtggaactggtgcttcccgacttaaagggcaagctcaaaggattagcggtgagggttcctacccctaatgtctcgcttattgattttgtggctaatttaagccgttccaccaccaaagaagaagtaaatcaaaaacttagggaagccgccgagggaagcctcaaaggctacctggcttattccgagctgcctttagtttcccacgactttaatggcaaccctcacagtgccattgttgacgggttgtctacgctgatgctgggagagcgcatggtcaaggtcctggcctggtatgacaacgagtggggatactccaatcggattgtggacttggtggaatacatcgccggccaaggactataactcgagacccatctttcttgtacaaagttggcattataagaaagcattgcttatcccccaaatacccagcaaattggagctctgcagagctttcgttcgtatcatc

SEQ ID NO: 446 - DNA, 1910 bp, Escherichia coli K12
agctttcaaactctttgtttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatggtggtttctaaaaaacctatggtactggtgattctggatggctatggctatcgcgaagaacagcaggataacgccatttttagtgctaaaaccccggtaatggatgcactgtgggccaatcgtccgcataccctaatcgacgcttccggtctggaagtcggtctgcctgaccgtcagatgggtaactccgaagtaggccacgttaacctgggtgccggccgcatcgtgtatcaggacctgactcgtctggacgttgaaatcaaagatcgcgctttctttgctaatccggtgctgactggcgcggtagataaagcgaaaaacgcaggcaaagcggtacacattatgggtctgctctccgcaggcggcgtacacagccacgaagatcacatcatggcgatggtagaactggcagctgaacgcggcgcagaaaaaatctacctgcacgcattccttgacggtcgcgacactccgccgcgcagtgctgaatcctcgctgaaaaaattcgaagaaaaatttgccgcgctgggcaaaggccgcgtagcgtccatcattggtcgttactacgcgatggaccgcgataaccgttgggatcgcgtagaaaaagcttatgacctgctgactctggcgcagggcgagttccaggccgataccgccgttgctggtttgcaggctgcttatgctcgcgacgaaaatgatgaattcgtgaaagcgaccgttatccgtgctgaaggtcagccagacgcggcaatggaagacggcgatgcactgattttcatgaacttccgtgctgaccgcgcgcgtgaaatcactcgtgctttcgtgaacgctgatttcgatggcttcgcgcgtaagaaagtggttaacgtcgatttcgtgatgctgaccgaatacgccgctgacatcaaaactgcggttgcttacccacccgcttccctggttaacaccttcggcgagtggatggcgaaaaacgacaaaactcagttgcgtatttccgaaaccgaaaaatatgcccacgttactttcttcttcaacggtggcgtagaagagtcgttcaaaggcgaagatcgcattctgatcaactcaccgaaagtggctacctacgatctgcaaccggaaatgagctccgcagagctgaccgaaaaactggttgcggccatcaagagcggcaaatacgacaccatcatctgtaactatccgaacggcgacatggtaggtcacaccggggtgatggaagcggcggttaaagcggttgaagcgctggatcactgcgtggaagaagtcgcgaaagcggttgagtccgtgggtggacaactgctgatcaccgctgaccacggtaacgctgagcagatgcgcgatccggcaacgggtcaggcacacacggcacacaccaacctgccagttccgctgatttacgttggtgataagaacgtgaaagcggttgaaggcggcaaactttctgacatcgcgccgaccatgttgtcgctgatgggtatggaaatcccgcaagagatgactggtaagccgctgttcatcgtggaataactcgagacccagctttcaaatacccagcaaattggagctctgcagagcttt

SEQ ID NO: 447 - DNA, 1776 bp, Sinorhizobium meliloti
gtcagctttcaaactctttgtttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatggcctatgatctcatcgttatcggaagcggccccggcggctatgtctgcgccatcaaggcggcgcagctcggcatgaaggttgccgtggtcgagaagcgcagcacctatggcggcacatgcctgaatgtcggctgcatcccctccaaggcgctgctgcatgcttccgaaatgttccatcaggctcagcacggcctggaggcgctgggtgtggaggtcgcaaacccgaagctcaaccttcagaagatgatggcccacaaggacgcaaccgttaagtccaacgtcgacggcgtctccttcctcttcaagaagaacaagatcgatggcttccagggcaccggcaaggttctcggccagggcaaggtctcggtcacgaacgaaaagggtgaggagcaggtgctcgaggcgaagaacgtcgtcatcgccaccggctcggatgtcgccggcatcccgggcgtggaggtcgcgttcgacgaaaagaccatcgtctcctcgaccggggcgctcgcgctcgaaaaggtccccgcgagcatgatcgtcgtcggcggcggcgtcatcggcctcgagctcggctcggtctgggcgcgcctcggcgccaaggtgaccgtggtcgaattcctcgacacgattctcggcggcatggacggcgaagtcgccaagcagcttcagcggatgctgaccaagcagggcatcgacttcaagctcggcgccaaggtgacgggcgccgtgaaatcgggcgacggtgccaaggtcaccttcgagcccgttaagggcggcgaggccactacgctcgatgccgaagtcgtgctcatcgctaccggacgcaagccctcgacggacggcttgggtctcgccaaggcgggcgtcgtcctcgattcgcgtggccgcgtggagatcgaccggcattttcagacgagcattgccggcgtctacgcgatcggcgacgtggtgcgtgggccgatgctggcgcacaaggccgaggatgaaggtgtcgccgtggcggagatcatcgcaggtcaggccggccacgtgaactacgacgtcattccgggcgtcgtctacacccagcccgaggtcgcctccgtcggcaagaccgaggaagagctgaaggctgcgggcgtcgcctacaagatcggcaagttccccttcaccgccaatggccgcgcccgcgccatgcttcagacggacggtttcgtgaagattctcgcggacaaggagaccgaccgcgtgctcggcggccacatcatcggcttcggcgccggcgaaatgatccacgagatcgcggtgctgatggagttcggcggatcgtcggaggacctcgggcgcacctgccacgcccatccgacgatgtcggaggcggtaaaggaagcggcgctttccaccttcttcaagccgatccacatgtgattattggagggcggtgagaatgcccctcatccgcctgccggcaccttctccc

SEQ ID NO: 448 - DNA, 1672 bp, Synechocystis sp. PCC 6803
tttgtcagctttcaaactctttgtttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatgatttacgacattttcatgcccgccctgagttccaccatgaccgaggggaaaattgtttcttggactaagtcccccggcgacaaagtggaaaaaggtgaaactgtcttggtggtggaatcggacaaagcagatatggacgtggagtcctttaacgaaggttacctagccgccattctagttccagcaggggaagaagctcccgtgggggcaacccttggcctagtggtggaaacggaagcggaaattgccgaagcccaagctaaagctggctctggtggtggttctagtgcggctccgactgcaaccccagccccccaacaacctgaaccagtggcgatcgccagtgcaactgccatagagacaactccggcccctagcagtaacggcaatggcaaaggcagtgggcgaattattgcttccccccgggcgaaaaaactagccaaagagttaaaagttgatttagctaccattgctggcactggcccccacggcagaattgtggccgcagatattgaaagtgccgctggtaaacccgtcactgcttccatcgctgcccccagtgccccagctcctaaaacatcccctgcccctactccaagggtaacctctacccccagtgttcccgtcggccagacagtacccctgaccactttccaaaaagctttggtgcaaaatatggtggccgccatggccgctcctacattccgagtgggctacaccatcaccaccgatggactggatcaactttataaacaaatcaaaggcaaaggggtgactatgacggccctgttggctaaagctgtggctctggccttgaaaaaacatcccattgtcaacgccagctacactgaccaaggcatcatctaccacaaggatgtcaacattgctctggccgtagccatgcccgatggcggtttaattactccggtgttgcaaaatgcagaccaagtagatatctactccctctcccgccgatggaaagaattggtggaacgggcccgggctaagcagttacagcctgaagaatacagcactggcactttcactatttctaacctgggtatgtttggggtagaccgatttgatgccattctaccgccgggtcaagggggaattttagcggtgggtgcttcccgtccccaagtagtggccaatgaggaaggtttgattggtaccaaacgacaaatggcggttaatgtaacctgtgaccatcgggtaatttatggggcccatgccgccgctttcctgaaggatttggctgtcattattgaagagaatgcccagtctttgactatgtaaatttaaatacccagcaaatacccagcaaattggagctctgcagagctttc

SEQ ID NO: 449 - DNA, 3076 bp, Xenorhabdus nematophila
attcatttatttgtcagctttcaaactctttgtttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatggcagatattttgaaaaatgacgtggatccgatcgaaactcgcgattggttacaggcgatcgaatcggtcatccgtgaagagggtgttgagcgtgctcagttcctgattgatcaggttttgaacggggcccgcaaaggtggagttagcgttgcagcaggtgttgcaagtcgtgattacatcaacactattcctgttgaggatgagcctgcttaccctggcaatctggatttggagcgtcgtatccgctctgctattcgctggaatgcggtgatgaccgttctgcgtgcatccaagaaagatctagatctgggcggccacatggcttcattccagtcttctgctactttttacgacgtttgctttaaccatttcttccgcgctcgcaatgaaaatgatggcggcgacttggtttacttccagggccatatttctccgggcgtttatgcacgtgctttcctggaaggccgtttgactgaagagcagatgaacaatttccgtcaggaaattggtggtaatggcctgtcttcttatccgcatccaaaattgatgcctgatttctggcagttccctacggtttcaatgggtctgggcccaatttctgctatttatcaggctaaattccttaaatatttggaacaccgtggtctgaagaatacgtctcaacaaaccgtttatgctttcttgggcgacggtgaaatggatgaaccagaatccaaaggtgcgatcactatcgcaactcgtgaaaaactggacaaccttgtcttcgttatcaactgtaacttacagcgtcttgatggcccagtgactggtaacggcaaaatcgttaacgaactggaaggtatcttcgcaggtgctggctggaaagtgctgaaagttctgtggggcgagcgttgggacgaactgctgcgtaaagacactagcggtaaactggttcaactgatgaatgagactctggatggtgactaccagacattcaagtccaaagatggcacttatgtgcgtgagcacttcttcggccgttacccagaaaccgcagcattggtcaaagatatgactgatgatgaaatctgggctctgaaccgcggtggtcatgatcctaagaaagtctatgctgcactgaatcaagcgcagaatactacgggtcaaccaacggtaattctggctcagaccatcaagggttatggtatgggtgataccgctgaaggtaaaaacattgcccatcaggttaagaaaatgaatatggaaggtgtccgtcacttccgtgatcgtttcaatgtgcctgtgtctgatgaacaaattgaaaaactgccatacgtcacttttgataaagactctgaagagtccaaatatctgcatgagcatcgtaatgcgctgggtggttacctgccaagccgtcgtgtaaacttcgatgaaaaactggaaattcctgcactggaagacttcagctcactgctggaagaacaatccaaagaaatttctactactatcgccttcgttcgtgcactgaacgttatgctgaagaataagtcgatcaaagatcgtctggttccaattatcgctgatgaagcacgtactttcggtatggaaggtctgttccgtcaaatcggtatctacagcccgaatggtcagcaatatactccgcaagaccgtgagcaggttgcatactataaagaagacgccaaaggccagatcctgcaggaaggtatcaacgagctaggtgccgcctcatcttggctggctgctgcaacttcatacagcaccaacaacctgccaatgattccgttctacatttactattctatgttcggattccagcgtatcggtgatctgtgctgggcggctggcgaccaacaggctcgtggcttcctggtaggcggtacttctggccgtacgactctgaacggtgaaggtttgcagcacgaagatggccatagccacattcagtctctgactattcctaactgtatctcttacgatccagcattcgcttatgaagtggctgttatcatgcatgacggtttagagcgcatgtatggtgagaaacaagaaaatatctactactatatcactacactgaacgaaaactaccacatgccagcaatgcctgcgggtgcagaggaaggtatccgtaaaggtatctataagctggaagcttttgacagtgcgaaaggtaaagttcagttgctgggttctggttctatcctgcgtcatgttcgtgaagcagctaagatcctgtctgacgagtatggtattggttctgatgtatacagcgtaacgtccttcactgaactggcgcgtgatggtcaggattgtgagcgttggaatatgctgcacccatcagaggaaccacgtgttccttatattgcgcagatcatgaatgaagcaccagcagtagcgtctactgactacatgaagctgttcgcagagcaggttcgtaacttcgtccctgcaagcgaattccgcgtattaggtactgacggtttcggtcgttctgacagccgtgaaaacctgcgtcatcactttgaagttgatgcttcttacgtggttgttgctgctctgggtgaattggctaaacgcggcgaagttgatgtgaaagtcgttgaagaagctattaaaaaatataacatcaacccagaaaaagttaacccacgtctggcataaatttaaatacccagcaaatacccagcaaattggagctctgcagagctttcgttcgtatcatcggtttcgacaacgttcgtcaa

SEQ ID NO: 450 - DNA, 2476 bp, Nostoc punctiforme PCC 73102
catttatttgtcagctttcaaactctttgtttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatggctgttgcaacccaatccgccaaagaattgtccgtcgaagaactggctattaactcgatccgcttcttggctattgatgccgtagaaaaggcaaaatcgggacacccaggactaccaatgggcgcggctccgatggcttttgtcctctgggatcgctttttgaagtttaatcccaagaatcccaaatggtttaaccgcgatcgctttgtcttgtctgccggtcatggctcgatgttgcagtacgccctactctacctgacaggctacgatagcgtcaccattgaagatatcaaacaattccgtcaatggggttctaaaactcctggacacccagaaaactttgaaaccccaggcgtggaagtcacaactgggcccttgggtcaaggaattgctaatggagttggtttagcgatcgcagaagcacaccttgccgctaaatttaacaaacctgataccaagattgttgaccattacacctacgtaattgtaggtgacggttgcaatatggaaggaatttccggtgaagcttgttcttttgcaggacacttgggattaggcaaactcatcgctctgtatgacgacaaccacatttccatcgacggttccacagatgtggcatttaccgaagatgtttccaagcggtttgaagcttacggttggcacgtccaacatgtcgaagatggcaataccgatttagcagcgatcgctaaagcaattgaagcggctaaagctgtcaccgataagccttctttcatcaaagtaacaaccattattggttacggttcccccaataaagcaaacactgctggcgttcacggcgctgccttgggtgcagacgaaatagcattgactcggaaaaatttgggttgggaatacgagccttttgatgttccacaagaagccctcaaccacacacgcaaagcagtagaacgcggcgcaagctacgaagccgaatggaacaaaacatttgccgactacaaagctaagtatgcccaagaagccgctgaatttgaacgttacctaagcggcaagctacccgacggttgggataacgtactacccacctacacccccgaagacaaaggactacccacccgtaaacactcagaaacctgcctcaacaaactggcggcagttttacctgaattgattggtggttcggctgacttgacccactccaacttgaccgaaatcaagggcaagggcgactttcaaaaagggcactacgaaaaccccaacatccactttggtgtgcgggaacatgctatgggcgcaatctgtaatggtatagcgctgcacacttcaggattaatcccctacggtgctaccttcttgatcttcacagattacatgcgtgctgccattcgcttatctgccctttcccaagctggcgtgatttgggtgatgacccacgattccattggacaaggtgaagatgggccaacacaccaacccattgaaactctagcttccttgcgagctattcctaatttattagtgtttcgtcccgcagacggtaacgaaacctctggcgcttataaaattgcgattgaaaaagcgaagcaaaatgctccgtctctgttggcgttcactcgtcaaaacgttcctaacttggcaggtacatcggttgagggtgtggcgaagggtggatacaccgttgttgatagcgaaggtacacctgatatcatcttgattggtactggttcagaattgagcctcgccgtcagcgcagccgaaaaactcaaggctgaaggtaagaaagttcgtgttgtctcgctaccttcatgggaactgtttgaagcacaggatgcggcttataaagagtccattctgccaaaagctgtcaccaagcgtttgtctgtagaagctgccgctagtttcggttggcacaaatacgtgggtactgaaggcgatactgttagtatcgatcgctttggtgcttcggctccaggcaatgtttgtctagagaagtttggctttagcgttgataatgtgttagcaaaggctaaacaattgttgggttaatagcaacagaatattctcaaaattttgtaagtgggcatcttgcatttaaatacccagcaaatacccagcaaattggagctctgcagagctttcgttcgtatcatcggtttcgacaacgttcg

SEQ ID NO: 451 - DNA, 1254 bp, Saccharomyces cerevisiae
ttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatgactgttactgacacttttaaactgtttattttaaggcatggtcaaagtgaattaaactcagaaaacatattctgcggatggattgatgctcaattaacggaaaaagggaagtctcaggcccgccactctgcaaaattgatcaagcagttttgcgattctaacaatatctctttgcctcagattggctatacttcaaggttgattcgaactcagcagaccatggacgttattctcgaagagttgggactaaaacacaccaattatgtaattactacgaatacaaacattaaggaggagctgcaggacacaagatttgaaggaagtatgcctgtgttgcaaacctggaggttaaatgagcgtcattacggcgcatggcaaggacaaagaaagccagatatcttgaaagaatacggtaaggaaaaatacatgtatatcagaagagattacaacggaaaaccccctaaagtcaacctaaacctggaaatggtccaagaggaaaatgatcaggggtcctccacaggctatgattttaaggagcccaatagacacttaaaatacggccccgaagagaaggctaatgagcgtctgccagaaagtgagtctctttgtgaagtggtcgtcagattgaaaccatttttaaataatgttgttctgtctaccgccaacaaaatcagtcaagaatcgtgtgttatagttgggcatggcagctctgtaagatctctgctgaaagtattggaaggtatctcagatgaagacatcaaagatgtcgatattcccaacggcattccgctagttatagagttggatagagacaattactcttttgtgaggaaattttacttggatccagaatcagctaaagttaatgctcaaatggttcgtgatgagggtttcgaaaagaatccatgaatttaaatacccagcaaatacccagcaaattggagctctgcagagc

SEQ ID NO: 452 - DNA, 930 bp, Synechocystis sp.
caaactctttgtttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatgattcgtttgctcatggtattccctcaacgtttttccccctcccatttgctatctcgtcactggggttggttggcggtcgccatggcctccctagggagcttgtcttccctgcccgtcaacgtcaattcctcggtggtggcccaaacggccccttctagtcccatgactgtccgctctgatatccaagaagctaattcccaaaccggggtggtgaccgctagggggaatgttcaagtttactatcctgcgcggaatttgcaagcaacggcggcccaggcccaatatttttcccaggagagacgtttagtccttagtggcaacgtctatgtgctccaggacggcaacagtatgcgggcggaaaccatgacctatttagtggacgaagggcgttttgtcgctaacccccaagcaaatcaacaggtggaatccatttatctagtggaagagtcccaaagtccagccggccccgcccccactggtcccaatcctctccccggtgataccctgccagatttgccgcccctgggttcttagctgtgggatactaacggcattcggtgacaggctttttagcgagaacatttaaatacccagcaaatacccagcaaattggagctct

SEQ ID NO: 453 - DNA, 1011 bp, Arabidopsis thaliana
atgtcgaccgctcctctctccggcttctttctcacttcactttctccttctcaatcttctctccagaaactctctcttcgtacttcttccaccgtcgcttgcctcccacccgcctcttcttcttcctcatcttcctcctcctcgtcttcccgttccgttccaacgcttatccgtaacgagccagtttttgccgctcctgctcctatcattgccccttattggagtgaagagatgggaaccgaagcatacgacgaggctattgaagctctcaagaagcttctcatcgagaaggaagagctaaagacggttgcagcggcaaaggtggagcagatcacagcggctcttcagacaggtacttcatccgacaagaaagctttcgaccccgtcgaaaccattaagcagggcttcatcaaattcaagaaggagaaatacgaaaccaaccctgctttgtacggtgagctcgcaaagggtcaaagtcctaagtacatggtgtttgcttgttcagactcacgtgtgtgtccatcacacgttctggactttcagccaggagatgccttcgtggtccgtaacatagccaacatggttcctcctttcgacaaggtcaaatacggtggcgttggagcagccattgaatacgcggtcttacaccttaaggtggagaacattgtggtgataggacacagtgcatgtggtgggatcaaagggcttatgtctttccccttagatggaaacaactccactgacttcatagaggactgggtcaaaatctgtttaccagccaagtcaaaggttatatcagaacttggagattcagcctttgaagatcaatgtggccgatgtgaaagggaggcggtgaatgtttcactagcaaacctattgacatatccatttgtgagagaaggacttgtgaagggaacacttgctttgaagggaggctactatgacttcgtcaagggtgcttttgagctttggggacttgaatttggcctctccgaaactagctctgtatga

SEQ ID NO: 454 - DNA, 741 bp, Synechocystis sp.
ctttgtttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatgattaaattattcaaccaagctagccgaattttttttggcattgccctcccctgtctaattttcctgggggggattttttccctgggtaacaccgccctagccgctgacctagcccatggtaaagctatctttgccggtaactgtgccgcttgtcataatgggggccttaatgccatcaaccccagcaaaaccttaaaaatggcagacttggaagccaatggtaaaaattccgtggcggcaattgtggcccagatcaccaatggtaatggcgctatgcctggctttaagggtcgcatcagtgacagcgacatggaagatgtggcggcctacgtgcttgatcaagcggaaaagggctggtagatttaaatacccagcaaatacccagcaaattggagctctgcagagctttcgttcgtatcatcggtttcgacaacgt

SEQ ID NO: 455 - DNA, 706 bp, Synechocystis sp.
tttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatgactgatcccctcacccctgctatcagtgaccgcatttgtaaacacatgaacgaagaccatgcctcggcgatcgccctttatgcccaggtttttggtcaacaaaccgatgtaaccatggcccagatgcaggccatcgatcccacgggtatggatttagtggtggaaagtgagggtggctcaaaaactatccgcattgaattcgagcaacccctgaaggattctgaagatgcccaccaagtattgattgccatggctaagcaggcccggagtgttggtaaaaatagctaatttgctccatggattctgccgctacctggacaaccgttaaacgtcatttaaatactcagcaaatacccagcaaattggagctctgcagagctttcgttcgtatcatcggtttcgacaa

SEQ ID NO: 456 - DNA, 1213 bp, Synechocystis sp.
aactctttgtttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatgataaattcagcagttcgctccctggccattgtggggggagtgcatggtaatgaaaggacgggggtggaggtggtgcgtcgctggcaacagaaagattttgctcgatattttccggcattgaagtgtcactatttcttggctaatccccgggcgatcgccgccaatcgtagatatattaaccaggacttaaaccgttgttttcggccccaggaccgcaaaaacccctatctaatgggctatgagcagttgcgggctcggcagttggcccatcaaatttccctggcggggattgatttcattgtggatttgcacaccaccactgcggccatgggcacaactttgattttaaactgcccccatcccctgctcctcaacctagcggcttatctcagcgcccaggatgaggaaattcgagtgttgcagtattctccccaaaaggatttaccctacattcgtggcctgtgtgaattaggcttaaccatcgaactaggccccgtcccccagggggtctatgacccaacggcgatcgccaaaacccaacggaccttggcccgaattctagcctatctccaggcctcgacctccggtaatgttccagcggcggataactgcactgtttatcagcagatagacactattgattatcccagggatgaacaaggacagattgtggcggaaattgcgccccacatccgggattaccaggcgattaaaccaggcacaccattgttttaccatcgccggggtaatgttacgccttaccagggagctgcgacggtttaccccgtatttattggtgaagcggcctatgtggaaaagggcattgccatggcgttaacccagcgcaaaaccattgccatttgaatttaaatacccagcaaatacccagcaaattggagctctg

SEQ ID NO: 457 - DNA, 1459 bp, Saccharomyces cerevisiae
ttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatgatttccagactgccaacatcattggccagaaatgttgcacgtcgtgccccaacttcttttgtaagaccctctgcagcagcagcagcattgagattctcatcaacaaagacgatgaccgtcagagaggccttgaatagtgccatggcggaagaattggaccgtgatgatgatgtcttccttattggtgaagaagttgcacaatataacggggcttataaggtgtcaaagggtttattggacaggttcggtgaacgtcgtgtggttgacacacctattaccgaatacgggttcacaggtttggccgttggtgccgctttgaagggtttgaagccaattgtagagtttatgtcgttcaatttctctatgcaagctatcgatcatgttgtcaattccgctgcaaagactcactacatgtctggtggtactcaaaaatgtcaaatggtcttcagaggtcctaatggtgctgcagtgggtgttggtgctcaacattcacaggacttttctccttggtacggttccattccagggttaaaggtccttgtcccttattctgctgaagatgctaggggtttgttaaaggccgccatcagagatccaaaccctgttgtatttttagagaacgaattgttgtacggtgaatcttttgaaatctcagaagaagctttatcccctgagttcaccttgccatacaaggctaagatcgaaagagaaggtaccgatatttccattgttacgtacacaagaaacgttcagttttctttggaagccgctgaaattctacaaaagaaatatggtgtctctgcagaagttatcaacttgcgttctattagacctttagatactgaagctatcatcaaaactgtcaagaagacaaaccacttgattactgttgaatccactttcccatcatttggtgttggtgctgaaattgtcgcccaagttatggagtctgaagcctttgattacttggatgctccaatccaaagagttactggtgccgatgttccaacaccttacgctaaagaattagaagatttcgctttccctgatactccaaccatcgttaaagctgtcaaagaagtcttgtcaattgaataaatttaaatacccagcaaatacccagcaaattggagctctgcagagctttcgttcgtatcatc

SEQ ID NO: 458 - DNA, 1102 bp, Sinorhizobium meliloti
ttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatggcgcccgatatccgcccgctcgtcgccggcaactggaagatgaatggaacacgtgcgtctctggaccagatcaaggcaatggccgagggcgtcaaaggcgacctttccgcgagggttgacgccctgatctgcccgcccgccacattgctttacgttgcgaccgcgctttgcgacgacagccctttgatgatcggggcgcaggactgccaccagaaacagtcgggagcccataccggcgaagtctcggctgaaatggtcgccgattgcttcggcacgcatgtgatcgtcggccattccgaacggcgcaccgatcatggcgaaggcgacgcactggtgcgtgccaagacggaggccgcgcatggagcggatctcgtcgcgatcgtttgcgtcggtgagacggaagaggagcgcaaggccggccggacgctcgatattctgaagcgccagctctccgagagcctgccggatcaggcgacggccgaaaataccgtgattgcctacgaacccgtgtgggcgatcggcaccggcctgacgcccaccgtgtccgacgtcgaggaggcgcacgccttcatgcgccgcgagctcgtctcgcgcttcggcgcggaaggcggcaagatgcgcatcctctatggaggttccgtcaagccctcgaatgcgaaggaactcatgggcgttgccaatgtcgacggcgccctgatcggcggcgcgagcttgaaagccgatgatttcctcgccatctacagggcctatgaagaattgactgcctgactcgagacccagctttcaaatacccagcaaattggagctctg

SEQ ID NO: 459 - DNA, 786 bp, Xanthomonas campestris
ttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatggaaacggtacggcagctgttggggatgaagcaggttgaggtgttttccgtcgcggccgacgccgcggtgatcgaggccatccgtttgatggccgacaagagcatcggtgcggtgttggtgatggagggcgagcgcctggtcggcatcgtgtccgagcgggattacgcgcgcaaggtggtgttgcgggaccgttcctcgtccagcaccagtgtggccgagatcatgagccacgcggtggtgacggtgtcgcccgcagactcggtcgagcactgcatgcagctgatgaccgatggccgtttccggcatctaccggtggtggataacggccgcgtgcagggcgtgatttccatcggcgatctggtcaaggcggtgatcgaagcgcagcaacacgatatcgaccagttgcagcgctacatcgccagctgaatttaaatacccacaaatacccagcaaattggagctctgcagagctttcgttcgtatcatc

SEQ ID NO: 460 - DNA, 1621 bp, Agrobacterium tumefaciens
ttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatgacggaaaaaagagttcagcctttggcgcgtgatgcaatggcctatgtcctcgcaggcggaagaggaagccgtctgaaggaactgacggaccgccgggcaaaacccgcggtttattttggcggcaaggcgcgcatcatcgattttgcgctttccaacgcgctcaattccggcatccgccgcatcggcgtcgccacgcaatataaggctcactccctcatccgccacctgcaacgcggctgggacttcttccgtcccgagcgtaacgaaagcttcgacattctgccggcttcgcagcgcgtgtccgaaacgcaatggtacgaaggcaccgccgacgcggtttaccagaacatcgacatcatcgagccctatgccccggaatatatggtcattctggccggcgaccatatttacaaaatggactacgaatacatgctgcaacagcatgtggattccggtgccgacgtcacgatcggctgccttgaagtgccgcgcatggaagcgaccggcttcggcgtgatgcatgtgaacgaaaaagacgagatcatcgacttcatcgaaaagccggccgatccgcccggcattcccggcaatgaaggttttgcgctcgcctcgatgggcatctacgtcttccacacgaagttcctgatggaagcgctgcgccgcgatgccgccgatccgacctccagccgcgacttcggcaaggacatcattccctatatcgtcgaacacggtaaagccgttgcgcaccgcttcgctgattcctgcgtgcgttcggatttcgagcacgaaccctactggcgagacgtcggcaccatcgatgcctattggcaggccaatatcgacctcacggatgtggtgccggacctcgatatctacgacaagtcctggccgatctggacctatgcggaaatcaccccgccggcgaaattcgtgcatgacgatgaagatcgccgtggttcggccgtatcgtcggtcgtctcgggcgactgcatcatttccggtgcagcgctcaaccgcagcctgctgttcacaggcgtgcgcgccaattcatactcccgccttgagaatgccgtagtactgccgagtgtgaagatcgggcgtcatgctcagctcagcaatgtcgtcatcgaccatggcgtggtcattccggaaggactgattgtaggagaagaccccgaactggatgccaaacgcttccgccgcacggaaagcggcatctgccttatcacccaatcgatgatcgacaagctggacctgtagatttaaatacccagcaaatacccagcaaattggagctctgcagagctttcgttcgtatcatc

SEQ ID NO: 461 - DNA, 1381 bp, Escherichia coli K12
attcatttatttgtcagctttcaaactctttgtttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatggacgagttagacggcatcaaacagttcaccactgtcgtggcagacagcggcgatattgagtccattcgccattatcatccccaggatgccaccaccaatccttcgctgttactcaaagctgccggattatcacaatatgagcatttaatagacgatgctatcgcctggggtaaaaaaaatggcaagacccaggaacaacaggtggtcgcagcgtgtgacaaactggcggtcaatttcggtgctgaaatcctcaaaatcgtacccggtcgcgtgtcaacagaagttgatgcacgcctctcttttgataaagaaaagagtattgagaaggcgcgccatctggtggacttgtatcagcaacaaggcgttgagaaatcacgcattctgatcaagctggcttcgacctgggaaggaattcgcgcggcagaagagctggaaaaagaaggtattaactgcaacctgacgctgctgttttcttttgcacaggcacgggcctgtgcggaggcaggcgtttttctgatttcgccgtttgtcgggcgtatttatgactggtatcaggcacgcaagccgatggacccgtatgtggtggaagaagatccgggcgttaaatcggtgcgcaatatctacgactactataagcaacaccactatgaaaccattgtgatgggcgcgagcttccgtcgcaccgaacaaatcctcgccttaaccggctgcgatcgactgactatcgcaccgaatttactgaaggagctgcaggaaaaagtttcgccagtggtacgtaaattaatcccaccttctcagacgttcccacgcccagctcccatgagcgaagcggagttccgttgggagcacaatcaggatgcgatggcggtagaaaaactgtctgaaggcattcgtctgttcgccgttgatcaacgcaaactggaagatcttcttgccgccaaactataaaccagccacggagtgttatatgtcccgaaaagaccttgatttaaatacccagcaaatacccagcaaattggagctctgcagagctttcgttcgtatcatcg

SEQ ID NO: 462 - DNA, 1886 bp, Bacillus subtilis subsp. subtilis str. 168
ctttgtttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatgagtaaaaaaccagctgcactcatcattcttgatgggttcggattacgtaacgaaacagtagggaacgcagtcgctttagcgaaaaaaccgaattttgaccgctattggaaccagtatcctcatcaaactttgactgcttcaggcgaggctgtaggtcttcctgaagggcaaatggggaactccgaagtaggtcacttaaatatcggtgcgggacgtattgtgtaccaaagcttaacacgcgtaaatgttgccattcgtgaaggagagttcgaacgcaatcaaacattccttgacgcgatcagcaacgcgaaagaaaacaacaaagccttgcacctgttcggtcttttatctgacggaggcgtgcacagccatatcaatcatttattcgcactgttaaagcttgcgaaaaaagaagggctgacaaaggtttatatccatggcttccttgacggccgtgatgtaggtccgcagacagcgaaaacgtacatcaaccagttgaacgatcaaatcaaggaaatcggtgtaggtgaaatcgccagcatttccggacgttactactctatggaccgcgacaaacgctgggaccgtgtagaaaaagcgtaccgcgcaatggcgtacggcgaaggcccatcttaccgcagcgccctggatgttgttgatgattcatatgcaaatggtatctacgatgaattcgtgattccatctgtcatcacaaaagaaaacggtgagcctgttgcgaaaatccaagacggcgattctgtgattttctataatttcagaccggaccgcgccatccagatttccaacacgttcacaaacaaagacttccgtgacttcgaccgcggcgagaattatccaaagaacctgtatttcgtctgcctgactcacttcagtgaaacagttgacggctatgtagcgtttaaaccgataaatcttgataacacagtcggagaagtattatctcagcacgggttaaaacagcttcgaattgcagaaactgaaaagtatccgcacgtcacgttctttatgagcggcggccgtgaagctgaattcccgggtgaagagcgtattctcatcaactcgcctaaagttgcaacgtatgacttgaagcctgagatgagtgcgtatgaagtgaaagacgcgcttgtcaaagaaattgaagctgacaagcatgacgcgatcattcttaacttcgcaaaccctgatatggtcggccactccggaatggttgaaccaacaattaaagcaattgaagcagtggacgaatgcttgggcgaagtcgttgacgcgatccttgctaaaggcggacacgctatcattaccgctgatcacggtaatgctgacattctgattacagaatcaggcgaaccgcacactgcgcatacaacaaacccagtccctgtgattgtaacgaaagaaggcattacgctgcgtgaaggcggaatcctaggcgaccttgcaccaacgttattagaccttcttggtgttgaaaaaccgaaagaaatgacaggaacatctttaattcaaaaataactcgagacccagctttcaaatacccagcaaattggagctctgcagagc

SEQ ID NO: 463 - DNA, 1631 bp, Pseudomonas fluorescens PfO-1
ctttgtttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatggctgaacaaggttcgccgcgccgctttgcgcgcattgatcgactccccccttacgttttcaacatcaccgccgaactgaagatggccgcgcgacgtcgtggcgaagacatcatcgacttgagcatgggcaaccccgacggcgccacaccgccgcacatcgttgaaaaactggtgcaggttgcacaacgcgaagacacccacggctactccacgtccaagggcattccgcgcctgcgccgggcgatttccaactggtacaaggaacgctacgaggtcgagatcgacccggaaagcgaagccatcgtcaccatcggttccaaggaaggcttggcgcacctgatgctggcgaccctggatcagggcgacaccgtgctggtgccgaacccgagctacccgattcacatctacggtgccgtgattgccggcgcccaggtgcggtcagtgccactggtgccgggcgtggatttcttcgccgagctggagcgggcgattcgcggctcgatcccgaaaccgaagatgatgatcctcggcttcccgtcgaacccgaccgcgcagtgcgtggagctcgacttcttcgaacgggtgatcgccctcgccaaacagtacgacgtgctggtggtgcacgacctggcttacgccgacatcgtctacgacggctggaaagccccgtcgatcatgcaggtgccgggcgccaaggacatggcggtggagttcttcaccctgtccaagagctacaacatggcgggctggcgcatcggcttcatggtcggcaacccggaactggtcagcgccctggcgcggatcaagagctaccacgactacggcaccttcaccccgctgcaggtggccgcgattgctgcgctggaaggtgatcagcaatgcgtgcgcgacatcgccgaacagtatcgccagcgccgcaacgtgctggtcaaaggcctgcatgaactgggctggatggtcgagaacccgaaagcctcgatgtacgtgtgggcgaagattcccgaagcctacgcgcacctcggctcgctggagttcgccaagaagctgctggccgaggccaaggtctgcgtctcgccaggtgtcggctttggcgagtacggcgacgatcacgtgcgcttcgcgctgatcgaaaaccaggaccggattcgccaggcggtacgcgggattcgcggaatgttccgggcggatgctctgggcaccaagtaactcgcgaattgcacccacaaaaaaaccgcatcactgcggtttttttgtgtctgcatcttcttgactcgagacccagctttcaaatacccagcaaattggagctctgcagagctttcgttc

SEQ ID NO: 464 - DNA, 1831 bp, Pseudomonas syringae pv. tomato str. DC3000
ttgtttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatggcgaagtcggttcaactcatcaaagatcatgacgttaagtggattgatctgcgcttcacggacactaaaggtacgcagcaccacgtgaccatgccagctcgcgatgcgctggaagacgacttcttcgaagtcggcaagatgttcgacggctcctccatctctggctggaaaggcatcgaagcctccgacatgatcctgctgccggacgacgaaaccgcagttctggatccgttcaccgaagagccgaccctgattctggtgtgcgacatcatcgaaccgtcgaccatgcaaggttacgaccgtgacccacgcgccattgctcgtcgcgccgaggaatacctgaagtccaccggtatcggtgacaccgtattcgcaggtccggagccagaattcttcatcttcgacgaagtgaaattcaaatccgacatctccggttccatgttcaagatctactctgaacaaggttcgtggatgtccgaccaggatgtggaaggcggcaacaaaggccaccgccctggcatcaaaggtggttacttcccggttccgccgtttgaccatgaccacgaaatccgtaccgccatgtgcaatgctctggaagaaatgggccagaccgttgaagttcaccaccacgaagtggcgaccgctggccagaacgaaatcggcgtgaagttcaatacgctggtcaagaaggctgacgaagttcagaccctgaagtacgttgttcacaacgttgctgacgcttatggccgcactgcgaccttcatgccaaagcctctgtacggtgacaacggttcgggcatgcacgtgcacatgtccatcgccaaagatggcaaaaacaccttcgcaggtgaaggctatgccggcctgtccgacatcgcgctgtacttcatcggcggcatcatcaagcacggtaaagccctgaacggcttcaccaacccggcaaccaactcctacaagcgtctggttccaggcttcgaagccccggtcatgctggcctactcggcacgtaaccgctctgcctcgatccgtattccttacgtcaacagcccacgcggccgtcgtatcgaagcacgcttcccggatccggcagccaacccgtacctggccttcgcggctctgttgatggctggcctggacggcatccagaacaagatccaccctggcgacgcagctgacaaaaacctgtatgacctgccgcctgaagaggccaaagagatcccacaggtttgcggcagcctgaaagaagcgctggaagaactggacaagggccgtgcgttcctgaccaaaggcggcgtattcagcgacgacttcatcgacgcttacatcgcactgaaaagcgaagaagaaatccgcgttcgcaccttcgtgcacccactggaatacgagctttactacagctgctgatccagccgcgccagcattgatggcgtaacaagagacctccttcgcagacctcgagacccagctttcaaatacccagcaaattggagctctgcagagctttcgttcgtatcatcggtttcgacaa

SEQ ID NO: 465 - DNA, 1561 bp, Sinorhizobium meliloti
tttatttgtcagctttcaaactctttgtttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatgaggaccagtcatttggcacagatgtcgaaacgcagcgcagtcgagccgttccacgccatggacgtgctggccgaagccacgcggcggcgcgattccggccacccggtcatatccatggcggtcggtcagcccgcgcatccggcgccgaaagcggcactcgatgctgcaaggcgggcgctcgatcacggtcggctcggctatacggacgctcttggcacacactccctgaagagggcgattgccgctcattatcacagccggcacggcatcacgctcgatccgcagcggattgcggtgacgaccggatcgtcggccgggttcaatctcgcttttctcgccctgttcgatccgggcgatcgcgtggccatcgcccggccgggctatcccgcctatcgcaacatcatggccgcgctcggcctcgaagtggtcgagatcgaagccaatgccgaggccggcttcactttgaccccggacagcctcgagggcgccgcggcacgtgccggaaaaccgctgaagggcgtgcttctcgcaagccccgcgaacccgacgggaacggtgaccggcaaggcgcagctgaaggcgctcgccgactattgccgggatcactcgatcgccttcatttccgatgagatctatcacggccttactttcgccggggaggagacgacggcgcttgaagtcgccgacgacgcagtcgtgatcaactccttctccaaatattattgtatgaccggatggcgcatcggctggatggttctgcccgaggcgcgggtgcgtgccttcgagcgcatcgcgcagagcctctatatttcgccgccggagctatcacagattgccgcagaggcggctctcggcgcgcatgaggagctcgacggctacaagcgcgcatatgccgcgaaccgcgcattgctgctcgaacggctgccgcagatcggcttttcgatcgcctcgccgatggacggcgcattttacgcctatgcggatgtcagccgcttcaccaatgacagcatggccttcgcccgtcggatgctggccgagatcgacgttgcggcaacgcccggcttcgacttcgatcccctcgaagggcatcgcaccatgcgcttttcctatgcgggcgcggctaccgagatggaggaggcgatgaaccgcatcgcgcgctggctggcctagctcgagacccagctttcaaatacccagcaaattggagctctgcagagctttcgttcgtatcatc

SEQ ID NO: 466 - DNA, 1841 bp, Sinorhizobium meliloti
tttcaaactctttgtttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatggaggagcgaatgctcgacaagcggaaattctacatcgacggcaaatgggttgagccggccacgcagaacgatcttctggtgctcaatccggcgaccgagaagccgatagcggtcatctcgctcggcaccgccgtcgacgtcgaccgggcggttgcagccgccaagaaggccttcgcgagctatagccggacgagcgtcgaggaacggctggcactgctcgaaaagctgctcgcgatctacaagcgccgttacgatgaaatggccgacaccatcacggccgaactcggtgcgcccagaacgatgagccacgagcagcaggcggatgtgggcgtcggtcatctgcagggcttcatcgatgccctgaagcgcctgaaactcagggaaaagctgccgaatggcgacacgctcctgcgtgagccgatcggcgtctgcggtctcatcacgccgtggaactggccggtcaaccagatcgcgctcaaggtcgtcccggcgcttgcgaccggctgcacctgcgtcctgaaacccagcgagttcacgccgctgaacgccatgctctacgccgagatgatcgaggaggcgggcttcccggccggcgtcttcaacctcgtcaacggtgacggcatccatgccggggcggcgttgtcgaagcacaaggacatcgacatgatgtccttcaccggttcgacccgggccggtatagccgtcagcaaggacgccgccgatacggtcaagcgcgtcacgctcgaactcggcggcaagtcgccgaacatcgtcttcgccgatgccgatatcgaggagcgggtgaccgccagcattctcgaatgcttcaacaattccggccagtcctgcgatgccccgacacgtatgctcgtcgagcgcagcgcctatgacgaggtcgtggaaatcgccaggcgcgtcggcatggaggcgagggtcggcgatccgacgaaggttggctcccatatcggcccgctcgtcagccatattcagttcgagcgggtgcaggcactgatcgaagccggcgttgccgaaggcgcgaccctgctggccggcggccccggcaagccggaaggcttcgagaccggatatttcgtccagccgacgatcttcgccgatgtcgacaattccatgcggatcgcgcgcgaggaagtgttcggaccggtgctttcgatcattcccttcgatacggaagaggaggcgatcgcgatcgccaacgacacgaattacggcctcgcggcctatgtgcagacccgcgaccgcgaaagggcggagcgggtggcgtcgcgcctccgggccggcatggtgcacatcaacggcggtccccaccgctacggaagccccttcggcggctacaagcagtccggcaacggccgggaaggcgggatgttcgggctcgaggacttcctggaggtcaaaacggttcacctgccggatgcggcctgactcgagacccagctttcaaatacccagcaaattggagctctgcagagctttcgttcgtatcatcggtttcgacaacgttcgtca

SEQ ID NO: 467 - DNA, 1128 bp, Xenorhabdus nematophila
ttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatgggacatccattagttatgggaaactggaaattaaatggcagtacccacatggttaacgacctgattgcaggcctgcgtaaagaactgagcaatgttgacggctgtggcgtcgctatcgcaccaccaacagtttatgtttctctggcaaaaaatgcactggctggcagccgtatcgctctgggtgcacaagatgttgacgttaacctttctggtgcattcaccggcgaaacatccgctgaaatgctgaaagatgtgggcgcgaaatatatcattatcggtcattctgagcgccggacttaccataaagaaagcgatgagctgattgcgaaaaaattcaccatcctgaaagaacaaggactgattcccgttctgtgcattggtgaaaccgaacaggaaaatgaagcaggccaaaccgaagccgtatgcgcacgccaaatcgatgctgttctgaatacactgggtgccgaagccttcaaagataccgttatcgcatacgagcccgtctgggcaattggtacgggtaaatcagcgactcctgcacaagcacaggctgttcataaatttatccgtgatcatatcgcgaagcaagatgcagctatcgctggacaggtcatcattcaatacggcggttccgtcaatgccggcaacgcggcagaactgttcacccagccagatatcgatggtgctctggttggtggtgcatccctgaaagccgatgctttcgccgttattgtgaaagccgctgccgaagcgaaaaaggcataactcgagacccagctttcaaatacccagcaaattggagctctgcagagctttcgttcgtatcatc

SEQ ID NO: 468 - DNA, 3041 bp, Bacillus halodurans
  misc_feature (1)..(588): n is a, c, g, or t
  misc_feature (2634)..(3041): n is a, c, g, or t
  unsure (1)..(3041): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcttgtttgttgattaacccttaattaatccgggcgcgcctgatttatcacaagtttgtacaaaaaagcaggctcctgcaggaccatgtgtggaattacaggctgggtagattggcgacgcaacttgcaaaatgagacggaaacgatcaaacagatggcggaaacgcaaacacatcgagggcccgatgatttgaacgtttggacagagaagcatgctgccttaggccactcgcggctcattgtcgttgatccggaaggcggttgtcagccgatgatgagggagaggaatggcaaacgctatacgatcgtgtataacggcgaattatacaatacagaagatttacggaaagagcttatagtaaaaggttaccaatttcaaggccattcggatacggaagtattactcgtgtcttatatcgaatggggttaccaatgtgtggagaagttcaatggcatttttgcgtttgcgatttggaatgataaagatcagagcttgtttatggcccgcgaccgattaggggtaaagccgctattttatactgttcgccatggatttttactttttgcaactgagataaaagcgctgcttgctcatcctgaaatcgagccggttcttaccgaagaagggctatcggaagtgctcgggcttgggccatcacgttcaccgggtaatggcgtttttgatgatattcaagagttgcgaccagctcatcttttgacatacgatcgcaatggggcaaaagtgagccgttattggagattaaaatcaatggctcattctgaagatgcgatggaaacggccgcccatcttcgcgacttattagaagatactgtcgaacgtcagctatttgcagatgttccagttggaatgtttctttcgggtggagtcgattcgagtgctttaacggcaattgcggcgctgatttacgagcgagaagggaagggcctgattcggacgtactcgattgattatgacgaaaatgataagtattttaaagcgaatgactttcaaccgaatgccgatggaccttgggttgaaaaagtttcaactacttttcgaacgaaccaccacaatgctgtcatctcgatcgaggagttggctaatcaattaaagcgagcggtagagcttcgtgacttacctggaatggccgatgtagactcttcattgtattggttttgtaagcaaatcaaaaaagatgttaccgttggcttatcgggtgaatgtgctgacgaaatttttggtgggtatccttggttccataagccagaggtcatgaattttaatgggtttccttggatgagatcagcggatgaacgtcaggagcttcttcatgaacgatggcgccaaaagttaaatttgcccaaatacgttcatgatcgttataaagaaacgattgccgaaacgcctcgcttcgaagaggacacaccggaagaagcgcgacgcagggaaatttcgtatttgaacatggtctggtttatgacaacgcttcttgatcggaaggatcgaatgagcatgggagcgagcttagaagtgcgagttccattttctgaccaccgaattgtagaatacgcttggaacattccgtgggaaattaaacaattcggagggagagagaagggcattttacgaaaagcgttggaaggcatcctcccagatgaagtgttataccggaaaaaaagtccttatccgaaaacgcaccatccaaaatacacgaaaatggtccagcaagagatggaacgaattctcggtcaaagcgatagccccctctttgatgtagtgaaccggaaaaagttaaaagagttaaccgaaactggtggcaaggcattaacgacaccttattttgggcagcttatgacaggcccgcagctccttgcccacttcatccaaatggagcattggcttaagcattacaatatcaaattaattggttaacgattgtgccccctcgtttgttgaaaaacgaggggcttttctcgagacccagctttcttgtacaaagtggtgataaattggagctctgcagagctttcgttcgtatcatcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 469 - DNA, 1763 bp, Pseudomonas fluorescens PfO-1
aaaaaagcaggctcctgcaggaccatggcgtactaccgcactcctcatgacgttaccgctctgcctgcctggcaagcgttgaaagatcaccgccaagccatgcaggatttcagcatgcgcgaagccttcaacgccgatccgcagcgcttcaatcagttcactctcagcagctgcggactgtttctcgactattcgaagaatctgatcaacgccgagacccgcaacctgctggtgggtctggccaatgaagtcgatctcaaaggcgcgatcaaggcgctgttcgacggcgaaatcgtcaactcctccgaaggccgcccggcactgcacaccgccctgcgtcgcccggtcggcgacaagctgtcggtcaacggtgtcaacgtgatgcctgaggtacacaaggtgctgaaccagatcaccgatctcgtgggccgcatccacgacggtctgtggcgcggttacaccgagaagccgatcactgacgttgtgaacatcggcatcggcggctcgttcctcggccccgagctggtctccgaagccctgctgtcctacgcccagaaaggcgtgcgttgccattacctggcaaacatcgacggcagcgaattccacgagctgacgcaaaaactgcgcgccgagaccacgctgttcatcgtttcgtcgaaatcgttcaacaccctcgaaaccctgaaaaatgcccaggccgcacgcgcctggtacctggcccagggtggttcggaagccgagctgtatcgccacttcatcgccgtatcgagcaacaatgccgccgccgtggccttcggtatccgcgaagaaaacatcttcccgatgtgggactgggtcggcggtcgttactcgctgtggtcggccatcggcctgccaatcgcgctggccatcggcatgtccaacttcaaggaactgctgtccggtgcctacaccatggaccagcatttccagagcgcgccgttcgaacagaacatgccggtgctgctggccctgctcggcgtgtggtacggcaacttctggggcgcgcaaagccacgcgatcctgccgtacgaccactacctgcgtaacatcaccaagcacttgcaacagctggacatggaatccaacggcaagagcgtgcgtcaggacggcaccccggtgtcgaccgacactggcccggtgatctggggcggcgtcggttgcaacggtcagcacgcttatcaccagttgctgcaccaagggacccaactgatcccggccgacttcatcgtgccgatcgtcagcttcaacccggtctccgaccaccatcagtggctgtacgccaactgcctgtcgcagagccaggcgctgatgctcggcaagaccctgccggaagccgaagcggaactgcgcgacaagggcatgagcgaagaccaggtgcagaaactcgcaccgcacaaggtgatcccgggcaaccgtccgagcaacaccctggtggtcgagcgcatcagcccgcgtcgtctcggcgcactggtggcgatgtacgaacacaaagtcttcgtgcaaagcgtggtctggggcatcaacgccttcgaccagtggggcgtggagctgggcaaggaactgggcaagggcgtgtacaaccgtctggtcggcagcgaagaaaccgccgctgaagacgcgtccacccaaggcctgatcaactacttccgcggccgtcaccgcggctgatcccgccctgaacacaccccctcgccatgagggggtgtttgttcacagctcgagacccagctttcttgtacaaa

SEQ ID NO: 470 - DNA, 3222 bp, Bacillus subtilis subsp. subtilis str. 168
  misc_feature (1)..(513): n is a, c, g, or t
  misc_feature (2721)..(3222): n is a, c, g, or t
  unsure (1)..(3222): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaagcaggctcctgcaggaccatggtcagcatccgccgcagcttcgaagcgtatgtcgatgacatgaatatcattactgttctgattcctgctgaacaaaaggaaatcatgacaccgccgtttcggcttgagacagaaataacagattttcctctggctgtcagggaggaatactcccttgaagcaaaatacaagtacgtctgcgtatccgaccatcctgtgacatttggaaaaatccattgcgtcagagcatccagcggccacaaaacggatctccaaattggcgcggtcatccggacggcagcgtttgatgacgaattttattatgacggagagctgggcgccgtttataccgcggatcataccgtatttaaagtatgggcgcctgctgcaacctcagctgctgtcaagctttcacaccccaataaaagcgggcgcacattccaaatgactcgcttggaaaaaggcgtctatgccgttacggtcacaggtgaccttcacggatatgagtatttgttttgcatctgcaacaattcagaatggatggaaacagttgaccagtatgccaaggctgtgactgtaaatggagagaagggcgtcgtcttgcgcccggatcaaatgaaatggactgctcctcttaaaccattctcacaccctgtggatgccgtcatctatgagacgcatcttcgcgacttctccatccatgaaaacagcggcatgataaacaagggaaaatacttagcgctgacggaaactgatacacaaaccgcaaatggcagttcttcgggattagcgtatgtaaaagagcttggtgtgacacatgtggagcttctgccggtgaatgattttgccggagttgatgaagagaagccgcttgatgcatacaattggggatataacccgcttcatttctttgccccggagggaagctatgcctcaaatcctcatgatcctcaaacgagaaaaacagagctgaaacaaatgatcaataccctgcatcagcacggtctgcgagtcattctggatgttgtttttaaccatgtgtataagagggagaattccccctttgaaaagacagtgcccggttattttttccggcacgacgaatgtgggatgccatcaaacggcaccggcgttggcaatgatattgcatcagaaagaaggatggcaagaaaattcattgcggattgcgtggtctattggcttgaagaatacaatgttgacggcttccgctttgatctcctcgggattttagatattgacaccgtgctttatatgaaagagaaagcaactaaggcaaagcccggaatcctgctttttggagaagggtgggacctggctacaccgctgccgcatgaacagaaagctgctttggcgaacgcgccaagaatgccgggcatcggcttttttaatgatatgtttcgtgacgctgtaaaagggaacacctttcaccttaaggcaacagggtttgcgctcggcaacggtgaatcagcacaagctgtgatgcatggaattgccgggtcttccggatggaaggcattagcaccgattgttccggaaccaagccagtccatcaattatgtcgaatcacacgacaatcacaccttttgggataaaatgagctttgcgcttcctcaagaaaatgacagccgaaagcgaagcaggcaaaggcttgcagccgcgattattttgcttgcccaaggggtgccgtttattcacagcggccaggaatttttccggacgaagcagggagtggaaaacagctatcaatccagtgacagcatcaaccagctcgactgggatcgccgtgaaacattcaaagaagatgttcactatatccgcaggctgatctcgctgagaaaagcgcatcctgcattccgtcttaggtccgctgcagacatccagcgccatcttgaatgcttgacgctaaaagaacaccttatcgcatacaggctttatgatcttgacgaggttgacgaatggaaagatatcattgttatccatcacgcgagtccagactccgtcgagtggaggctgccaaacgacataccttatcggcttttatgtgatccatcaggatttcaggaagacccaacagaaatcaagaaaacggttgcagtaaacggcatcggaacggttatcttatatttagcatcagatcttaagagttttgcttgactcgagacccagctttcttgtacaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 471 - DNA, 3107 bp, Escherichia coli
aaaaaagcaggctcctgcaggaccatgatgcaggtcagcagaaggcagttctttaagatctgcgctggcggtatggcaggcaccacggcagcggcactgggttttgcacccagcgtagcactcgcggaaacccggcagtataaactgctgcgcacccgcgaaacccgtaatacctgcacctattgttccgtaggctgtgggctgttgatgtacagcctcggtgacggagcaaaaaacgccaaagcatctatcttccatatcgaaggcgatccggatcacccggtcaaccgcggtgcactttgtccgaaaggcgctggcctggtggatttcatccactccgaaagccgtctgaagtttccggaataccgtgcgccaggttctgataaatggcagcaaatcagttgggaagaggcgtttgatcgcatcgccaaactgatgaaagaagaccgcgatgctaactacattgcgcaaaacgccgaaggcgtgactgttaaccgctggctctccaccgggatgctgtgtgcttccgcgtcgagtaacgaaaccggctatttaacgcaaaaattctcccgcgcgctgggtatgctcgcggtcgacaaccaggcgcgtgtctgacacggaccaacggtagcaagtcttgctccaacatttggtcgcggtgcgatgaccaaccactgggtcgacatcaagaacgccaacctcgtcgtggtgatgggcggtaacgccgctgaagctcacccggtcgggttccgctgggcgatggaagccaaaattcacaacggcgcgaagctgattgtgatcgatcctcgctttacgcgtacggcggcggtagctgactactatgcccctattcgttccggtactgacattgctttcctgtcaggcgtattgctgtacctgctgaacaatgaaaaattcaaccgcgaatacaccgaagcctataccaacgccagcctgatcgtgcgtgaggattacggctttgaagatggcctgttcaccggctacgacgcggaaaaacgcaagtacgataaatcctcctggacttatgaactggacgaaaacggcttcgccaaacgcgataccacgctgcaacatccgcgctgcgtgtggaacttgctgaaacagcacgtttcccgctacacgccagatgtggttgaaaacatctgtggtacgccaaaagacgcgttcctgaaagtctgcgaatacatcgcagaaaccagtgctcacgataaaactgcctcgttcctgtatgccctcggctggacgcaacactccgttggtgcgcaaaacattcgtacgatggcgatgatccagctgctgctcggcaatatggggatggcaggcggcggcgttaacgccctgcgcggtcactccaatattcaggggctgacggacctggggctgctgtcgcagagcctgccaggttacatgacgctgccaagcgagaagcagaccgatctgcaaacctaccttaccgccaacacgccaaaaccgctgctggaaggccaggtaaactactggggcaactacccgaaattcttcgtctctatgatgaaggccttctttggtgataaagcgacggcggaaaatagctggggctttgactggttgccgaagtgggataaaggctacgacgtcctgcaatacttcgagatgatgaaagagggcaaggtcaatggctatatctgccagggctttaaccctgttgcctcattcccgaacaaaaacaaagtgatcggttgtctgtcgaaactgaagttcctcgtcaccatcgacccactgaacactgaaacctctaacttctggcagaaccacggtgagctgaacgaagttgactcgtcgaagatccagaccgaagtgttccgtctgccatcgacctgcttcgcggaagagaacggttctatcgttaactcaggtcgctggttacagtggcactggaaaggtgcggacgccccggggattgcgctgactgacggcgagatcctctccggtatcttcctgcgcttgcgcaagatgtatgccgaacagggtggcgcgaacccggaccaggtgctgaacatgacatggaactacgccattccgcatgagccatcttcagaagaagtggcgatggagagcaacggtaaggcgctggccgatattaccgatccggcaaccggtgcggttatcgtcaagaaaggccaacaacttagttcgttcgcccaattgcgcgatgacggtacaacctcctgtggctgctggattttcgccggtagctggacgccggaaggcaaccagatggcacgccgtgataacgccgatccgtctggcctcggtaacacgctgggctgggcatgggcatggccgcttaaccgccgcattctgtataaccgcgcctccgcagatccgcagggtaacccgtgggatccgaagcgtcagttgctgaaatgggacggcactaagtggaccggctgggatattccggactacagcgcagcgcctccgggtagcggcgtcgggccgtttatcatgcagcaggaaggcatggggcgtctgtttgccctcgataagatggcggaaggtccgttcccggaacactacgagccgtttgaaacgccgctgggaactaacccgctgcatccaaacgttatctcgaacccggctgcacgtatctttaaagacgacgccgaagcattgggtaaagccgataagttcccgtatgtcggaaccacctatcgtctgaccgagcacttccactactggaccaaacacgcgctgttgaacgcgattttgcagccagagcagtttgtggaaatcggggagtcgctggcgaataaacttggcattgcccagggcgataccgtgaaagtctcctccaaccgtggctatatcaaagccaaagcggtggtgaccaaacgtattcgcacgctgaaagcgaacggcaaagatatcgataccatcggtattccgattcactggggctatgaaggcgtagctaaaaaaggctttattgccaatactttaacgccattcgttggtgatgcgaacacgcagacgccggagtttaagtccttccttgtgaatgtggaaaaggtgtaatagctcgagacccagctttcttgtacaaa

SEQ ID NO: 472 - DNA, 2417 bp, Xenorhabdus nematophila
  misc_feature (1)..(26): n is a, c, g, or t
  misc_feature (1881)..(2417): n is a, c, g, or t
  unsure (1)..(2417): unsure at all n locations
nnnnnnnnnnnnnnnnnnnnnnnnnnttcttgtttgttgattaacccttaattaatccgggcgcgcctgatttatcacaagtttgtacaaaaaagcaggctcctgcaggaccatgaaaaacatcaaccctagccagaccgaagcctggaaagcattgcagcaacattttgagcagataaaagatactcacctgcgagatctgtttgaacaggacaaggcgcgttttgcgacattctctgccacatttgacgatcagatgctggtggattattccaaaaaccgtattaccgcagaaacactggagaaattacaggctctggcgaaagaaactgatttatccggggctattcatagcatgttttccggtgaaaagattaaccgtactgaagatcgcgctgtattgcatattgctttgcgtaaccgcagtaactctccgattaaggttgatgaggaagatgttatgccgcaggtcaatgcggtactggcaaaaatgaaatcattcagtgagcgcattattagtggggagtggaaaggttataccggtaaagctattactgatgtggtaaacatcggcattggtggttcagatcttggcccatatatggtgacagaggcactgaaagcctataagaaccaccttaatatgcactttgtatccaatgtggatggcactcatatcgcggaaacactgaagtctctggatccggaaaccacgctgttcctgattgcatcgaagacttttaccacgcaggaaacgatgactaacgcacattctgcccgtgattggttcttgcaaagtgcagttgatgaagtacatgttgccaaacattttgcggcactttcaacgaatgaacaggaagtcagcaagttcggtattgatccgcaaaacatgtttgagttctgggactgggtcggcggccgttattctctttggtctgcgattggtttatccattgtcctgtccattggatatgataatttcgagcaattgctgaatggtgcccatgctatggataagcactttgcacaaactgctcctgaacagaatattccggttattctggcgctgattggcatctggtataacaatttctttggcgcagaaactgaagcgattctgccttatgatcaatatatgcatcgttttgctgcttacttccagcagggaaatatggaatcaaacggtaaatatattgatcgtaatggaagccctgtggattatcagaccgggccgattatctggggggagccgggcactaatggtcagcatgctttctaccagcttatccatcagggaacgaaactgatcccatgtgattttattgctccggcaatcagccacaatccaatcggcgatcatcacagtaaattattatctaacttctttgcacagactgaagcgctggcttttggtaaaactcaggctcaggtagaagccgaatttgttgctgccggaaagaatgtacaggatgtggcaaatgttgtgccattcaaagtgtttgagggtaatcgtccgactaactcaattctgttacgtgaaattacaccatttagtatgggcgcattaattgccatgtatgagcataaaatctttgctcagggcgcaattctgaatattttctcatttgaccagtggggcgttgaattgggaaaacaattggcaaatcgtatcctgcctgaactccacgattcagaaagcgtaaatagccatgacagctctacaaacgggctgattaatcgtttcaaagaatggcgttaatctgatttatcattttatataatcagctatcccctcaataacactatgagctcgagacccagctttcttgtacaaagtggtgataaattggagctctgcagagctttcgttcgtatcatcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 473 - DNA, 858 bp, Arabidopsis thaliana
tctcctcttctcagaaattagggttccgtctcaaattacgagcagatctcgtactctctgatgtctgaagatccggagtaccgttgcttcattggtgggcttgcttggacaacgtctgatcgtggtctcagagatgcctttgagaagtatggtcacctcgttgaggccaaggtggttcttgacaagttttctggtcgctcccgtggttttggattcatcactttcgatgagaaaaaagctatggatgaagctattgcagcaatgaatggaatggatttggatgggcgaactatcactgttgataaagctcagcctcatcagggtggtgcaggcagagataatgatggtgaccgtggtcgagaccgtggatatgatcgtgatcgcagtcgtccctctggtgggcgaggtggtggagattgctttaaatgtggcaagcctggacattttgcaagagagtgtccttctgaaagtagtagagatggtggtggaaggttcagctcaaaggatgataggtacagttcgaaggacgataggtatggtgcaaaagatgataggtatggtgcaaaggaggataggtatggtgcaaaggatgataggtacagctccaaggatgataggtacagctccaaggatgataggtatggtagtagggatggtggaggtagtcgctatggacctgatcgcagtggtgaacgcgctggaggacgcagccgggatggtggcagccgtggagctccaggaggtgagaggcacagtcgtgctccatatgaccgccccagagctggtggtttccactagaattctactccaaagggtatgtatgcattctgttattttaactttttctattgtatccct

SEQ ID NO: 474 - DNA, 620 bp, Arabidopsis thaliana
ttaattaacttctcctcttcaatcgcaagggcatagactgtaatttcgagatggggtcaagggaccaaaaggtaaaatggagctggagctcagccttaatcggagcagcatcagcaacagcagcagcttcactcctaagcgccaagccaaaagatccaacattccaccttatctccatagaccttacctcactgaaactaaacctccctgtcctcgacgcagagctaatgcttaccgtacacgtcactaaccctaacatcgcagccatccattactcctccaccaagatgacaatcctctacgatggcacggttcttggctcagctgaggtcaaagctggctcgcaaccggcgagatcttgtcagcttctccggctaccggcgcgtctggacggtatggagcttgcgcaacacgcgcggcagttcttttctgacgtggcgaatagagagatgaaacttgaggctaagcttactattgaaggagcggctaaggttttgtggtgggatcatagttttagggttcacgtggatagttttgtcaccgttgatcctgtttttcttgatgttattggtcaagagaataagtctcagatggatttgtttcttacttaaaggcgcgcc

SEQ ID NO: 475 - DNA, 1155 bp, Arabidopsis thaliana
ttaattaatggagattgattctgagatttctgattcatcgtcaagcaacaactcgatgatccctcctcttcctcaaaaccctattttgactgtgaaactctctccgatcattctccatgtacgacgttgctcgaagaacattaaaaagaagaaacgtacacggacgcctttgaagaagaagaagaagagtattagtagcagtgtcgaatctataatcggagtctcattcaaatccgcctctcagaaacattccaccaccgtaactcgcgacggaggagttaaaaagatttcctcttgggtgaaatctaggttacttggagaaggggcttacggttgtgtttacctagcgacaagtaaagatgacatatacaaaacagagagagcgatcaaaagtgctgatgttttaaaggcttggagtcttatgcacgaaggaaggatcttaagaagtttgcaatctccgttcgtgattcgttgttacggccatgaaattgcacgagaagggactggtcatcaatataatttgattctcgagtactgctctggacagtgtcttgcggatatgatcgaagataatcaaggagggataccggagtttgatgtcaagcagttcgctatagatgttctgtctggtctcagttacattcaccgcagaaacattattcattgtgaaattaaaccggacaatctcttactcagccctgttgatcaccggtttaggtctaatgggtttttgacaaagattgcagatttcggtttatcaatggagaaaggttctaaagagtatggaaacggacgtgggcacatgagagggacaactaggtacatggctccggagttaataggcggtgggcttctggattttgctgttgacatttgcgcgtttggatgttctgttttggagatgctaaccgggaaaagggtttggggagaatatggtgatttggctcatgatgattgggttgatttgatcggtcacagtgatctcactcctcaaatctcgattcggttatctgcagaagctcaagactttctgatgaggtgtttggttaaggagcctggttcgaggtggaccatcggtgaactcgtggaccatccgtttctctgttcagatgaagagttttctcacaatggatttgtttatgattgaggcgcgcc

SEQ ID NO: 476 - DNA, 965 bp, Arabidopsis thaliana
atggcttctctcaactccgacgttatcatgggtgaatcctcctccatctccgtaccttcatcttcgtccaagaactcgaaacgatttgaattaaagaagtggagtgctgtcgctctctgggcttggggtactttatcaccaaaccctaattcttcttctcacgttttattcttcttcttcttagttttttttatgattcactcttgtttggttttttcagatatcgttgttgataactgcgcaatttgtaggaatcacatcatggatctctgtaagctttttgaggtatctatactttgttttgaatcatcttgatggattatgcttagttctttgttgtgtgttttgtggttttaggtattgaatgtctagctaatcaagctagtgccactagtgaggaatgcactgttgcttggggtaagtcattgaatactgaactcttttgaatccagatgtggttttagttttgcatatagtcaaacgaaattatatgttatttgttgatctttgacattcattgacttacttatctttgatattaccacaagcactttgagtaatctgatacgacctcaaggaagattataaggccttagtgggccttaacactagttaatcgttttaagcccatattattgtcatcttttacttgttattagtatctctagttcttttgaatcggtatcgaaaatgatcaagtaaatctagtcaagaactcataataccatagactgctcaagaaacgtgccattatttgacttgtaggggtttgcaaccacgcctttcacttccactgtatcagcagatggctcaaaactcgtcaagtgtgtccactaggtatgttttttaaatctaatcttacatgctctcttactcatcaatgttttctcttctcattgtttttgcttcttgcttggtttttaacagatgtctgcgagtgggaattccagaaatatggtcactaa

SEQ ID NO: 477 - DNA, 711 bp, Arabidopsis thaliana
ttaattaatggagtcttaccaaaaccagtccggagcgcagcagactcaccaacagcttgaccaatttggaaatccatttccagccaccaccggagcctatggaactgccggtggagctccagccgtggctgaaggtggtggtttaagtggcatgcttcaccgttctgggagtagctctagctctagctcggtatgcttctgttttacgcaattgcttttgcaatatttagtgtactctttctatatcaccaaatacaagaagtttcatttaatttgacttcacctaactagaaaaaatcaggaaaccatattttagatttaactctacatattttttataaaccattttttgtgttcaaatgataagtttttgtttgtaatttgaattatattcaaggtataccatatatttaaaattactaaataaaatatggaaagtgttgcaaatacatatagctttttaatttttctgacgattttcatgcatgaaggaggatgatggactaggtggaaggaggaggaagaagaagggaataacggagaagattaaagagaagctgccgggtcatcacgactccaacaagacttcttctttaggttctacaacgacggcctatgataccggcaccgttcaccacgagaagaaaggcatgatggagaagatcaaagagaagcttccgggtggtcatcattagtttcatttggcgcgcc

SEQ ID NO: 478 - DNA, 1380 bp, Arabidopsis thaliana
ttaattaacaatgtctgagctaaaagagcgcctgcttcctccaagacctgcttcagctatgaacctcagagatgcttctgtgactcggccttctgcttctggaagaccaccccttcttggagttgatgtcttgggtctgaagaagcgtggacaaggcctacgctcttggattcgtgttgatacttctggtaatactcaggtcatggaggttgacaagttcactatgatgcgtaggtgtgacttacccgcccgtgatttaaggctgcttgatcccttattcgtgtatccctctactatcctaggccgagagaaggctattgttgtcaacttagagcagatccgttgtattattactgcagacgaagttctgcttctgaattcccttgacaactacgtgctgcgctatgttgttgagttgcagcagagactaaagactagtagtgtaggtgagatgtggcagcaggaaaattcccagttgagtaggaggaggagcaggagttttgacaatgcttttgagaattcatcccctgattatttacctttcgagtttagagctcttgaaatagcccttgaagctgcttgtacgtttctcgattcccaggcttcagagttggagattgaggcatacccgttattagatgagcttacctcaaagatcagtacactaaacttggagcgtgtgcgtagactaaagagcaggcttgtagcactgacaagaagagttcagaaggttcgggatgagatcgagcagctaatggatgatgatggagatatggcagaaatgtatctaacagagaagaagaggagaatggaaggatctatgtacggtgaccagtccttattgggttacaggtcaaatgatggtctatctgtttctgcaccggtgtctcctgtttcttctccacctgattcccgaagacttgataaaagcttgagcattgcgaggagtcggcatgacagtgcaaggagttctgaaggtgcagagaatatagaagagctagagatgttgctggaagcttactttgtcgtcattgatagtactctaaacaagttgacatcgttaaaggagtacattgatgacactgaagatttcattaacattcaactggataatgtgcggaatcagctgatccagttcgagttgcttctgacgactgcaacgtttgttgtagccatatttggggtcgttgctgggatctttgggatgaactttgagatagacttcttcaatcagccaggtgcattcagatgggtactcataattactggagtatgtggctttgtgatattttcggcattcgtctggttcttcaagtacagaagactcatgcctctataagaagagagacatgaatgtgctccccagaaagtaggcgcgcc

SEQ ID NO: 479 - DNA, 1779 bp, Arabidopsis thaliana
tgttctgggtatttcttttttttagtgattctcagatctaccatttttcttaatttcgtaagaatgtgttgttaagagatttaacaagttagagactttgtttttccccagttcgttgaaatgacgagaagaaaatccaccgtcgtcctgccgcagcctattcgtcgatcagcgaggcttatctctctgcagaatcgagatagtcaagtgaaacccaggaaagatctgggctttggctcggaacccacgaagaaaactcgtcgggaagtcttaagaggtctatcgaagagattagtatactcatcggatagtccaatcgaagattcgaggtcgaagaaattgaacatttcgaaagatgggtttccgtcgctaaggagatctcttaggctttcgagtagggaatgtcctgaagtcaacaaagagaagcctaagactgcatctacttcatcttctcgcacgaaatcgtcgaccactgtttcgtcttcttgtgctctgagacgttctcctaggttttcaagtggaggaggagaatctgtggatcaatcttcttcttccattgggaagaaatcaggtaatagtgttttgagtagctgtagtacgaaatcaatttcatcggagaaagtgaaaggtggagatggtttgaaatctaaggatagaagtagaagtcgtgttcgtcctaagactaagaagatgtttagtggttgtgatgataatgaagaagaagaagaagaagttagtgtctgccttactgagaggaaaaggatgagaattgcaaagccgaatgaggaagaaaatgctgaagcaaaagctgatgaagtgaagagaaaaggaaaggaggaagaagaagaagaagatgaagaagaaggattgaaggcaaagaataagcttgagaaaggaggatggacagaggagttggagttagctttacaaggagcttatttgacggtgaagccaagtcctaatttctggaaaaaagttgctaagatggttcctggaaaatctgcgcaggaatgttttgatagagtgaactcagctctgattactcctcgtcaagctcagcctcgaagagccacaaaaacaatcttatcaacgattccgcagttttcactttctgcaagcaaactactgaaacccaattcaccaaagacaaagatacgacagcgcagaaacaatctctcaaagaaagtggtcaggcatttactggagaagcaaaatcatatggatcaaggtcttggatttgatctcttctcagttcttgagcctaacaccacaagcaattttctctcaactccaatggaaaaagggcgaagtcttccaaaaatccttgaaagtccggtgccttgttcaagtaaagatccaacaactctcgttagccctccagtactgaaacaggtaaaaaacaaggcattgcatgagaagtacattgatcatctgcatatcagggatgctaaaagaaaagccgagtcaactcgactggctgggaaagagaacataagacctattgaaattcagaagaaggattcggtgagagcagctaaggatgcacttttctttgatgtacaagatgcaatccaaaagctaaaaggtctggaagctgagaactcatctagttcttcagagttttgctatgatcatgtcgaaacggacgaagaagattaaatctagttgtttctagccagatagatttgattgtactagggcacagagcgtagagattagagtaaggcattactgtaaatcttagttttgtaaccatgagactgaaactacacattgtgt

SEQ ID NO: 480 - DNA, 2413 bp, Arabidopsis thaliana
gaaatcaaatcacattaccccaaatctctcttctttgaactttaatcctcttctctattgcatgctttaagctccaaacccaaaacgcaggaaaatctctttgacagtttttggttttagatgggaccaatcaaaacgataaagaagaagaagagagcagagaagaaggttgatcggaacgtattgcttgctgctactgctgctgctacttccgcatccgccgccgctgctcttaataacaacgacgacgacgacgactcatcatctcagtctttggattggtgggatggattctctcgccgtatttatggtatctctttttttttcctacctttcttgttggtggtgatttttgcattggcagagtttttgttttttgaatctaattgttgattctgtttcatggaacttgcaattctgaatgttgatttttatttgggttttctaggtgaaaaagtttcagattgaatttagtaatgtagacaagagatgtcctttaatcttactctgtacattggagtattgtttcgatctattgattcgtagttttgggggtttgtgagttcttattcgattctagttgtgtcgtggctaacttaagtgagctatatggatccatggaagtggtttttgtgtagatgaagttgttcttaaggctctaggggctcagtttcgagccatttagactcatctagataactttgagcatgttttttttttcctgttttcgattttggtttaaatgatatgattctttagaaccaatttgggattagcagactttgactagtcttagtttctttttccaatttggcaagttaattttgttttgtaaaagttctcattgctttctgatgatgacattattaactctctttgtgaagagtcagccagatgttttccatgtctctttcagtgatgttctgattatgataagacattttttgcccctcttcccgttgtctctccctgtgtaaatgcgcttgtaggtcgatgataatcaattgataggtcattagctcttctgcttttgcactcttcttttagctttccgagtgttggatttaagctagtccaatgttgtatgagctgatatataatgtgatttaaacagttatggatctgcatggttcttttacactgacttcattacaatgaatgtgtctttgtactaaagagcagtaagcttgatcttggatacattgttgattttgtagttactatgagaatgtcatgttttttcttttcatctcctttttcaggagggtcaacggatccaaagacatttgagtcagttttcaaaatatcaaggaagacatttgactacatttgctctcttgtgaaagccgatttcacagcaaagcctgcaaatttcagcgactcaaatgggaaccctttatctctcaatgaccgtgtagctgtggcgcttaggaggcttggctctggtgaatctctctctgtcattggagagacctttgggatgaaccagtcaacagtctcccaaatcacttggcgctttgttgaatcaatggaagagagagcaatacaccatctctcatggccttcgaaactcgatgaaataaaatcaaagtttgagaaaatctcaggtcttcctaactgctgtggcgctatcgacattacacatattgttatgaaccttcctgctgtggaaccgtcaaacaaagtttggttggacggagaaaagaacttcagcatgactttgcaggccgtagtagacccggacatgagattcctcgatgtaatagctggttggcctgggagtttaaatgatgatgttgtcctcaagaactcaggattctacaaactagttgagaaagggaagagactgaacggggaaaagttaccgctctcagaaagaaccgagctaagagaatacatagtaggtgattcaggttttcctcttcttccatggcttctcactccataccaaggcaaacccacgtcgcttcctcaaaccgagttcaacaaaagacactccgaggcaacaaaagccgcgcagatggcactatcgaagcttaaagacaggtggaggataataaacggggtaatgtggatgcctgatagaaaccggttaccaaggataatctttgtctgttgcttgctgcacaacattattatcgatatggaggatcaaactttggatgaccaacctttgtctcagcaacatgacatgaactacagacaacgaagctgcaagcttgccgatgaggcttcatcggtcttgagagatgaactctctgaccaactgtgtggaaaaaattcatcagcttgattactctctcccggttcttgtggtctttctatgaaagcttcatttgcttctttttccttctggtaattttgtttagcataacattttatcgtttgatttgatctattgacatattctttt

SEQ ID NO: 481 - DNA, 443 bp, Arabidopsis thaliana
ttaattaacatcgttggaggatcaaaacgttaattcgattgatcgatgaatcctagaagggagcctcgtggtggtagaagttctctctttgatggcatcgaagagggaggaattagagctgcttcttcttactctcatgagatcaatgaacatgagaatgagcgtgccttggagggattgcaagatagagtcattctcttaaaacgactatctggcgatataaatgaagaggtcgatactcataaccgcatgcttgacagaatgggcaatgatatggattcatcaaggggatttctctcaggaaccatggaccgctttaaaacggtgtttgagacaaagtcaagccgaagaatgctgacgctcgtggcatcgtttgttggtttatttctagtcatatactatcttactcggtaaaattgcaaacccggagtattcggcgcgcc

SEQ ID NO: 482 - DNA, 1660 bp, Arabidopsis thaliana
ttaattaacttgattgcagataacaatggggaaagaagttgataacaagttcacttgggtgattaagaatttctcctctcagcagtccaggaaaaattattctgatgaattcttcgtcgatggctgcaaatggtaagaagtgaattttttcgaatgatttcatcaatttagttttttttttgttttccgtgaaattgaggattgactaaattttcttgaaggcgtcttctggcctttcctaaaggaaatggtgttgagaagttgtcactgtatctggccgttgctggtagtgaatttttacctgatggatggagaagacacgcatatttccacttcagtgtagtgaatcaactctctgatgaactctctcaagctagaggtgattgtttttctacacaatgctcgttacttgatatgcgttggaaattgattgcaacagttttttttttccttatgttgtttgagttggttggtttaagactagtgtcaatgtttcgtagcaagtttagagcatggttcatggatggctttattttatgtgaagtgaagtcaatgatgaaatggaatttatttcgttgttgttacagaaacaaaaaattggtttgatgcgagtactagtgactggggttttacatcaatgctttcccttaaaaaacttcatgacaaagatggtggattcctggttaatggagagctcaagattgttgtcgatgtttctgttcttgaagttattggcaaattagacgtaccagtggaatctgaagagacaaccaccaaagctctaagcgagctagaggaaaatgacgtaccagaggaatctgaagagacaactaaagctctaagcaaggtagacgaaaacgatggtgcagagtctaatgattcgctcaaggaagcttcatcagtaaaggaaagcatggatgttaatggctttcgagttcttccttcacaggtatgaaatcaagaatggtgtagttgtttcttaaaatatctaaccgacatatgttctattctgttttgtgaattgtttctcaagtagcagagagcacacttgtatattcagtaaaaacaagaaatgaaattgtaaaagtttcttgatacatgtatgatgtatctatgatttgcagaatatgagcgaaactggaatattggagatgtttttgtctgttctgatttattcaagtctctgataactgcctcctcaatttgtttttttctacttaattcatctttctatcactttcaggtggaaactgtgagctgtatatttgaaagacaccccgacatagcatcagagttcggtccaaagaatcagcatctgaggtcagcttacatgaacgtccttctcagcctaatcaagactatgtgccagtcgactcaggaactttccaaggatgatctgtcagacgcagatgctgctcttgcatacttgacggatgcggggttgaatctaaattggttggaggagaaactggaagaagtgtcagaaaagaaggagaacgaggaagctggtgagactcgggtgcatgaaattgaagaagagttgaaggaattaaagctgaagtgctcaaacctggaagctcagctggagaaggagaaagcagatgtgtctgtggccagagctcctttctccttcgatgatattgtttaatggcggcgcgcc

SEQ ID NO: 483 - DNA, 1352 bp, Arabidopsis thaliana
ttaattaactctcctctttcttgaaacgggaaagagggagggaagaacaataagaagatgaagaagattctagaaagatcaatggaaggttcagggacatggcaaggcttggtgctcgttggtattgtcacatggatctgtgcttcttcttatcttaaatttacccataaatttagatctctcttacaaccatgggtcgctcgtcaagtcgttggtggtgtccctctcattctcagaatccagaaatgtcagaatggagtgttggatgctttcttctcagggctatcttgtgttgtctctgttcccttttacactgctttcttgcctttgctcttctggagtggacatggtagattggctaggcagatgactctcttgattgcattctgtgattacttgggaaactgcattaaggatgtggtatcagctcctaggccaagctgtccaccggttagaaggattactgccactaaagatgaggaagacaatgcaatggaatatggcttgccttcttcacatactcttaacactgtttgtttatctggctatctactccattatgtgttatcctccttggaatacgaaagtgtgtctatccagtactatggatttgcccttgcttgtttgttggtagctctaatcgccttcggaagggtttacttgggtatgcatagtgtcgtcgatatcgtcagtggtcttgccataggagtcctgattctaggtctttggcttaccgtcaatgaaaaacttgacgatttcattacatcaaaacagaacgttagctctttctggaccgcgttgagtttcttattgctctttgcttatccgacccctgagcacccaactcctagctacgagtaccacacagccttcaacggggttaccttaggaattgttaccggagtgcagcaaacgtacagccaattccaccacgaagctgctccacgaatcttctcaccagagctccctatttcatcctaccttggtagagtcatggtgggaataccgacgatactcttagtgaagttctgcagtaaatctcttgcaaaatggactttaccaatggtatccaacgcacttgggattccaataagatccagcatgtacattcccaagctcaaggggtatgcaagtgggaagaagacagacgaacccaagaattcagttggatatttgcagaaactatgcgagtttttgagccacgactcgtttgatattgatactggtataaggttcttccaatatgcaggccttgcctggtccgttgttgatcttgttccttcactattctcttacgttaacttgtagtaacagtttcattgtgtgatatataaaatcagtgccggcgcgcc

SEQ ID NO: 484 - DNA, 505 bp, Arabidopsis thaliana
ttaattaacatgtcgctagacgcgaatacttgttctatcgtcttctttctattcttcactgtctctttcgccgtctccggccaaaagccaaccgcttacgacgccgtcaaactctataacttaccaccaggaatcctcccaaaaggagtggttgactatgagcttaacccaaaaacaggcaacttcaaagtctacttcaatgacacgtgtgaattcaccatccaatcctaccagctcaagtacaaatcaactatctccggcgttatatcacccggtcatgtcaagaatctgaaaggagttagtgttaaggttcttttcttctgggttaatattgctgaagtgtctcttgacggcgccgatctcgacttctccgtcggaatcgcgtcggcgagttttccggctgctaattttgaagagagtcctcagtgtggttgtgggtttgattgtaataatgggcttttattttcttcttgaatctgttgggccttgtgttgtacggcgcgcc

SEQ ID NO: 485 - DNA, 1336 bp, Arabidopsis thaliana
ttaattaagaattagggattcgagaatgacgatgaactcgcttccgaggagatttgggaagaatcatggctatttggatcgagattatcgaaacggaagacgatctggttcagattccgatgaagaattgaagggattgagtcacgaagagtataggaggcagaaacggcttaagatgaggaaatcagccaagttctgcttttgggagaacacaccgagtccacctagagatcagaacgaggattccgatgagaacgccgacgagattcaggacaagaacggcggcgaaagagatgataattcgaaagggaaagaaaggaaaggtaaatctgactcggaatctgaatctgatggtttgagatctaggaagaggaagagtaagagctcgaggtctaagcgcaggagaaagagatcttatgacagcgatagtgaatccgaagggagtgagagtgattcggaagaggaagataggagacgaaggaggaagagttcttctaagaggaagaagagtagaagcagccgtagttttaggaaaaagcgaagtcataggagaaagacgaaatacagtgactctgatgagagcagcgatgaagatagtaaagctgagattagtgcttcttcgtctggggaggaagaagataccaagtcaaagagcaagaggcggaagaaatcttcggattctagttcaaaacgaagcaagggagagaagacgaagtcagggagtgacagcgatggtactgaggaagattcgaagatgcaagtagacgaaacggtgaagaacactgagctagaacttgatgaagaagagttgaagaagttcaaagagatgattgaattaaagaagaaatcttcagctgttgatgaagaggaagaagaaggtgatgttggtccaatgccattacctaaagctgaaggtcacatcagttatggtggtgctttaagacccggtgaaggagacgccattgcacagtatgttcagcaaggtaaacgtatcccacgtagaggagaagtgggtcttaacgctgaagagattcagaagtttgaggatcttggttatgtgatgagtggaagtaggcatcaaaggatgaatgctattcgtattagaaaagaaaaccaggtttacagtgctgaagacaaacgggcattggccatgtttaactacgaggagaaggcgaagcgcgaggctaaggttatgtctgatctgcagcggcttgtgcagcgccatatgggagaagaggtggggccaaatcatgaccctttcggtgctggaaagactgaagaagatgatgattgattttgcttggcttcctgcttctgttatgtgggtaggcgcgcc

SEQ ID NO: 486 - DNA, 593 bp, Arabidopsis thaliana
ttaattaattgaagcaaattagcactgaccgatcgatccatggaagaggtgaagaaggatgtatactcggtttgggcattaccagatgaggaatcggagccccgattcaaaaagctaatggaagctttgagatccgaattcactggcccaagattcgttcctcacgtcaccgtcgccgtatctgcttatctgacggcagacgaagccaagaagatgttcgaatcagcttgcgacggtcttaaagcttacaccgccaccgttgatcgcgtctccaccggaactttcttctttcaatgcgttttcttgcttctccaaaccacccctgaggtaatggaagctggtgaacactgtaagaaccatttcaattgttccactaccacaccttacatgccgcatttgagcctgctttacgctgagttgacagaggaagagaagaagaatgcgcaggagaaagcttacacgctcgatagcagcctcgatggactcagtttccggttaaaccgacttgctctatgcaaaaccgataccgaggacaagactctagagacatgggagacagtggctgtatgcaatctcaatccttaaggcgcgcc

SEQ ID NO: 487 - DNA, 801 bp, Arabidopsis thaliana
ttaattaataccaaagaatgggttgctgctgttgtctcccgagtatacccgaagtaaagcctctacgtctttcttgtttgcagcctttttgggttttggtttttgttttcttatgttttattgttttctgtagagctcaagaactatagatgagcatcttcccttatctcgtgccacgccttcctctctctctaatgcatacagttcacctctttcgccgcctattcctttagccatcacgaatataaatcttcaaactagtccaccgaaattgccaagaactcagggcaattcgagtgaagcatccccgggactcacacaagttgttccagagaagaaaacatggcatgttgatgatctaactgattttgagctaaagaaacagtatcgagaagcaatcgatgaatgtccaatttgcttagaaggtattttgtttatcattcaaagttacatgttaaatataacattttggtaaatatcttcatcttgtttgtttgcagaatatgagattgataacccgaaattgctcactaaatgtggccatgactttcatctcgcttgcattcttgcatggatggaaagaagcgaggcgtgtccagtttgcgataaggtttgtgtccgtttaaaatccgccattttcacaatacattttgaacttcttgagtcactagaatctgttttgacaatagagtctactttttgggtattcttttcacaggaattagtgctcactgaatcataatcgtgaacaagaaaccaatagctcggaacaagaagtgcgaaaaacggtacaggcgcgcc

SEQ ID NO: 488 - DNA, 561 bp, Arabidopsis thaliana
ttaattaagtcgatgtcgataacgattccctacgatggctcaatctcccgcgagccatcaccgtctccaccgccgccaaaagcgaacacgaagaatctaccgacgaagattctctctaacttcctcataggtctaatcatgatccctgtagctataaccgcttttatctttatcctcacgtctctcggtttcaccttcttcttcgctttctactggtttcttcaacgaaactatcgccaccgtctccgccgccatcgccgtcacgaatactcagatgggttatctccaagatgcgtgaagaggcttcctcaattcaagtattgtgagcctagttcagagtacggaggcgatgattgtgttgtttgtatcgatggatttagacaaggacagtggtgtcggaagctgcctcgatgtggacatgtgtttcaccgaaagtgtgtggacttgtggttgattaaagtctcgacttgtccgatttgtagggatagggtttatagatttgaagaaggaagaagatggagaccacaaggtgaaattttttgatcggtggtttggcgcgcc

SEQ ID NO: 489 - DNA, 2305 bp, Arabidopsis thaliana
ttagtgaattatagaagacctctgttctgtattgcgagctaaatggatctgattgatttgtggaaatgcagggcattgataattggacttgttggttaagatttgaatcaacctggagctatgtcgagttttaatctgagtgtagatgtgaatcagaatgggaatatcaagaatgttgattctttatctacattggacgatattgatgacattgattttgccaagttgctagagaagccaaggccattgaatattgatagactgagatcacttgacgaaaggtctcttactgaattaactggttcaccacagcttagaaatgcggataatgcttctcgggcccctgatcatgcggattatgtgatttcaccaagctttggtaggaggtctggattcaatactcctaggtcacagcctggatttgagtctcatcctatggttggtgaggcctgggatgctttgaggcgctcaatggtttactttcgtggacaacctgttggcactattgctgctgtggataattctgaagaaaaactcaactatgatcaggtgaagaatctttatatcttctgaaaacttctgaataaccacattttactgtcattgaccttgtatctctgcattgactttatccttaaggtgttcgtgagagattttgtaccaagtgctttagcattcttgatgaatggagagccagatatagttaaaaacttccttttgaagactcttcgtcttcaatcttgggagaaaaagattgatagattccagcttggtgagggtgttatgcctgctagcttcaaagttttccatgatcctgttagaaaccatgaaacgctgatagctgattttggcgagagtgctattggaagagtagcgccggttgattcagggttttggtggattatattgctcagagcctacacaaaatctacaggagactcttctcttgctgacatgcctgaatgccagaagggtattcggctgatacttagcctgtgtctgtctgagggatttgataccttccccactctcttatgtgctgatggttgctgtatgattgatcgtaggatggtaagcagcaaatttactttattagttatttctagtgattctttctacaaggagagtttgagctaggtgcttcatcagttttccatcttttaattttgtgctttttttgttgtagggagtttatggttacccgatagagattcaagcccttttctttatggccttaaggtgtgccttgctcctgcttaaacatgacggagaaggtaaagaaatggtggaacagatagtgaagcgacttcatgcattgagctaccacatgaggagctacttttggctagacttgaagcagcttaatgacatttaccgatataagacagaggaatactctcacactgctgtcaacaagttcaacgtaatccctgattctcttccagaatgggttttcgactttatgccgcctcacggagggttctttattggcaacgttagccctgcaagaatggatttccgttggtttgctttgggtaattgtatagcaatattgtcttccttggctacacctgaacagtcgacagcaattatggatctgatagaatctcgctgggaagagttggttggagaaatgccactgaaagtttgctatcccgccatagaaagccatgaatggagaatagtaactggttgtgaccccaaaaacactcggtggagctaccacaatggaggatcgtggccaggtttgccttttctcttgtacttttgattggactacaaaggaatctctcctttcccagtgttcttctggttcctctgtggtatcttaatcctagtaaattgctattctgacccttattgatgtaattatgtttaatggtacacagtgctgctatggcttctgacggctgcttgtatcaaaactggtcgacctcaaatagcaagacgagcaattgaagtagcagaggctaggcttcataaggaccactggcctgaatactatgatggaaaggtagggagatacgtggggaaacagtcgcgtaaaaaccagacttggtcagtcgcaggatacttagtagccaagatgatgctggaagatccgtcacatgttggtatggtttgtcttgaggaagacaaacagatgaaacccgttatgagaagatccaactcctggacttgttgaaaacgttggaaagagatgagctaagaagaaccttcttcgtgattcctggctttaatgctgataacgactcttttcttcatttttcaattgcaaattttacgttgcttgctttgtgaaata

SEQ ID NO: 490 - DNA, 1526 bp, Arabidopsis thaliana
ttaattaatgggaaagcttttgtgtgattcaacggcgacatttcaatctccttcaccaacggttccttggagagaaccttctacagtcgccgtgtctctcgaagatgtagatcttgttgaccaatccgcggctgctgcggcggtggacgcggttgagaagacaatggccgccgcaactaccaccgcttgggatgaggtttttggattggaggaggcgcaaagacggcatctgagccggctacacgcgagaggtgtgttgtggaaacatcctggtaaagatgaatcctctgcttccgtcgttttccgtctctctcacggcggagaggtttcttccgacgggaactgtttgttcaccgcttctcagaaggctatggaggcgcgtgggatcgacgcgcgagatttacggcggcggacggtgaggaggtttttggaggatttcagatctgctagcgaggaagagaaggaggttattacggatgcgattaggcatatgtattcgccggatctgaagagtggttgggggattcatattgtccaggaagagaagttgttggcgaaaaaagatgaacgtgagagtcttgattccgccattgaagagcttttacagattgggatgcataggtacttttgctaactatggactcagatctggtatcgaccttgatgttttgtttttatgattaggggaaataggaagcaaaatgtagcattattgttcttcttgttatgattaagaaagatataatcttgaggtgacattgtgttctataatttctagggtttgtaatgtttattgattacttttcttcattgcagagaaactgctgcagagtcaatctatagagagaggtgtcttccggtgaatgatggacttagttggtctaagtacatgtcgatttcaggctcaacagaggatgagtatgatatcattaccttgcagtatacggaagatgggttgttatctgtagatgagaaccgagaaggacgtgcagctgcgtttggggatgacatagcaatcgagtgtctagccactgagttcaaacgagaaatctatgtggtgagtagttatctgatgtaacaagtttgttactttggttgtgtttttttttcccaaatgacatctaagtaaagttgtgaaatgttggtgttataggtgcaagcgcatggatcagatgggatggtagaggaagagaactgtgtgttctttcttcctcacaaaccaagaagtgaagttcttgaagtcccagtctttctattcatgaaaggcactggtaaataactaaacaccatttgataaaaagtcttcaaatctatctcatatttttggacttggtaattactaaactcatctcactggttcaggttggtgtggtggtggagcagaccattacgagcccttgatagcgaatccatctcctctgatatctcatgagaaagtcgccctcgttctctgaattttggagcttggcgcgccaaaaattggagctctgcagagctttcgttcgtatcatcggttcgacaacgtc

SEQ ID NO: 491 - DNA, 350 bp, Arabidopsis thaliana
ttaattaatgtgtccgatgaggttcttattggtgttcttctcagctgtactcgccggatatttcgcatggaagacggtgagttcttcgccggaattcgattcaccggacgaattgaatgagaaacaagaactcaatctcaaaaaggtaagcataaatctcgttcctttttcgttaatttctggtgatttgttctaatttctctgtttctttgttgaattgctattttaacagaagatggagaatgggttttgggtgttcgtcgatatggctagcggaagatacctttggaggaatctcaaggaaatgagagagaaatctcaatgaagatgatgatgaacgaaggcgcgcc

SEQ ID NO: 492 - DNA, 2461 bp, Arabidopsis thaliana
ttaattaacggtcacacacagtcgctagatatgtctctctcgcttccatcttcttccgccgccgctgctgcggcgtcaacatcgggatcatcatcttctccggcggctgcttcgtcttcctcaacaaccacgtcatggttctccgggatcgttcgtggtcgtggtgataaatccggcaccgcgaagctatctaaaagctcttccatggctggaggaggaagcggaagcggagattacggtggaccaatcaaagggaagaatcaatttcgcggtgttttgttcaaatacggtcctaaatcaattcaggttcgcttctcgatttcgatttgttaaattgaattgcttttgagttacttcgaagcaaagacacaaaattttgaataataaattatcatttcgtgattctagggttgcttaaatatgtgtgttgttatattgcttcgtgactgtttttagcaaacattgtgttcatcacaagcttgtttgctgatcatgtttaaggttcgttgaagaaagtcaatgaaaatttaggtcaacgttccaagccatgtgagaccttgatttcaacttttgcatcaagttagatgattttagttgaccacttgtagcagctttgatcaaagtttacaaagatggatcctttttgaaaatcagaataggtttactatagattgttgggtatagtaacatcagcttccttgtctgtttatgcatcaccaggttgcttttaagaccggagagtataaacaacaagtgatatttatcggtggattaactgatggacttttagctactgagtatgtagcttcttctctctttgacctaaatctttatcttttgggagaaattgtgtacagtgcagataccttatcgaatcatgtttgcttcatgtatattaattgatagaacatttgcaaattggctgtttcagttacttggaacctcttgcgattgctttggataaagagaaatggtcacttgttcaactactgatgtcttcttcatattctggatttggcacttccagcttgaaacaagtaagagttatttcatataatttcatcttgccttgtaatattgttagtctctgggaaaaaactaagaatttctccattccgcaatatactaaacaatatatctttgtttcttctgatgaaggatgcacaagaaatcgaccagctaataaaccacctcatcaacaaagagaattctgaaggtgttgttctgcttggtcatagcactggctgtcaggtgattggttaagccctcaaacactttttgatcatggttctgaaagaaaagttatgacagaaacttgtgtcttctcgcattttgaaacaggacattgtgtattatatgggaacaaatgcggcatgctcccgagctgtccgggctgcaattttacaggtgcgagtcctagattctttgacttctattttgcgttctctcttgaagctacactttttattatgtgaaaggcctcgtatcatatgttctgactgtagtgtagctttgatcatattgcctattgcaatgcttacttaggcaccagtcagcgatagagagtacaaagcaacgcttcctgaaacacctgctatgatagacttggctgcaaacatgataaaagaaggtcgaggagaggagctaatgcctagagaagctgatccttgtgctccaatctctgcttataggtcaatatctatttccttctaccatattcgtagctttgaaaatggaaaaattgtgattcgaacatgtctaaatacaaaaatcaatcttttgcttgcttcctgcagatatcactccctctgcgcttacatgggagatgacgatatgtttagttctgaccttagtgatgatcagttgaaaactagacttggccatatggctaacacaccttgtcaggtataaaaaaaaaactaatcaaaagcatttccagtcccgctgaacataaatttttctagttgtggccaattgggcattgattagcttcttatatcatctatgtcttggttctacacaggtgattttctccatgggtgatgagtatgtaccagattatgtcgacaaaaaagcattggtcaataggtgagggcagttaaactaaagtaattataagaatctgtaactgaagacaccttacatagacatggatgtcccatttttttcatttgtttgcaatttaagttaaaattggtatatatgaagaactatagatgcaaactttggatcaaaatgatatcgaaatgattggacatgaacaatcagatcaaaaggattgatttgatctttgtgattacagattaagtaaagcaatgggaggagcagagaaagtggagatagagcatgggaatcattctctctccaatagagttcatgaagctgttcaagccatcattggttttgtcaaaagagaaggacccagtggttgggatgatccttggagctaaatctggcgcgc

SEQ ID NO: 493 - DNA, 439 bp, Arabidopsis thaliana
ttaattaagaagaagaaaggagccatgacaatgtttagatctatctccatggtaatgctgctcgtcgcactagttacattcatttctatggtttcttctgctgcttcgtccccagaagccgactttgttaagaagactatctcttcccataagatcgtcattttctccaaatcctactgcccctactgcaagaaagctaaatcagtgttcagagagctggatcaagttccttatgttgtcgagcttgatgaaagagaagatggttggagcatccagactgcacttggagagattgttggaaggcgaacagtaccgcaagtcttcattaacggaaaacatctcggaggatcagatgataccgtagatgcgtatgagagcggtgaactcgccaagcttcttggtgtttccgggaacaaagaagctgaactctaggcgcgcc

SEQ ID NO: 494 - DNA, 2212 bp, Arabidopsis thaliana
agttttcttcacagatccgtcttagctctttctagaggtttgttgtataccaaagatctctttttttttttgcatttgctttgatgagtttggtcatggagatttatgtgtgtttgcagaatggcggatttgataccattttatctgaatattgtggcgtttctatgtactgttggagctattgctttggcgatatttcatatctacaggcatcttttgaattacacggaaccaacttatcagagatatattgtacgcattatcttcatggtcccggttagtgcttttcatcatctctagcttgaattgtttatagtccttaacatgttgaattctgtctcactgacatgtttgtttgcttcttgctgccaggtttatgccttcatgtcattcttgtctcttgtgttacccaaaagctcgatatattttgattccatacgagaagtgtgagtattcctaaatttctagttgtgcatagacgatgttagtggtgtttttcttcttttagagtggctcaataggtcttagagttggtcttgaaagttttctgtttccgttcaaagtcaatggcctttagcctactctgatgacctttttggtgttccagatatgaagcatgggttatctacaattttctatcgctgtgtttggcatgggttggaggcccaggatcagtagtgcttagtttgagtggtcgttctttaaagccatcatggtctcttatgacatgttgctttccgcctttaacactggacgggtaagttcgcagaatgaaacaaaattcttctacttatcaataaggcagtgtttacataatctttcctggtatttcctatcattttggatgatgatttttctgtgcaagtcatacaatattaatgacctggacatttgagtgttctgtttggatttcgaggtctcatgatgattctatttatcttgcgtttttataagacagtcctcttagctgaaatctattgacacatgcactatggtctttttcatgcaggcgatttattcgacgatgcaagcagggttgtctgcaatttgtaattctgaagcctatcctagttgctgtcacacttgtgctttatgctaaagggaagtacaaggatggaaattttaaccctgatcaagcatatctctatcttaccatcatctataccatatcctacacagtggctttgtacgcacttgtgctgttttatatggcatgcagagatctacttcagccattcaatccagtcccaaagtttgtgatcataaagtctgtggtctttctaacctattggcaggttaaatttgcttactacttcagagtatttgatatcctctcttgccttttgctatcttccacgcatagttgtgttttctgattgtgttccatgaccctcttctttgcacagggtgttctcgttttccttgctgcaaaatctggattcataaagagtgcagaggcagcagctcattttcaaaattttataatatgtgtcgagatgctcattgctgcagcatgtcatttctatgcttttccatacaaggagtatgctggtgccaatgttggtggatctggcagtttctcaggaagcttatcacatgctgtaaaactaaatgacttttaccatgacactgttcaccaggtaaatggtttctcttgaagccatctttacttcagataatatacttttttcatattggttttctgatgattgttttattgcagtttgctcctacctatcacgattatgtgctctataaccatcaagatggtggtgacgaggggacaaagaagtaccgatcgagaacctttgtgccaactggccaagagatggatgcaatgagaaaaaacaaacctgtgtatgcaaacaagatagatggtgtttcagtctcaagtagtctatcttcagaggcaagctcacctaaaagctccagcgtaacttctgatcctgcacgctctgatgctgtgaaatcttccttgctggtggatgcctcagattctcttgaaacaatgtatgatatgtcgctcattgacattgatctatctagtttccccagcaatgtcccatctgcaagtgaaagtgggcctagataggagcagagaaaatgtagaaatcaccattaacaggtacaaaacatgctcctaatagttgtattcagatgaatcttctgaggtgtgttcttagttggaagatgttgttagttggagacttga

SEQ ID NO: 495 - DNA, 1733 bp, Arabidopsis thaliana
tcatcgagactcgtttagtgattcgaaatttcccttctcggctcaaatcttcgatctgggctttcgtgtctttttgcgttttgattggtaataaaaagaagctttttaaaaactttttccatggctggaagtgaagaagttaatcttattgagagcaaggtaagacctttttattgactttgctgattttgggtattatctgtgttcatggattgttcttagttttctggtgtttggttagattaggattcatatgtgttttgttttgttttgtaatcaaagcttagaactttcatcgtttggggtgatgaaacgtgtcggttccttgatgggtctttactaatttaggagctctccttggctttatttggcttttagtttttttttctctgacccttgtgactgattttgattttgttattccatgaactgtttctactgtcaagtgttgtaatcatatctcttataaggttttgttgtgtttgtgtatagttcccctgttttacaagtgaaagctctcaaaaatctcatctttgatatctttatggctatctccttatggttttgtgtttgaaagttctctgatttattggtctgtcttgtgttttttgttgcagacagtggttcctctcaatacatgggttctaatatccaactttaagctagcttacaatctcctgcgtcgccctgacggaacttttaaccgtcatctcgcagagtttctagaccggaaagtccctgcaaatgccaaccctgttaatggggtcttctcttttgatgtgatcatcgatcgccaaactaatttgcttagcagagtttacagaccagctgatgctggcacttcaccaagtattactgatctacagaatcctgttgatggtgaaatagtgcctgttattgtcttctttcatggtggaagctttgcacattcttctgcaaacagtgctatttatgatactctttgtcgtaggcttgttggtttgtgtggtgctgttgttgtctctgtgaattatcgtcgtgcaccagagaatcgatacccttgtgcttatgatgatggatgggctgttttgaaatgggtcaactcgagttcttggcttagaagcaagaaagactcaaaggttcgtattttcttggcgggtgatagctctgggggtaacattgtgcataatgtcgcggtaagagcggttgagtcaaggatcgatgttttggggaacattttgcttaaccctatgtttggagggaccgaaagaacggaatctgagaaacgtttggatgggaagtactttgttacggttagagaccgagattggtattggagagcgtttcttcctgagggtgaagacagagagcatccagcgtgtagcccgtttggcccgagaagcaagagtctagaagggttgagtttccccaagagtcttgtcgttgtagcgggtttagatttgattcaagattggcaattgaagtacgcggaagggctcaagaaagcgggtcaagaggtgaagcttctttacttggagcaagccactattggcttctacttattgcctaacaacaatcacttccataccgttatggatgagatagctgcatttgtaaacgcagaatgccaatgagaacactcttatctctcactgtaatctcttcactaacaaacgggtgatatccaccatggaaggtgaaagcccgagattctcgttttagaagctctttgtagtgagtcaaaagaacggcgt

SEQ ID NO: 496 - DNA, 2100 bp, Arabidopsis thaliana
tcgacgttgtcggtggacacaaagctccataaagacactattactgtattattatcttcgaaatatctatctcttcgtcgtcgaacccaaaaagattctccgtcttagattccgatcacgatgaacccaacccaaaaacccgaaccggtttacgatatggtcatactcggagcatccggatttaccggtaagtacgtcgtcagagaagctctcaagttccttcaaacaccgtcttcttctccgttaaagtctctagctttagcgggtcgtaacccgacccgtttaacccaatctctcgaatgggccgcccgcccgaacccaccaccttcctctgtcgctatcctcactgctgatacatctgaccctgattcacttcgtcgtctctgtactcaaaccaaactcatcctcaattgtgttggaccgtttcgtatccatggtgatcctgtcgtctctgcttgtgctgattcagggtaaagtgtgaatcttttcctctgttttctcaattttgttttaagttacagtgtgaacctaaaaactggaaaaagttgataattttttgaagtttgagaacttgtgattgttaacatttgagctttgtttcagtgatacttataaagatcaaatttttattgagttcttgataaatggtagcttataagaatggttaaaatttgtagcttagaaaaagttagaaacttgatgaaaaagtgtaatcttttgaagtttcatttgattgctacatggttctttataggtgtatctagggacaaaagttgtagcttgatgaaaaagtgtagtcttattaagttttgtttgcttttgggacatggtttttgtaggtgtgattatttggatataagtggtgaacctgagtttatggagagaatggaagctaactaccatgatagagcagaagagactggctctttaatcgtttctgcttgtggttttgattcaattcctgctgaattgggtcttctctttaatgctaaacaatgggtatctccatcggttcctaaccagattgaagcgtaccttagcttggagtctgacaaaaaaattgctgggaactttgggacttatgagtctgcggttttaggtgttgctaatgcagaaaagcttaaagaattaagacgttcaagaccaagaaggccaagaccaacggtaagtaatgcattttaacgtaatgtgacattgagacaattctgcttgagaatgagatagtgttgatattgtacattcttggttagtaggccttggctaatattaaagtttggaatgtatttgcagatttgtggtcctcctgctaaaggaccaacattagaaaaccagaagacgattggtctttgggctttaaagctaccttcagctgatgcagtagttgttcgtagaactctcacaactctaacagagaaaccacatgggcttcctgggattaatgaaagtcctgagcagatacaaaagagagaagcattctggtcatcgatcaagcctgctcattttggtgtaaagataacgtccaaatctctctttgggatattccgatatgttacacttggagtgtcacttggtttactttccaagttctccttcggaagatggcttcttttgaaattcccttcagttttcagccttggttggttccagaagaaaggtccaagtgaagaagaggtagaaagcgctacgtttaagatgtggttcataggtcgtgggtacagcgaagagagtctagcttcacaaggagaaacaaagcctgacttggaaatcattacaagaatttcaggacctgagattggatatataaccaccccgataacacttgttcaatgcggtttgatagtcttgggccagcgcgaaagcctagttaaaggaggagtctacacacccggcattgtgtttggttcaaccgatatccagcagcgacttgaggataatggtatatcttttgagctgatttcaaagatcaagactcaaggataaaaagagatctcttatcctgcttttctattctgtttttagttgttatgttatgcttcacagtgacattgaagacagtttgatggtaagttgtattccaataataataaaactgtttccttt

SEQ ID NO: 497 - DNA, 1241 bp, Arabidopsis thaliana
ttaattaatcttcaaagatccatggccgtaattatccctcgttcagatccaccgtcacgaatccatccggaaccaccacaaaccctagaaatcgaccatttcgatcatcttcctgactcaatcctcctcctcgttttcaacaaaatcggcgacgtcaaagctctcggaagatgctgcgtcgtttccagaagattccattctctcgttcctcaagtcgataacgtcgttgttcgtgtcgattgcgtaatctccgacgacgattcgtcatctttgtcatctatcaaatctcgctccggttcttccgctggttcgttctcggctatatttcgtcttgttgttggtggcattgttaagccgttacaagctttaggtcaattccttggtacgaagagatcatcatcatcatgtggtggttctggatcttcttcttcttcgttgtctattagtggagatgatgatggtggagagatcgaacaaggcggtgttacgcatcattcacctactcaggttttgaaaaacttcgatgagattcgttacttaagaattgagcttcctagtggtgaattagggattgatgatggagttttgttgaaatggagagctgaatttggttctactcttgataattgtgtgattctcggtgcttcttcagtgattccaccaaatccaatgagagtttctcaagcttgtgatactactacagtcgttgaagctcccggttctggctccgatgataatgggagtataccggaatcgttttacacaaacggaggtttgaaattgcgtgttgtatggacgattagctctttgattgctgcatcagcacgacattacttgttacaaccgataatcgcggagcataagacgcttgatagtttagtgctcactgattcagatgggcaaggtgtgctctgtatgaacagagatcagctagaagagcttagggtgaaaccattagcagcttcatcggcttcgaagaggacacttgtgcctgctctgaatatgagactatggtatgctccaaccttggaattgcctgatggaactgtgttaaaaggtgcgactttggttgcgataagaccgagtgaatcgaaaaaggaagtgtctgatatctcttgggtgtcttcggcttttgaggagccttatgagacggctgctaagatgctggttaaaagaaggacttactgtcttgaaatgaactcgttctagcttgaatggtttcagtcggaatctggcgcgcc

SEQ ID NO: 498 - DNA, 2008 bp, Arabidopsis thaliana
gtgagctctcaaatcttcatagatacaaatcaagaaagtgatcaaacaaaaaaaggacaagtctttttggtatttcagatcgagaaaaaatgtggttgcaaggtttgaagtaatcttgcaatggattctttgactggatttagaatggaacccaaatggcaaattgatcctcagcttctctttgttggtccaaagattggtgaaggagctcatgctaaagtctatgagggaaagtaagctcctttcttcttctttgttaactttctggatttgatttgcttatgagattattgggaaagtttggattttgatttgtgggtaagtgaagtctagtatttgttctataagggtatgaataaaatgcttgtttggtacactcatctatcttgatttgtctagttgaattattgaaattgtaaagttggagtttttaatggatctctactgtgtttggtcgttatgatctgagacagatacaagaatcagacagttgctataaagatagttcacagaggagaaacaccagaagagattgctaaaagagattcaagattccttagagaagtagaaatgctctcacgtgttcaacacaagaatttggtcaaggttcttgtttcttgagatctatggctgtttttgttgttactagcttaaagggtttcatgagttcatgattgtgttttgtctctggatcagttcattggtgcttgcaaggagcctgtaatggtgatagttacagaacttcttcaaggcggtacattgcgtaaatatctattaaacttgagacccgcatgtttggagactcgtgtggctatcggttttgcgcttgatattgctcgtggtatggaatgcttgcattcccatgggatcattcaccgtgatctcaaacccggtaaaactacctctttaaacctgatatgtatcatttaatgatctgcttaaagtatttgcaaaacaccttgcttcatggaaaccacatgctcagatctcaatcacaaagaatcttttctttcttttttattgtctgacaccacacacgcttcaagttcttttaatattctggttatgattaagatttaatcttaagtgttgaagatggtgttaaaggatctattgttctgttttgcagagaacttgcttttaactgcagaccataaaacagtaaaactagcagattttggattagcaagagaagagtcactgactgagatgatgacggctgagacaggaacataccgatggatggcacctgaggttcttctttacttatagacatatttgttcatttcttgtgcttctctttgctacttaaagacaatcttggtggaatattacagttgtacagcacggtaactcttcgattgggagagaagaagcactacaatcataaagtcgacgcctatagctttgcaatagttctttgggagcttttacacaataaattgccttttgagggaatgtcaaatctccaagcagcatatgcagcagccttcaaagtgtgtaacactgtcttgttttgcttttgattttcgctgaactttattctctttgttttgacatgtttcttatacagaatgtgagaccaagcgcggagagcttaccggaggagttgggcgacattgtaacatcatgttggaatgaggatccgaatgctcggcccaacttcacgcatatcattgagttacttcttaactatctctctaaagttggatctccgatatccgctattccacaacggattcttgcttcgaagaacacgctattgccaccggattctcctggaactagctctttgatggctaagcttgatgaatgtggggaaactccaaaggccaaaagtgaagacaaacgaaaaggtttgtttttctgcttcaatcaatgttattaaccttgaaatcacagagtggttttaggaccagagatttggtagacatcactcaaattattcatgtaataatatcctccctaccatatgaatttagcaagaagttcatttatataaataaat

SEQ ID NO: 499 - DNA, 1251 bp, Arabidopsis thaliana
atgatttacactgctatcgacaatttttacctatccgacgagcagctgaaggcttcaccttcgaggaaagatgggatagatgaaacaactgaaatctctcttagaatctatggatgtgatctcatccaagagggtggaatattgctcaaactaccacaggcagttatggctactgggcaggttctgtttcagcgattctattgcaagaagtctttggctaaatttgatgtcaagatagttgctgccagctgtgtatggcttgcatcaaaactggaagaaaaccctaaaaaagctagacaggtcatcatcgtattccacaggatggagtgtcgcagggagaacttgccattagaacatctggatatgtatgccaagaagttctctgagttgaaagttgaattaagcagaactgagagacatatactgaaagagatgggttttgtttgtcatgttgaacatcctcacaagttcatatcaaactaccttgccacattagaaacacctccagaattgaggcaagaagcttggaatttggccaatgatagtctgcgtacaaccctctgtgtaaggttcagaagtgaggttgtggcttgtggggtagtgtatgctgctgcccgtaggtttcaagtaccactccctgagaatccgccgtggtggaaagcatttgatgcagataaatctagtattgacgaagtgtgtagagttcttgctcatttatacagtcttccaaaggctcagtatatctctgtttgcaaggatgggaagccatttacattttctagcagatccgggaattctcaaggtcaatcagcgacaaaggatctgttgccgggagcaggcgaggctgttgatactaaatgtactgcaggatcagctaataacgacttgaaggatggaatggttactacaccacacgaaaaggctacagattccaagaaaagtggtaccgagtcaaactctcagccaattgtaggagactcaagctatgaaagaagtaaagtaggagatagagaaagagagagtgatagagagaaggaacgaggtagagagagggacaggggtaggtctcacagaggcagagattctgacagagacagtgatagggagagagacaaactcaaagatcgaagtcatcatcggtcaagagacagattgaaggattcaggtggacattcagataaatcaaggcatcattcttctcgggaccgtgactaccgcgactcatcgaaagaccgtcgtaggcaccattaa

SEQ ID NO: 500 - DNA, 965 bp, Arabidopsis thaliana
ttaattaattccatggcgattatctctgaggtagaagaagaaagcagtagcagccgacccatgatatttccctttagggcaacactcagttctgcaaacccattagggtttttggagaaagttttcgactttctcggagaacagagcgattttctcaagaaaccctccgcggaggacgagatcgtcgtcgcggttagggcggcgaaggagaagttgaaaaaggctgagaagaagaaagctgagaaggagagtgtgaagcctgtggagaagaaagccgagaaggaaattgttaagcttgtggagaagaaggtagagaaggagagtgtcaagccaactatagctgcttcaagtgctgagcctatagaagtggagaagcctaaggaggaagaggagaagaaggaatctggtcccattgttcctaacaaaggtaatggaactgatcttgagaactactcatggatccagaatctccaggaggttacagttaacattccagtgcctactgggactaaagcacggactgttgtatgtgagattaagaaaaaccgtctcaaggttggtctcaaaggccaggatccaatcgtcgatggggagctctaccgatctgtgaagcctgatgactgctactggaatatcgaggatcaaaaggtgatttcgattctcttgactaagtctgatcagatggagtggtggaaatgctgtgtgaaaggtgaacctgaaatcgatactcagaaagttgaaccagagactagtaaattaggtgaccttgatccagaaactcgctcgactgttgagaaaatgatgtttgatcaaaggcaaaagcagatgggtcttccaacaagcgaggagctacagaagcaagagatccttaagaaattcatgtctgagcatccggagatggacttctcaaatgcaaagtttaactgatgctcgtatcgtccagtctctctgccaaaaggcgcgcc

SEQ ID NO: 501 - DNA, 981 bp, Arabidopsis thaliana
ttaattaaggagaaaagagagaaaaaatggcgatggagatcggagaagatgaatggaaggtttgctgtggaagctccgaattcgcgaagcagatgtctacgtctggaccgttaacttctcaagaagcaatatatactgcaagagacatctggttcaaccaagttaatgtgacagattggcttgaagctttctctgctcatcctcagattgggaatactccttcaccttctatcaactccgattttgctcgtcggagcgtatcagaacagtcaaccgcctttgccacaacttctgcttctgctttacaggagcttgccgaatggaatgtactttacaaaaagaagtttggctttatcttcattatttgcgcttctggcaggactcacgctgagatgctccatgcgttaaaggaaaggtatgaaaataggccaatagtggagcttgagattgctgctatggaacaaatgaaaataacagagctacgaatggcaaagctgttctccgataaggctaaagttatatcagaaactgacagctctagctctcctgtttcaacaaaacctcaagctgaagcaaaagctcccaagagaagtaggccaccgatcacgactcatgtcttagacgtctcacgtggtgctccagctgcaggtgttgaagtgcacttagaagtgtggagtggtactaccggtccttcctttgttcatggaggtggtggggtctggtccagtgtgggcacatcagctactgatagagatgggcgcagtgggccactgatggatttggttgacgctttgaatccagggacatataggattagcttcgacactgcaaagtattccccaggctgcttctttccctatgtttccattgtatttcaggttacagaatcacagaaatgggagcatttccatgtcccactgttgcttgcacctttttctttctccacataccgtgggagctagagctatgctacggcgcgcc

SEQ ID NO: 502 - DNA, 1635 bp, Arabidopsis thaliana
atccatcatgttttcgtccttttaatttttagatctgtatttactctttaccgataaaataataaataaattcaacggggagagaggaaaaacgaaagggaacaaaaagaaataggggatatggtaggcggacgcggcggagttggcggtggtggtggtaacagagtggaggcggatcagtggcttgtaacatcggagaagcttctagcgtctagtgatcttcaaggagcaaagacatttgcgatccgcgcatgcgaagctgacccgacccgagcagaagctgcagactacatcctcgcaatctgcgacattcttctcgccggagagactcgtttaggtgattccaacttgccagactggtacgccgttctccgactcggtcgtttagctcaaaaccctgaacacgtcgcgactcagtaccgtagactcgctcttctcctcaatccttccgttaatcgtctcccattcgccgatcgagctcttaaaatcgtctccgatgcttggttcgttctctctgatccgttcaagaaatcattctacgaccgagaattgcaacttagtcaactcggtcaatctggattccatcctcaaacccaatcgcatcaaaatttccagtgggaacctagcagtagcaccgccgtatatccgccaccgcggtctcagagccaggctgggacctcggcggatcctatggcgacgagcttctggaccgcttgcccttactgctttgtactctttgagtaccctaaggcttacgaagaatgtactttgaaatgtcaagaatgtagaagagcgtttcaagctgtgacgataccaaaacctccggtggataagaaagacgacgaagacgtttacttttgctcatgggctttgtttccattggggttttccggtgaatttcaagctccaagttggtcacctatttcacctctctttgcctgtcctctgcaaaagttggatggtgaaccaaagaagagaaaggaaccgggtcctcctaggatttactatgacgatgatgacatttatgttgcgatttcggatggagatgacgctggtgatgatggtgattggcaagatgtggtacaagtgaataagaagacgaatgttgggaaagggaaagaaacatatgtgagaagtaacaagaaacatggagttgaagaagtccaaaatgtagaaagtatcagtagtgctagcaatcacgcggtttcaattgcttcaaatgctgcggctgttgggtcttcaactggggttatgtctaaaccagggagttatattactagaaaacgaatgggaacaggcgctaagaacctggggaggttggatttgaatgtggagtttagtaatgaagtggaagagcctggtgtggcaggtgggggaaatgcaggcaatgggatcggaagtaacagggaggtagataatatggaagggattgggttctttgagggacttgatgaattcttgaatagtttgcccatactttctgttgttggagatgataagatcaaggctacttagtgaagtaaggctttttcctctctttgtttaggttgcgggtgtttcgttgttgtaggccttagcttttatgtttcctgttgatgtttaactgtagtggaaatactagcattttgattcctt

SEQ ID NO: 503 - DNA, 1397 bp, Arabidopsis thaliana
ttaattaacctgtggaaaacatcgttctttcaccaacaatggcgaagaagcgagatcgaattgtcaacactcaaccttttatctccgatgacgcctccgtcgcttcttccaggaaacgatcaaaggttccaaaaacccatcagaaacaggaaaagttgattgaagctggtatgagcgagaagatcatgaaacaagctcttgcccaacaaaaggaagttgctgatgaagagaacgccgagagaaaccctagtagcgccgcttttgctgttgccggcgctgcgactgctggagaggagcagaaaattctggaggaggaagaagatgatattgatgattttgatggaacctttgaaaaccagagccaattcgataagcaagaggagattaatgaggatgatgagaagttgtttgagtcattcttaaataagaatgctcctcctcaacgtacgcttactgatatcattatcaagaagctcaaagataaggatgctgacttagctgaagaagagcgtcccgatcctaaaatggaccctgcaataactaagttatataaaggtgttggcaagtttatgagtgagtatacagttgggaaattgccaaaagcatttaagcttgttacttcaatggaacactgggaggatgttttatacttgactgagccagagaaatggtcacctaacgcattgtatcaagccacaaggatctttgcttccaacttgaaagacagacaagttcaacggttttataactatgttttgcttccgcgagtgagagaggatattagaaagcacaagaagctgcactttgctctgtaccaggctctgaaaaagtcactgtataagcctagtgctttcaatcaagggatactattcccgctttgtaagtcggggacatgcaatctcagagaagctgtaattatagggagcattcttgaaaagtgttcgatccctatgcttcactcatgtgttgccttgaacagactggctgagatggattattgtggcacaacaagttactttataaaagttcttttggagaagaaatattgtatgccgtatcgggtgcttgatgcattggttgctcacttcatgagatttgttgacgatataagagttatgcctgtgatttggcaccagtctcttcttacctttgtgcaacggtacaagtatgaaatactaaaggaagacaaagaacatctccaaactctcctccagaggcaaaaacaccatcttgttactcctgagattctgagagagcttaaggatagcagaaaccgtggagagaaagaagatcctatggtggataattttgccccagtaccggctaaagaagacaggtttgacattcctgaagtaccaatggaagaagactgatgattcatggtgtttgggcgcgcc

SEQ ID NO: 504 - DNA, 931 bp, Arabidopsis thaliana
ttaattaaggcacattcacagagttacagcatctgaagttctaaccggaaaccattcctcccgagatggcgaccgtgaaaggccttcttaaaggccttcgctacattactcagattttcggtgagtctcatcgactcactaacaagaacaattttaacttttcttgcaatacaagtcacatctctgtatgtatatgaaaacaaaaaatctaattacagacgaagaaaaagacaaggacatgcagatcgggtttcctaccgatgtaaagcatgtcgcccacatcggatccgacggtcccgcgaccaatgtgccaagctgggtacgctttgtacatctgtacgtatttttccgactttatatacgtattagctaagtgtactcatcattagtaaaacaaaacatgtagatgggtgacttcaaacctcaagaaaacgagaatggtcaagtagtttctcgagcagatgccaacaacaatcaaataggagaaggagttggattacaagagttgttgcctcctaccgacaaaccaaagcacaagaagacaaggcgtaaatccgagacggtctcacaaaacggttctccgcctaggcgaaacagcagtgcctcagcatcagatatgcaaccaaaaaacacaagacgtcaccacaggagtaggcacgggtcgatagattcatcgaatgatccatcagttaggaggaggcgtgttgtctcggttaccaccaacgatatggaaggttcttaccctctttcagatagttctactcatagtagaaagtctacatcacgtcataggaagccaaaaggatcaggaggaggagagctatcaatgaagaagacgaaagggaaaactgagaatcctattgttgaatcagtcgatacatgtaatgataataatatcagtgacaaagagtaaaacacatcatggcgcgcc

SEQ ID NO: 505 - DNA, 2085 bp, Arabidopsis thaliana
ttaattaagatgttaaagacattgttagtccaatggcttgtcttcttcttcttcttcttaatcggttccgtcgtcaccgccgcagaagacgacggtagcttgtcgttatgcaactgcgacgacgaagacagtctctttagctacgagacaatcctcaactcgcaaaaagtcggcgactttcttatcgcaatcgcttatttctcgatcccaatcgagctggtttacttcgtgagccgcaccaatgtgccttcaccttacaattgggtggtctgcgagtttatagccttcattgttctctgcggcatgacccatttgctcgctggtttcacctacgggcctcactggccttgggtcatgacagctgtcactgtcttcaagatgctgactggtatcgtctctttcctcacggcactctcgttagtcactctcttaccattgcttcttaaggctaaggttcgtgagtttatgttgagtaagaagaccagagagcttgatcgtgaggttgggatcattatgaagcagactgagacgagtttgcatgttcgtatgctcactaccaagattaggacgtctcttgatcgacacaccattctatacactacgcttgtggagttgtccaagactctggggctcaagaactgtgcggtttggatcccgaatgagatcaagacggagatgaatcttactcatgagttaagaccgaggattgatgatgagaatgagaatgagcattttggtggttatgctgggttctcgataccgattagtgagtctgatgttgtgaggattaagagaagcgaagaggtgaatatgttgagccctggttctgtgcttgcctcagtgactagccgagggaagtcaggtcctacggttgggataagagtccctatgcttcgggtttgtaactttaaaggcgggacaccagaggcgattcacatgtgttatgcgatattggtgtgtgtgcttccattgagacagccgcaggcttggacttatcaagagcttgagattgttaaggtggtggctgatcaagtggcggttgcaatctctcacgccgtgattcttgaagaatctcagcttatgagagagaaactcgctgaacagaaccgagcgcttcaggttgcgagggagaacgcactgagagctaatcaagccaaggctgcgttcgagcagatgatgagcgatgcaatgaggtgtcctgtgcggtccattctcgggttgcttcctttgatacttcaggatgggaagttacccgagaaccagactgttatcgttgatgcaatgaggagaaccagcgagttacttgtacagcttgtaaacaatgccggagatataaacaatgggacaatccgcgctgcagagactcattatttcagtttgcattcggttgtgaaagagtcagcttgcgtggcgaggtgtttatgcatggcaaatggttttggtttctcagctgaagtttatagagcattgcctgactacgtcgtaggtgatgatagaaaggtctttcaagcgattttgcatatgcttggggttctaatgaatcgaaagatcaaagggaatgtgactttctgggtttttccggaaagcgggaactcagacgtatcagagaggaaagatattcaagaagcggtttggcgacattgctattcgaaagaatacatggaagttagattcggattcgaggtaactgctgaaggtgaagagagtagtagtagtagtagtggtagtaacctggaggaggaggaagagaatccgagtctcaacgcttgccaaaacattgtaaaggttggtcatttgtgttttgtatgtaaatgtgctaatgacttggtttaacacttttatcttgttttgtgacagtatatgcaagggaatattcgggttgttgaggacggtctaggtttggtgaaaagcgtctcagttgttttccggtttcaactccggcgatcgatgatgtcgagaggcggtggatattctggagaaacgtttagaacctcaactcctccgtctactagccactgatcattgacgtcaggaagggggggaggggaatgtagtgcaaaagaaagatttaaggggtggcgcgcc

SEQ ID NO: 506 - DNA, 1514 bp, Arabidopsis thaliana
taataataatttgccgacaaaattaataaaataatgccaaaccgacgacaaaatcaagattcttgtctgttgtcccaaattgctcatcaaattcaagatcctgtaaaatcagtagcaaccatggagaagccaaagttcaagactgtccaagaggtggttgcagccggtcaaggactaccggagagatatctccatgcaccaaccggcgaaggcgaaagtcaaccacttaacggtgcggtgccggagatggatattccggccatcgatctcagtcttctcttctcttcctctgtagacggtcaagaagagatgaagaaacttcactcagcactctctacatggggcgttgttcaggtttgactatcttggttagtgatgatcagattcatgatttaaactctgtacaagttcttattgaagtaagcaggtgatgaatcatggaattactgaagcttttcttgacaagatttacaagctaaccaagcagttctttgcgcttccgaccgaagagaaacacaagtgtgctagagagacaggtaatatccaaggatatggtaacgatatgattctgtctgataatcaagttcttgattggatcgaccgtttgtttctcactacttaccctgaagataagcgtcaacttaaattctggcctcaagtccctgtcggattcaggtaagaaagtgacaccacattggttcattattgactgtggtggtgattttgactatagtttttttattcagcgagacgttagatgaatacacaatgaagcaacgggtattgattgagaaattctttaaggctatggctagatcattggaattggaagagaattgttttctagaaatgtatggagaaaatgctgtaatgaattcaagattcaacttctttcctccatgtccaaggccagacaaggttattgggattaaaccgcatgctgatggttcagctatcactcttctcttacccgacaaagatgtcgaagggcttcagtttcttaaagatgggaagtggtataaagctccaatagttcctgatacaattcttatcactttaggtgatcaaatggaggtacatcaatcctgtagagatatatgcatatgattttcaaagattgattggtgtaggtttgacataatctcttgtgtgtttagataatgagtaatgggatatataagagcccggttcatcgagtggtgaccaacagagagaaggaaaggatatctgtggcaacgttttgtgtaccgggtctagacaaagagattcaccctgcagatgggcttgtgactgaggcaagaccaagattgtataaaacagttaccaagtatgtggatctccactacaagtactatcaacagggtcgaagaactattgaagctgcattaatctgattatacttctttaagtctccttcttcaagtctcatttttttttccaaagaaaactggccaatcttttcaagtaacatttcaacaataaagagtctctaaacccttaagtaacctttcaac

SEQ ID NO: 507 - DNA, 811 bp, Arabidopsis thaliana
ttaattaacgacaaaggtgtcaaatttggtcatcatgacggagtataagcaggagcaggaaatggagattgaagctcttgaagctatacttatggatgagtttaaagaaattcattctagtgaaagtgggcttaatacttcgaatcgatgctttcagattacagtgactcctcaggatgatgaactggaggaattagcaatcccaccagttcagctggctttggttttctcgcacacagaaaattacccggacgaggctccgcttttggatgttaaaagtattcgaggaatccatgttagtgacctcaccatcttgaaagagaagcttgaacaagaggcatctgaaaatctaggtatggccatgatctatacactggtctcatcagcaaaggactggttgtctgaacactatgggcaagatgatgcagctgaatttgccgaagtagaagctgccaaagaggatgaggtaattgtccctcatggagaacctgttacgctagagacatttttggcgtggagagagagatatgaggcagagcttgcacttgagcgagccaagttgatgccggagtctgctcttacagcacctaaggagaagaagcttacaggaagacagtggttcgaaagtgggagagggagaggaacggtggtcattgctgatgaggaagatgaggaggaagatgaggaagacatcgactttgaagacgaagactttgaagatgacgaagaagacatgcttgagcactatttggcggagaaatctgattcttccgctcccccaacaaggacatgaagctaagggaggcgcgcc

SEQ ID NO: 508 - DNA, 1614 bp, Arabidopsis thaliana
atggagttatctcttctccgtccgacgactcaatcgcttcttccgtcgttttcgaagcccaatctccgattaaatgtttataagcctcttagactccgttgttcagtggccggtggaccaaccgtcggatcttcaaaaatcgaaggcggaggaggcaccaccatcacgacggattgtgtgattgtcggcggaggtattagtggtctttgcatcgctcaggcgcttgctactaagcatcctgatgctgctccgaatttaattgtgaccgaggctaaggatcgtgttggaggcaacattatcactcgtgaagagaatggttttctctgggaagaaggtcccaatagttttcaaccgtctgatcctatgctcactatggtggtagatagtggtttgaaggatgatttggtgttgggagatcctactgcgccaaggtttgtgttgtggaatgggaaattgaggccggttccatcgaagctaacagacttaccgttctttgatttgatgagtattggtgggaagattagagctggttttggtgcacttggcattcgaccgtcacctccaggtcgtgaagaatctgtggaggagtttgtacggcgtaacctcggtgatgaggtttttgagcgcctgattgaaccgttttgttcaggtgtttatgctggtgatccttcaaaactgagcatgaaagcagcgtttgggaaggtttggaaactagagcaaaatggtggaagcataataggtggtacttttaaggcaattcaggagaggaaaaacgctcccaaggcagaacgagacccgcgcctgccaaaaccacagggccaaacagttggttctttcaggaagggacttcgaatgttgccagaagcaatatctgcaagattaggtagcaaagttaagttgtcttggaagctctcaggtatcactaagctggagagcggaggatacaacttaacatatgagactccagatggtttagtttccgtgcagagcaaaagtgttgtaatgacggtgccatctcatgttgcaagtggtctcttgcgccctctttctgaatctgctgcaaatgcactctcaaaactatattacccaccagttgcagcagtatctatctcgtacccgaaagaagcaatccgaacagaatgtttgatagatggtgaactaaagggttttgggcaattgcatccacgcacgcaaggagttgaaacattaggaactatctacagctcctcactctttccaaatcgcgcaccgcccggaagaattttgctgttgaactacattggcgggtctacaaacaccggaattctgtccaagtctgaaggtgagttagtggaagcagttgacagagatttgaggaaaatgctaattaagcctaattcgaccgatccacttaaattaggagttagggtatggcctcaagccattcctcagtttctagttggtcactttgatatccttgacacggctaaatcatctctaacgtcttcgggctacgaagggctatttttgggtggcaattacgtcgctggtgtagccttaggccggtgtgtagaaggcgcatatgaaaccgcgattgaggtcaacaacttcatgtcacggtacgcttacaagtaa

SEQ ID NO: 509 - DNA, 4202 bp, Arabidopsis thaliana
aaaatcgtcatctacttcttcttgaaaccctagttccaaaatctgcacacacactcagaagaagaagacgtcatctctctatctctgtctttctgctaatttcacgaagaatctgagaatatgccaaccatcagtgttggcagagaccgtttgttcgctgctcttggagaatcctatagtaattcaatttcttcttctccttcttctttctttctctgatttcatagtgtgtgttttctaatttcgtcttatcctctttgtaatgcagctcaggaaaaattcgaggaactgtgtttcagtttcggtatcgagcttgacgatgtggtgagtgacttcattttgatctgcttttgtgatttgattcttttttcaaatcctgattaaggttttgcatcgtatatcaatgaaacagactactgaaaaggcaataatcagaaaagagaagcacatcgatgaagaagctgatgatgatgaagaaatcatctacaagattgaaattcctgccaacaggtttataaactgtgacttttcttcttctagattaaggaattgtttaagtattaggaaattgattcggtattttgtttatatctctaattgcagacctgatttgctttgcctcgaagggcttgctcaatctcttcgcgttttcatcgagaaacaggagataccaacgtatactcttgctgacattagcaaagacaagatccttcaaatgaatgttaaacctgaggtgtgtgtgtttctgtcatagcaagtatcttctgatttggttccttctttattgaaacttttctccttttgtagacatcgaagattcgtccatttgttgtatgtgctgttttaagaggtgtaacctttgacgaggctcgttacaacagcttcattgatcttcaggataagttacatcagaatatttgcaggtaaatgacattgctagttataggatccatttcttctctcttgtattatttcaattattagctaccatcattgtgttggcttgcattttgggattaaaaattggtttccatttatttaactttgctacgctgtacacatttcaggcgaaggtccttggttgctattggaactcatgaccttgatacattgcagggtcctttcacatacgaggtgattgtctgttattatctttcctcttcttttttcgtgtctacagtcttcctctacctctcgaagaagtagaatactgatccaactttcatacaatctgtttcctttgatttatgttgacacttttgtttagttgagcttttttcgtgtctcattaactctatgtatattatttttcaggctttgccgccaacggatataaattttgtacctttgaagcaagtaagtcaatgtcattatgggttcatcaactagtatctctgttcaaaatagttacatgtgcctgtgtttctttgtttaaattctgaatcattctttctcctcggttatatagataaatgatttttaatgtaatggttatttggttatagcatgttctttttttttaatttctggtacaatttctcacttcttcgtagtgacaatctagtttgtttcatgtttgtacctaataccaatttcttggtcgcagacaaagagcttcagggctgacgaacttattgaattctacaaggtaaacagttaatctgttactttctcgtattgtgttatgacatttgttactcttgtgaaatcgtaacttctttggagcaaataatcaacgaaagatatccccgaacttatggatatgtatagaatgagatgaaataattgtttactcgctgaataactacttaggctttccgaaggcttttccttgatgtgtgaaagattacttttgtttgcagtctgatatgaagctgaaaaagtttctacacataatcgagaattcacccgtcttccctgttttatacgacagtaagaggtatttgttcttcctacttctgttcattttacctctagggtgaagaagtaaagatgtctatcaatctatgataaatactttcataaaccaatcaataattttcctactataaatgaattacgtactgaaacataatgaaagctcacttttgcagaactgtgctgtcattgccacctattatcaatggtgcacattcagcaattaccttacagacaaagaatgtcttcattgaatgtactgcaactgatttgacgaaggccaagattgttttgaatacaatggtatgttgttaacaaatcaaacctacagtgctaactgatcaatagctaactaatcatttaacgttttccaggttacaaccttctcagaattttgtgccagaaaatttgagattgagcctgttgaagttacatacgacgatggaaagtcatacatctatccggatttagctgtctatgatatggaagttcctctctctttcattacagactcaattggagtctctttaaaggtggaacaggtaataaagacatcactgttgtcaatttgtaatggttgaaccagcctcattttcttatttgagatgtcgattttagaggctactgtgcaatgattttaatcatttgttatgtgaaatggattttgtacctttcaggttacaagtctgctgacccgaatgcagctgcaagctgagcaagcaaaatctagtgataaccagtgtgccatcaaagtacatgtaccccccagcaggagcgacgttctccacccttgtgatgttatggaggtatattttcatagctaaaacccttctgtgttggtgacataatgccattatgatgattctccatataactaatcattttgcttgtatttcaccaggatgttgccattgcctatggtttcaataacattccaacaagaaagcctgcttcgataaaaccactgactttgaatgagctcactgatcttctaagaatagaggtatttgcacttccatttaactgttgcatcagctcacagagatctgtgtctgtgtttcttgttaaattacttttaagcatttgtttctcagggaaattatctattttatattttgaatttagattgcgatgtgtgtgtacacggaggtggtaacgtggctactatgctcacataaggaaaactttgcgatgctaaatagagaggatgttaattcagccgtcatagttgggaacccgcggtctgctgattttgaggttcctttcaaataatttggtcatctctttgtaaacttttccaatggtaatgctttgctaattgtttcattatatgttgaaataggccatgaggagggctctcatgcccggattattgaagacagttggtcacaacaataaataccctaaaccaattaaggtaaacccatatctctggtgccgttagctagatttgagattttagtgtcccgtgaatgataaatctttttctttctgttaaagatttttgaaatcagtgatgtggtcatgttggatgagagcaaagacgttggtgcatccaatcgtcgccatctcgctgcactatactgtggtgctacttctggatttgaggtatggatttcatttgctaactatgatatcgtcgttatgtaacttattttctcaagtttgcgcaacttcatcaattgatatgctttctctgtataattcttgattcagcttatccatggcctggtcgataggatcatggaagtgatggcaataccatttctaacaatccatgaaaataacgtaccaatcaatgaaaaagacggatactatgtaaagctctcccaagtaagctctcctttcgatctgcaagcatcttaagatttttcattatcgactaactcaagatcctaatctatctctcttttgcgttctgcaaaaggaacccgagtttctaccgggcaggcaagctagcatcattgtcagagggaaacatattggtaactttggaatcgtgcatcctgaggtatcactcatttaagtctccttgcttgatccaaatagctgcaataatttttcaaatcgtttttcttttcttttgtttccatcaggttttgaacaactttgacatccctgatccatgctcttacttggagttagacatcgaagctatcttatagaaaaagaaaccaaccaaaatgttttcttctctttgtgcaatatcgttatctggattatttgaagttgttgattttgtttggttagaggatctagaacacgcatgtcgagagaattactac

SEQ ID NO: 510 - DNA, 1113 bp, Arabidopsis thaliana
ttaattaagtgccatcttcatcctctgagatgtggagattctgcttcttcttatcgttactattctttgatgttagcgcggtgaaatctgcagaatcgattttcctcccaagtcaaatcggagttgaagattcccgcgtctttgaatctcttagtcttagtcctgtatgctccgcggctgatccaaacctcaactacaagccggtcatcgggattctgacccaccctggcgaaggtcgatgggacgctcgtcttcactctctgaaaaactacgcctacgcgacgaacatatcgtacatcgcagcttcgtatgtgaagttagctgagactggtggagctcgtgtgattcctcttatctacaacgagcctgaagaaatcttgtttcagaagctagaattggtaaatggtgtgatattcacaggtggttgggctaaaacagggttatattacgatgttgtggagaaaatcttcaataaagttatggagaaaaatgatgctggagaacattttccggtgtacgccatgtgtcttggattcgagattttgtcaatgatcataagtcagaacagagacattcttgagaggtttaactcagtaaactatgcatcaagtctccagttttttaaaaacgttaatatcgaagcaaccgtgttccaaagatttcctccagagctgttgaaaaagctcagtgcagactgtttggttatgcagaaccactattttggtatctcaccagacaactttcaaggcaatccttatctgtctagtttcttcaatatcgtcacaaccagcgccgataaagacagcaagacttttgtttcaactattcgatcaaaacgataccctgtgaccgccttccaatggcatccagagaaaaatgcattcgaatggggatcatctgaaatcccacactctgaggacgcaattcaggtgactcaacatgctgcaaattatctagtcagtgaagccagaaagtcaatgaacagaccatcttctgagaaagtgctgagcaatctcatctacaactacaagcctacgtactccggatacaaagggagcggtgacgacgaggtttatattttcacgtaacaaagatccctctctgtggcgcgcc

SEQ ID NO: 511 - DNA, 463 bp, Arabidopsis thaliana
ttaattaatgtcagctactggtataaaacggtccaacctcaacactagaccggttcagagagatgcttcggctaagcaaacagctatcaagggaccttatggtaagagtccgggatgcacaacaagctgcggattaaggttaccgaggaaaacagaagtgacagcagcaaaattgatcaagcatcttggatgcaaatttgcaaaaggtttgcgtctggtggtgatgaggaagaagaaaagatctccaccgtcgaaggtttcttctttttctgggaggtctcagccaccaatcatcccaataaacaatgacagtcatcgatcagaggccatagaagactgcatacagttcatcaactcatcatcctccttcaccagatcaaactctacttcttaagtgttatcattcccaaaccttttgtctcggtcgctcgctcgctcgcgtattgtctattttaggcgcgcc

SEQ ID NO: 512 - DNA, 506 bp, Arabidopsis thaliana
ttaattaaccaagaagaccttctctcatcatcattattataggaagttaggaactatggcttatgaagagagaagatcatcgatcctggattcattctcgctatcgccactaccatacccagttcttttgatcctagccgttgcttcagtgttcttgttgagttcatggtacttcagcttggaagaagcagccgaatcagcggaagagcagataaattttgcgcttctcttgattcctctgtttcttatagtcttggtccggtggttatcttccatggagaaccctgatgcgcttctcgggatgttttcaagcagtcgtcggacaacttacgtgagtcccggagccggaggtgacggtggaagctcgccgtggggagtggcggcgttgatagttttgttgcttgtattgcttcagtatcaatcaagtttcttggagatgtggtctggttaatgatattgataggtttttttgattttcacgtgttttgttttgtcgtcggcgcgcc

SEQ ID NO: 513 - DNA, 932 bp, Arabidopsis thaliana
ttaattaagaggtggtgattatgagttcaagcgaagcgtttcccgtgatgcaggagatcatgcttgagtttcgtgctgggaagatgtctttgcagggaacaagagttgtccctgatgcacgaaaaggacttgtccgcatagctagaggtgacgagggactgattcatttccagtggcttgatcgaaaccagaatacagtagaagatgatcaaattgttttcccagatgaagctctatttgaaaaggttaatcaatcctcagacagggtgtatattctgaagttcaacagtgatgaccgcaagttattcttctggatgcaggagccaagagctgaaggtgatgcagaattgtgctcttcagtcaatcaatacctcaatcaaccactagagtttcctggtgaagaaggacttgcagctgctatcacggaggagctggaagacatggcagaggataatacatcatctagagcgggaaacttggttgtaccaaatttgtcttcagaggtgagtgacgtgacatcgtcctctggaccggttaagctggcagacctgcaaagaattctgaacaacctctctggtggccctgtaggtattgctggagatcaagacgaaggtttagcattaggggatatcttgaaaccggagttgataatgccattgcttgaggcgttgccggtacaagaacgactatcttcgcatttacctgagggtcattctagggcagaagatatactggagttgttgcagagccctccttttcgtcaacaagtagatgcatttacctatgtactccgcacaggacaaatagatttgactcagtttggtatagacccaagtaaatacaagttcacagtggactcattccttgaagcacttgaagactcggtttcaacgcaatcaagggatgcgatggatgagagttaatggcgcgcc

SEQ ID NO: 514 - DNA, 757 bp, Arabidopsis thaliana
ttaattaacgatcgatccgttaaaaaaaaatggatatgattccccaattgatggaaggctcttcagcttacggaggtgtcacaaacctcaacatcatctcaaacaactcctcctccgtcaccggagccaccggaggtgaagcaacgcaaccactgtcttcctcctcctcaccatcggcgaactcaagccgttacgagaaccagaagaggagagactggaacacgttcggacagtacttaaggaaccatcggccaccgctttcgctttcccgatgcagtggagctcacgtgctcgagttcctccgttacttggaccagttcggtaagacaaaagtccacacgaacatttgtcacttctatggccatcctaatcctccggcaccgtgtccgtgtcctctccgacaagcttggggaagtcttgacgctcttatcggtcgtcttcgagctgcctttgaggaaaacggaggcaagcctgagacgaatccttttggagctcgtgccgttaggctttatctaagggaagttagagatatgcagagtaaagctagaggtgttagctacgagaagaagaagcgaaagcgtcctcttccttcgtcgtcgacttcttcttcctccgccgtagctagccaccagcaatttcaaatgctaccgggtactagttctactactcaattaaagtttgagaagtaagtaattatataattaagagaaatggagtattttatgtaatctgaaatgtgatttggtctcggcgcgcc

SEQ ID NO: 515 - DNA, 1114 bp, Arabidopsis thaliana
attccagtaaaacggcacacaactgcaaaaccctaatctcaagttttctgtcgattttgatcttttggttgtaattttgtttgtgaaagtttcggacttttggaatttgaggtagaagagatgaacagaggaagaaggaatctgaaacaagcggcgtcggaccaggatttcacgcttgaggaatgtcagagcattgcccaagtcgtctctctcagaggttccaatcaaattgaggtaaaagataaacgcttttttcttaggtttcatacaatctcgccaattcatagcattttcttcggaattttctttggatgggttggcttgtttgtatgtatgtatgtactgaattaaagtttgtgttttaactgctgtagttgttttgttgtctctttgaagataatggatgcaaaaggagagaactcattagctttgtttccagccaagtttcgtgagagcatgtggatcagacgaggtactttttcttgttagtcttctctggtttgttctttcttgaatggttagatttactgcatgatttggtgtggattggaggagtttgagatgtgctacactgatttgcaggaagctttgtagtgattgaccatacaggaaaggaaaaggctcaagagtctggtagcaaagttacatctattgtatgtaaagttctattctttgagcaagtccgtcttcttcaaaagtctccggaatggtatagcttctatcttttgttctgtatggatggcttctcatattgagtaattatagctcatgttagtttggacatggtgaatgcaggccagaaatcttcaaagatactagaccgattccagctgagaaaagctcacccattgaacagcatgaagatgacggtgaagttgattcgagtgatgatgatgatggtatgcctccattgcaagcaaacacaaacagattgagaccgtttggggtgaagtgtgatgcagaaactgattcagggtcagattccgattcatagaaacatccggtacatttcttttcgcagcctcaacttaatttctcaatataggggatttatagttgcaagctgtattttataaacagtatgtaaccaacacagatctgctgataaagcaga

SEQ ID NO: 516 - DNA, 1732 bp, Xenorhabdus nematophila
ttcatttatttgtcagctttcaaactctttgtttcttgtttgttgattaacccttaattaatccgggcgcgcctgatttatcacaagtttgtacaaaaaagcaggctcctgcaggaccatgaccaatcatctagagacattactgctgcgccaacaggcttatatcaatggtcaatgggttgatgcgcataataaaacgacgtttgccgttatcaatcccgccaatggcgaagttattgccaatgtcagtgatatgggttgtgcagagacgcaacaagccattgaagccgcccagactgcccttcccgcatggcgggcattgactgccaagcagcgcagccaaaagcttaagcaatggttccatctaatcatggataaccaaaaatcgttagcggaactgctgagtgccgaacagggaaaaccccatgcggaagcgatgggagaaattgcctatggtgccagttttatcgaatggtttgcggaagaaggtaaacgcatttatggcgaaactatcccatcaccgatgccgggtcgtcgtctcgcgaccatcaaacagccgataggcgttgtagccgcgattacgccgtggaatttccccaatgccatgatcacccgtaaagttggcccggcactggccgcaggttgtacggttgtactgaaacctgccgcagaaactccgctgtctgcgctggcattagcagtactggctgaacaggcgggcattccggcaggtgtcctgaatattgtcaccggtatagatgccaaagcaattggcgaaacactgacttcaagccctatcgtacgcaaactctcttttaccggttctacccgtgttggcaagttactgatggcgcaaagtgccgataccgtcaagaagctttctctcgaactgggcggcaatgcgccttttattgtctttgatgatgcggatcttgatgcagctgtggaaggcgcgatggcgacgaaattccgcaacagcggacagacttgtgtcagtgccaaccggatcctggtacaagaaggcgtttatgatgcgtttgctgaacgtctggttcatgctgtcaaacaacttcgcgtcgggccgactcatagcgattcatcacaacctgtgccacaacaagggccactgattaatcaggcggctgtggaaaaaatacaggcacatatcagcgatgcggtttcccacggcgcgcgtattctggccggcggcaagtcccacaccttgggtgggttattctttgaacccaccgtgctggccgatgtggatgattccatgcgggtcagccatgaagaaaccttcggcccactggcgccgctgatcaaattccgcgatgaagcagaagccattcgcctcgccaatgatacagaatttggcctcgcggcttatttctattcccgcgatattggccggatttaccgggtggcagaagcactggaaagcggcatggtcggcatcaatgaaggtttgatttccaacgaagttgttccattcggaggcataaaacagtctggtctggggcgtgaaggttcacgttacggtatcgaagattatctagaagtgaaatatctctgttttgggggtttgggcactaaaggagcttaacacgctatgcaacagcagctacagcaagaagtcatatcacaggttgctcgagacccagctttcttgtacaaagtggtgataaattggagctctgcagagctttcgttcgtatcatcggtttcgacaacg

SEQ ID NO: 517 - DNA, 1108 bp, Saccharomyces cerevisiae
aactctttgtttcttgtttgttgattaacccttaattaatccgggcgcgcctgatttatcacaagtttgtacaaaaaagcaggctcctgcaggacctcttctggatcaatttttctttttcatctaaagtttaaaaggagatgggtttatatcaagcaaagaatgatgagggaagtgatccgaaaagcagcagcaagattgacgatttgatagaaaatgaggcagaaatcatacgactaatcaaggaagatggcaagttactgatagacaatggcgatggtagagatatccataacataattcaagaagacaagctcctcagtgtagaatttaacgaagtactaaagcgatttcacggggaagaaaagtcagatattcctcggaaggagtttgatgaagacgaggatgacggatatgattctaatgagcaccatcaaaagactatagaagtaatgaacacactaaatcacgtcattaataaagaggtgattcctcccgaaaactttagccacgtcgttggggagatataccgtagcagtttcccacgacaagagaacttttcgtttttgcatgaaagactaaagttgaaatccatcttggtactaattccggaagaatatccgcaggaaaatctaaattttttgaagttaacgggtataaaattatatcaagttggaatgagcggtaataaggagccatttgttaatataccgtctcatctactgacaaaggcactagaaatcgtgttgaatcctgcgaatcaaccgatactgatacattgtaatagaggcaaacatagaacggggtgtttgattggttgtataagaaaactacaaaattggtcgctaacgatgatttttgatgagtacagacgtttcgcatttccgaaggccagggcgcttgatcagcagttcatcgagatgtatgacgatgacgaaattaagaggattgctagtaaaaacaactggttgcctctacaatggtaatatgtagacagtgattacctttacgtaactagtctcttcgaaatgagtctcgagacccagctttcttgtacaaagtggtgataaattggagctctgcagagctttcgttcgtatcatcggtt

SEQ ID NO: 518 - DNA, 578 bp, Saccharomyces cerevisiae
ttcttgtttgttgattaacccttaattaatccgggcgcgcctgatttatcacaagtttgtacaaaaaagcaggctcctgcaggacctcattgcacaattgagtactaaaagctttcgtatcttacccaatatcatgtccggtgttaataatacatccgcaaatgatttatccactaccgagtctaactctaactcagcagtaggcgctccttctgttaagactgagcacggtgactccaaagactccctcaaccttgatgctactgaagcacctattgacttacctcaaaaacccctctctgcatataccaccgtcgcaatcctatgtttgatgattgcatttggcggtttcatctttggttgggataccggtaccatttctggttttgttaacctttctgactttatcagaaggtttggtcaaaaaaaaacgacaaggggacttactacttatcgaaagtaagaatgggtttgattgtctcaatattcaacattggctgcgccatagctcgagacccagctttcttgtacaaagtggtgataaattggagctctgcagagctttcgttcgtatcatc

SEQ ID NO: 519 - DNA, 1674 bp, Saccharomyces cerevisiae
ttcttgtttgttgattaacccttaattaatccgggcgcgcctgatttatcacaagtttgtacaaaaaagcaggctcctgcaggaccctattagcaaaagcgcgagaattactacattataaaggatctgtcaagaatgacattgaataggaagtgcgtagtgatacataacggatcgcacagaacggtggctggatttagtaacgttgaattgccacaatgcattataccctctagctatattaaaagaacagatgaggggggggaagctgagtttatattcggaacctacaatatgatagacgctgcggcagaaaaacgcaatggtgacgaggtgtatacattggtagatagccaagggttaccgtacaattgggacgcattggagatgcagtggagatatctgtacgacacccaattgaaagtttcacccgaggaactgccactggtgattacgatgcctgccaccaatggtaaaccggacatggccatattagagcgctactatgagctggcgttcgacaaattaaatgtaccagtattccagattgtaatcgagccattggcaattgccctatccatgggcaagagttctgcattcgtgattgatatcggcgcgtcaggctgtaacgttactcccatcattgacggtattgtggtgaagaatgctgtagtgagatctaaatttggcggtgatttcttggattttcaagtacacgaaaggttggctccactgattaaagaagagaacgacatggaaaacatggccgacgagcaaaaaaggtccaccgacgtttggtacgaagcaagcacgtggattcagcaattcaagtctactatgttgcaagtaagcgaaaaggacttgtttgagttggaaaggtattacaaagagcaagcagatatatacgctaagcaacaggagcagttaaaacaaatggatcagcaacttcagtacacggcgttaacgggaagccccaacaatccgttggttcaaaagaaaaattttctattcaagccattaaacaagactttaaccttggaccttaaggagtgctaccaattcgcagagtatctcttcaaacctcaactgatatcagacaaattctcaccagaggacggactgggaccgctaatggcaaaatcagtcaagaaggccggcgctagtataaattcaatgaaggccaatacctccaccaacccaaacggattgggtacaagccatataaacaccaatgttggcgataataacagtactgccagcagcagcaacatatcaccagaacaagtatactcgctactgttgacgaacgtcatcatcacaggatctacctctctgatcgaaggtatggagcaacgcataataaaggagctgtcaatcaggttcccgcaatacaaattgacaacttttgccaaccaagtcatgatggaccgtaaaatccagggatggctgggcgcccttacaatggccaatctgccatcatggagcttgggaaaatggtactctaaggaagattacgaaacgctgaaaagagacagaaagcagtcgcaggctacgaacgcaacaaactagtggtaaggcgcaaatatccaaaagggattgtaggagctcgagacccagctttcttgtacaaagtggtgataaattggagctctgcagagctttcgttcgtatcat

SEQ ID NO: 520 - DNA, 764 bp, Zea mays
aactctttgtttcttgtttgttgattaacccttaattaatccgggcgcgcctgatttatcacaagtttgtacaaaaaagcaggctcctgcaggaccatgcgcagctgcagctcggtaaggcagatgttgctgactcgtctgtccagcgtttcttgctcgtcaacagcgcagcagttgcatgcgggcgtcggcaagttcgccgccgccgcatgctggagctggaagaagaagcgcgaggagctcccctgcttcagggccagactggccgccaagccgccgcgcgcctcaccggcgaagggcggcattgttccggccagcgacgatgacgacggcgttagcctcggcaccgtgaagctgccgggcaacatcgacaccgctcggttggagtccttgctcttccagtgggggaacagcctctgccaaggcgccaacctgccacttccggtgcctctcaaggtggacaaggttgagggcgggatcaggctagggttcgtcgcggtcgaggacggcgcgacgcggacgctggtgtacatcgattgcctggtctctccggccccggatggctctggtccggtgttccgagcgatcaggaacggtcctatgaaggacaaggagccacctggggagcccaggatcatgagaagcctccttcaggctctcgaaaagtctattcagatcgctcgtgtttgactcgagacccagctttcttgtacaaagtggtgataaattggagctctgcagagctttcgttcgtatcatcggtt

SEQ ID NO: 521 - DNA, 3557 bp, Zea mays
ttcttgtttgttgattaacccttaattaatccgggcgcgcctgatttatcacaagtttgtacaaaaaagcaggctcctgcaggaccatgacgggggcgcgggagccggtggccatggagataccagcggaggaagggccagcggcggcgagggcgccgccgcggcggattaggaggaggctggtggagggggcgcgcggcggtggggcgccggcgagcgtggaggagatcgaggccaggcttagggaggccgagctccggaggcagcaattccgtgaatggttggcctgcaaagcaaggaagaagccacggagcccgtcgtggtcctctcaagaggaagaccatgggcagcgccttgaagcgaagcttctggctgctgagcagaaaaggctaagcctcttggcgaaggcacagaaccgactcgccaagttggatgaactcagacaagctgctaagaatgatgtggaaatgaggtttgagaaggaaagggaagaactcgagaccagagttgagtctcgtgtccgacaggcagaggagaaccgcatgcgccttctgcatgccgatatgcagaagcgggccgcactgaaggagaggacagcgaggtccctggtgcagaaggcaaaatcagagagcaaatacatggagcaggtgcgctctgcaatttctctgaagcgcgctgctgctgagaagaaacgactgaggttgctggaagctgaaaagacaaaggctcaagctaggcttttacgcatccaaaaagctgccatgactgtatgcagccggagagaatcagagaggagaaaactgaaagaacagctggacaacaaacttcaaagggcgaagaggcagagggctgagtatttgaaacaaagaggaagtcctcgtggttcaacccatgctgattacttaaagcatgcatatgccctttcaagaaaactagcaagatactggagaatatttgtgaagtccaggaagacaacatttgctttggctcaagcttatgatgccttggggattaatgagaagtctgtgaaaaatatgccttttgaaaaattggccatgtcaatggaatctcctgtagttcttcggagcacgaaggcattactcgaccgattggagaaacgccttgtcatttctcattcagtagcatcttcatcagtagaaaatgttgatcatctactgaaacgccttggttctcccccaaggaggagggctcctcctagcagagaaggaaaaactcgggcagtggtaaaaagaccagctaaaagttctgaggcaagcatcaaattgcccagatactcactgagggtggtgctctgtgcttacatgatactggctcatcccagtgctgttttaagtgggcaaggtgagcgggagaaacagcttatcgagtcggcagcaaactttatcaaggagttcgagctgttgattaaggtaatccttgatggaccagggcagtcatctggtgttactggccagaggaagttcagggcacagttggctaatttggacaaggcgtggtgttcgtatctttacagctttgtggtgtggaaggtaaaagatgcaagattattggaggaagatcttgtcagggctgcatgcaagcttgagttgtcaatgatgcaaacatgcaagctaactgcagacaggcactcgcaaaacaatcttacacatgacatgaaggcaattcagaaacaggttattgatgatcaaaagcttttacgtgataaggttcaacacctgagtggcgatgctggccttgagcggatgaactctgctctttccgatacgagatcaaagttctttgaagcaaaggagaatgggagtccattgacagcacctgttgcaaatgtgtctacccctttgagcatcaattcgtctgggaaagcaccactttctgaggttcctgaaagttccaggacaaatgttgttgggacaagctctgtagtccgttctttgttcagtgcttcttcatcatcagtcagttcatcaccagaaaagcagccgacagagaatgaaaaaatggtcaatgaaatgcttcatgaggatgccagtgctcttgctggcaggtctgatagtgctagtactgctgaggaggagttccagaacaaagtgagagaaaccatggagaaagctttctgggatatggtcaccaactccatgagaggagaaagacctgattatagtcaattgatcaacctagtaaaggaagtgagggattcgttgcatgacctggctcccaaagaatggaaggagaaaattcttgagaacattgaccttgaaattctgtctcaggtacttgggtcaggttcccaggatgcacaatacttggggcagattttggagtattctctggatatggttcgcaagctctctgctgctgcaaaggaggatgagatgaagaaaaaccatgataaattattgagtgaattgtctacgaattctgaagttaacggcgatggcatcaactcatttgtcattgctgttatcaagggccttcgtttcatcctggaagaaataaaggaactgaaagcagaagtgagtaaagcacgtatccagatgatgcaacagatcataaaagagtcggctggggttgagtacctgcagaaggcttttgctgatcgctatggacctcctgagacggcaccagcttctcttcccctaactctgcaatggattttgacatcgaagaacattgcggaagaagaatggagtgaacattcagactgtctttcagtaatgccagcagcagggcaggctcctgctcttgttccggtactccggtctggtcatggagctccagtagggcaaccatctccttctgcaggagacacctctggtcaaccagagtgcaagggtgagaagcttgacaagctaataaggattggcctgttgcaactcattggtagtgtggagggcttgcaattgcagtcaactcctgaaagttttcagattaatctgctgaggctgagggccgtgcagagccaattccaacaggtgatcgtgatcgccacaagcatgctcgtcctgcgccaaattctgatgagcgagaactcgagggccactcctctggaactggaaaatgccatctcagaactcgtcaaggctctcgcggacattctggacagctcacccgattccggcacggaagagattgtgcaggcgatggtcaatgcatcagcctcagttggctcaccatcagaggagaaggttcaggccaggatgcagatgatcacccgggtgttcctcaagagcctccagcctggtgacgtggtcttcaagaaggtatcccgtgcggtctactgcgccttccgtggcatcatcttaggtggcagtggtcccaagggccagaagctggcggatgcggcattgcgccgcatcggcgccatcaaggttgtcgacagggtgttgaaggctgctgaggtgctgatcaaggtggcaacggtatcagagaaggtccacggtccctggtacaaagctctgatagtctgactcgagacccagctttcttgtacaaagtggtgataaattggagctctgcagagctttcgttcgtatcat

SEQ ID NO: 522 - DNA, 1565 bp, Zea mays
ttcttgtttgttgattaacccttaattaatccgggcgcgcctgatttatcacaagtttgtacaaaaaagcaggctcctgcaggaccatggggaagcgatccggcggccggaagctgccgttcttcaccagatcctcctcgtcctcgtccaagcggaatcgctccgcccgccgcctcccttccctccccaagcaggacaacgcgacgagggctcttctcgcctccccctctgctgcctcgccgtccgcgaccccgggatcggcggcggcggggcagaccgcccagctgccccctcccctctcagttaccgcgggcggcggggttgccgtgtcggggaaggtcaacaagaagaaggccggcacgcgcctatggatgcggttggaccgctggagtgcctccgagatcgtcgagctcgacaaggcctccataatccgccgcgccggactgcccccgcgcgacctacgcatcctcggccccgttttctctcgctcctccagcatcctcgctagggagaaggcgatggtgatcaacctcgaattcatcagggcgatagttactgccgaggaggtgctcctgttggaccctctcatgcacgaagtgctccctttcgttgaccaattgaggcagcacctgcctctgaggagccgggtgggtgagaatggtgagtgtgcccctgatggcaatggggaaaaacagaagggctcgcttaatgaagcgaccggggcagagcatgagctgccattcgagttccatgtgctggaggtagcactcgaggttgtgtgctcatcgttggaccttagcgtgtctgaccttgagaggcatgctactccagtgcttgacgaactgaccaagaatgtaagcacaaggaaccttgagcgagtgcggaaccttaagagtcatcttacccgtttgcttgcccgtgtgcaaaaggtcagggatgaaatagaacatcttctagatgataatgaagacatggaacatctgtatctaacaaggaagcaagtacaaaaccaacaggttgaggctttaatgtcatctgctgcttccaacagcattgttcttgccggaacaggtgtgcccaggctgaactctagcttccggcgtagcctgagcattgctactagcatgcatttggataatgatgtggaggacctagagatgttacttgaggcctacttcatgcagctggatggaattcgcaacagaattttgtcggttcgggagtatattgatgacacagaagactacgtcaacattcaactcgacaaccagcgtaacgaactcattcaactccagcttacacttacgattgcatcctttggcatagctgccaacactttcattgctggagcttttgcgatgaacatcccgggctctctgttcaacaccgatggcagcctcttctggccatttgtcgggagcacctcatctggctgctttgtaatcaccgtcctcttgttggggtatgcctggtggaagaagttgctgggtccttgactcgagacccagctttcttgtacaaagtggtgataaattggagctctgcagagctttcgttcgtatcat

SEQ ID NO: 523 - DNA, 1844 bp, Zea mays
ttcttgtttgttgattaacccttaattaatccgggcgcgcctgatttatcacaagtttgtacaaaaaagcaggctcctgcaggaccatggcggcaccaccggaggggaatgtccgcttaggcgaggggtgggacgaggacgacgtgctggagccgcagccgctggaggtcatagcgccggatgtcaagtccaagaagcgcaatccggcgcccggagttcgggttgttggtcgccggatctacgatccagagaatggcaagacctgccaccaatgccgccagaagacaacagacttcgcagcggcgtgcaagcaagtcaagaagaagggtccgtgcccagtcaagtattgcctcaagtgcctccttaacaggtatggcgagagtgccgaggaggcggccggcaaggaggactggatctgtcctaagtgcaggggcatctgcaactgcagcttctgtagaaagaagaaaggcgagatgccaactgggataatggcccacatcgccaaggcttccgggtgcacctctgtccatgatctccttaaaaaggggtcagatgtggtttctgctgcacaggcgattctcaaggtgaatggtagtgacaagggcacaaagagatcccgagggacagatgctgctgctgaggtggcgactgaaaaggatgtaaatataggcattgatatcaatacagttatagcagatgaaggagatgaaaatataggtgttgatctcaattcacttccttctgttgataccaagaaaaggcagaagcggcagaagctcaagcacaggacaaagaaggatcctgctgatgcaacgtcacatggagtcaatactgaaccattgcagatggatgggaaccttgattttctcaatagtaaaactgtgcgacccaggggtaccccagtcactaaaattgcaggcgcagagcttgatgacgaggatactggggctgcaattcagtttatagaattctgccgtgcatttacagagatttttcaaataaagaaagggcaaccagaaaaaattcttcaagatttagttggaggccgtgaacttcggtttgtatcctcagttgttgctgggtttcatataaatttgttatctgtcattcaagaaggaaaggggaagaagcctctggcttacacaagagacggagatgcatgggtaattgatattggcaaatatataagtgaatcagcttctatatcaaaagggtttcctctcaaccatatcaatcaggggatatcaggatataaaaacttgagcccttcttgtaagctgcgtgttctgaattttctttgtgatgagaccctctctactgacaagctgaggaactggattgacatgcaaaatgacatagctgctgaaccagtgaatgctgctagagaaaaggcgcgtgctgcaaaagaaatggtaaaggagctaaaggaaaggctaaaggacaacatgaacaaaataattgtttcaccaaatgaagcagcagcctctaacagtgaagcaaataagtatattatttcccaaataaaggaggcacaggaagtcaagcgtgcagccataaatgacatggcaactatggagaagcaaggaggtttttggaccaagcctctgatggtagagaaaggggcagcatattggaagttagatggttactgtgataactcagcaatattgcttcaagagtatggtggcgatgaattaatggcaaataaagacaagtggtttatgtttactgaagacgaggagaaaataattgaaaaacatttagccactaggtaactcgagacccagctttcttgtacaaagtggtgataaattggagctctgcagagctttcgttcgtatcat

SEQ ID NO: 524 - DNA, 756 bp, Zea mays
ttgtcagctttcaaactctttgtttcttgtttgttgattaacccttaattaatccgggcgcgcctgatttatcacaagtttgtacaaaaaagcaggctcctgcaggaccatggtgcttgtgcttgcgctgggggatctgcacatcccgcaccgggtgcccgacctgcccgccaaattcaagtccatgctcgtgcccggcaagatccaacacatcatctgctctggcaacctctgcatcaaggaagttcatgactacctgaaaagcctttgccctgatctccacattactggaggtgaatatgatgagtatgctcgatacccagagactaagacacttacaattggtcagtttaagcttgggctgtgccatggtcatcaggttgttccatggggcgacctggactccctggcgatgctccagcggcagctggacgtggacatcctggtgaccgggcacagccatcagttcaaggcatataagcacgagggaggcgtggtgatcaaccctggctctgccacgggcgcctacagcagcatcacttacgacgtgaacccaagctttgtgctgatggacatcgaaggactccgtgtggtggtatacgtctacgagctgattgacggcgaggtgaaggtggacaagatcgacttcaagaaagcagcgacgatgcaagcctagctcgagacccagctttcttgtacaaagtggtgataaattggagctctgcagagctttcgttcgtatcatcggtttcgaca

SEQ ID NO: 525 - DNA, 956 bp, Zea mays
aactctttgtttcttgtttgttgattaacccttaattaatccgggcgcgcctgatttatcacaagtttgtacaaaaaagcaggctcctgcaggaccatggcggggctctacgagaagcagtcggagacgtacgccaagaagcgtccgcagtaccccaaggagtggttctccatgctggccagcctcaccgcggggcaccagcgcgcctgggacgccgggtgtggcaccggccaggccgccatcagcatggcggagcactacgagagcgtggtggcgacggacgtgagcgaggggcagctccggcacgccaccgcgcacccgaaggtgcggtacctccacaccccggagcacctctcggaggacgagctggtgtcgctggtcggcggcgagggctccctggacctggtcgtggtggccacctccatccactggttcgacgtcccgctcttctacgccgtcgtgagccgcgccctgcggaagcccggcggcatgctcgccgtgtggggctacaactacgagatccacccgttcgaggacgcgctgcacggccagctctacccggccctgcggccgtacctggacccgcgggcgggactggccatggagcggtacaggtccctgccgttcccgttcgagcccgtcggggtgggcgccgagggcgcgcccgccgacgtggacatcgaggtggagatgacgctggaggacctggtcgggttcctgaacaccggctctgtcgtgaccacggcgagggccaagggcgtggacctggaggcggtcacgagggccgcgctgaagcgtgtggaggagcagtggggcggcgcgcccaccgtgccgaggaagctcgtgttcaaggcgttcatgctcgccgggaggcccaagtgctgactcgagacccagctttcttgtacaaagtggtgataaattggagctctgcagagctttcgttcgtatcatcg

SEQ ID NO: 526 - DNA, 508 bp, Zea mays
tttcaaactctttgtttcttgtttgttgattaacccttaattaatccgggcgcgcctgatttatcacaagtttgtacaaaaaagcaggctcctgcaggaccatgggtttcatcatggacttcgcggagaatctgatcctccgtctgatggaggacccggacaagcgcgaccaggttcggcgggagcatgtctacaagatgaaggagcggtgcgagcgcactaaggcggcgtggagcctccctctgcgcccctacggcttctggaccttcgaccgcttcaactcgcagctctcctgggatccccagatcagccaggccgccggccgtcgggacccctacgacgacctcatcgcacgccactctggctcgccgccgtcttcctgaacacccgttccgatctttgcccagaaggtctacttgggcatcaataagaactcgagacccagctttcttgtacaaagtggtgataaattggagctctgcagagctttcgttcgtatcatcggttt

SEQ ID NO: 527 - DNA, 1415 bp, Glycine max
ttcttgtttgttgattaacccttaattaatccgggcgcgcctgatttatcacaagtttgtacaaaaaagcaggctcctgcaggaccatgaatcaacttggtggtgttagcgttatccttctggttctctcagtcttgtgtttccatgttagagcacagacttctgcaccttcttcaggagatgctgtctccaatttccagccaagccttgctgttgtcataggaatccttggtgtcatgttcttactgacattctttcttctcatgtatgcaaaattctgtcatcgccgccatggcggcgcttcggccgttggagactcagaaaatcaacttacttttgtgagatcaaggtctagattctcaggaattgacaagactgtcatagaatcactccccttcttcagattctctgcactcaaagggttaaaggaagggctggagtgtgcagtgtgcttatcaaagtttgaagatgttgaaattctgagacttgtaccaaagtgcaagcatgcttttcatattgattgcatagaccactggcttgaaaagcactctacctgtcctatttgcaggcacagagtcaaccctgaggaccacacaaccttcacatattcaaacagtttaaggatgttagcaggtgaggaatctaacatagagatcttggttcagagagaagaggaagagcatcatggttcatcaagattcagtgtaattggaagcagcagctttcggaaaacggtcaaggaagaagaattactcatccaaaaaggagcagaagatagtgatggtaaccagaaagggtatcataaacacaaccacaggattactatatctgatgttgtgttcaagcacaggtggagcaacgtgagttcttcagaccttatgtttctgaattcggagatgctcaatgatacatcaagcaacagattcagcagcaacctggaatcaattacaagaggggtagtggtggaaaatgagcaaattatgaacatcaaggaggagatggagaggaagatttcctttgagaacaaagttgttggtgcactaaacaacatcgtttcagatcataaggaagatcctccttttacatcagattctgcaccaaagtatgtgaacccgggtgagaaaaggtcaatgtcagaaatcactgctgtttctagatttggagatttaggcatgaaaatgagggtcttgaaggattctgattcccttcaaaacaaccttaaagaggaaagaatgaggcagatttggtttccaattgccagaagaacagctcaatggtttgtgaatagagaagaaagaaggtctctgcaatctcagaataataaacaacagccattagatgtataactcgagacccagctttcttgtacaaagtggtgataaattggagctctgcagagctttcgttcgtatcat

SEQ ID NO: 528 - DNA, 1355 bp, Glycine max
ttcttgtttgttgattaacccttaattaatccgggcgcgcctgatttatcacaagtttgtacaaaaaagcaggctcctgcaggaccatgcattcccagaaagttgtagagatggaagacaagacagaaagtcatatgagttcagctgcggcctttgttgaaggggggattcaagaatcctgtgatgatgcttgcagcatatgccttgaggagtttggtgcaagtgatccttcgacggtcactacctgcaagcatgagtttcatctgcagtgcattctcgaatggtgtcagagaagctcccagtgtcctatgtgttggcaacctattagcttgaaggatcctactagtcaggaattgtttgaggtagtagagcaggagagaagcttgagggctaccccatcaagaaatgctgctatttttcatcaccctgcctttggagattttgagttgcagcatttacgcatgagtctaaatgatgctgattttgaagagagaattattcaacatttagctgctgctgcagcaatgaggagagctaaccaacttggttggagggaagggcagcgagctcgttcatcagctcatggtcatccacaattcttagtgttctctaatcagcctattgcaccttcatcagttgctggaggagaaaatgacccaactgcaattcctaatagaagtccatctaccccaataacatccgttggaaatgaagcatcgcagcagatcctgcaccttcaaactcaaagttcttcttcagcttctggatctcctgtcatggctacaaatcctcgaggaatttactctaatgaaagaggctctactgcttgttcttcaccagcaaaccaagatagagcagagccatcagagttgcagtcattttctgattctctgcgatccagacttaatgcagtgtccatgagatacaaagagtcaatctcaaaaggcacaaggggatggaaggagaggctgttctctcgtagttcttccatgtcaaaacttggttcagaaacaaggaggagagagataaattctggaattgctagtgtatcccgattgatggaatcccttgaaactagtgaaaataatagagttgtgggtacttctttgtcaaatcatacggagggttgttccataggaggggtgagcaaccagaacaatgttgaagctagaggggagaactcttcacatgatgacaatactccagctgcttgttctgctaactcacatttaaattgagctcttttttggtttccgttaatgcatctctcctcagcatctcatattctcgagacccagctttcttgtacaaagtggtgataaattggagctctgcagagctttcgttcgtatcat

SEQ ID NO: 529 - DNA, 662 bp, Zea mays
ttcttgtttgttgattaacccttaattaatccgggcgcgcctgatttatcacaagtttgtacaaaaaagcaggctcctgcaggaccatgggggacgctggcgctgacgcctcctcctcgccgccgccgccgtccgggtccttctcctacttcgccgtcttccgcaactaccccctcgtcgccgccctgctcggcttcgccgtcgcccagtccatcaagttcttcgtcacacggtacaaggagaacagatgggatcccaagcggcttatcggctcgggtggcatgccgtcatcacattccgccacggttacagcactagcagtagcaattggattccaggatggctttagctgctccctctttgcaacagcaactatatttgcaagcgtggtaatgtatgatgcttctggtatcagactgcatgctggaaagcaagcagaggtattgaatcaaatagtttgtgaacttccttctgaacaccccttgtctgagacaagaccactgcgagaacttttaggccatacaccaactcaggtggttgctggtgcattgcttgggtgtacaatagccacagcaggacaattattcctttgactcgagacccagctttcttgtacaaagtggtgataaattggagctctgcagagctttcgttcgtatcat

SEQ ID NO: 530 - DNA, 1247 bp, Zea mays
ttcttgtttgttgattaacccttaattaatccgggcgcgcctgatttatcacaagtttgtacaaaaaagcaggctcctgcaggaccatggggtatctgccggcgctgggcgggaaggcggcccacctggtgaacgacctcgccactgtcatcctgaaccccgtctccgagcgcgagcgccagccacaccaccccacccacctcccggaggccactgaaggagaagacacactattcgttgacgatgattctgaccaaaattctgatggtcctgacacatcttcattcagagcatttctgatgtcctttgtgccttcctcaactgccagcaagaattcaatggagaccatacctgagcataatctagatgtggaatacccaactttaacacctgttgggaaggcgtgcagtgggaggaaaggcctgtttagtagagggaagcattcccttggtaggattattagcaaagcaggacttggtaatttgagacagaaacagacccacagcattgatggtgaaatcataggccaaaccgaatcagttgcacctagatttgaagtgaagggttcaaaagaatcaactttgcacgataaattgccagctatgtctgaaccttctcttcttctgacagaaatgatgcgagctgttctttatacatctcttcctgtacttgttcaaggaaggaactggatgctggtatatagcacctggaggcatggaatatctttgtctactctgtatcgaagaagcaggctttgtgctggctactcacttttgatagttggggatcgaagaggggcagtttttggtggcttggtcgaggccccactgcaacctatcgtaaaaaggaagtatcagggaactaatgactgctttgtgttcaccaacgtagatggttgtcctgttatatgccatccaacaggtgctaataactattttacattttgctctaccgattatatggcaatgggaggtggtggtcacttcgcactttatctcgatggagaccttatgactggttctagctccacctccgagacttttaacaacccatgcttatcccatacccaggaattcaaaatcaaagatgtcgagctgtggggtttcgtcaatgcttccaagtttgaagagatgctcatgatctgccgcaccgaaaagcaaggaatttggaacctgtgactcgagacccagctttcttgtacaaagtggtgataaattggagctctgcagagctttcgttcgtatcat

SEQ ID NO: 531 - DNA, 684 bp, Triticum aestivum
ttcttgtttgttgattaacccttaattaatccgggcgcgcctgatttatcacaagtttgtacaaaaaagcaggctcctgcaggaccatggtggggagcggcatgcatgcccagcgcggggacccgctggtggtggggcgcgtgatcggcgacgtggtggacccgttcgtgcggcgggtggcgctgcgggtcggctacgcgtccagggacgtggccaacggctgcgagctgaggccgtccgccatcgccgacccgccgcgcgtcgaggtcggcggcccggacatgcgcaccttctacacgctggtgatggtggatccggatgctccaagtcccagcgatcccagccttagggagtacttgcactggctggtcaccgacatcccggcgacgacaggagtgtcttttgggaccgaggtggtgtgctacgagggcccgcggccggtgctcgggatccaccggctggtgttcctgctcttccagcagctgggccgccagacggtgtacgccccggggtggcggcagaacttcagcacccgcgacttcgccgagctctacaacctcggcctgcccgtcgccgccgtctacttcaactgccagagggagaccggaaccggcgggagaaggatgtgactcgagacccagctttcttgtacaaagtggtgataaattggagctctgcagagca

SEQ ID NO: 532 - DNA, 696 bp, Gossypium hirsutum
ttcatttatttgtcagctttcaaactctttgtttcttgtttgttgattaacccttaattaatccgggcgcgcctgatttatcacaagtttgtacaaaaaagcaggctcctgcaggaccatgcaggctttatgttcttgtgaagaagcgattgatatcggaacgatgatggaaaacaaacggaaccctttttctgttgatcatactgggtttacgtctttggcatcgaaacggcagaaggccacaaaggagaaaaaagatcaggtcagtgaacggattgcggctctgcagcaacttgtttcgccatacggaaagacggatacagcttccgtcctactcgaggcaatgggatacatacgatttcttcacgaacaagttaaggtgttgagtgctccatatctccaaaccataccagcaaatagtttacaggatgatgatcagtatagcttgagaaaccgaggtttatgccttgcaccggtctcgtgtaccgtaggacttgctcgcagcaatggagccgatatttgggctccggtaaagaccacatctccaaaatttgacgaggttatctcacaattcaattgaagctttcattttcacagccaaactttgtgacatagagctcgagacccagctttcttgtacaaagtggtgataaattggagctctgcagagctttcgttcgtatcatcggtttcgac

SEQ ID NO: 533 - DNA, 1099 bp, Zea mays
aactctttgtttcttgtttgttgattaacccttaattaatccgggcgcgcctgatttatcacaagtttgtacaaaaaagcaggtcctgcaggaccatgcttctccaccaccgcctcctccctcgcctacttcttgttccttccacacatacctccacactcctctgcccctcccgtttgccgcgccgcctctccctctcgccacgcttctacgcgctgccccacctcgcggcaccccagaccgtcgaccactccgacgatgagggggcaccccagggggaggggcagatcaagctcccgctcgaccatctcttcgtgccgcccggggcaacaatggatgcgggggaccaggaggccgtgagcgcacgggtgcttaagggctccaacatcgtgctgggcccatacgcgcgcggcgacgcacaggtggtcaacgcagattttgtaaagagcagcgtgcgtcccgatgactgccctcgggacggccttccggagtttgcactcgttggccggtccaacgtcggcaaatcgtcgctgctcaactcgcttgtccgccgcaagcgccttgcccttacctccaagaagcctgggaagacccaatgtatcaatcatttcaaagtaaatgacagctggtatcttgttgacttgcctggttatggatatgcttctgcaccacaggaagctcgtaccaattgggatgaatttactagaaattactttctcagtcgggagaatttggtatctgtttttcttcttatagatgcaagtatacctgccaagaagattgatcttgactatgctagttggcttggccaaaacaaggttcccatgacccttgtgttcacaaaatgtgacaagcgcaagaagaagaagaacggcggcaggaaacctgaagaaaacgtggaaactttccagggcctaatccgcgaatacttcgaggccgcgcctccttggatcatgacgagcagcgtgaccaaccagggccgcgacgagatactcctgcacatgtctcagcttaggaattattggctcaagcattgactcgagacccagctttcttgtacaaagtggtgataaattggagctctgcagagctttcgttc

SEQ ID NO: 534 - DNA, 1833 bp, Xenorhabdus nematophila
ttatttgtcagctttcaaactctttgtttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatggccgttgaacatgttttgtccatgattgaagaacatcaggtgaagtttattgacttacgttttactgataccaaaggtaaagaacaacatatcaccattcctgcccaccagattgatgaagacttcttcgaagatggcaaaatgtttgacggttcatctatcggtggctggaaagggatcaatgaatccgacatggtgttaatgccagatccaacgaccgcaatgcgggatcccttctttaatgatgccacactgatcctgcgctgtgacatcctggaacccggcactatgcagggttatagccgtgatccgcgttctattgccaaacgtgcggaagatttcctgcgtgcaagcgatattgctgatacggttctgtttgggccagagcctgagttttttctgttcgatgacattcgtttcggtagttccatttcgggtagttattaccatattgatgatgttgaagccgcatggaacagtggaacacgctatgaaggcggtaacaaaggccaccgtccgggcatcaaaggcggttattttccggttcctcccgtggactcctctcaggatctgcgttcagccatgtgtctgacaatggaaaaaatggggctggtggttgaagctcaccaccatgaagtggcgaccgcaggccagaatgaaatcgcgacccgctttaatactatgaccaaaaaagcggatgaaacccagatttacaaatatgtggtgcacaatgtggcccattcattcggtaagaccgcaacgtttatgccaaaaccgctggtaggcgataacggctctggtatgcactgccacatgtcgctgtccaaaaatggcaccaacctgttcgcaggtgataaatatggtggcctgtccgaactggcgctttactacatcggcggcgtaatcaaacatgcccgtgcattgaatgcctttaccaacccaaccaccaactcgtacaaacgtctggtaccgggttttgaagcaccagtgatgctggcttactcagcccgtaaccgctctgcttccatccgcattccggttgtggcaagcgccaaagcccgccgtattgaagtgcgtttccctgatccggccgcaaacccttatctgtccttctctgccctgctgatggcaggtcttgatggcatcatcaacaaaatccaccctggtgatgcgatggacaaaaatctctatgacctgccagcagaagaagctcaagagatcccaaccgtagcctcttctctggatgacgcgttagccgctctggatgcagaccgggaattcctgactcgtggaggtgttttcactgatgatgccattgatgcttatatcaaattactgcatggtgaaatcgaacgcgtacgcatgacgccacatccgctggagtttgaactgtattacagcgtgtaatgcttgatggcattacgactatccttttttgttgccgtgaaacttttgctcgagacccagctttcaaatacccagcaaattggagctctgcagagctttc

SEQ ID NO: 535 - DNA, 1421 bp, Pseudomonas fluorescens PfO-1
ttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatggcccgcgttaccctgagtcgctatttgattgagcagacccgcagcaacaacactcctgccgatctgcgtttcctgatcgaagtggtggcgcgcgcctgtaaagaaatcagccacgccgtgtccaaaggcgccctgggcggtgttctgggcagcatgggcacggaaaacgtgcaaggcgaagtgcagaagaagctcgacgtgctgtcgaacgaaatcctgctcgaagccaacgaatggggcggtcacctggccggcatggcgtccgaagaaatggacaacgcctaccagatcccgggcaaatacccgaaaggcgcctacctgctggtattcgacccgctggacggttcgtcgaacatcgacatcaacgcgccggtcggcaccatcttctccgtgctgcgttgcccgaacgaatacctgagccagaacgaagccctggatgaaaaggccttcctgcagccgggcactcagcaagttgccgccggttatgccatctatggcccgcagaccatgctggtgctgaccctgggccacggcgtcaaaggcttcaccctggaccgcgaaatgggcagcttcgtcctgacccacgaagacatcactattcctgaaagcacccaggaattcgccatcaacatgtccaaccagcgtcattgggaagctccggtacagcgctacgtttcggaactgctggccggtgaagaaggcccgctgaaaaagaactacaacatgcgttgggtcgcggcgatggttgccgatgtgcaccgcatcctgacccgtggcggtctgttcatgtacccgcgcgacagccgcgagccgtccaaaccgggcaaactgcgcctgatgtacgaagccaacccgatgtcgttcctggtggaacaggcaggcggcgcttccaccgacggtcaccagcgcattctcgatatcaagcctgaaggcctgcaccagcgcgtagcggtgttcctcggctcgaaagaagaagtcgcccgcgccacggcgtaccacaaggaataaaccatgaccgcgccctggcagccgttgctcgattggtggttcggtcatgcctcgagacccagctttcaaatacccagcaaattggagctctgcagagctttcgttcgtatcatc

SEQ ID NO: 536 - DNA, 853 bp, Synechocystis sp.
ttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatggaaccaatccacagatacatcagattaatattatctaaggatcaagacttactgtttttgtcgctgttgcgtacttttgagaagatactttccaagttgttagccatctgcctgatggtggtagtttttgttgcggtgttcgacctatttaaggtgctaattatcgaattgcagacggaaccctttggcttttttaatcggagtttaattgagatttttggtttatttttaaatatattgattgccctggaactgttggaaaatatcactgtttatctgaaagataatgttatccaagtggaattggtgattgtgacagctatgattgcggtggccaggaaaattattatttttgactttggcaaatatgaaggcatggatttattagctttgggctttgccattgtctgtttggcggcgagcttttggatggttaagaagttgaatgttaataataagcactaacttagtacaaagtttgacaatatttggcaattttcccataggggcaaatttaaatacccagcaaatacccagcaaattggagctctgca

SEQ ID NO: 537 - DNA, 1016 bp, Synechocystis sp.
cttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatggttcaacgtcttgtgcacatattggctttaactgtctgcggccttgccgtggtctccagtttgactccgtcagtccggggacagggggtcacggaggtggaggaagtgattatcgagggtagtggtcccgaaaattctagggagtttcgtcccctcaaccaagaaggtagtatcttgagcgtgggcgccggccgtcgcttaatgaatgaagctaatgaggctattaatcttaaccagtacacagtggctctggaaaaactacaggaagcccgcaagatttttaaccaattgtccaactttcatctgcaattagctaatagtttctcgggcattaacacggttatttttgaagaacaaagaattgccgctctggaaactggtcaactgcgggatgaagctacctaccgtttagctctagtacatcgagccaacaacgaaccagctttggcggtgcccctgttgctacaaattatccgttcccagaatcccaccacggacttgggcagaaaatcctaccaacagctttatgaattgggttttgtagcttctccgtttgagggacccacccccactggcaccaatgcggcccctactgccccggtggttaattagccccagttgtggtcagcaacatcttgactggacggtggaatgcttacatttaaatacccagcaaatacccagcaaattggagctctgcagagctttcgttcgtatca

SEQ ID NO: 538 - DNA, 997 bp, Synechocystis sp.
tttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatggcccattccactgatctttccgccctagcccgttggatggccgccgattttagcaaccaggcccaagcctttgaaaatccccctttttatgcccatatccgggtggccattcgtcccctcgaccaagcaaagtttggcgatcgccttttatttttagaacaggcctacgactttatgttgcagaggccctatcgcctacgggtgctgaaattaaaggtggtggaagatcatattgaaattgaaaactttaaagtcaaagatgaggaaaaattctatggtgcggccagggatttgggcaaactagctcaactaacccccgctgatctcgaacccatgcatggctgtgacatgattgtggaatggaccggcactagctttaaaggggaagtgcaaccgggacggcaatgccgagtgatgcgggacggcaaggaaacctatctggaaaatagttttgaagtgagcgaaacgggattaattagcctcgaccgtggttacgatccagaaaccaacgaacgggtttggggctccgtggccggtgcttttcattttgtccggtggcagagtttcgccgatgaagttagtttttagccagcctcgactttgttgtttcccggaggaaacaggtagattgccccatttaaatacccagcaaatacccagcaaattggagctctgcagagctttcgttcgtatcatcggtttcg

SEQ ID NO: 539 - DNA, 1223 bp, Synechocystis sp.
aactctttgtttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatggcaccatctgcggcgagtcatgccattgataccctgatcgaaatggcccaccaaggggagattaacccctgggacgtgtcggtgatcgatgtaattgatcgctttttgcaggatctgggcattctcaacagcctcgacctgaattttcaacagcaaaatttaccccgttctggccaggcttttctttgggcctccatgttggtgcgctacaaagctgacagtctccacaatttggagcaggaaccagaagaagttttacctgaagctgagctagaagaatggcccgatggtctaattgcccggttaccaagggatttagaaaatcgtctgcgtcgccgcactgctgtcccgcccctacaacgtcgtcgggttaccctggcggaattaattgatcagatcgaggcgatcgccgttgaaatcgaaaaaagcgaacaaaaacccaagcgggtgaaacgggcccgtccccaatcccggcgggaagcactacaaatcattaccgaattagcccaccaggaaaatttaactgagttagccagccaattggaacaatttttacaaacccgtctgccggaaattttgcctgatttaccccatcgttcctgggtagatttggatacattactccactgttggcatcatcatttagatccagataaattgccggataaaaaagataaagttggcgtattttgggcattactattattaagttcccagtcgaaagtatctttggctcaggaagagttttaccaagatttacaagttcaaattattgatgactctgaaaaaaatatacagttaaccttagatccagaaacagaagtgttaaactcagcctagatttaaatacccagcaaatacccagcaaattggagctctgcagagctttcgttcgtatcatcggtttcgacaac

SEQ ID NO: 540 - DNA, 786 bp, Synechocystis sp.
ttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatggacacttttttggcatcccctaaagcattagctggttacactgcccacacctacaatcgggcccaaagagctttccagtgttgtcccttttatttgaacttatttcgggctatggcccaagccagtgtgcccctaccaacgatcgccggggctgggggagttgagcaaggtttttgtgggcaagcattaacagaaaatcgggtggagcgggaattgatgtggctcattcaggtggggctattgcgacgggaagtggacggccagggaattacggacagttttcgcctgacacctttggctaagcaaatcctcgctcaatatcccggagagcaaaggcaatttccatccccttcccttttagatcgtttacaaaatcggttggcccgctggctggctccccttgcgaccctgttggtccggggctaaatttaaatacccagaaatacccagcaaattggagctctgcagagctttcgttcgtatcatc

SEQ ID NO: 541 - DNA, 787 bp, Synechocystis sp.
ttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatggctgagtccgtaatctccccagaagatgccttcaaccaggcgatcgccagatataacgggggggaaggccccgaaaccctgatcccggtgtttaaggacattgccgatagctccccgaaaaatgcgacggtgtgggcttgcctagcttggctgtatctcctggacgacaagccaactttggccttcaaagcggcccaaaggtcggtgaaaattgacggttatcatccccaggcaaggattaactatgccttggccatgttggctaataaaaaaaccggtgtacgggaacaggtggagttagcggcgcaaatgatgtcctttgatcaggaaatcgctgcgggagtgatggaaagtttggatgatggtctcgagcgtaagcccgattggcgagacattgaacggattaagaaatggctgacagaatagatttaaatacccagcaaatacccagcaaattggagctctgcagagctttcgttcgtatcatc

SEQ ID NO: 542 - DNA, 1220 bp, Synechocystis sp.
ctttcaaactctttgtttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatggaatggcgtgaaatttctggcagttgggttctagtgccgccccaaccgatcgccgtggtgcattttctcgggggagcttttgtcggtacggcccccaatgtggcctatcgttggttactaacggaattaggtaaagctggttatgtggtggtggccacccccttcgtcaacaccttcgaccaccaggcgatcgcccgtagtgtgctgaatcgctttgaaattattctggaaagattgcaaaaacaaggggaaattaccactggtttactgccggtatacggcttaggccatagcttgggttgtaaactacatctactcattggcagtttgtacgaggtggagcgggccggcaatatcctcgttgcgtttaataactatcccgttaaacaggctattccctttggggaacaattagcccaactgcaactggataaattcctcacaggggtgcaaaaacaattaagacagctcaatctccaggtggatttaaattttgaatttactccatccccggaggaaaccaaccttttaatcgccgaaaattatcgagtgcggcgtaatttattaattaaattttccaacgatgatattgaccaaaccctgggcttaaggccaattttaaatcaacaaaccgctgacctagtggcctactgtcccctacctggcaatcatttgactcctttggggcaagacattcaatgggaaaccggccaggaattttcccccttagacgcagtggggcaatggttgaaaaattccctttcccaggatttgaggcgactgcaaaaggaaattctccgttggctagaaccgactcgtttctatagcggttttgataatctataaatttaaatacccagcaaatacccagcaaattggagctctgcagagctttcgttcgtatc

SEQ ID NO: 543 - DNA, 1813 bp, Zea mays
ttcttgtttgttgattaacccttaattaatccgggcgcgcctgatttatcacaagtttgtacaaaaaagcaggctcctgcaggaccatggcggcggctccggcgagcgtcggctgcggcggcgcgtactcttgcgagacggcggagcgtacccgcgagtggatgcaggccctggccactttcctcggccgccaccgtccgctcctcgaggcccacgtcgtcaactttttcaaggacaggctgtgggagctagtggacgccgagtggatggagtgcctccggcgggagcccgtcgagagcttgctcaagctgccatctggatgcgtccaggagcactggcctgctacactgcgagagtttgtgcttactgctaggtcgcttgtgattccacgggagcagaaggctccgcaatcgcttgtatctgacattcatgtagccccagttggcactgttctcgctcagggcatgaactcaaagaagaagcacgaaattgaaaatctagctgctgtggttcatgcaattgcaaagaggtgtggagccaagacagtggttgatgtaggttctggccagggttatctcgcacaggccttatcttttgagtaccaactccgtgttgtagcaatagatgcttcatcacaccatgcatcagttacaattgctcgtgcagaaagaataaagaagcactatgctgctaaatgtgtggagaagcaactgctcatggtacctagggcagtcacctgtcatgttctttctagtgacacattggcagcagtcacattagatgcatgtaaggatgacaatggagaacatgtgagagatactaaaacatctactaagaaaatcactcaaatccaggaatcaactcagggcacccctccattaatcctggctggtcttcatgcatgtggtgatctttcagttaacatgctaagagtttttgtgtcctgtgaacaagtaaaagcattggtaagcattggctgctgttacaacttgctttctgaggatacttatgaggacacagatacctgccctggttttcctatgagcaaggctgccaaacattctgaattggtacttgggaaaagcatccgtgaccttgcatgtcagagcgcagagagatggagaaatctcaccatggacattgcattgcaaaattttgatgtacatgccttccgagctgcatttcaaatggtacttgagaaatattttccagaagtgtcaaggttgagtccatcaattggaaggcaaggaaaagctcttcgacgtcagaggcttcgaaaagttgtggaatcacaaatgactacaaagaaaaatgatgatttctcctgttcaactttaaaggaacaaaacaagaacacaaacgatgttcatccagtcatacatgaagttgacacagggccagatgacatccatcagaacgcacatcaaaagttcatcctgttcaaagatttcacattatctggattaggtcgccttggctgtggctcagtggaagacacgagtcttcttgaaatatggaaggacgtgcaacccttctctgaatatataggtcccttttggtgccttcgagctgctttaggtccactggtggaaacatatattttacttgatcggttattgtatcttcaagagcgaagcaacctagttgaagcattgctgtttcctctgtttgatcctaccatttctccaaggaacatggccgtaattgcttggaagttatgtgcaaattcttcagaagcatgactcgagacccagctttcttgtacaaagtggtgataaattggagctctgcagagctttcgttcgtatcatcg

SEQ ID NO: 544 - DNA, 1301 bp, Zea mays
ttcttgtttgttgattaacccttaattaatccgggcgcgcctgatttatcacaagtttgtacaaaaaagcaggctcctgcaggaccatggccgtgtccggcgagaagccgccaccgccaccgccaccggccacggcgtccggcggaacggcaaggaagctcatcctagcgctgcttacatgtctgtcgtcggcgctgctgtacaggcagattcagccgctaccgcccaagatccccggcacgccgggcggcccgccggtgacggcgaccaggacgaggctcagcgacggcaggtacctggcctatctggaaaccggcgtcccgagggagaaggccaagcacaggctcgtctttgtccatgggttcgactcctgcagacacgacgcgcttccgatctccacggagcttgcgcaagagctgggcgtttacatgttgtccttcgatcgccccgggtacgccgagagcgacccgcacccggccaggaccgaggagagcatcgccctcgacatcgccgagctcgccgacaacctgcagctgggtcgcaagttctaccttgctggcttctccatgggcggcgagatcatgtggagctgcctcaagtacatcccacacaggctctccggcgtggccattctcggccccgtaggcaactactggtggcccggcttgccgtcgaacgtgtcgcgggacgcctggtaccagcagctccctcgggaccagtgggcggtctgggtcgcgcatcacctgccgtggctcacctactggtggaacacccagaagctcttcccggcctccagcgtcatcgcctacaaccctgccctcctgtcccaagaggacgagatgctcatggccaagtttggctatagagcctacatgccgcagatcaggcaacagggggagcacgagtgcctgcaccgggacatgatggtcgggttcggcaagtggagctggagcccgctgcagctggagaacccgttcgccgacgccgacgccgacgatggccagggggcggggaaggtgcacctgtggcacggcgccgaggacctcatcgtgccggtcagcctgtccaggtacatcagccagaagctgccgtgggtcgtctaccacgagctccccaagtcgggacatctcttcccgatcgccgaggggatggctgacatcattgtcaagtccctgctgctcggagacgatcatctgtcgtcgtcggcctcacagcctcctcattctccatgactcgagacccagctttcttgtacaaagtggtgataaattggagctctgcagagctttcgttcgtatcat

SEQ ID NO: 545 - DNA, 2177 bp, Zea mays
ttcttgtttgttgattaacccttaattaatccgggcgcgcctgatttatcacaagtttgtacaaaaaagcaggctcctgcaggaccatggcggcagcccttttgctccgcagtctccggccatcggtgagccgggcacatatccaccttctttcccatgcctcctccccgacggcgctggggtctccccttttaccccgcctctactcctctgcggcagcgtcaaccgccgcctctcctgttttcacgcccggcggcgtcatggacccatcccgcatccgcaacgtagcggtgatagcccacgtcgaccatgggaagacgacgctcatggaccggctccttcgacagtgcggggccgatatcccccacgagcgcgccatggattcaatcagccttgagcgcgagcgcggcattaccattgcctccaaggtcacttctgtctcttggaaggaaaatgaactcaacatggttgatacacctggccacgctgattttggtggtgaggttgaacgagttgttggaatggtggaaggagctgtcttggttgttgatgctggagagggacctttagcacaaactaaatttgtgctttcaaaagctttgaagtatggcttgcgtccaattcttctcctcaacaaggttgataggccttcagtttctgaagaaacctgcgatgaagtagagagcttggtttttgatctttttgcaaatcttggtgctacagaagaacagttagatttcccagttctttatgcatccgctaaagagggttgggcttccttaactttcaccaagagcccccctgataatgcaaagaatatgtcttcactgctcgattccattgtacgacatgttccttcaccaaaagctgatcttgaggctccattccaaatgttggtttccatgatggaacgtgatttttatctaggacggatactcactgggagagtaaggtccggagttgtccgtgttggtgacaaagtccatggtcttcgcagtacagatgatggagttcataaaattgaggatggaaaggttgtcaaactcatgaaaaagaaaggcacaaatatggtaacagtagaggctgcaggggctggtgatataatttcaatggcaggattggctgctccagcaattggacatactgtggcaaattcagagatattgagtgctctgcctacaattgagttggatcctcccacaatatctatgacgtttggcgtgaatgattcaccgttggctggccgggatggcactcatctaactggagcaaaaattggtaaccgcctgatggcagaggcagaaacgaatttggctattaatgttctccctggaccattatcagaatcttatgaagttcaaggaagaggagagcttcagttaggaatattaattgaaaatatgcggcgtgagggatttgagctttcagtttcacctccaaaagtgatgtataaaacagagcgtggtgaaaggttggagcctattgaagaagtgactgttgaggttggtgaagagcatgtgggattcgtcttggaaaccattactcacaggaagggtgaagtagttgacatgggcccggttcctggcacaactggaagaactcgaatcttcatgacctgtccatctaggggtttggtgggtgttaaaggaattttcagcagctttacacggggaactggatttatgcaccgtgcttttcaggcatatgctaaatacagaggtccactgggcagtgtcagaaaaggagttctgatatctgttggcaagggacttatcacttcacatgcccttatgagtttagaagctcgtgggatcctctttgtatcccctggaatggaggcatatgaagggatgatagttggtgagcactcacgtgacagtgatcttgaggtgaatcctgtgagaactaaagaacttacaaatatccgagcccctggaaaggatgaaaatgtccgtttgtctccaccccgattgatgagtttggaagaggcaattggatatgttgctgcagatgagcttattgaggttactcccaaggtcgtacgtcttcgaaagaagtacttggattccactaagcgtaagatgatgaaaaacaagcctatgaattagctcgagacccagctttcttgtacaaagtggtgataaattggagctctgcagagctttcgttcgtatcat

SEQ ID NO: 546 - DNA, 1616 bp, Zea mays
aaaaaagcaggctcctgcaggaccatgccgccggcgcaggcgccctccagcggcggcgccgcgtggcgccagctgctcctgctcctgacagtcctcccgctcacgctcgctgcgctggctttcgtgctccagtggcgcggcggcggcggcgtcgatgaccctaccactcgctggccctcccacgccttccccggcatggccgagcccaccccaccgtccctcccctcgtccgactgcgcagacgtgctcgtgggatcctccgccccctccttcccctacatccgcggctggtcattcccctccgactcgggcgctgccatgggttctgtagaggaacatctccagcccaaggtgtgcgtgcagacgagcacctccgcggggcttgagcagatcctgccctggctcttctatcacaaggtcgtcggcgtcgcgcagttcctgctcttcgtggagggcaaggcggcgaaacccaatgtcgcgggagtcctcgagtcaattcctggggtaaaagtggtgtacagaactaaggatcttgaggagcggcaggcacggagtcgaatctggaatgagacttggctttcaggatttttctacaaaccttgcaactatgaactctttgtgaagcaatccctcaacatggagatggctattgtaatggctcgggatggtggcatggattggatcatacatttagacactgatgagttactttatcctggcggagctgctgagtattctgttagacgtttgttagctgaggtccctcgtgatgtcgacatggttatttttccaaactatgaaagcagtgttgagcatgataatataaaagatccattcagcgaagtatctatgttcaagaggaattatgatcatcttcctaaagatacttactttggcatgtataaggaagcgacacgaggaaatccaaattattttctcacctatggtaatggaaaatctgctgcacgaattcaagaccatctccgtcctaatggcgcgcacaggtggcataattatgcaaagagcccaaatgagatcaagttggaggaggctgcagttctgcattatacatacactaaattttcagatttgacatctagacgtgatcgctgtggatgcaagcctacaaaagaagatgttaagagatgtttcatgttagattttgacagagcagcttttataattgcatcaactgctagtgaagaagaaatgcttcgctggtacaatgaacgagtcgtgtggaccgataagcagctgaacttaaagcttctgaggaaaggagtgctgactcgcatatacaccccaatgacaattgttcagagtctgcgcgaatccggtgtcttcacttccgccattgcagctggccaacctgctgtgaatgccaaactctcacccaaggaaaccaatgcgcagagccaaaatgttaccgcatctgggaacatgacaagagtggtcagatctactgattcaaaggcatcaggcagaaagatactgcaagccgttgatcttgccttcagcgatactaatgtaactgctgttccaccgttgtcgccgcccagtttggacgaacacaggcatcatagtgaataactcgagacccagctttcttgtacaaa

SEQ ID NO: 547 - DNA, 698 bp, Triticum aestivum
ttcttgtttgttgattaacccttaattaatccgggcgcgcctgatttatcacaagtttgtacaaaaaagcaggctcctgcaggaccatggcagcccatgtggatccccttgtggttgggagggtgatcggtgacgtggtggacatgttcgtgcccaccatgccggtgaccgtgcgcttcgggacgaaggacctgacgaacggctgcgagatcaagccgtccatcgccgacgcggcgccctcgatccagatagccggccgggccggcgatctcttcaccctggttatgactgatccggacgcaccgagccccagcgagccaaccatgaaggagtggcttcactggctggtggttaacatacctggtggatcagatccttctcaaggggaggaggtggtgccctacatgggtccgaagccgccgttgggcatccaccgctacgtgctggtgctgttccagcagaaggcgcgtgtgctggcgccggctcccggcggcgacacagcagcgtcggccatgcgcgcgcggttcagcacccgtgccttcgcagagcgccatgacctggggctccccgtcgccgccatgtacttcaacgcgcagaaggagccggccaaccgccgccgccgctactagctcgagacccagctttcttgtacaaagtggtgataaattggagctctgcagagctttcgttcgtatcat

SEQ ID NO: 548 - DNA, 685 bp, Zea mays
aaaaaagcaggctcctgcaggaccatggtggtgtacacgcaggaacatgtgtaccggcacccgtgggaccgggtgacagcggcggcgtggcgcaagttcacggatccggcctcctgtacggcgctctcccacgtcgcagacgttcacaccctacaccgccgcctcgactccgacacgggccgcctccaggccgcgcgctccatcaccgtgcggtccccgccgctccctttcgtcctgcgccgactcctcccgtccgccgcggcgtccccaaacggcgccgcgctctgccactgcgtcgagacctcgctcgtggacgcccagcgccgcgccatggacgtcgtcgtgcgcaacgtcagcctccggggcctcatcgaggtcgaggagcgcgcctcctacagaccacatccggaccggcccgacgactggacgcagttcaggcaggagaccacgatccggtgccgcccgctcgcggccctcgccgccgtcgctgagaaggtcgagacccggtgcgccgagaggtttctgcagaatagcgccaaggggagggaggtcgtcgagcggatctgccggtacctcgaggccgagtccgccggcgccgcgccctccgtaacctgatctcgtttgcacatctttgcttgatccgaacggatccaagggttcctcgagacccagtttcttgtacaaa

SEQ ID NO: 549 - DNA, 742 bp, Zea mays
ttcttgtttgttgattaacccttaattaatccgggcgcgcctgatttatcacaagtttgtacaaaaaagcaggccctgcaggaccatgaccgggaagaagcgcaaggcggaggcggcgcgcctggaggagacggaccaggcgctctacggggccttccggggcgccgcaaactcgctctcgcagctctacactctcgccatgggtgcgcagaaagcctcctttaacgccggcgaacgccacgccatggaaaaactttatgaatggatcctgaggcagcacgaaaatggtttgaggctaacagttgctgatgtagcttcccgtatccagcttgagattcagtatggaggtgacaatgcatcagcctctccaaggccacaataccctagccaaagcactgcacctacagtgcacatccccaacacaagcaaccagcaaccatcgccaagcttatttgctccaggaaaccctggtctgacacaatccaagaattccatggtcttttcaaacgcattatccagccccatccggcggagcctgcagccttaccacctagaacaggacggagacacagggtactttgtgaacggcgcaagccgcgacatggaccccacggcttcgaacgattcatccatggacatgcactcggacagcccagttcatgactcctactgactcgagacccagctttcttgtacaaagtggtgataaattggagctctgcagagctttcgttcgtatcat

SEQ ID NO: 550 - DNA, 918 bp, Zea mays
ttcttgtttgttgattaacccttaattaatccgggcgcgcctgatttatcacaagtttgtacaaaaaagcaggctcctgcaggaccatgcttgccaaagggaggaaggtagctggaaggcgtgaagaaatgtctgcaaattatgcgtttggaccacaggatgatgatgcgattattaaacacaggcttctgactaggacaacgaccaccaggggtgaaccgccactaaagaagcttcagaagaagttcatgtcctttgcaactgagatcgagaaggatgcagataacataagtgactgtgaaagactgtacaaggcctttctacatgaaattaacacctttgagctacctcttctgaaaagcaaggctgtggttgatgcaaacattagggagaaagaaagctttaatgagctgcaggttgagattgagcgacagatcttgcatgctaagactgatattgaggaccttaagaagcaacttgagcagagcaagattgagaggcagcacaaagaagagtgtgaagccatccggaagctgatttgtttgcagcctccacggtcagaaactgaaaaactcattgcagaccttgagaaggagataactgatttgaaggctgagaatgtagcatgcataaggactttggaactgaggaagaagcagtttgcccttcttctacatgtggttgaggaattgcagatctcgattgaagatgagcagaagagtatagcagatgagctgagagctattgctggagagcagaagatgagcatggaagaagggagcgtcggtgcttcagattccatggttgttgactgatcgagatacattcacatatgttgcagacctgcttgccctcgagacccagctttctttacaaagtggtgataaattggagctctgcagagctttcgttcgtatc

SEQ ID NO: 551 - DNA, 1569 bp, Zea mays
ttcttgtttgttgattaacccttaattaatccgggcgcgcctgatttatcacaagtttgtacaaaaaagcaggctcctgcaggaccatggctaaaccagaggggccaaccattggcgtgaagctgttcgtggacaaagagaagaagaaggtgctctttgctgagtccgacaaggagttcgtcgatgtgctcttcagcttcctcaccatgccgctcggcaccatcgtccgcctgctggacaagcagtctcagatggggtgtctcgaccagctgtacaagagcgtggaggacctcaacttggagtacttccaaaccagtgcttgcaaggcgatgcttctgaaaccgctcaacgcggcttccggccactgctgccgcctcaagatcaacgttgatggaagctttccaagggtggtctatgtctgcaaggacacgtcgtgcagcgcactcagcgacaacgcgtttagttcgttccctggcacggtctgcaaatgtggtaaggtcatggagttcgttgggcggtgcccaaaatacgatggtgacactgaaaccgccgccgccgcttgttcagaggatggagtttttgtgataggttgcttgaagtttatcgtcaccgatgatctccaggttgcgccagcatctacctctcttatgatgtctttcttcgagaaatttggtgtgcttgatccagctgtcctagagcagcaggttctgcagttcagttctgaaaagataaaatgcttgttgaagagattgttgacgtccaagcaacctctcactgatcattatttcgaagctcttgttccacaagatgatgcaagcctagaagcgcttgttcagaacttacatcctaaacaagaaaacgaggaccaggaaatgccaggaaaccagaagatcagggttcttcagacgaaggacaactctgccctgctgtatgatgaagttggtgtcgattttgtggactctctcttcggcttattaagcattccactgggatcggcaattaagttatattgccagtgctcggcaaaaggctgcctcggtaatgcttacaggagcatagatggtagtgtcaaagaattcgtcagagaggagtgccagagtctccttctggacccaaaggtaccacccttctttggttgctgcgcttctaagatccttcaggttgacgaattagctccgagagaactgacgatggaagcctgctttgtttgcttcaagagtctatggttttcaggttgtaaccgttctcacgagttcgcttattctttgcgatgcaatgaagttttttgcgcgaataaggtgaagtccattaaactttgtgaggcgaacccaaaacgacaaaacggcggaagcgggcagacgaattttgtggtgaaagaaatcaaactaaaggttatggagctacagagggctgtccttgtgctgagtcgcaatatactcagctctgtgcttctgcatcctaagaagaccaagaagctgcaccattaccgtcgcatgtaactcgagacccagctttcttgtacaaagtggtgataaattggagctctgcagagctttcgttcgtatcatc

SEQ ID NO: 552 - DNA, 399 bp, Zea mays
ttcttgtttgttgattaacccttaattaatccgggcgcgcctgatttatcacaagtttgtacaaaaaagcaggctcctgcaggaccatgccggcgacgccgacgatcatcggcgccctcctgggactgggcactcagatgtactccaacgccctccgcaagcttccctacatgcgccatccttgggagcatgtgttggggatgggtctcggtgcagtatttgtgaaccagctggtaaaatttgacgagaagctcaaggaggacctcgacaagatgcttgagcgcgccaggctagccaacgagcaacgctacattgatgatgatgaatagctcgagacccagctttcttgtacaaagtggtgataaattggagctctgcagagctttcgttcgtatcatc

SEQ ID NO: 553 - DNA, 1122 bp, Zea mays
ttgttgattaacccttaattaatccgggcgcgcctgatttatcacaagtttgtacaaaaaagcaggctcctgcaggaccatggctcgcaacgaggagaaggcgcagtcaatgctgaaccgcttcatcacgatgaagcaggaggagaagcgcaagccccgagagcgccggccctacctcgcctccgagtgccgcgacctcgccgacgccgagcgctggcgctctgagatcctccgcgagatcggcgccaaggtcgccgagatccagaacgagggtctcggcgagcaccgcctccgcgacctcaacgacgagatcaacaaactcctccgcgagcgcggccactgggagcgccgcatcgtcgagctcggcggccgcgactactcccgcagctccaacgcgccgctcatgaccgacctcgacggcaacatagtcgccgtccccaacccctcgggtcgcggaccggggtaccgctactttggcgcggccaggaagctccctggcgtgcgggagctcttcgacaagccgcctgagatgcggaagcgacgcacccgctacgagatccacaagcgcatcaacgccgggtactacggatactatgacgatgaggacggcgtgctagagcgccttgagggccctgccgggaagcgcatgcgggaggagattgtttcagagtggcaccgtgtggaacgggtgcggcgggaggccatgaagggggtgatgagcggtgaggtggctgcggctggagggcgcagcggggaggctgctagagaggtgctgtttgagggggtggaggaggaggtcgaagaggagaggaagcgtgaggaagagaagagggagagggagaaaggcgaggaagttgggagggaattcgttgcacatgtgccgctacctgatgaaaaggagattgagcgcatggtattagagaggaagaagaaggagctgcttagcaagtatgccagtgattccctgctggttgagcaggaggaggccaaggagatgctcaatgtccgacgctagaagacggtctgtcctcgatttccatgtctccaatgagctcgagacccagctttcttgtacaaagtggtgataaattggagctctgcagagctttcgttcgtatcatc

SEQ ID NO: 554 - DNA, 1172 bp, Zea mays
ttcttgtttgttgattaacccttaattaatccgggcgcgcctgatttatcacaagtttgtacaaaaaagcaggctcctgcaggaccatgttttacgggggatatgcttaccatggcaactcgtttgagcaaacataccgttgttatccagcatcgttttttgataagccacacctggaaggcggtgataaagtaataatgccaccttctgcccttgatcgtcttgcttccttgcacatcgagtaccctatgctatttgagctgcacaatgatgcaacccaacggatttcacactgtggtgttttggagtttgttgcagaagaaggcatgatcatcatgccctattggatgatgcaaaacatgctgcttcaagagggtgacactgtccatgtcaaaaatgcgactcttcccaagggcacatatgtgaaattgcaacctcacacaactgattttctggatatttcaaacccgaaagccatcttggaaaagactttaagaaatttctcctgcttaaccacgggagacagcatcatggtagcctacaacaacaaacaatattatattgatattgttgaaacaaagcctgcttcagcagttagcattattgagacagactgtgaagtggactttgcacctcctcttgattataaagaacctgagaaactacgacaaccaacagttcttgcaagcaaggcacctgctgaagatggcaacactgcagcagaggatgaaccaaaattcaaaccatttactggttttggaaagcggttggatggaaaagcctcaaaactgcaagcatcagaggttccttccactgcactttctgcaccttcagattcaaacaaaagagcaaatcagcaaatctcagcaccggcagcttcaggagctagcagttacagtcgacagaaaactggaaaacttgtttttggttcaagtgcaagcaacaataaggaaccacaaaaggctcctgctaaagaggagcaacccgcaaagaaggacgacgagccgaggttccaagcgttcagcgggaagagctattcattgaaacgttagctgcttcagttaaccttgaaattcgccgctactctttcgtttgttgcatgctcgagacccagctttcttgtacaaagtggtgataaattggagctctgcagagctttcgttcgtatcatc

SEQ ID NO: 555 - DNA, 1021 bp, Zea mays
ttcttgtttgttgattaacccttaattaatccgggcgcgcctgatttatcacaagtttgtacaaaaaagcaggctcctgcaggaccatggcgggcggaagcggcgaggcggctatgtctccgccgtcctctagtgccagcgggaagcgcgggcgggacccggaggaggacgtgtacgtggacaatctccattcccacaaacggtatctcagcgagataatggcatccagtctgaatggactgtctgttggggattcactgcctgacaacatcatggagtcccctgcaaggtcagagactgcttcctgctacagggatgagatattatcccaatactcaccgatgtcagaagactcggatgattaccggtgctatgacactcaattaaaccccagtgggaatcatcctgatgcgatgatcagcccttcaactagcccaatgtcatctcctcatcgacaccagagaccacaatcttctttgttaccttcaaacccataccctctcccaagctgctccctttcgtcagtagtctgctctcatgctcggcgtggctccgataatgaaggccggttcccgtcctcgccaaatgacatgtgccatgtagcagatttgaggcgaacagcactactgaggtcagtgcaaatgagggtgcagggaccccattcgtatgacctatcattcggcatcagacaaggacaagatcatgcacatgagcatgaaggggaacatgaccatgagcatgaacatctagaggacttggaagggacagaaggatcatcttgcaataagtcaatcgttaacgaagtcacgtacaaccagagacgtgaccatgattttggtcggtcagagcacgagatagattacatcaacaacagcacatcagatgattgtgtaagtgatctaaaatttaagcaagaagataagagccatagtaaatttgatatccctatgcacaaaaattcatagctcgagacccagctttcttgtacaaagtggtgataaattggagctctgcagagctt

SEQ ID NO: 556 - DNA, 982 bp, Zea mays
aaaaaagcaggctcctgcaggaccatgcctctcatcctaatctcaggtttcccttctgcgggcaagaccaccagagcccgacaactcgagcaattcttcgagtccaagattgccagcgctcctcctgatgcccgcacgtcccgcctcaaggtgcatcttatcaatgaccagactctcggtgtgccgcgctccgtctaccgtacggccagagccgagaaggatgcgcgtgcggaagaatattctgccgtcaagagagtcttgtcacgggatgatattgttatcgcagatggcctgaactacatcaagggctttcgctaccagttgtactgcgaggccaaagccctgcagacccccagctgcgtgctgcacgtaggcacgccgcccgaccgatgtcgcgagaacaacaagaaactcttggcggacgaggggactgacggcggatacgaagaggacgtctttgagaacctcatcttccgatacgaagagcccaatggcatgacgcgctgggacagtccattgttcattgtggttgaggaagacgagacgccgccatgcgaccagatatgggaagccatgattggcagtgacggcaagttgaagactgtcaagcccaacctggcgacagtgctgaaaccagcgaccgagcaaaattacctctacgaacttgacaagacgacgtcggacattctcacgcagataatggtctaccaaaaagatcacgctggtgaaggaggcggacaaatagctgtagcagatgtcgagaagcccattgaactgcccgcgacgccaatgactctcccacaactccagcgcatacgacgccagttcatcaccctaaaccgacaacacagcttttccaaggcgcggataaaggaggtctttgtcgactacttgaacgccgagtttctgcgttagaatgattgtagtcatgtgcagggacagcgtcgtttccagggctcgagacccagctttcttgtacaaa

SEQ ID NO: 557 - DNA, 634 bp, Zea mays
ttcttgtttgttgattaacccttaattaatccgggcgcgcctgatttatcacaagtttgtacaaaaaagcaggctcctgcaggaccatggcgacgaccaaggatcccgcgaccatcggcggcgagcccgccattggcattccctaccacccggcggcggaggcccaggggcactattactacgcgccgccgccgaacccctacgcggcggggatgccgccgcccaacgcgatctacgccggcgcgcccaagggggtgccgctccagcagaccatgttccgcgacacgcccgcgcccttccactgccaggcctgcggtgaagccgccgtctcctccgtccggtcaaagccaagccttgcatccgtcgtggcttgcatgatgccattcatgctgggggtctgcttcctatgcccttcgatggactgcctctggcacaagtaccattactgccccagctgtggggaaaaggtgggtgagttcaggaagtcggacccgtgcctcgtcgtggatgcgacccggtggtccgagccgagcttcgccgtgcctgcgtagcgcacatatgcaccacttgctatactgccttaaaaactcgagaccagctttcttgtacaaagtggtgataaattggagctctg

SEQ ID NO: 558 - DNA, 685 bp, Zea mays
ttcttgtttgttgattaacccttaattaatccgggcgcgcctgatttatcacaagtttgtacaaaaaagcaggctcctgcaggaccatgggaaacgcgtcgtccatgctgacccagtacgacatcgaggaggtgcaggagcactgcagctacctcttctcgcagcaggagatcgtgtcgctgtacgagcgcttctgccagctggaccgcagcgccaagggcttcatctccgaggacgagttcctctccatccccgagttctccctcaacccgctctccaagaggttgctccgtatggttgatggattgaacttcaaggattttgttgcgtttctttctaccttcagtgcaaaggccagccttcgtcagaagatcgagtttatattcaaggtttatgacatcgatggcaagggaaaaattaccttcaaggatctgctagaggttttacgggacctaacagggtcattcatgtccgaggaacaaagagagcaagtggtaactgaagttctggaagaagcagggtacacaagggattacgcattctcgcttgaagattttatccagatcatcgaccatcctggccttaagatggaggtggaagtgccaatcgactagctcgagacccagctttcttgtacaaagtggtgataaattggagctctgcagagctttcgttcgtatcatcg

SEQ ID NO: 559 - DNA, 978 bp, Zea mays
ttcttgtttgttgattaacccttaattaatccgggcgcgcctgatttatcacaagtttgtacaaaaaagcaggctcctgcaggaccatgctgtacatcgtgggcctcggcctgggcgacgagcgcgacatcactgtgcgggggctcgatgccgtacgcagctgctccaaggtatacatggaggcatacacatccctcctctccctcggcctcgacccggccgcgctcgccaacctggagaagctgtacgggaaggagataacggtcgccgatcgggagatggtggaggagcgtgtcgaccaggtgctaagcgaggctgctgacactgacgtcgccttccttgttgttggcgacccgttcggggcaactacacatactgatctggttgttcgtgccaagaaaatgggagtagaagtgaaggtgatccacaatgcatctgtcatgaatgcaattggagtttgtgggctacaactttaccgctatggagaaactatctcaataccattcttcacagacgaatggagaccagatagtttctatgagaagattcagaacaatcgccagcttgggctgcacacactttgcctgcttgatatccgtgtcaaggagccaacatgggaatctttagccagaggaaagaaagtctatgaaccaccaagattcatgactgtaaacactgcaataagtcagctttttgaggtggaggaagcacgtgggggatatgcatatcgcagggaaacattgtgcataggagtggcacgacttggaagtgatgatcagaagattgttgctgggcctatggagaagctactagatgttgattttggtccaccccttcactgcctgatcatagtgggagagactcatcctttggaagaagagatgctagagttttacatgatcaagtagctcgagacccagctttcttgtacaaagtggtgataaattggagctctgcagagctttcgttcgtatcatc

SEQ ID NO: 560 - DNA, 1180 bp, Zea mays
aaaaaagcaggctcctgcaggaccatggcgtggagcgccgccgccgtctccaggttcgccgccgcctccccacccgcggcacccatctccgtcaggcttggagccgccgcttctcgctcctccctgtccttctccagtgggcgccgacgccccgtggccgcgtccctctcgacctctgccaccgttgtaaaggaggctgttcagacagagaaggcaccaccagcactaggcccttattctcaggccatcaaagcaaataatcttgtgtttgtttctggagttcttggcttgaatcccgagaccaggaagtttatctctgaaaatgttgaggagcaaactgagcaggttatgaaaaacatgggcgagatattgaaagctagtggtgctagctattcttcagttgtgaagacaacgatcatgttggctgatctgcaggatttcaataaagtaaacgagatctatggcaaatatttcccggcgccagcacctgcacgatcaacctaccaagtggcggcgctgccactgaatgcccggattgagattgagtgcatcgctgctctctaactcgagacccagctttcttgtacaaaaaaaaagcaggctcctgcaggaccatggcgtggagcgccgccgccgtctccaggttcgccgccgcctccccacccgcggcacccatctccgtcaggcttggagccgccgcttctcgctcctccctgtccttctccagtgggcgccgacgccccgtggccgcgtccctctcgacctctgccaccgttgtaaaggaggctgttcagacagagaaggcaccaccagcactaggcccttattctcaggccatcaaagcaaataatcttgtgtttgtttctggagttcttggcttgaatcccgagaccaggaagtttatctctgaaaatgttgaggagcaaactgagcaggttatgaaaaacatgggcgagatattgaaagctagtggtgctagctattcttcagttgtgaagacaacgatcatgttggctgatctgcaggatttcaataaagtaaacgagatctatggcaaatatttcccggcgccagcacctgcacgatcaacctaccaagtggcggcgctgccactgaatgcccggattgagattgagtgcatcgctgctctctaactcgagacccagctttcttgtacaaa

SEQ ID NO: 561 - DNA, 2896 bp, Glycine max
ttcttgtttgttgattaacccttaattaatccgggcgcgcctgatttatcacaagtttgtacaaaaaagcaggctccttcaggaccatggcggaggaggaggaagacgacgagagcttcggcgacttcacgttcgcgtcgtttccgagtcaaccgacctcaaacgacaccaatcccgtcgacgacgacgacgattggggcgacttcatgaaccattccaatcagatcaacggcaaacccttcgacgcgttcggggttcccacggatcccacgaacaaacacgtgaacgacaacaacggcgttgccgttcaggccgaggcggcgaaaaagcctaaaggagctatcccgctttcgatcttcggcgaggaggaagaagaagaggaagagcaacaggagaaacccgcttctgccaatgttttctccaacggtggtgcggtgaaaaggggatccgattcgaacgggtccgttggaatcagcgatttgatttcgagtttgtataaccagcagcgccctcaggtggattctcacaacaacggatcggtttcggtatccaatgttgatgctcccaattcgacgaactcgaacggaagcaaattgaattcggatgaggtggatgaggatgatgatggatgggaattcaagtctgcggaatgggaaactggaaccaagagccaggatgttaaggctgaaacgccaaaacatgatagtggtgctcttgatgtcggtactgtgttggattcatccaatgggatttcagacaaagctggtggatggcacatggagtttgagttcagtccacgttttgcatcgcaagatcatattaacccacaaccaagtccaaaaaatgaatcaaatgacattggaactgggtttgccatgtttaatcaaaattttggggagtttagttcagggtcagggccagggccaaatcaaaatttggaagcaccgaagaaggctggcatttgtgccactaatatggaattactcaaattcaatggtgcaactccccatggtactattgattcatctctcacgtcagaatctcatcaatctgatgaatggaacttcggatttaatttcaattctagttatgtgggtgaagacaatcatagttcagattcatatttcaaaaccaaaaacaaccaggatgataacaacagaaacaatgcttccccaactaatatagatgttgattcacatgtcaatttctttgactcagagagtgatgttacacaacatgagaagcccctaacaagcccagagaatcgtagggaagccttacctctgtcaatttttggtgatgagacaccagatactgatgaacatcctgtgtctcaagatttatctccctatacaccctcatccccaataaggaacagcttcactagccctggttccaacttttctatcaatgacatatggaatttatataatcaagctgaaaaccaaagttcttctaatgtgacaccaaaagcaagtgaaaatcagattcatgccccccctgaagtatcgggctccagtttggttaccggtaatgatgatttagatgatgacttctgggactataaggatgccgcaactgaaacaagatttaccaatgaatctgcacagaaaacttcttcaccacaagtcaatgagaatgggttgcagtcttccccaacatttttaaattctgatttgaccaacggtgatgatgattttgaggatgattcatgggaatttaaggaagctacctctggaacaattaatcaagatcacacatctactcttgatcacagaggtttaccacagttatcaacaaaactagagcaggttgattatgcagagttttatagcaaagtgaaggatgaattgtgcaattatgttctgttccatcttcagaatctgaagaaaactcaaaatgttgctgctctctcgggtgaagatgccaaagcaaaagctcttcaggaggaaatatcggaattctccaagatactgcatcaggatactatgagcatccccaatgaatatctctctgaggattattgcccaagaaatgtccgctttaatgagcttcttgaagttttgaaggaacctaagttccaacctgttgagtcagaatatcaactagcatcaaggttgtcgatggctgagaaggatattaaatatggtatggaacttttgaaagatacagtatcaacattaagaattctcaagctgggatcaagagaagaacaatctagttatcttaccatatggtccaaaatagcctttgtttgttctcaagagctgaaacatggtgcttatgtttggaagcaagctgtactacagaatgttcatgaccagatattatctagccagaaaggtgttcagtatatccttgcacttggagaaatttatagagtggcagaaattattgaagcttcagccaaacttcataaaccttggatgttgtcaggtgccatagatcataaaagtttatgtgcccttttgaatgaatgttatagcatatggttggcttcaggacttgaagaagcccttttgagtatagcaaatcagaataattttgagctagatggcatttcaagggaattagttgaatccattaagtatattcatgagcttgatgaacatgcacttcagagctttgtcatctctggagaacaaactacttgccagttgtcagccttgccagctggtttcataccagggttaaatttggtgaaatggaatgggaagcattacattgtcaaacttgcaaacttgtggatcaatctaataagttcagatccacccaagaagtgacacctgcaaattcaattgtctctcacaacaagtggagttttcactcgagacccagctttcttgtacaaagtggtgataaattggagctctgcagagctttcgttcgtatcatc

SEQ ID NO: 562 - DNA, 1002 bp, Glycine max
ttcttgtttgttgattaacccttaattaatccgggcgcgcctgatttatcacaagtttgtacaaaaaagcaggctcctgcaggaccatgtatgcagagactggtcttctcttcccatatttgaacaacatctctcacggccttcatcagctcgaggagtactgcaaaacccagaagtccaatgcttcaatggatgaccttgttcagtcttctgtcatgtcagagtatgatttggcagcagagggagatctgttcaaagctcctgaacctattattgaagagccaatcatggatatggatcccatgacagccaccatctccatgatatcttgtggggaagatgtctcctcacagggactaaaatccactgatattgatattcttcaaaatgatcagtttctgcatgaggtgttctatgaatgtgaaaaggatctcttagaaaaggcagcaatagagccaccattctctgagattctggaaatcaaggttcctcttctgaacattgatgagaacacaattcaagaaaacaagctgcttcctgacatgcaattagcaaagagtgtcagctcaggaagtttgagctcaatggactggatgcgtggagctgcaatgaagcctgctttcattgatatccctgcaatagatttcaatgcagattatggcatgcggagatcatttagcgaaggagatataaagactcttggtaatggtaacatgaacatcgtccaatcaccccttgagaggcccttgcttatcagcaactgcaccagtgaggaacgctttcaaaagctctcaagatacaggaataagaggacaaagaggaattttgggaggaaaatcaagtatgcttgcaggaaggctcttgctgacagtcagccaagaatccgtgggagatttgcaaggactgaagagtctgatgtcaagagggaatgactcgagacccagctttcttgtacaaagtggtgataaattggagctctgcagagctttcgttcgtatcatc

SEQ ID NO: 563 - DNA, 936 bp, Glycine max
ttcttgtttgttgattaacccttaattaatccgggcgcgcctgatttatcacaagtttgtacaaaaaagcaggctctgcaggaccatgtctgcggctttggatatgaccctcgaagatataattaagaacaacaagaaatcttccctcgccaacaccaggggccgaggccgagcctcgggacccggacccgctcgccgcctccccaaccgtgccgccaatcgcgccgcaccgtatgccgctgccaaggcgccggagacagcttggaaacacgatatgtacgcgaaccagccagtggccgcggcgtatccaggtggtcgagcgtcttccatcgaaacagggactaagctctacatttccaatttggattatggcgtttccaatgatgatattaaggagttgtttcttgaagttggcgacgtgaaacggcatactgttcattatgacaggagtgggagatccaagggtacggcagaagtagtcttctcgcgccgagctgatgctgtagctgcagtgaagaggtacaacaatgttcagctggatgggaaaccaatgaaggtagagattgtggggacgaacatcgctacacatgctgcaccacccgctgtgaatggaacttttggaaacccaactggagttcctagaagtggacaagggagaagtgggtcattaggaaggccacgtggtgggagtagaggtcgtggcagcattcaacggggccggggacgtggaagaggaggtcgtgatgaaaaggtatctgctgaagatcttgatgctgatttggagaagtatcatgctgaggctatgcaattaaactgaaggaaacaacgatgttctgttttattgctattacatttgcggttgttagctcgagacccagctttcttgtacaaagtggtgataaattggagctctgcagagctttcgttcgtatcatc

SEQ ID NO: 564 - DNA, 1080 bp, Zea mays
ttcttgtttgttgattaacccttaattaatccgggcgcgcctgatttatcacaagtttgtacaaaaaagcaggctcctgcaggaccatggccgcttcttcctcctgcaaggtcatcgactcccacctgcacgtctgggccacgccacagcaggccaaggaggagtacccgtacttcccaggccaggaacccacgctgcgtggcgacgccgacttcttactcgagtgtatgagtgaagctggagtggacggggctgttattgttcaacctattaatcatatgtttgatcattcgttggtaactagtgtgttgaagaaatacccatccaagttcgttggttgctgtcttgcgaatcctgcagacgatgggactgggattaaacagcttgaacatctgattgtacaagaaaaataccgtgctgtgaggttcaacccaaacttatggccatctggtcaaaagatgaccaatgaggttggaaggtcattattttcgaaggcaggggaacttggagtaccacttggaataatgacgatgaagggagttggtccatatattcaagaaatagaggaactgtgtagggattatcctgcaactaccgttattcttgaccatatggctttctgcaagccaccaacgaacgatgaagaagagaaggcattctcttcatttctaagcttatccagattcccacaggtttatgtcaaatacagtgctcttttccgcataacaagagaagcatatccatatgaagacactgctcagcttctttccagtgtgatatctcactatggagccagtcgagtaatgtggggaagtgacttcccctatgttgttcctgaatgtggttacaaaggaggaagggaggcgatttctcatgtcgccagcaagataccagtttcccagtcagatttggaatggatcttgggaaaaacagtgagccaattattccaaggtgcatgggttactccatgatcactgtagtgtattccagagcaactatatcaacaggaactcgagacccagctttcttgtacaaagtggtgataaattggagctctgcagagctttcgttcgtatcatc

SEQ ID NO: 565 - DNA, 1726 bp, Zea mays
ttcttgtttgttgattaacccttaattaatccgggcgcgcctgatttatcacaagtttgtacaaaaaagcaggctcctgcaggaccatggcggcggcgaacggagctgccggtgcggtgctgttcagcgaggaggacctgagggaggtgagtggggtgcgctggggagaggacttcgtggaggtgacgtgcggatgcaccagccaccgctacggcgacgccgtcggccgcctccgcgtctttgcgtcaggcgacctggagatcaactgcgagtgcacgcccggctgccgcgaagacaagatgacacctgctgcctttgagaagcactccggaaaggagacagctggaaagtggaggaacaccgtctgggtaatggtccagggggaaaaagtgccactgtcaaagacggctctgctcaaatactactacctggcgcacaagtcaggcaacggttctcacaagggccgtaacggacgtccgtcccaccgcgacgagttcatctgctgcgcaggatgtggcaaggagaggaggtttcggctccggtcaaaggaagagtgccgtgtttaccatgacgctcttgccaaagctagctggacgtgtgcggatttgacaactgatagggtcacctgtgacgacgaggaggagcgtgcaagccgcaaggtcctgcggggctgctcccgcgcgccgtcctgcacgggctgcatgaagtgcgtgtgcttcggctgcgagacctgccgcttcaaggactgcgactgccagacctgcgttgacttctaccgcaactccaaggaatagctcgagacccagctttcttgtacaaagtggtgataaattggagctctgcagagctttcgttcgtatcatttcttgtttgttgattaacccttaattaatccgggcgcgcctgatttatcacaagtttgtacaaaaaagcaggctcctgcaggaccatggcggcggcgaacggagctgccggtgcggtgctgttcagcgaggaggacctgagggaggtgagtggggtgcgctggggagaggacttcgtggaggtgacgtgcggatgcaccagccaccgctacggcgacgccgtcggccgcctccgcgtctttgcgtcaggcgacctggagatcaactgcgagtgcacgcccggctgccgcgaagacaagatgacacctgctgcctttgagaagcactccggaaaggagacagctggaaagtggaggaacaccgtctgggtaatggtccagggggaaaaagtgccactgtcaaagacggctctgctcaaatactactacctggcgcacaagtcaggcaacggttctcacaagggccgtaacggacgtccgtcccaccgcgacgagttcatctgctgcgcaggatgtggcaaggagaggaggtttcggctccggtcaaaggaagagtgccgtgtttaccatgacgctcttgccaaagctagctggacgtgtgcggatttgacaactgatagggtcacctgtgacgacgaggaggagcgtgcaagccgcaaggtcctgcggggctgctcccgcgcgccgtcctgcacgggctgcatgaagtgcgtgtgcttcggctgcgagacctgccgcttcaaggactgcgactgccagacctgcgttgacttctaccgcaactccaaggaatagctcgagacccagctttcttgtacaaagtggtgataaattggagctctgcagagctttcgttcgtatcat

SEQ ID NO: 566 - DNA, 393 bp, Glycine max
ttcttgtttgttgattaacccttaattaatccgggcgcgcctgatttatcacaagtttgtacaaaaaagcaggctcctgcaggaccatggatctttcagaccttaattccgctgaaatgcagaagttctactctgaagaacagcaaagagccatggttaatgaaatggtggcaaagctaacgagtgaatgctgggataaatgcatcacgggtacacctgggaataaattcagttccagtgaatctaattgtctttcaaactgtgctcaccgttacttggaaatgagcatgcttatcatgaaaaggtttcagagtatgcaatgactcgagacccagctttcttgtacaaagtggtgataaattggagctctgcagagctttcgttcgtatcatc

SEQ ID NO: 567 - DNA, 3179 bp, Glycine max
ttcttgtttgttgattaacccttaattaatccgggcgcgcctgatttatcacaagtttgtacaaaaaagcaggctcctgcaggaccatgctcgaaccgcgagaatctgatatacctgtcctgtttctggtcctggttgtgcttcccttggtggcttacatcttacttggaaaatggagtgaaactagtaagaagagagataggataaatttgcttgcccatttggctgctgaagaagctctaagagctgaagaaatggccgtggctgatgtaattcctccagtgtctgcttcaaaaaatgaacatcatgtgtgtgctaggtgctctgctccagccagaactcgctgctccagatgcaaaattgttagatattgctctggaaattgtcaaataatccattggaggctaattcacaagcaagaatgccagcaactggaacctcataaatcaagctcatttcctctggctgtttcagttgaggaatttggtcatggggatggtagttacttttatgaaaatttgaacaaccagttcttaggtccctctttgaagcagactttaagggagagtgcacctttggactatttggttcaccctctgacaggcactgctgcttctactacagctgatttttctgtatttaataactttcaacattctgcttttgaaagaacttcccataaatccaacagagaaacattgagaagagataatggctctatatatgaatcttctattgaatcttctgattataaagctagcagttctctctcaagtgtggtaccaaaggaggcgtttatgagacagaagtcaagaaagagcagtgattctgtgttggaagaagaaatttcaaatgtcagttctggtggctttggagtttatattaacagatttgatgcatcaaaaaacatgatccatgagaatgacagccatcaaagtcaatatggaaatgcattggtaacaagacacaaatatggacgctcaaatgtgtcaagtgctgcaaacaatgataacggtgtagatgaatttgaaacggacatcaccactaaaggtgtaagtgtagtcaaagggggaaattatcattctgatgaagcagcacaatacaaacgcccttctgaatcgacaatcaaaggaagcatgaaagctaaaaagatattacatactcccaagaccaaatcttctaaatcaccaaagtcaacatcaaagacatcagctgacttttgttgctcagaaatagagaagaaaggaaaaactgcagatgaacttaaagttgctggaaatagtgataccatccctttacatggtaatggtagcaatgggactgcaaacactggaattatgaaaatgatgggcttgaggaaatcaacaaagcctactcctctagcctctacagaaagcatggacgtaaagtgcaagaaggtgaagaaaataaagatgttgtttccttatgatgaatttgtaaagatttttcagagtgatgtctttggcatataccccaggggccttttaaattgtgggaacagttgctatgccaatgctgtcttgcagtgcttaacttctacaaagcctctagttgtctatttgctttatagatcacactcaaaagcttgttgtgctaaagattggtgtctcatgtgtgagttagagaaacacataatggttttaagagaaaatggggatcctctatctcctagtaggatactttggcatatgcggagcattaactgccacatgggtgaaggaaatcaagaagatgcccatgaatttttaaggcttctaattgcatcaatgcaatctatatgcttggaggcacttggtggtgagaaaaaggttgatcctagactacaagaaacaactttcatacaacatacttttggtggtcgtcttcaatccaaggttaagtgtttgaaatgtaatcacgaatcagaaagatatgagaacattatggacctgaccttggagatattgggttgggttgagtcactggaagatgcactgactcagtttacttcccctgaagatttggatggagagaatatgtacagatgtggaaggtgcacatcatatgtcagagctagaaagcaactgagcatacatgaggctcctaacatcttgactatagttctgaagagatttcaggaaggaagatatgggaaaattaacaagtgcataacttttcctgaaatgctggatatgattcctttcatgactgggacgggtgatattccgccactttacatgctttatgctgttgttgtgcacctggacacactaaatgcgtctttctctggacactatgtttcatatgtgaaagatctgcaaggcaattggttcagaatagatgatattgaggttcagccagtactagttaatcaggtcatgtcagaaggagcatatatcttattctacatgaggtcttgtccccgtcctccggtggaacatactgtgaaagctgtgcagcaatcagtttatgattcttcaaagcacaatccaatggaaatgcagaaacctaataaaccaggacatagcaggcatggcagtcatcagttttttgtctcagagtcatcacccaatgcgaggccagaaatttccactcacattattgacaccaccaatggcttccttagaaaaagcaccaataggaatgccctgccggtgacccaaacttacgccaaaaatgtcaggagtgagttctctgacaccacctcaagcgactggtcccttttcacaagctcggatgaggcttctttcacaactgagagcaccagggactccttcagcactgtagactatggtgattcaggcaacatggatccaatttcatcaatcttcaactacaccccagaaaagtcctacttgaagttttcacatagtaggccagttaccagggtcttccctgaaaagggtcatgttgaacaagtacagagaattgatcactccaaaagggtcggccattcttcaaatgaacatccaccaaatgggaattgtggcttgtatgtatattatgggagtaatcctgtgtgtggtactacccggacttctagtcagtgtgaattttagtctttggagaatcctaacttgttgaactgattattagatgcagtaggtgcctcgagacccagctttcttgtacaaagtggtgataaattggagctctgcagagctttcgttcgtatcatc

SEQ ID NO: 568 - DNA, 594 bp, Glycine max
ttcttgtttgttgattaacccttaattaatccgggcgcgcctgatttatcacaagtttgtacaaaaaagcaggctcctgcaggaccatgccagttccacttgccccatacccaacaccaccagctccatatacaccaccagctaatggtgtacagagtcaacttgtctgttctgggtgcagaaaccttctagtgttcccagttggagccacctctgtgtgctgtgctgtttgcaatgctgtcacagcagtaccacctcctggcacagaaatggcccagttagtatgtggaggttgccatactttactcatgtacatccggggcgcgacaagtgtgcaatgttcttgttgtcacactgtcaatctagctttggaagcaaatcaggtggcacatgtcaactgtggcaactgcaggatgctactcgcgtaccaatatggagcaagatccgtgaaatgtgcagtttgcaattttgtaacatcagttggggccacagcaagcaccactgagcagaagttcagcacttaactcgagacccagctttcttgtacaaagtggtgataaattggagctctgcagagctttcgttcgtatcatc

SEQ ID NO: 569 - DNA, 5398 bp, Arabidopsis thaliana
cggagacagcgagaggatagagcgcttcttcggctacaacaagctttcgctaatggcggtttccttctgatcactctcaccggagccgtcatcttctctgttttaccgatttttagggtttgtttccggataaactcttcgtatgctttttttttttcgttggattcgtttctggaaacgtatccatttcctgtctagagatcatgtgaatttctcttagaacagaactcagatctaaattaaagtaacggtgcttgattcattaaactcggaatgcaaagtcccttgcgttttattcactgaaatcttagtcgattagatcttgaggtctgtttgttaatcgcacttttctggggaattgatcgtagaagcaattacgctcatgggaaatgatgaaagttatagctaaactttactgtagaaccttactctgattatatttcatttaaaaatgctatttggttggtaaagagaaacatcacaacttttcatacttttctatttttttcagaaattttgattgtggtggaaacttgttgtggcaactctactgagaaagtttgaagaagctggaatcaaagatatagctagagttaagagggttcatactaacttgtgctcgttttgtgatgtgctgttgttaacgtttggaggaaaaagttgtagtgtattaaaattcagcgtccgagttctggggcggagttgccccatagcattgactttacgcctctacacatagtccgaagggctaattcagctcaaaacatgatgatggatgaagatgttgagcaggccagtttgatgtctttcaatgacaggcctagggcttttcccaacatgcgtagtaaaacctatagtccactggtacaacttttattcctctctttcttgagtgcttttctttttgcttgcatcagatcactgagatgcgtattataactagtttccttctatttcgtttagcatcttagtttcttgagcatctcgttttcattttctttgaaattgtataaagtttagttgttttttggcagatattccggattattaggaaattaaatgtccgtgtcctttcgataattctgcttttctgcttcggagcaatcttttacatgggggcaagtacttctcccatcatcgtgttcgtcttcacagtatgcatcatcagcttccttttgtcaatatatctaaccaagtgggttttagcgaaagatgaaggacctccagagatggttgaggtaagctcactcagattatgtggtgttagtcatgatgttgacatttttccttctttgttctcatcaaaaatttgtaattctaatttgtgaggtaattctcttacttatagatatcagatgctatacgtgatggagctgaaggttttttcagaacgcagtatagcactatatccaagatggccattttgctagcttttgtgattctttgcatatatctattccgtagcttaactccccagcaagaggctgctggtttaggaaggtgctgatacatgattacattcacaagatttattttatcttttgaattgttgtgaatgaagcttagccatattactattttgctgcagggcgatgtctgcttatattactgttgctgcatttcttttgggggctctatgctcaggtattgctggatatgttggaatgtgggtgtcagttcgtgctaatgtgcgggtctccagtgctgccagacgatctgcgagagaagcattgcaggttcttctttagtttagctattttggtaacatgtcatgtacacgtttccaaatactaagtggcagatataatgcagatagccgttcgtgctggtgggttttcagccctggttgttgttggtatggctgtgattggtatcgccatcctctattctacattttatgtgtggttgggcgtgggttcaccaggctcaatgaatgttactgaccgtaagtcttctgctcttttttttttatgaaaaatattcattttcgtcttgtgtgtatattctataatcattgtactgagtttcaaaaagttattgttatcttttcaaaggatcattttcagacatgagcagtattttcttaaatatgtcatgacttgtattaatcttgattgaggtggggtaccaatacagttctaagattttcagtgaaccctatatgtaattctcttgatttattgaccagaatttgcatttgcatgggcgatagtggagctattaaacttgtaagatttattgattgaattttctgtttctcttacagtacctcttcttcttgtcggatatggttttggtgcttcgtttgttgccttatttgctcagttgggtggtggaatatatactaagggagctgatgttggggcagatctcgttgggaaagttgagcagggaattcccgaggatgatcctcgaaatcctgctgttattgctgatttggtatttgatctttgttctttttgtttcttactttcttgattctgtgattcccaaacgtgacatccttgtttggggcatatatcactctacaagggtttgcttgtgttttcgtcatttaggcatttaaagccattttcatcttcttgtaggttggagacaatgtgggggactgtgctgctagaggtgctgatttatttgaaagtatagctgcagaaatcatcagtgcaatgatactaggtggaacaatggctaagaagtgcaaaattgaaggtgcaccatctctctttaaagttacttctggtatatgcaaatatataacttatggtgtgagttcctgactcataccgagaaaattaaatgaactgctaggattttataatctgaaatgcaaacttaggaagagttgcatagagagttcaagctcgtaaattacattctgtatacagaataatctacgctttattgcatgttttggtcactccttgaggatttgagggtacattattacttgttaggatttaaaaagtcgacataagttgtatagagttattgtttgaagcaccttgtacgaacctgctatgcattgtgtgaaaattgaaggaagactacttttcatgacagcaagctacacttggctgcagtcaaaaaatttcaataacattacccatttctagcagtggttgttagatatgcgctgataaacatcctattaaacctcttgttcatgcttgatacttactcaaatctttctctattatgcagatccatcaggctttatcctttttcctctagttgttcattcttttgacttgattatatcctcaattggtattctatcaatcaagggaacacgtgatgctagtgtgaaatctccggtagaggatccaatggctgtacttcagaaaggatattctctgacaattatattagctgttataacatttggcgcggtaatgttgtcacacataaccattgattgtcttgttcctttcattctttttacaattaattctgctttttatgggctttttggttcagacttttcattagcctacactagccttgttattactgaaatttcgaacaaattctttgctatattcttctgacagcattatttatgtttgtagtcgactcgctggctgctttacactgaacaagctccatctgcatggttcaatttcgccctatgtgggttggttggcatcatcacagcctatatctttgtctggatatccaaatattatacagactataagcacgagcctgttcggacgttggctcttgctagctcgactggtcatgggactaatatcattgctggagtaagcttgggcctggaatcaactgctcttccagttttgactataagtgtagctattatttctgcgtattggttgggcaatacctcgggtctagtggacgaaaatggtattcccactggaggtctatttggaacagccgttgctacaatgggaatgctaagcactgcagcttatgtccttactatggacatgtttggccccatagctgacaacgctggtgggattgtcgagatgagccagcaggtaagatgtcacatgattggcttgaaaggctcttatgttccatctttattctatgtagaaataataaatgtttcgtgcagccagagagtgtccgtgagatcactgatcttcttgatgctgttgggaacaccacaaaagcaacaacgaaagggtttgccattggatctgctgcacttgcatcattccttctctttagtgcgtatatggacgaggtttcagcgtttgctaatgtgtctttcaaagaggtagatttcgttatgcatcgttgctgtattctcgatgttgagacaacttctcatactcatcctcggataaaatcaggttgatattgctatcccagaagtgttcgttggtggattattgggtgccatgcttattttcctctttagtgcttgggcatgcgcggcagttggtcgaactgcacaagaggttgtcaacgaagtaagaaggcaatttattgagaggcctggcataatggtgagcatatttttccttttgagtgcttcaccttttcttgtgtattggcttgtaccgttgttgactagcaaatatcttgttgcaggagtacaaggagaagccagattatagtcgctgtgtcgccatagtcgcatctgcagctttaagagaaatgataaagccaggagctttagctattgcatcacccattgtagttggtaagtcagtaatatctactcgtttttctttacttactgtattgaaagtttgaaaccacaacattgtgaccaaaaacaaacctcttgttctctctttcaggtttggtgtttcgaatcttgggttactacacaggacaacctctgctcggagcaaaagttgtagcttctatgctcatgtttgcaacagtttgtggtatcttaatggcacttttcctaaacacggcgggaggtgcttgggacaatgcaaagaaatacatagagaccggggcacttgggggcaaaggaagtgaagctcacaaagcagctgtgactggtgatacgtaagtattttcgttctacttcaacactcattcaaagttatattcctgaatacgatttctcattagaattcatctgaaaattgtagcgtgggagatccgttcaaggacacagccggtccatccattcacgtcctcataaaaatgcttgcgactataactctcgtcatggctccggttttcctctgaaagtgaaccgttacttatccatcccggcttatttactctcttgcacatatacaaatagagagggagagaggttggttataaaatgatttacatggattaatggtttttgtgtttcatttcatctgaataaatgagataattctgtttttgagtttagagacactctttaaggaattctagagacattttaatcaaccacatctttgacttt

SEQ ID NO: 570 - DNA, 1506 bp, Zea mays
ttcttgtttgttgattaacccttaattaatccgggcgcgcctgatttatcacaagtttgtacaaaaaagcaggctcctgcaggaccatggcgtcccagccgccgccagagcccgcaccggccgaggcgggtctggaaagcatggagggcctcgtcctcgacacggtcatctcaagagccggcgcgcgccccgcagcggcgctcgcctgcgccagcacgcgcctccgcaccgccgttgccgacgactccctctggcgcagattctgcggtgaggacctggggctcgacgctcccgtcgatccagagggccggcctcttccctccttccaggttgcatataaagtttggtcggagtcttttggcatgtaccctctacctatggtaaagagagtgagacaattctggacttcaatgaaaacttggttgtctgaaaactttcctgaggcatacaaaacgttatgcgaaggtgtttctgaagctcaattaaagtcagcagaggatgatcttggtttcaagctccctatgcccacaaagctgttgtatcgcttttgcaatgctcaactgccttttagtgaggaccatgacacaaataaaagcatttccacttatggattgattgggggctatgcgttttatgatcattgggtgaatgtgcatttgtcaccgcttgagcaaatagttgaagagacgaaggacttctatcgggagttccctgatgtatttcatgggcgcaaattcattgtagtggcaacttcatggtttcatccgaaaacatttcttctagattgctcaaatggtgaactttatgttggtacatacaacttaccgataggaggaatgcttccctgtgtgcccaaagcattgataaagccagcaggtaatgatctagcacaagatggactactcctgtggttagaagaacaccttaggcgtttacagagtggcatgatcaagacccgtatgctgatggcatcgagatatatcagcttatatccagaagcacctccatcatgcagttcagctgttacaaatggcattaaggtacgctcatctgctgtctttgtgccagaacatcctgggaggcctggggaaaaatttatgttcacttactcaattcgcatgtcagttccagaggcatgcatgctaggtggcgtgtactattcttcctgccagctttgctcccgccactggaccatcagatcgtgtgacagggttgtttctgatgtgagcggaggaggggttattggagagtatcctctactgttacctggtgaggatgagtttgtctacgagagttgcacgccactgccccaagtaccaggatctgtggagggctctttttcgtttgtgccgggcaagttgagccgacctgaagggaagccgttcgaagtcatggtggcgcctttccctcttgatgtgccagaatacatcttctgactcgagacccagctttcttgtacaaagtggtgataaattggagctctgcagagctttcgttcgtatcatc

SEQ ID NO: 571 - DNA, 826 bp, Zea mays subsp. mexicana
ttcttgtttgttgattaacccttaattaatccgggcgcgcctgatttatcacaagtttgtacaaaaaagcaggcctgcaggaccatggatacaggagttcaagctatgttcatcatcagtcttgtgctctggtgtactacaagctttgccttggatgatgctgctgctacaaggattccaaatgtgggcacattacctctgtcaatgaaagaaaatccgcaattatgccaactttgtgaggagtttgcatcagaggccctcttctatttaaatgaaaatgagacccagactgaaatcattgatacactacaccaagcttgttcaaagtttggctcttttaagctggagtgcacgaggttggtggattattatgtccctcttttcttcacaaaaattgcttcattaagccctgaagaattttgtgcatcagcaagtttttgtggcgaggtaacattcattcgtcttccaagacatgaagatacttgcaccctttgccatgtggttgtcgatgaggttgttactaatcttgaagatccagacatggagcttaagataattgagatacttctgaaaggatgcaataatgcagaggattatgtacaaaagtgcaagaggttgataatccaaaatgcacctatcataatggagaatattaagaagttcctcgagaagagagatttttgcaattctatccatgtctgtggaggtaaatccgttcgcgctggatcacaagtcctcagaagcctttcttcagcctgactcgagacccagctttcttgtacaaagtggtgataaattggagctctgcagagctttcgttcgtatc

SEQ ID NO: 572 - DNA, 2223 bp, Arabidopsis thaliana
ttcttgtttgttgattaacccttaattaatccgggcgcgcctgatttatcacaagtttgtacaaaaaagcaggctcctgcaggaccatggttaccttatgtgccacgttactgatccttctctcaatctttcttgcaactccgtcgaatgttcgaggaaatgcagagctgaaggctttaatggagctgaaatcgtcgcttgaccctgaaaacaagcttctccgttcatggacgtttaacggcgatccatgcgacggatctttcgaaggaattgcatgtaaccagcatctaaaagtcgcaaacatatcattacaagggaaacgtttggtcggaaaattgtctccggcggttgcagagctcaaatgtttgtcaggtctttacttacattacaatagtctctctggagagatacctcaagagatcacaaatcttactgaattatcagatctttatctcaatgttaataacttctctggtgagattccggcagatatcggctccatggctggcttgcaagttatggatctttgttgcaacagtttaacagggaaaataccaaagaacattggatccttgaagaaacttaatgtgttgtctctgcaacacaacaaactaaccggagaggttccttggactttaggaaacttgagtatgttaagcaggcttgatttaagcttcaacaatctgttaggtttaatcccaaaaaccctagccaacattcctcagttggacactcttgacttgcgcaacaatactctctctggctttgttcctcctggtcttaagaagttgaatgggagcttccagtttgagaacaacaccgggttatgtggtatcgattttccttctttgagagcttgttctgctttcgataatgcgaataatatcgaacaatttaagcagcctcctggtgaaatagacactgataaatcagctcttcacaacattcccgagtctgtatatctccaaaagcattgcaaccaaacacattgcaagaaatcctcatcgaaactcccacaagttgctttgatttcaagcgtgattaccgtcactataacattgattggtgctggtatattgaccttctttcgctacagaagaaggaagcaaaagatcagtaacacacctgagttttccgagggaagactaagcacagatcaacaaaaagagttccgtgcatcgcctttagtgagtcttgcctacactaaagaatgggatccgctaggtgatagcagaaacggagctgagttttcacaagagcctcatctctttgttgtaaatagtagcttcaggtttaacttagaagacattgaatcagcaacccaatgcttctcagaagctaatctattgagcagaaacagcttcacctcagtgttcaaaggagtcctcagagatggttctccggtagctatcagaagcatcaacataagcagttgcaagaacgaagaagtcgaattcatgaacggtttaaagcttttatcttcgttgtcacacgaaaacttagtgaagctacgtggattctgctgttctagaggcagaggagagtgtttcctcatctatgattttgcttcaaaaggaaagctttcaaattttcttgacttacaagaacgcgaaactaatctggtccttgcttggtctgcaagaatctccatcatcaaagggattgcaaaaggtattgcttacttacatggaagtgatcaacagaagaagcctacaatagttcatcgaaacatctctgtcgaaaaaatcctacttgatgaacaatttaacccgttaatcgctgattcgggtcttcacaaccttctagcagacgatatggtcttctcagcactcaaaacaagtgcagcaatgggatatttagctccggaatacgtcacaaccggaaaattcaccgagaaaaccgatattttcgcctttggagtcatcattctccagatactctctggtaagctcatgcttacaagttcactgagaaatgcagctgaaaatggagaacataacgggttcatcgatgaagatcttcgtgaagagtttgataaaccagaggcgactgcaatggcgaggattgggataagctgtacacaggagataccaaacaataggcctaatatagagacattgcttgagaatataaactgtatgaagagtgaatgactcgagacccagctttcttgtacaaagtggtgataaattggagctctgcagagctttcgttcgtatcatc

SEQ ID NO: 573 - DNA, 1163 bp, Zea mays subsp. mexicana
ttcttgtttgttgattaacccttaattaatccgggcgcgcctgatttatcacaagtttgtacaaaaaagcaggctcctgcaggaccatgagcatggggcgcttcgtcaactccatggatccgacgtcggggctggaggtgatcagagactggaacggcgtagcccaggtcgtgctccgctcgcccaagggagcctccgcgcgggtgagcctgtgcggtgggcaggtcgtctcatggaggaacgaccgcggcgaggagctcctcttcaccagcagcaaagcaaccttcaagccgccaaatgccatgcgaggtggaattcagatgtgtttccctcagtttggatactctgggacattggagcgacatggatttgcaagaaacaggatatggtccctggatgatgagcagccaccactgaatcataatgataacggaagcaaagtttctgttgaccttattctaaagccatctgaagatgacctcaagtgctggccacattgttttgagttccgtctgagggcctctctttcaaaggatggggacttgtcattgatatcacgcatcaggaatgtcaatggcaagccattcagtttctcatttgcttatcacacatatctttctgtttctgacatcagtgaggtcaggattgaaggtctggagacacttgattatcttgacaaccttagccacaaagaacggtttacggaacaaggagatgccataacatttgagtcagaggtcgaccgagtctacgttagctcccgaaatgtagtagcagttattgaccatgagaagaaacactcgtttgtcataagaaaggaaggacttcctgacgttgttgtgtggaatccatgggaaaagaaatcgaagaccatggtagacttcggcgacgaggagtacaagcagatgctttgcgttgatgctgctgctgtggagagaacaatctcgctgagaccaggggaggagtggactgggaagctggagctttctgcggttttatccactaactgcagcgaccatcttgatcatcctgtcagcatctagcgtttattcccattgtagtgctatatatttgcctcacaagagaagtatagctcgagacccagctttcttgtacaaagtggtgataaattggagctctgcagagctttcgttcgtatcatc

SEQ ID NO: 574 - DNA, 591 bp, Zea mays subsp. mexicana
ttcttgtttgttgattaacccttaattaatccgggcgcgcctgatttatcacaagtttgtacaaaaaagcaggctcctgcaggaccatggctgagccgacgccgtcgcagtcgccagcgcagacgccgcccccgccgccgacgcagcagactcccgcggcgggtgggctcgaggacatgctggcgtgtgtggcggcgctggaggccgcgctgctgccgtgcctccccgcgcgcgagctccaggccgtcgaccgctccctccagtcctcccaccagattgatgttgagaggcacgcaagggatttcatggaggctgccaagaagctccagtcttatttcatcagcctgcagcgtgaggaaccgccatctgcagaagagatgcttcgaaaggagattacgacaatggaggaagagttgaagagcaagtctgagctcattgccaagcacaagaagttgattgaagggtggcaaaaggaactgaaggagcagctgagcaagcacatcacggagcttgaaagggtgtgactcgagacccagctttcttgtacaaagtggtgataaattggagctctgcagagctttcgttcgtatc

SEQ ID NO: 575 - DNA, 2787 bp, Arabidopsis thaliana
ttcttgtttgttgattaacccttaattaatccgggcgcgcctgatttatcacaagtttgtacaaaaaagcaggctcctgcaggaccatggctcctcattcgttaaagaagaactacaggtgctcacgatctctaaagcagttctacggcggtggtcctttcattgtttcatctgatggttctttcatcgcctgcgcctgtggtgacgtcattaacatcgttgattctacggattcatcagtgaaatccacgattgaaggcgagtcggatacgctcactgctttagctcttagtcctgatgataagctccttttctctgctggacatagtagacaaatccgagtttgggatttggaaaccttgaaatgcattcgctcttggaagggacacgaaggacctgtgatgggaatggcttgccacgcatctggaggattgctagctactgctggagctgataggaaagttcttgtttgggatgttgatggtggtttctgcactcattatttcagaggccataaaggggttgtgtcaagtatcctcttccatcctgattcaaacaaaaacattcttatctcgggaagtgatgatgcaaccgttcgtgtctgggatcttaatgcaaagaatactgagaagaaatgtcttgccattatggagaagcacttttcagctgtgacttcaattgctctatcagaggatggattgactttattcagtgctggaagagataaagttgtgaacttgtgggaccttcatgattatagctgcaaggctacagttgcaacgtatgaggtactagaagctgtgacaacagtttcttctgggacgcctttcgcttcatttgtagcttctttggatcagaagaagagtaagaagaaggaatctgattctcaagcaacatattttattactgttggtgaacgtggtgttgtgcgcatctggaagtctgaaggttcaatttgcctctatgagcaaaagtcgtcggatattactgtcagctcggatgatgaggaatctaaaagaggattcactgcagctgctatgctgccttctgatcacggactgctttgtgtgactgctgatcagcagttctttttctactccgttgtggaaaatgtggaagaaacagagttagtgctaagcaagaggctggttggatataatgaagaaatagctgatatgaagttcctaggtgatgaagaacagtttctcgcagtagctacaaatctcgaggaggttcgtgtatatgatgttgcaacaatgtcatgttcctacgtgttagctggccataaggaagttgttctgtccctcgacacttgcgtatctagttctgggaatgttctaatcgtaactggaagtaaagacaaaactgtaaggctatggaacgcaacaagcaaatcttgtatcggagttggtactggccataatggcgatatcttagcggttgcttttgcgaagaagtccttcagtttctttgtcagtggaagtggtgatcgtacactgaaggtctggagccttgatggtatttcagaggactcagaggagcccattaatctgaaaactagaagtgttgtcgctgcccatgataaagacatcaattccgtggctgttgctcgtaacgatagcttagtttgcactggttctgaggatcgtacagctagcatatggagactaccggacttggtacatgttgttacacttaaaggacacaagaggcggattttttctgttgagttctcaactgttgatcagtgcgtaatgacagcttcaggagataagacagtaaagatatgggctatatctgatggttcctgcctcaaaacatttgaaggtcatacctcaagtgtacttagggcctcatttataactgatggaacccaatttgtctcatgtggtgccgatggtttgttgaaactttggaatgtgaacactagcgagtgcattgccacatatgaccagcacgaggacaaggtatgggctttagctgttggaaagaagacagaaatgattgcaactggtggaggtgatgcagttattaatttatggcatgattcaaccgcttcagataaagaagacgatttccgaaaagaggaagaagcaatcttgagaggtcaagagctggaaaacgcagtgttagatgcggaatacactaaagctataagattagcatttgagctttgtaggcctcacaaagtttttgagctcttcagtggtctctgcaggaaaagagattcagacgaacagatagtgaaagctcttcaaggacttgaaaaagaagagttccgtctactttttgaatatgtccgagaatggaacacaaaaccaaagctatgccacattgctcagtttgttctttacaaaaccttcaacatacttcctcccacagaaattgttcaggtaaaaggaattggggaactcctggaagggttaatcccatatagtcagagacatttcagtagaattgacagatttgtaagaagcagtttcttgttagactacacacttggtgagatgtctgtgatcgatccagagactgttgagacagagtatcctaaggacgagaagaaaaaagaaaaagatgtcattgctgcaatggaacaagacacagacgagctaaagcaggagactccttcgaggaaacgaaagtctcagaaatccaaaggtaaatcgaataagaagagactcattgccgaagcacagggaagcgtaattgcagtttgactcgagacccagctttcttgtacaaagtggtgataaattggagctctgcagagctttcgttcgtatcatc

SEQ ID NO: 576 - DNA, 870 bp, Zea mays subsp. mexicana
ttcttgtttgttgattaacccttaattaatccgggcgcgcctgatttatcacaagtttgtacaaaaaagcaggctcctgcaggaccatgtccatggcttcccgtccgcctcttcgtcgtcgacgtcgtcttcccctcgtcccgctcctcgttctgctctgcctctccccggcatgcgccgccgggagagtcccggtttcggtctactacgaagcgctgtgcccgttctgctccgcgtttgtcgtgaacgacctctccagggtcttccgcgacgggatctcctccatcgctgagctgcggctcgtccctttcggcaatgggcgtgtctcggccgacggaaccgtcacttgccagcatggagaggacgagtgccaactcaacgctatagaagcttgcgtgatcagaatatggcctgacgcggagcagcattttcctttcattcaatgcgttgagcatttagcactgactcggaaatgggacgcctggccgtcttgctttcatgaaactggtctcgcttatcaacctgctattgactgctacatctcagggtatggaaggcagctcgtactccagtatgctgccgagacaaatgctctgcagcctcctcatcggtttgtaccttgggtggtcgtcaacggcaaaccgctcggtgatgattacatgaactttgaggcatacatctgcagcgcttatgacggcaatcttccaaaggcatgcaaggggaagcacctagcaattgctcaggagacgaaagccagccgaggagacaaggtgtgcccagctagcaaaactatcagctaactcgagacccagctttcttgtacaaagtggtgataaattggagctctgcagagctttcgttcgtatcatc

SEQ ID NO: 577 - DNA, 2422 bp, Arabidopsis thaliana
ttcttgtttgttgattaacccttaattaatccgggcgcgcctgatttatcacaagtttgtacaaaaaagcaggctcctgcaggacctatgcagatttctcttcaaatccatttatcttccttcacttttcttcttcttattttccttcttccagtactctctgagtctcaggtagcttcaagtgaatcacaaactcttcttgaaatccagaagcaactacaatatccacaggttcttcaatcatggactgatacaaccaacttctgtcacattcgtccgtctccttccttgagaatcatctgcctccatggtcacgtaacagagttaaccgtcaccgggaacagaactagtaagctctctggaagttttcataaactcttcactcttcttacacaactatcgagcttaaagactttgtctcttacttctctcggaatttctggttctctttctcctaagatcatcactaagctatcaccgtctcttgagtctctcaatcttagctctaatttcatctctgggaagattccagaagagattgtgtctttgaagaatctgaaaagccttgttttaagagacaatatgttctggggttttgtctctgatgatctcagaggattatcaaatcttcaagagctggatttgggaggtaataaactcggtcctgaagttccttcactcccaagtaagctcaccactgtttcattgaagaacaactcctttagatccaagattccagaacagatcaagaagctgaataaccttcaaagtttagacctttcttccaacgaattcaccgggtcgattccagagtttctgttttcgattccttctcttcaaattctcagtttggatcagaatctgttaagcgggtcacttccaaattcttcttgcacctcctcaaagattataactttagacgtgtctcacaatcttttaactggaaagcttccttcttgctactcttcaaagagtttcagtaatcagacagtgcttttctcattcaactgcttgtctttgattggcactcctaacgcgaagtatcagcgtccgctttctttctgtcaaaaccaagcaagcaaggcaatagctgtggaacctatccccaaggctaaagataaagattctgcaagaatcaaactcgggttagtgattttgataatcatcggtgtgatcatccttgcagcaattttggttctgttggttttgattgccctcaaaagaagaagatcaagatcagaagatgatccttttgaagtgaacaacagcaacaatgagagacatgcctctgataaagtctctgtttgcagcaccacaactgccagctctaagtcattaccagattcaagacgtgtaccacagacaatgagatctgcagtgattggtttgccaccgtaccgcgttttctccttggaggaactggaagaagcgactaacgactttgatgcagctagcctgttctgcgaacagctgtatagaggttgtctaagagaaggcataccagtgacagtgcgagttatcaagctgaagcagaagagcttgccacaaagcttagctcaacagatggaagttttatcaaagctaaggcatatgcatttggttagcgttcttggacactccattgccagtaaccaagaccacaatcaacacgctggacacaccatcttcattgttcaagaatacatctctagtggatcattgcgggactttctcacaaactgtaggaagaaagaggtactgaaatggcctcagagaatggcgatagcaataggagtcgctcgagggatacagttcttgcatatgggagtagcaccaggaatctttgggaacaatttgaagatagagaacatcatgcttgatgaaacactcacagtaaaaatcagtggctatactattcctttaccatccaaggttggagaagagaggcctcaagccaaaaaacctcggagtaatgaagatagagagaaagaagatgtgtaccagtttggagtgatactactacaaatcatcacagggaaggtagttgctgcaggatcttcagagatgggaagtttgaagcttcagctggagaacggtttgagagatgaaccatcagtattgagcagcttagcagatccatctgttaaaggatcatatgcttatgagtcgttgaggacgacagtagagtttgctatcaactgtctttgcgaagatcagagcaagcgtccttccatagaagacgttgtgtggaatctacagtatacaattcaagtgcagcaaggatggagaccaagcagtgggaatcatgaatcatccatgaaagcaatatatgaatgaaatgatcataaagagaggcaaaaactgtagaaacaactcgagacccagctttcttgtacaaagtggtgataaattggagctctgcagagctttcgttcgtatcatc

SEQ ID NO: 578 - DNA, 2949 bp, Arabidopsis thaliana
ttcttgtttgttgattaacccttaattaatccgggcgcgcctgatttatcacaagtttgtacaaaaaagcaggctcctgcaggaccatcgcctccggcatatcaatcctccgccttctcattcttctccagacgccatggagttccgtttcgagaatcttcttggcgctccttacagaggcgggaacgcagtcatcactaagaatactcagctaatttcaccggttggtaatcgtgtctccgtcaccgacctaagtaagaaccattcggtcactcttccgctcgaaacctctaccaacatatgtcgcctcgcttcctcacccgacggtactttcctactcgccgtcgatgaacaaaaccgatgccttttcatcaacttgcctcggcgggtagttcttcacagaattaccttcaaggataaagtcggtgccttgaagttcagccctaatggtaagtttatcgctgttggaattggtaagttggtggaaatatggcgatcacctggtttcaggcgagctgttttgccctttgagcgggttaggacttttgctaattctgatgataaagttgtctccttggagtggagcttggactctgattatttgcttgttggctcaagggatttagctgctaggttgttttgtgttagaaagttgaagggtgttttaaataagccatttttgtttctgggtcatagagattctgttgtgggttgcttctttggtgttgataaaatgactaacaaggtcaacagggctttcacgattgcaagggatggttacatttttagttggggctatactgaaaaggatgtcaaaatggatgaatcagaagatggccactctgagccaccgtcacctgttactccagatagggctgatgaggtgatggtggaaaatggtggtggtgttggtactgagcttaagaaacgaaaagagtatgacggtaaaggtcttgaatcagatgaagaaggagatgatgatgatgaagagtatatgcacagaggaaaatgggttttgttgaggaaggatgggtgtaatcaggcatcagcaaaggtgaccgcttgcgactatcatcagggacttgacatggttgtggtggggttctcaaatggtgtttttgggctttatcagatgccagatttcatctgtatccatctgctctctatttctaggcagaagctaacaacagctgtcttcaatgagcgtggtaattggctgacctttggttgcgcgaaacttgggcaactgttagtctgggattggcgaaccgaaacctatatactgaagcaacaaggacactattttgacgtcaactgtgtcacttactcaccggattcgcagctcttggcaactggtgctgatgataacaaagtcaaggtgtggaacgttatgtcaggaacatgtttcattacattcaccgagcataccaatgccgtgactgctcttcattttatggctgacaaccactccctcttaagtgcatctctggacggcactgttcgtgcttgggattttaaaagatacaagaactataagacatacacaacccctacaccccgacaatttgtttccttaacagcagacccgagtggtgacgtcgtctgtgctgggaccctagattcattcgagatttttgtatggtccaagaagactgggcaaataaaggatattctgagtgggcatgaggctcctgttcatgggttgatgttttctcccttaacgcaacttttagcttcatcctcatgggactatacagttcggttgtgggatgtgtttgctagcaaaggcaccgtggaaacgtttcgacacaaccacgatgttctaacagttgctttccgtcctgatgggaagcaattagcctcgagtacgctagatgggcagatcaatttctgggacaccattgaaggtgtgttaatgtacaccatagaggggcggagagatatcgctggaggtcgggtcatgactgaccgtcggtctgcagctaattcaagttctggaaagtgttttacaacattgtgctattccgctgatggagggtatattctagccgcaggaactagcagatatatttgcatgtatgatatcgcagatcaggttcttctgcgccggtttcagatatcccataatctttcgttagatggggttctggacttcttgcactctaagaagatgacagaagcaggaccaattgatctgatcgatgatgacaacagcgatgaagaaggtggcattgataaacagtcgagagggaatctgggttacgatctgcctggatccaggcctaaccgtggcaggcccattatccggacaaaaagcctcagcattgccccaactggaaggagctttgctgctgcaacaacagaaggagtcctcatcttttcaattgacgataccttcatctttgatccgaccgatctagatatagatgttactccagaggctgttgaggctgccatagaagaggatgaagttagcagagcacttgctctaagtatgcgtttgaacgaagatagccttatcaaaaaatgcatcttcgctgtagcccctgcagacataaaagctgttgccatctctgtccgccagaaatacttagaaaggcttatggaagctttggtggatctgcttgagaactgtcctcatctggagttcatacttcactggtgtcaggaaatctgcaaggctcacggaagctccattcagcggaactacagaactctattgcctgcactgagatcgttgcagaaggcgatcaccagagcccatcaggatctggcagatatgtgttcttccaatgagtacacgcttcgctacttgtgttctgttccaaacaatcattgattatgttttctgcattatgtatcaccggaaattttcatcttctcgaacccagctttcttgtacaaagtggtgataaattggagctctgcagagctttcgttcgtatcatc

SEQ ID NO: 579 - DNA, 858 bp, Zea mays
ttcttgtttgttgattaacccttaattaatccgggcgcgcctgatttatcacaagtttgtacaaaaaagcaggctcctgcaggaccatggacagggctaccatgagcagcaatcaggcaggcaaagtgttgaagaaaggaaaaaagaagcaggccaaggacgagctggaccgccagaagcaggcggagaagaagcggcgccgacttgagaaagcgctggcaaactcggctgccataatctcggagctggaaaagaagaagcagcagaagaaggaagaacagcaaaggctggacgaggaaggtgctgccatagcagaagcagtcgctcttcatgtcctcataggcgaggactccgatgaaccctgccatttgatgctgaacaagcaccatataaggtgcaaccattgggccccctcggctgcttttgaattcaccgtggacgcacagcccgccgaggtgtacccgtctgaggatggactggtatgcggcagccatgcgtatgctcccagagcccccaaggggaggcgggctgattgggggattggacaggcactgccatgctggggagaagtgagtgacctccaaggcccgtactaccaaggaacgttccgtcagtctgttacctgccctggcttcatagccgctcaggctgtgtcatcgttgcagatcagggaagagtcgccagaggtcacctctccaagccatggggccgatgctgctgcgaccgtggttaaccggatgcttggtggcaccagcaggctcaacctttacagggggatataaacatttctcgagacccagctttcttgtacaaagtggtgataaattggagctctgcagagctttcgttcgtatcatc

SEQ ID NO: 580 - DNA, 994 bp, Zea mays
ttcttgtttgttgattaacccttaattaatccgggcgcgcctgatttatcacaagtttgtacaaaaaagcaggctcctgcaggaccatgcgcggcctccaccgctgcccgcaccagctcctcctggtctctccaccgccgcggtccgcccccgcgtgccgccagtcggccaccgcctcatcgcggggcctcaggagctccctcgccgtcttctccgcacccggggctcgggtagcggcggcggcgcgcgagcagaagtggggccacgtggagggtgatgaagacggtggagaggagggcctaggggaggcgctccacaggacgcgggagctcgtggagtgcgccatgttcgcggccgtcgctgggctggcctacttcctcagcaattccctcgccattgagaattatttcagttgctttttcccattgccgatagtcatttcctcattaagatggggactagaagccagcaggaaaaccgtggtggctactgttttactgctattcacattatctggccctgtaaaagcgtcaacttatctgctaatgcatggagtagttggtctcatcatgggtactgtttggagattggagaccaactggattgtctccatcatcctctgctccattgtccgtgccctgggagcttgtggttacgtgctagtgtcatcgtttctgataagagaaaatattctcgcgctgataacggttaacattcatgcttcgttgacatacatcctgacggcagctggcgtgaacacaattccttccatgggcacaatatatctactctttgggacactgcttctacttaattgtgggttcttcgtcttcctcctgcatgtgatgtatacggtattcctggcgaagcttgggataaagccgtcgctgaggtcaccaagatggctggacagagtgatgtgactcgagacccagctttcttgtacaaagtggtgataaattggagctctgcagagctttcgttcgtatcatcg

SEQ ID NO: 581 - DNA, 735 bp, Glycine max
ttcttgtttgttgattaacccttaattaatccgggcgcgcctgatttatcacaagtttgtacaaaaaagcaggctcctgcaggaccatggtgttgtgggagataacgctcggaactgcgtatttcttgggtctgaagcgaacttacaggctcgctctcaggattcaacgcaggatcgtaagccctaagtaccctaagctcctccaatttcttcacagacggacccgtgctgtgtttgatgtagctatcagagtgcatcgtaacattcaagttagggacatagaagtgggacggaattttgggaactttatattgcgatggctggatcgaatgaagccatcggctcagattcgcggtcccccaccttctaatggtattacatcaagagaaagtgttggaaaacgtttatcagcaggtagaagttccaatcagaagggttctggaacgtcaaggagggactctgataggcatttgtttacctcatcaaggataatgcattttcctacagtagcgaggatgatgcgaccgccgaatcctgctgggattaccatccatggcaggcacttcagtacctctacgcctcaaactgttggatcaatttacagggtaaattggtcagagggtgttattaggaaggatattatgcagtggttgaggcataactaactcgagacccagctttcttgtacaaagtggtgataaattggagctctgcagagctttcgttcgtatcatc

SEQ ID NO: 582 - DNA, 1136 bp, Glycine max
ttcttgtttgttgattaacccttaattaatccgggcgcgcctgatttatcacaagtttgtacaaaaaagcaggctcctgcaggaccatgcatcgtggtaaattttcccttacacccaagaatgaagtcaaggacttgacaggttcaagtttaaccagttacaaacatagcagtcttctggaccccatagatgtttcttcatcttcagatgatgaaaatgaccttcctaatgatgatgtgtctaatcaattagtcctttatgatcctgtggcgaatggaaacaatgcaattgaacttgcacctgatcctctccagtgtgaacatccattgcttccaagaagcaaaccttcacattcagttcctagagttttgccttcagttggtgctttcactgtccaatgtgcatcctgcttcaaatggaggttgattccaacaaaggaaaaatatgaagaaatacgtgagcatatccttgaacaaccttttgtttgtcaaaaagctcgtgagtggcgacctcatgtatcttgtgatgatccagaggatatttctcaggatggcagcagggtttgggctattgataagccaaacattgcacagcctccggctggatgggagcgactgctaaggatcagagctgaaggaagctccaaatttgcagatatatactatatagcaccatcaggcaagagattgcgttcaatggtagagatccagaagttcttgatggagcatcctgagtatacaagagatggggtaactctttcacagttctcatttcaaataccaaggccattacaagaaaactatgtgaggaagcgacctgctagacttacctcttcatatgaagtcagtgagcctgttgaacatgaacaagtgagtcctctagcatgggtagatccagaagggcatggtcgcagactggggcttcctgcccccccattcatggaatcccatgatattgaccctatcagtatcagccgtccttcaaagaggcaagcaactcataaaggtgccctgtagtaaggaccctcatcaaatcctttcgtgttatgtgcattgtgcagtcagtcctcgagacccagctttcttgtacaaagtggtgataaattggagctctgcagagctttcgttcgtatcatc

SEQ ID NO: 583 - DNA, 927 bp, Glycine max
ttcttgtttgttgattaacccttaattaatccgggcgcgcctgatttatcacaagtttgtacaaaaaagcaggctcctgcaggaccatgagttccgccgataccgtcaatgcgagttctgctgagtctgtcaaagaacctgtcatagggtcaagtctggaagcaaaacaggatgatactgaaataaaatctcaagttgatgccatgtgggaacaaatgaataaaggagtatctaataagaccctcaacagatttacaagcaagcctaattctgctccaaaaaaaactgcaaagaagacatcatctaactggatgtcttatttggccttggcaccgaaggcaactgaatcccttgggcaaggtgcttccaagaatggacctggcattctgcagagcagtacaagtgatgaagccaagaagcttgctgctgctgctcttgcagcagtgaaagatgatgctgccatggctgcctcaagcagggggaaacttgtgattactgaggttcgggactttgctggtcaagaaattgaagttaaaaagcttgtagattctgactcaaaggaggcaatggaaagagccaaagctcctccaccttctgcagtggatactgtccttgaacaaatcaagaagaaacagaagctcagtgtactggataagaccaaaaaggactggggtgaatttaaggaagaaaagagactggaagaagagcttgatgcttataagaagagttctaaccagtatttggacaaggtttctttcttacagcgagcagattaccgtgagtttgagcgtgagagagatgcgcgactggctttgcaatccaggaagcgaccagataatatgcaagaggatgactgactcgagacccagctttcttgtacaaagtggtgataaattggagctctgcagagctttcgttcgtatcatc

SEQ ID NO: 584 - DNA, 1788 bp, Sinorhizobium meliloti
ttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatggacacccagctcttgatcggatcgcgcttcgaagccggaaccgaggccgaggaacacatcctcaatccgcggacgggcgccgggatcatcgacctcgccgaggcctcccacgcgcagatcgacgcagccgtcgacgctgccgagcgcgccttcgtcggctggtcgcagacgacgccggccgaacgctccaacgcccttttgaagatcgccgatgcgatcgagaaagaagccgacgaattcgccgcccttgaggcgctgaactgcggcaagccgatcaatgcggtgaagaacgacgagctgcctgcgatcatcgattgctggcgcttcttcgccggtgcggtgcgcaatctgcatgcaccggcggcgggcgaatatctgccgggccacacgtcgatgatccgccgcgatccgatcggcatcgtcggctcgatcgcgccgtggaactatcccctgatgatgatggcctggaagctggcgccggcgatcggcggcggcaacaccgttgtcttcaagccatccgaacagacgccgctgacggcgctgaaacttgcgcggctcatcgccgacattctccccgaaggcgtcgtcaacgtcatcaccggccgcggcgagaccgtcggcaacgcgctgatcaaccatccgaaggtcggcatggtatcgatcaccggcgacatcgccaccggcaagaaggtgctcgcggccgccgccaagacggtaaagcgcacccatctcgagctcggcggcaaggcgccggtcatcgtctatggcgacgccgacctcgaggcggtcgtcaacggaatccgcaccttcggctactacaatgccgggcaggactgtaccgccgcctgccgcatctatgccgaagccggcatctacgagaaactcgtcgccgacctcacctcggcggtctccacaatccgctacaatctcgacgacgacactgaaaacgagatcggtccgctgatctctaggcgccagcgcgaccgcgtggcaagcttcgtcgaaagggccgccgaccagaagcacatcgagatcaccaccggcggccgcacgggcagcgacgaaggcttcttcttccagccgacggtcgtcgcgggcgccactcaggaggacgagatcgtccgccgcgaagtcttcggcccggtcgtctccgtcacgcgcttcaccggcaaggacgatgccgtggcctgggcgaacgacagcgattacggcctcgcctcatcggtctggacgaaggacatcagcaaggcgatgagggccgcgtcccgcctccaatatggctgcacctggatcaacacacatttcatgctgaccaacgaaatgccgcatggcggcatcaaacagtccggctatggcaaggacatgtcggtctatgcgctggaggactacaccgccgtccggcacatcatgatcaatcacggctgactcgagacccagctttcaaatacccagcaaattggagctctgcagagctttcgttcgtatcatc

SEQ ID NO: 585 - DNA, 1902 bp, Arabidopsis thaliana
tatttgatcctttttggctttggttttttgtttctacaaatcgctaaagtttttgtttttgttttcttcttttgtgcaattcagtgctacggagtgcaaggattgtatttgtgtgtgatcatggtggaggagaaaacgggaaacgtgactctacttgatcaaacagttgaagatttgttattacaggcacaagagcttgtaccgatcgctttgtccaaagcaagaacagtgaaaggtttctcaagcagatggagagtgatcatttcaagattagagaagataccgacatgtttatcggatttgtctagccatccttgcttctctaagcacactctatgcaaagagcaacttcaagcagtcttagaaactttgaaagaaaccatcgagctcgcgaatgtttgcgtaagtgagaagcaagaggggaaattgaagatgcagagtgatctagattctctatctgcgaagattgatcttagcttgaaagattgtggattgctaatgaaaacaggtgttcttggagaagttacgaaacctttatcttcttcgactcaagacttggaaacgttcagcgttagagaattgcttgctcggcttcagataggtcacttggagtctaaacgcaaagcgcttgagcagctcgtcgaggtaatgaaagaagacgaaaaggcggttataaccgctctaggccgtaccaacgtcgcgtctttggtgcagcttttgacggctacctcgcctagcgtaagggaaaacgcggtgactgtgatctgctctctagcggaatcaggcggatgcgaaaactggcttatctctgagaacgcattgccttcattgataaggctactagaatcaggaagtattgttgctaaggagaaagcggttatttcgttgcagagaatgtctatttcatcagagacatcgcgttcaattgttggtcacggcggggttggtccgttgatcgagatttgcaaaacaggggactctgtttctcaatccgcttctgcttgtactttgaagaacatttccgctgtgcctgaagtaagacagaatctagcggaagaaggaatcgtgaaagtgatgattaacatacttaactgcggaatcctattgggatctaaagaatacgcagcggaatgtcttcagaatctcacttcaagcaacgaaactcttcgaagatcggttatatcagagaacggaatacaaactctgctcgcttacttagacggtcctcttcctcaagaatcaggagttgcagcaattaggaatcttgttggctctgtttctgtagagacttacttcaagataatcccaagtttagtccatgttcttaaatcaggttcaatcggagctcagcaagcggctgcgtcaactatttgcaggattgctacctcaaatgagacaaagagaatgatcggtgaatcaggttgtatcccgttgttgataagaatgttggaggcgaaagcgagtggagctagagaggttgctgctcaagctatagcgagtctggttacggttccaaggaattgcagagaagtgaagagagatgagaaaagtgtgacgagtcttgtgatgttgcttgagccgagtccgggtaactcggcaaagaagtatgcggtttcgggtttggcggctttgtgttcgagcaggaagtgtaagaagctgatggtctcacatggagctgttggttatttgaagaagttgtcggagttggaggttcctggttcgaagaagcttcttgaaaggattgagaaagggaaattaaaaagtttctttagtaggaagtagaagaaaatgaagcaacgtggtatatatataatgtacttgatatgtttcataatctgtatgaaacttagccaatgatatcttgtttggtgaccgtatccgtatgtataataatgtattttg

SEQ ID NO: 586 - DNA, 1865 bp, Arabidopsis thaliana
aaaattcaaaaaggaacatatttttacatttaaacagtgtgtctcacacttccatttacacgtcagctctcttcgccggcgcttaatacaaccgtcaacctcgccgccggctagaggaaaatggcgtatcaccaaccgtacgatcctttctacgtctatcaacttcattctcatcctcatcatcttccgccgcagctgccactgctcgccgacgaacctggggcgattaacactctctttgtctctggcttgcctaatgacgttaaggctcgtgagatccacaatctcttccgtcgtcgtcatggattcgaatcttgtcagctcaagtacactggacgcggtgaccaggtttgtaaaaatctccaatttctgtttttttttattcccatttttagaaaagctgtatactttgtgattctatcgatgtttaagctttctgaagttacctatcttcaggttgtggcatttgcaacattcacgagtcatagattcgccttggctgcaatgaatgagctaaatgtaagattcactttgatcgaattgtgtgactctattgttacattgtgttatttgattgtggtgaagcatttcttttagggtgtgaaatttgatcctcaaacaggatcaaatctacatatagaactagctagatcaaactctagaagaaaagaaaggccaggtattttctagactttactctcttcttactattgagttagtgtggttggtaaatcgatcaatgagtaatgaacagtctatgtggataggaagtggaccttatgttgtgattgataacagaaacaaggaaatttctaagtctcaggatgaccagagtgatgaaggtaatgttctggttaccttgtggactcctaattatttaaatgtatgaatgctttatgtttctgcttgatcattgttgatgcatctaggggatagcgatccagatgaggtgcaggaacctggaaatagcgattctccaaaggaaaacgatactaccaaaaggttgaaaatgacaattagaagcttggttttgtagttttttaggtcaaaagaagaagactaatgtattctgatttctttgcaaatttacagcgaagcggattctgagccagatagtaaagcaccatctgctaatgtaagtccaagccaaaaatctaatctttttaaccagttgagatatctctatttctcaagttcgttgaagattaataaaatcttatttgttacttactgtaagatacttccatatagacttccttatggttcagtagcttactgatagatttctacaggggcacttagagaaagcatctgaaggaggttctggtgctcgagcttgttcgaccttgtttatagctaatctagggcctaattgtacagaagatgaactcaaacaactcctatctaggtaaccttgtacaatgactgaaacctacagcattagggtttgaatgtttcttcaaacaatcattggtttttgcctttccgaaagtcgattgatctgatccatttgcttacagatatcctggtttccacattttaaaaatccgagctagaggcggaatgccggttgcatttgctgattttgaggtataagttgttatacatgcttttgattttgtctttgtagtctatatacccactctcaccaattgcaggaaatcgagcaagctactgatgccatgaatcatcttcaagggaacctcttatcctcttcagaccgaggcggcatgcatatagagtaagagtagtttttcttacacttgttcaacaattagtttaaaattcaaattttgccagattattactctcatagtcattacagctaccccaatgtcacaccctggtttttggttcttccagat

SEQ ID NO: 587 - DNA, 1768 bp, Arabidopsis thaliana
tcctcttcattttctgcatacgaaaagttcttttgggtatttgtgatttgtcatctccgaaacgtttctctctttaaaactttttttgaccgttctttataatttgaattgaaagagaagatgggaagagctgcgagatggttcaagggtatttttggtatgaagaagagcaaagagaaagagaactgtgtttccggcgacgttggaggtgaagccggtggttctaacattcaccggaaagttctccaagctgactccgtctggctcagaacttaccttgcggaaacagacaaagaacagaacaaacacgcgattgcggttgctgctgctacagccgcggctgctgacgcagcggttgcagcggctcaagctgctgtggcggtggtcaggttaacaagtaacggaagaagcggaggatattccgggaacgcaatggagcggtgggccgcagtgaaaattcaatcagtcttcaagggctatttggtaaatttcttaaaaacctccaaaacacttttttttttttttggtgtgtaatcgatttcgacgcaaaaagattgaattttgccatgtgggtatcgtttagattcgacaaaactaaaagaaagtatgtctgtactttacttgctccttacacatcttcgttaatgaaacagtacaacacatctttgctaatttcaagaaagttagattcttttctgattaaacactaaaatgtggttatttggtctaagtattttttttttttttgttataggcgagaaaagcgttacgagctttgaaaggtttagtgaagctacaagctttggtaagaggatacttagtccgcaaacgcgccgccgaaacgctgcatagcatgcaagctctcattagagctcaaaccagcgtccgatcgcaacgcatcaaccgcaacaacatgtttcatcctcgacactcacttgtaataaccattctttttcttttgtcttatttctaacataatctctatagtcaaaacttatgttttgatggattgatttgattataggagaggttggatgattcaagaagtgaaatccatagcaagagaatatcaatctctgtagagaaacagagtaatcacaacaacaatgcgtacgatgagaccagtcccaagattgtggagattgatacttacaagacgaaatcaagatcaaagagaatgaatgtggctgtatccgaatgtggagatgatttcatctatcaagccaaagatttcgaatggagttttccgggagagaaatgcaagtttcctacggctcaaaacacgccgagattctcttcatcaatggctaataataactattactacacgcccccatcgccggcgaaaagtgtttgcagagacgcttgttttaggccaagttatcctggtttgatgacacctagctatatggctaatacgcagtcgtttaaagccaaggtacgttcgcatagtgcaccgagacaacgtcctgatagaaaaagattgtcacttgatgagattatggcggctagaagtagcgttagtggtgtgaggatggtgcaaccacaaccacaaccgcaaacgcaaacgcagcaacagaaacgctctccttgttcgtatgatcatcagtttcgtcagaacgagactgattttagattctataattagtaaaaaacgttattttcgtccttaaagaaaatatcgtcatagcctttgacttttcatttatgactttccttttttttttttttttgtaaattattgctttgctttggaaaaaatgtgaaa

SEQ ID NO: 588 - DNA, 2273 bp, Arabidopsis thaliana
gtgtttagtttagttgtacaacaaaaaccctgaggatttttcgtgttcgccggcggtgacatttacgcgcagaaacgttgatactctctctctctcgacggaaaattcttcctcggagatatggtgacggagctggaagagcttgtcgaatttttgtcatctccttcaccgcctgtaagctttttggtttcatctgtttctgagctatggggatgcattgataattttagattctagggtttttgttaccgatgagtctgattgaatgaagaaacaaacttgtaggtgaagaaagctgcggtggaaattgttagtggtttaactggttccgaggaaggtttacaatctctatcaaagtattccgagattcttcttccatcattgtctcagcttctaaatgaaagcaaggtcattgaatcaactcttaagaagcactaattgtttcctgaatttggattgagagatattgaaatgttgttttgaattcaattttgcaggaggtatcagagccagcagctcaagctcttgttaatctttctcagaagtgtgaattggcaaagaagatgattcaaatgggtttgattaaagtggccatggacatgttgtataagccagagtcttgtattaccagattacttgttatgcttctagtgaatcttactcagttggatgatggggtttcttctttgcttcaggtcgtttatcataagttaaatttgtgtaatatatagtggggattatcttttggtagtctaatggtgacgtagctaatcgtgtaaaactttatgcctttgttagattgacgatgagaagatgcatggactacatatcatgaagcttgttaggtcattttgcaggtcttctggtgaaactgctggtatgtacttcccactttagtattgtaatataatttgtccaagtttatatatatatatatctacttctagatatgatagtttggaatttccttttcatatatcacgtttttgtttcatatatctaaatctaatcctcggtaggacagtctagaattttaatgtttgcattggcaccattgaatattatgcgtagttacttactggtagtttttttagtttgcaatcaagtttcatagctactgtataaaaagaggaatgaattactgaatattgttcttatttgcgcaccagatgatcagtttgagcatgttggttcgatccttgtcaacatatcaaaaacagaagatgggaggaaattgttactggagccaaagagacgactattaaaacagatcattaggcagtttgattcaacaaatcaattgcgaaagaaaggggtacgtttaaaaggagtttggcagattactctttaatgaacatgttgcttagtctataccctttgaacaatttaacatggattatgcttatcggctttcaggttgctgggactattcgtaactgttgttttgaagccaaaaaccaactccagaatatactcttgatatcagagtttctttggcccgctctgctcctaccagttgcaggcagcaaggtttgttgattttgctttatagctgctacgttgttgcttacaaaggttttcttcttttatgagaaaatagtttctgattattgggttttactttccttagacatacagtgagcaagatgtcgcaaaaatgccacctgagcttggaagtgcactgtccattgagcgagaaccagttactgatcctgacattcgcgttcagacactcgaagctatatatttgatcatcttagaggtaaaacatttctctgtctcgctttcccttcttgtgaactcttgtgaaggaccaatcaaacccaaaacttacaaaaggtcctctgttatgtcaaaactacttttgatgttgcaggaggcaggtcgaagggcattttggtcagtcaacggcccacggattctacaattgggatacgaatatgaagaagatccgaaagcaatgagagcctatgagcaagtcggttctttggtatgttcactccctctaatctcactcactgactaactctacaggacttaagatagcatctttctcactattaaccgttatttgctgtgccgtttttaaccagcttgttgaggaagctggaggtccggaagagtcgttggagccaacaaaagcagagtcttgaagttcattatttgttgttctccgactctagtccccattattggctgccctcgcaaagtaagttacttatcctgttatgaaagagttactactacatcttgtgcactactagttgtaacac

SEQ ID NO: 589 - DNA, 1833 bp, Arabidopsis thaliana
aataacagagttgtgaaaccaaatcacagatcacacttaccagatcacaagacaaacacaaactaatagtttcgtgtgacacaagtaaagagtttcgtgagatagaagcaacaccaaaagatgcttgaaactggagccatatggggaataaccggcacgacggtgacgagctttatgttcttctgggcgatttacaaacaatacgtccctgcccatttccgagcctatgtggagagatacttccacaagatgattggatggatctcttactacgttgacatcaaattcaccgagtacacagatgaaggtctgaagagaagccaagcctacgactccatacgcaactacttagcgtcgaaatcaacggctcttgctaaaagactaaaggccaacgaaacgaaaaacagcaaatctttggtgtttagtatggatgatcatgaggaaattgaagatgagttcgaaggtgtgaaggtgaagtggtattcgaatgtgaaagtgattcagcctcagtctaattatggtcaacgcagctcagaggagagaaggcactttactcttagtttccataggcgacaccgaggtatgatcattgagacttatcttgatcatgttttgagagaagggaaagctattggattgatgaacagagagaggaagctttacactaataactcaagtcaagaatggtatccttggaggtcaggaaagtggagcaacgttccttttcaccatccggcgacgtttgagactttggctatggatccagagaagaaagaagggattaagaaggatttgataaagtttagcaaagggaaagattattacaagaaggttgggaagccatggaagcgcggttatctcttgtttggcccgcccgggacagggaaatcgacgatgatagctgcaatagcgaatttcttggactatgatgtgtatgatcttgagctaacgacggtgaaggataactcagagctgaagaagttgttgttggatacaactagtaagtctatcattgtgattgaagatattgattgctcgcttgatcttacggggcagcgaaagaagaaaaaagaggaagatgaagaggaggatggagaggagaagaaggaaggtgagaagaagcccaaggtagatgataagcagagcaaggttactttgtcaggtttattaaactccattgatgggttatggtcagcttgtagtggtgagaagatcatagtgttcacaactaattttgtggataagcttgatccagcattgatacgtagaggaagaatggacaaccacattgagatgtcttattgcaagtttgaagcattcaaggttttggctaagaactacttggagattgaaacacacgacttgtatggagaaatcgaaagaaagctcgaagaaaccgatatgtcccccgcggatgttgcggagactttgatgccgaaatctgacgaagaagatgcagatatttgcatcaagcgtttggtcaagactttggaggaagagaaggagaaagcaaggaagttggctgaggaagaagagaagaagaaagcagagaaggaagcaaagaagatgaagaaagcagaggaagcagaggagaagaagaagaagacagaggaagatgagaagaaggagaaagtgaaggccaaggaggaaaacggcaacgtttctcaacaaaatggcaactcaattgatttgaacaagaaaagtgactcatgatgaattttagtttattgtataaggatgtaatttggcaattattcttctctcctcttatcatatgcttttaaagaatttgtatttactatctatagatttcatcattgtgttccatcgttt

SEQ ID NO: 590 - DNA, 1257 bp, Arabidopsis thaliana
tgagaattgatatctgatttcccttatttgttctatacttttgcgactttttaacttggaaacggccgtgttgcacgattgggtgaaattcctgtctcttagggtttcgtttgtatctccatgaagactactcctggtttgaggattttcaagcccatcatccctcacacacgtacgtatcatctcttccaaactttttattttgtattcgtagctatctgtcctaatttttttttttttttttgacgtcatttagctaaaccggactctagaatttatgtggaagatgcttggacaatgctaaagccagccataagagccatcttcctcgacgagccacaagattttgcatgcagtgggcttttcaatgtatctacacttacttattcttctttctttctcaatgtttttcttgcatctttctcaacgtttttcttgattggtcttaggctgttaataaatcatggtgtgaaaagtcttcaggagaagccctttacaagctgatcttggaggagtgtgagatatacatctctgcagccatacagtctttagaatcgcaatgcgatacggatccctctcttttcctctcactcttggagaagtgttggctagactttcgccgcaagttacagtttctctgtagcattgccggtggtgaaggtcagaccgtcggtccacactcagtgtgggacttgggtagtgagctttctcccaagcatctcttctcagcccagaaagttcgtgacaagcttctttccatcattctacaactcattagagatcaaaggtaaatttctgttacattaggctggataaatataatgttttgtatacaataggtgttgatagatttggatttactgataactctttcgccttttcattgttaccaccagatcattcatgtctgttgacatgactcagctaaagaataccaccagaccagtcatgtctgttcacatgactcagctaaacaatcttaggggtttgttttatggacagtctctctacaagtcgcccttcttcaagaaaccctttatcgactgcgctgttgagttttactcagcagaagcaatgcagttcaaggagcagtcagacattccactgtatttgaaacgtgtcgagtatgtggcgtgaggagaagaaaaattgcagacacggactctacttctttaaagagtttgaggaatcgttgatggaagctgttgagagaatacttctcaaggatcatgtttctgtcattcttgaaaaggtagc

SEQ ID NO: 591 - DNA, 1698 bp, Arabidopsis thaliana
cagaaacaatctttttgcttttcccacatttcaagctccaaagcttcgaatttttgaatcaatagcttccgaagttgtgatttttgtagaattcgaaaaccaaggtctcgatttgagaagatgggtgggtcaggaaattggattagatcactgatatctaacagaaaacccgtaaatgatcaggtaagctaaaatgcctcgatctttgttgtttcttcctactttaccaaacattgatctctctgttaattgtgcagcaggagaagttaagtgataagagcagcaagaagaaatggaagctgtggaggatttcatcggagagcttagcatcttcttctttcaagagccgaggaagctatgcagcttcttcgttaggttcagagctaccgtctttctcggctgacgaggcttttactacggccatggcagcactcattcgagctcctcctagggattttttgatggttaagagagaatgggcttcaacaagaatccaggctgcttttcgtgctttcctcgtatgtgaatcttcactaatctctagttacatgagctattctagttgtggtttgatcattagtactcacgggtcttcttgttcattgtgttgtctgcgtcttttcttttttcaggcaagacaggcgtttagagctctgaaggctgtcgtgagaattcaggccatttttcgtggcagacaagttaggaaacaagctgccgttacactcaggtgtatgcaagctcttgttcgtgttcagtctcgtgtaagagctcatcgtagagcgccttctgactcgcttgagctaaaagatcctgttaagcagaccgaggtatatattaatctattgagtaaagtctattgaacattactttaaagtatgtgaatctggttgatgtttttacagaagggttggtgtggtagccccagaagtataaaagaagtgaaaacgaagttacagatgaagcaagaaggggctattaagagggagagagctatggtttatgcgctcacacatcaggttggtcaatgtgttttcagaacagaaattcagagtgttgtcgctaattgtaataatgtctcatgagttgttttggcagtcgaggacgtgtccaagtccaagcggaagagcgattacgcatcatggtttgcgcaagagcagtcctggttggaactggtatgatgatgttgggacattttcaaggaaaagtagtgagagcagtgtgttatctgaatatgagactgtaacagtcaggaagaacaatctttcttcaactagagttcttgccagacctcctcttcttcttcctccggtttcgtctggcatgagttatgattctttacacgatgaaacatcaacatcatcgacatctcaatcaccagttgcattctccagcagtgttcttgatggtggtgggtactatcgaaagccgagctacatgagcctgacacaatctactcaagccaagcagagacaatcaggattatcttgcaacggagatgcaagacgcagtgctggttcagaccagtgtactgatctataccctccggggaatgtctgggccaagagccagcgaagctaaaagagcaagccatgatgattcttgtcaagccatattcaacagcctgttggtttatcttttgtcttgtttcaggaacggttcctgtgaaacgtatacacgaactatagatacagaaacagc

SEQ ID NO: 592 - DNA, 970 bp, Arabidopsis thaliana
gagaatcatgaaacacgtcgttttaaaactaagaacgacgtcgttagtctattccaacacaataaatgtgaaattgcgttgcttttcgatttcttcttcttatccaaaactctctcagtcatggctcttcttcgtcttcctggcatttccctccaaattctaggtcacaaatcaaaccagaagaaccctaatcccaatgttgccttcaccaatcactctctctctttatctactccttcactatgtcgtctccatcgtcacgcgacgtttccagactcaattccagcaaaatccagaaacctcacttcgtacttctccaccacaacacaagagccagtcctcgaatcttcttcttcttcttcttcagctcctgaggtagtagaagaagagatttctaaaaccagattgattgctcagaatgttccatggacatctacacctgaagatattagatcgttgttcgagaagtacgggagtgttatcgacattgaggtttttggtttttctcgtttccttcttttgaaatcgatgaattgaatcttttgtgttttggtttaacgaattgtgtttgatttttgatttgtagatgtctatgcataagaaggaaagaaatagaggtttggtgttcattgaaatggcttctcctgaagaagctgcaacagctcttaaatctcttgaatcgtgtgtaagtacaacgcttcctacatgtctatattggaatactatcattgagatttggttgcgttatgtttcatattatctggctttacgattagtagaagttatacattgtgcttattgggctcttttatgttgcagttatctcaatttgattgattattgtatgtaagaacattgcaattcgcttcctccatctctaagttagcacagaatcattgagatatttctctcatttacattactttatgagtagtggaagtgtacattatgttattagactctttcaggt

SEQ ID NO: 593 - DNA, 2441 bp, Arabidopsis thaliana
ttcaattttgaaaacccctgcttttaagttgggggatgtttcgattttgaaatttgatttcttcaagagaagagatttaatgaaaataaataacttccgcagataacgaagaagaagaaaatggttagatcagatgaaaatagccttggattaatcggatcaatgagtctccaaggtaccctaaatcgatcgattttgttattaaaaatcaaaactttcgttctctttgatttttcccccaaattgattttgaatttacttgatgtagggggaggagtagtaggaaagatcaagacgacggcaacaacaggaccgacaagaagagcactaagtactattaacaagaacatcactgaagcgccgtcttacccttatgctgtcaacaagagatcagtttctgagtaagttcactttaatcctcagattcaagattagtgttttttttttcttctccctttgattagactcttataggaaccctatttctttctgtgactttgcagaagagatggcatttgtaataaaccacctgtgcatcgaccagttactaggtaagcatagatctttactcttgtctactttgagtatctcacattgtctgattacttaacttttactactctctgttggttcaggaagtttgctgctcagttagcagatcataagccacatatccgtgatgaggtaccctattgttcaatgtatgtttcatttagagcaatgatgatatagaccggattttaaagttctgatctttaactcttaggaaactaagaaaccagactcagtttcaagtgaagaaccagagacgattatcattgatgtggatgaaagtgataaagaaggaggtgactctaatgagccaatgtttgtacaacatactgaagcaatgctggaggagattgaacagatggtatacatatttcctaaccattctttgctttgtttatggaagtgttaatatagttactcatattgtttgtgtctttcaaaaggagaaggagattgaaatggaagatgcagacaaagaagaagagcctgtgatcgatattgatgcctgtgataagaataatcctttggctgcggttgaatatatccatgatatgcataccttctacaagaattttgaggtgaatttgtcttgtttcacatcaacttttgcttttgtgttctttatcatcgaaaggattgtagtttcaaaatcttgtacttatgtttgattcattcttatgattctgcagaaacttagttgcgtgcctcctaactatatggacaatcaacaagatcttaatgagagaatgagaggaatcctcattgactggttaattgaggtagacagatctagacaaaagctatttaatgccactttttttgtctcaatgtgcctgaagataaattgactggaaaattatcttgtccaggtgcactacaagtttgaactgatggaggaaactctttatctcacaatcaatgtcatcgacagattccttgcggttcatcaaatcgtgaggaaaaagcttcagcttgttggtgttactgctttgttgcttgcatgtaaatatgaagaagtttcagttccagtggtagatgatctcatcttgatctctgacaaagcttactctagaagagaagtgctagatatggtgaatacacaactttgtcttgatcattaactaccactggttgatgcttcatagttgaatttacctgtttttggtttctattgcaggagaagctaatggccaacaccttgcaattcaatttctctctaccaactccatatgttttcatgaaacgatttctcaaagctgcccaatctgacaagaaggtatatatctccctaactaaaaaagcttgaatcattatatccggaaaccatcaggcctaatatctaaatcggtgtggtatatgcaattgtggtttcagcttgagattttatcattctttatgatcgagctttgccttgtggagtatgagatgctagagtatcttccatctaagctggcggcctcagcaatctacactgctcagtgtacacttaagggatttgaagaatggagcaaaacctgtgagtttcacacaggctacaacgaaaaacagctactgtaagaacatacattgatttttttgaaaaccccatgacatgagattttggtatcctgacagtgggtttttgtgttttttctagggcatgtgcgagaaagatggttgctttccatcacaaggcaggaacagggaagctcacaggagttcacagaaagtacaacacatctaagttctgtcatgctgcaagaactgaaccagctgggtttctgatttaatattaataagaatctaatatgacttaactcgagtttttctttagaacaaaaagagtgtgagagaaagagagatagtagagcaagttgcccaaaatgggagaagaatggatctttagatat

SEQ ID NO: 594 - DNA, 2264 bp, Arabidopsis thaliana
tctccattcccaattgtctcttcttttctttttgtacttgtcaaaaacaaaaagaacaacaaaaaaaatctcaaccgtagaaaattccgacaagagttcagttcatacaatgaactaagtatgggtttctttggaagactgttcggaagtaagaagcaagaaaaggcaacaccgaacagacgaagatggagcttcgctactagatcctcacatcccgagaatgattcgtcttctcattcaagcaagagacgtggggatgaagatgtcttaaacggcgacaagcatgcgatagccgtcgcggctgctacagctgcagtggctgaagccgcactcgctgctgctcgtgcggcggcggaagtcgtgagactcaccaatggtggtagaaactcgtcggtaaaacaaatcagtcggagtaatcgtcggtggtctcaagagtataaagcagctatgaagattcaatccgcttttcgtggctacttggtgagttaattacttctctaagtttaatcttaatactcaacttcataatctataattttgtttgaaagaaattaagtttttgagccaaagtgtggaatagctgtctgatgttgatttttctacttaaacccaaattgaaatatttactaaacaaaaaaaagaaagaatgagaataatttgtatttatttgtattggtccccgaaaaagactaggaaaggagacaaatgaatgaataatgataccaagaaacttgtttagagccgatacgattctctaccgagtaccgacactatttaatggtactactctagaattgtatagataaaatttggtcccaaaaaatatgcaaatattatctcaaacaaaatcttacctaactagatttagctaagggcttattctttgtaataaattaatttttacattaaaccaagtcagcaataaagaataacaaggagagggccaagttctttattttatctactttctttttagtttccaaagttccaaagtgtattttactataaaggtgaaactacagattggtttttaagctttttgagctttaaagttgcatcaccactgttactatcaaagttgcaacctacctttttcataatttgacagataggttatgtagtttagacacataatttagagattctctaatcttattgcttcgtatataacaaataaggtgtgtatcatttagaagaaaatgatagtggttgggaaactatgagtaatttaataaggagtattagtgtattactttgtggtttgaattaagtgtgtaaccaagttttctttaattcaggcgaggagggcgttgagagcactgaaggcattagtgaagcttcaagcgttggtgaagggacacatagtaaggaaacaaacggctgatatgctgcgtcgaatgcaaacgctggttcggctccaagcacgagctagagcttcgcgttcttctcacgtttctgactcttcccatccgccaacactaatgattccatcttccccacaatctttccatgcacgatgcgtttcagaggctgagtacagtaaagtcattgccatggatcaccaccacaacaaccaccgttcaccgatgggttcaagccggttattagaccaatggaggacagaggaaagtctatggagcgcaccaaagtacaatgaagatgatgacaaaatcctagaagtcgacacttggaagcctcacttcagagagtcaccaaggaaaagaggatctctagtggttcctacaagtgtggagaacagtccacaattaaggtctagaacaggaagcagcagtggtggttcaaggagaaaaactcccttcacgcctgcgagaagcgagtacgagtactactctgggtatcaccctaactacatggctaacactgagtcttacaaagcaaaagtccgatcacaaagcgcaccaagacagagactacaagatttaccttcagagagtggttacaagaggtctatacagggacagtattactactacacgcctgctgcagagcgatcgtttgatcagcgttcggataacgggatcgcgggttacagaggagtttctgatgggttagatcgaaaccaaagtgacaaatcgaagatgtacacttcgtttttcagttctaatcctcttttctttcaatagtcgagaaaggatgaaaaaagtgagtggaatgtgtaaaattagatttcgacacacgagtacagagacagccagtgatcaatctgtgttttgtactattttctaattgactgtatccaacaa

SEQ ID NO: 595 - DNA, 1310 bp, Arabidopsis thaliana
aattttctatgtttgttttttctaatatatttacttcaccaatcaccaccacaacttccctcactcttcttccaagtgaagttattaaccaaaattacagataggaagaagagtgctgcaatggaggagattgtggtagagagtcttcttagcggtaacagagagtctcaaatagaagcagctatagagctgactaatctaagcaggaagcaaagacaaaaattggcagaaagagagatcatttctcctttgctctcgatgttacaatctcaagactgtatcacaacagaggttgctctatctgcattactcagccttgcctttggcagtgaaaggtttgtgtttctatctgtgtttaactattcatgtgcggtagtaacaggcaaaataataataattgtgtttattaccgaacttacaggaacaaagtccgaattgtgaaatctggcgcagtaccaacgttgctagaaattctccagtcagaaacgaagatggtagttcttgaattggccatggcatttcttctgattctctcttcctgcaacaaaaacaaggttaagatggcatcaaccaggttggttcagcttttagttggacttattgggctcgatagacttaccatccaggccaaggttgatggcatagcaacactacaaaatctatctactctccatcagattgttcccctggttatagcttcgggagcaccatatgctttgcttcaagtcatcaacttttgcgataaatcttccgaattggctgataaggcagtagctttgcttgaaaacataatttctcattcaccagaatctgtttccagcatcggtggagcaattggggttctggtggaagccattgaagaagggtcagcacagtgtaaagagcatgccgtgggaatactacttggtatatgcaacaacgacagagagacaaaccgaggaatgatacttagagaaggagtgatgcctggattgcttcaagtgagcgtagacgggacacggagggctaaagaaatggctagagagctactgctactactaagggactgctctggctatgtcatcaaaaacaaacagtcaaagattgagattgttgagcaaattatgcgggagattgatcaagaaggagagcgaatacctggaaccatgttgaagttggtagaagagatgatttccaaactcagcacataaccccctggttgcattccagatcttgtatatataaaaccatgtactgtttcacagaaagagagacttcttcttaggaataattgttaccaccatcttattgcaaccaatagtgtatgtacc

SEQ ID NO: 596 - DNA, 1672 bp, Arabidopsis thaliana
gactaactccactattattgtgatgattttgcatatttctaaacaaagattttgttttgataggtatataagattcttcagtatgtagaatcttaccagaaggaagttaatctcagtcccatgcctattattctttgcgggtaactatcttgtttggattttacttttccatgggttagatgtgatgattacagtactataagctcctatgtttgtgtctgtggcagagattggaacggaagtaagcgaggacatgtctacaagtttctcaggtcacagggttttgtgtcgtcttacgatactgctcatcggtacacagactcagatgctcacaaggtcactgtctttcttcatatggcgaatacttttgggtatgctgtagattttttcgatgttttgaataggcgatcgggattctgaaactgttgttgttatctttggtttaacagtgggtaagccaccggaatcatcggggtaacatatgcgctgtcgatttcatatggcttttaaatccaaatcggtatagaaagctgctaaaaacaagttggagcgaggcagtctttggcatgttcagggtgagactctcctcaattgtgtcttatcacaagttttcatctctgaatgaatttcactgtcttttttatccaaaagtgatttacttgttgatctttgaactggttcaacattaacttaatagtataccaagaaaaatgtctcttcctttacaattcttgtctaaattatttatggaaacggaattgttttctggttcctgcttgtaacatcagaacattttgatatgcagtatctactgagaagagcttcactaacagctgaagatgcttttgcttttctaaaaactgacaatgatggtgaccacattacattcatgggcttctgtgagactcttcggcaggtatgtagaatctgtaacgcagttaatcatattcctatgactgccttactcagcttaatgtttacagagttttctctttcttaatttcatactctttctctatacagctcaatctaacaggtcactgtaatggactcacgacaaaagagatcaaagatttgtggactcaagctgacattgatggaaacggtcttctagattataaggagtttcaggtaatgtttcttcattagactccccctctctagattacaaggaattgttcatgataaggtagtttttagtagaacttaagagttacaatagctgaacataatcgcccgtgaacatctagacatagaatcgaaaacccttgttcttgttcttgaaactacacacaagtttctcaattgcttatgtaatccattgcagcaaagaatatggaaccaaacctggtcagaacaaagagatgcagaggacggagaagcaaaaggtaaccaagaacaaaccgttggattcagtgtcaaaaacgcagttttgtttcctcctgaagttgaaaaaggaatgtggccagaaaattactctctatcagatcacgcgagactcactgttgtattctcacccataagaatgccttgctctcaattggtttcatgacaaaacacactcaccaaacaaactttagcttcttccatttttaagagacctctgagttttggtgtccccttacagagaaacttcgctctgtctctccattggatcggcttgaccgctctc

SEQ ID NO: 597 - DNA, 1819 bp, Arabidopsis thaliana
acaaaaaattaatattaaaaaaataaaactttcttgttcaccactcaccaaaactctttatataaacatatacacaactctttcacttttgcatcatcttccttcttctcttaagcacaaatggcgactctttatagtcaagttccttctgtatcagcagttttctctctttacacatctttttccgcaatcacgatgctttttcgaacaatcctcaacgagattgtgcctaaaagaatcagagagtacatagctatgaaagctgtagacttcttctcttcttactttcaatctgatttcacttttgtgatagagcaacgttgggagtttgttgagaatcagacgttccgtgctgctgaagtttacttacctacctgtctcgccggactttctacaggcaaacttcttgtgggttcaagtaatcttaagaatccagctgctgagccaaaacttggtatccctgtgaacactaagatcattgataactttgaagggattcatctagaatggactcttcactctgttgaaactaagaagtatctacccgaaaaacggtaaccctaaaaaaactctgttgtcttttatctcttagactctattcttctttgatctgacatgttttgtgtgttcaggtactttcatttgacatgtaagaaggagtttcgtgagaagataatgacggattacttcacttacttagcgaaatcagcggagaagataatgagccatcgcgagaatctcaagatctatacttataaccaagaccggtctaaatgggaatctgctatcttcgagcatcacacgacctttgagacgttagctgttgagccagacctaaagaagactttgattgacgatcttgatgctttctctaaaggaaaagacttcttcaagagcgtaggacgtgcttggaagcgaggatatcttctttacggtccaccgggaaccgggaagtcttctatggtagctgccattgctaatcatatgaagtatcatatctatgatcttcagattcaaagtgttagagatgatggtgagttgcgggagattcttacttcgaccaagaaccggtcgattcttcttattgaagatattgattgtggagctgatgcttctcgtagacgtcagagtaagaagaaggaagaagatggtggagaagatgatggtgagccacaaaagaggaagaagaagtttgaagttggggtaagtttaatgaaaatttcctctgttttgttagtttctttagtcttatgaatctttctttcttgtggtacagatatctttgtctggtctattgaactttgttgatggactttggtcaagttgtggagaagagaaaatcataattttcactactaatcacaaggagaagctcgacccggcgttgcttagaccaggacggatggatgttcatattctcatggacaattgtactccctttgtgttcaagaagcttgtggctttgtaccttaaaaccgatgagcatgtcttgtttgatcccattgagaagctcattcttgaagtgagttcgactcccgctgaagtcacgcagcagctcatggcgagtaagaacgctgatatcgcgcttaaaggccttgctgaattcttggagaacaagaagttgaaaaagggagaagattctagtgtggaggaagagggagagattgaagatgctgagactaaagaagcagaaacataagactttattagaagtaactctagtgtttcagctccttttggtaataaatatcattgctttagaccagatgaaacaaaatgtagctaaaactacatgttgatgtatgaacaattaggggac

SEQ ID NO: 598 - DNA, 664 bp, Arabidopsis thaliana
atggcgttagaactatggcaaactctcaaagaagcaatccatgcttacacaggtctttctcctgttgtcttcttcactgctctagctctcgccttcgccatttaccaagtcatctcaggctggtttgcctcgccgttcgatgatgttaaccgacatcagagagctagatccttggctcaagaggaggagccaccgattcctcagcctgttcaagtcggtgagatcacggaggaggagcttaaacagtacgatggctctgatcctcaaaagccccttcttatggctatcaaacatcagatctatgatgttacacaaagcaggatgttctacggaccaggaggaccatatgctttgtttgcagggaaagacgctagccgagctcttgcaaagatgtcatttgaggagaaagacttgacttgggatgtctctggtcttggtccctttgagctagatgctcttcaagattgggagtacaagttcatgagcaagtatgctaaggttggtactgtcaaagtggctggttcagaacctgaaaccgcatctgtctctgaacccacagagaatgttgagcaagatgctcatgtaaccacaacgcctgggaagaccgttgttgataagagtgatgatgctcctgctgagactgtgttgaagaaggaggagtaga

SEQ ID NO: 599 - DNA, 2485 bp, Arabidopsis thaliana
aagaatttaacgaaactcaactgtttcgaattcgatttgaatctcgacccgttacttagcaggaagaagatgaagcagcgcttcaccttcttcttcgttatcttctcttaataatccccaatggcttcatcatcatcccaacgacgctgcgtttttggtaactcactcttcttcttcttcttccattatcactctgtgaattctcttcgattttggattcaattggcttaaagttttcgactttcttcgtctattttagttgggaacattccttacgacgcgaccgaggaacaacttagagaaatttgtggagaagttggacctgttgtctcgtttaggtcagttttatcgttcaattatgatttagggttttgataaaggaaacacttttcttcaaacaaacgaaacacagaagcctaaaaaactttgctttattggattcagattagttacggatagagaaactggtaaaccaaaaggctacggattttgtgagtataaagacgaagaaacagcattaagtgctcgtcgtaatcttcagagttatgaaatcaatggtcgtcaattaagagttgattttgctgagaatgacaaaggcactgacaaaacccgtgatcaggttactcctctctctctttcttctttcaatgttggatggtttttaactgttgtcaagaagttataactaaagatggtaaatttgggttttcagagtcaaggaggacctggtttgccatctactactactggtatgttttgttttcagtctctgatactttactgactgcaattgtgtttggatgaacacaaacttatcgttgttcttctttcttttggctgtttagtgacagagtctcaaaagcagattggagggccagtagattcaaatatgcatcagccagttggtctccaccttgctacaacagctgcatctgttatagcgggtgcgctaggtggtcctcaggtcggttcgcagtttacgcaaagtaatctgcaggttccagctagtgatcccctggctcttcatctagccaagatgtcaagaagtcagcttactgaaattatatcgtccattaaggtgtgaatcttgatatcgttttttctttctttttttgggtgcattgttatactattggaagcgagttgtgtgatgtgattgtgttctctcaatgtcagttaatggctacacaaaataaggaacatgctagacagttgttggtttcaagacctcagttgctaaaagctgttttcctggtactcactcatcctcttattgtgcaaatcatttttcattattgacaaatatttcttatgatacttacaccatatttgaacctttactttgtctacccttgtaggcgcaggtaatgcttgggattgtgagtccgcaagtggtaagttttccatcttatcgaacagttttgtgctacttccttctttatctatctgtcatgtcttaagaggactattgccattcttgaattgtgcagttacagtcgccaaatattgttcaggccccaagtcatatgacagggtcttcaattcaagatgcgcaattatctggtcaaaaccttttaccgccactggcacaaaggtcacagcagctaagtcgtgctccccatagtcagtatcctgtccagcaatcttctaaacaaccttttagtcagattccacaactagtagcacaaccaggtccttcttctgtgaatcctcctcctagatcccaagttaaagtcgaaaacgctccattccaacgccagcaagtggttccagcttccaccaacataggttatagtagtcagaattcagttccgaataatgctatccagccatctcaagtaccccaccaagcattaccaaattctgtgatgcaggtgagtttccacaatatttttatttgtttttttggattcctctgaacataacttctcatgtgtaatttacttacattacagcaaggtgggcaaacggtatcattaaattttggcaaaagaataaacgagggtcctcctcatcaatcaatgaacagaccatcaaagatgatgaaagtggaggataggagaactacttcactccctggaggtcatgtgtctaattcaatgcttccgaatcaagcacaagctccccaggtattatcaatcacatcatctaatgtcgcttagaatgccctgaataaatctattaatcggtaaaatccttactcttcttccagacacatatctctcccgatgttcagtcaacattgctccagcaagtaatgaaccttacgccagaacagttgagattactgactccagagcaacaacaagaggtcttaaagctgcaacaagccctcaagcaagaccacatgatgcagccttcatagcattgaggtaggtttgttatatatatatcatcgacctgtgttgctgtcattcttctctgtgatatttgaatctaatactcgtctcggtttcacctctctgatatatacaggggaaagcaa

SEQ ID NO: 600 - DNA, 2000 bp, Arabidopsis thaliana
ttttacaaatatattctcgaacccacctttctccgccggatctgattccaaaacctgtgaaagtctccagctttactacagatttttgaagaacaacaaaagggtttcaaatttgagcaaatgggtggctctggaaattggattaaatctctgataactaacaaaaaaaacatcactgatgatcaagtaactctcgaaaaggctctcttctttacacttgatctatctctgttttcatctctcagtaactgattctattgtttttgcaggagaagaacatcaagaagaaatggaaactatggaggacttcatcggaaggtttgatttcttcctcaaagggtttcaagagccgtggtggtagttatggaactccttcgttaggctcagatccgccgtcattctctgctgacgactctttcacggcggctgttgctgctgtcattagagctccgccgaaagatttctttcttgttaaacgtgaatgggctgctacacggattcaagctgcttttcgagctttcctggtttgtgaatttaaccactattactgagattgcttcactgttcaattgttaatcaactctttacatagtctgctttggtttagtgacctgttcattggttttaacatctgattgcaattctaatagaaagttagaaacttaaatcaaccatcaacacttaatggatcattaaactaagtcaattcatttgagcagctcatttgttgtcttctctgaagcttttgtggttaatgtttttatgaatgcgttttacaggcaagacaagcgctgagagctctgaaggccgtagtgaggattcaggcaatattccgtgggagacaagtccggaaacaagcagatgtcaccctaaggtgtatgcaagctcttgtacgagtccaagctcgggtacgagctcattgtaacagggggccttcagatggacaggagttggagaagccatctgatcaacaaaaagatgatccggcaaaacaggctgaggtaatgattatcagatatggattttgggatagaatgggactcgtgggagactaaatgtatatgttttgcaatgatgtgttgttcagaagggttggtgtgatagcccgggaagtatcaatgaagtgagaacgaagctacaaatgaggcaagaaggagcaatcaagagggagagagctatggtatatgcattgacacatcaggtaatgcattcataactagaatcaattttgcgaggattttactctctctcagagcatttgtgttcattgagtttctcaaattttgacacagccgaggacatgtccaagtccggccaaggcgagcaagcaagggagtgtcaaaaagaataatgggtcgtgtaagagcagtccaggttggaattggcttgaccgatgggttgcagacaggccatgggaaggtcggttgatggaaggtcctacaaactcatcagaaaatgcaaggaaaagcgagagcagtgtgtctgaacatgatacggttcaggtcaggaagaacaatctcacaaccagagttttggctagacctcctccaatgtcatcgtctgctacgagttctgagtcttcatcgacttctcaatccccagttcccttctcgggaagtttccttgaggaaggagggtactacagaaagcctagctacatgagcctcacacaatctattaaagctaagcagagacgatcagggtcttcgtcctcttgttccaaaacaccgtttgaaaagaaacagtcaatgtcttacaacggagatgtaaatgtaaggcgtagtgctggttcggatccgttgaacaaccagtggactgatctatacccaccagctcaagtaacaggaagacatatgtgggcaaagagccagagaggctaagcaatcgtgccttcaatcatctcaacagcttgttggtcccatgaaacacatacacggaatatagatacagaagcaacttctgtttatcttttttttacatatgaatgttaaggaattagt

SEQ ID NO: 601 - DNA, 1799 bp, Arabidopsis thaliana
ttagtgtcagatttgtttcttctttgatgcaggggaaaaagaaaatgagttaggtgaagtttcagaaccatagagacgacgatttgatcgttgcgtaaaccaaatgatataaagcaaaagatgcaatcgagaatcgtcggattagctccggcgttttctctcttccctaacctaaacacacctcacaaaaccttcactttccatcaaatcttagttctcatcatcacattcacagcctacgcttcctttcacgcttctcgtaaaccaccaagtatcgtcaaaagcgtccttggtccaccttctcttaattcatcttcaattgataatggctgggctccgtttaacggaacccaaggaaccaagagacttggtgagcttgatttggcttttctttcttcttatgctttgggtatgtattttgctggacatttaggagataggattgatttgagatactttcttgtgtttggaatgatgggtagtgggattcttactcttgtgtttggtttagggtattggatgaatgttcatacacttgggttttatatgagtgttcagattgtttgtggtttgtttcaatctattggatggccttgtgttgtttctgttgttggtaattggtgtgggaaagagaaacgtggtttgattatgggtttgtggaactctcatacttctgttgggaatattctcggttcggttattgcgtcttcggttcttgatttcggttggggttggtcttttgttttgcctggtgtgttggtgcttgtgtctggagtggttgtgtttatgtttcttgttgttagtcctaatgatttggggtttgaagaattgggtaaagagattgagattgagatgagtttaggtgagaatgtagaggaaagtttgaggaaacatgaagctgagggcgcggtgctacttgaaaacgtagatgattcgtcgtttgctatcgggtttctcgaggcttggagattgcctggtgttgcgccttacgctttctgtttgtttttctcgaaactcgtcgcttacacgttcttgtattggttaccatactacttaaggcacacaggtatgtatccatccatggctggctttttccatataactcaacttgcatcaccttcttactgttatagtttgtaacagctgttgcgggtgtgaatctctcccataaaaccgctgggattctctcgacggtctttgacgttggaggagttcttggtggaatatcagcagggttcatttccgataaaattaaagcgcgtgcgctcacgtcaatcacattcttggcactctctattcctgctttaattatgtacagagtctatggaagtgtgtccatgttcatcaacatcgtcttgatgtttatatccgggttattagtaaacggtccttatgcactaataaccacagctgttgcagctgatctcggaacacaagactctataaaagggaatggtcgagctttggcgacagtaactgctattatagacggtactggttcggttggcgcagctttgggtccgttgcttgctggttacatatcgagcagagggtggaacagtgtttttttcatgcttattgtttcaatattctttgcgggtttgttcttggttcggcttgcaaagtctgagatcaatacgatgaggtccggagaattgatagcgtcgagtgttccttaaagctgatgattttgatcccagcaggattgtatacaaaggtagtatcaggtacatagattcaaacaatacaatacaaattgagacaccacctgatttgtttactaccattttagtttagat

SEQ ID NO: 602 - DNA, 2229 bp, Arabidopsis thaliana
cttttttgtctctctccctgattcatcgccgtagctgtgtgaccgaacattgctgcgagttcctcaaaacccaaatctttcttcctcaaagactctgttttttctttcttcctttcttcaatggcgttatcgaaaaacagtaacagtaacagctttaacaagaagaaagtttcgtatatctcagtcccttctcagatcataaactctttatcatcttcctcattacaatctcttcttgtttctcccaagaaatcatcaagaagcaccaacagattcagcttctcttataggaaccctagaatctggttctttactctcttcctcgtctcactctttggaatgttgaaactcggtttcaacgttgacccaatctctctccctttctcacgttacccttgttcaacgacccaacaaccactaagcttcgacggagaacaaaacgctgcatcccatcttggtttggctcaagagccgattttgtctactgggtcatcgaattcgaatgcgattatacaattaaacggtggaaagaacgagactttgttaacggaaggtgatttctggaagcaacctgatgggttagggtttaagccctgtttgggatttacaagtcaatatagaaaagatagcaattcgattttgaagaacagatggaagtatttgcttgttgttgtctctggtgggatgaatcagcaaaggaatcagattgttgatgctgttgtgatcgctaggatccttggagcttctttagttgttcctgttttgcaggttaatgtcatttggggagacgaaaggtataaactttaaactcattataatctcttaaagaagaaagtaataagattgtgacattgttgatctaattgtttgttttgttgcaattttagtgaatttgcggatatattcgatttggagcatttcaaggatgttttagcagatgatgttcatatagtttcgtctttaccttctacacatgttatgacgagacctgttgaagagaagaggactccacttcatgcttctcctcaatggattcgtgctcattatcttaagcgagtaagatttcttaccaaaacaataccattttgaagtgtttctttgtttgactagattgagctaataatagtgttttatttcctctgtttttgcagattaacagagaaagagttttacttctccgtggactcgattcaagactctccaaagacctcccttcagatcttcagaaactccgatgcaaggttgctttccaagcgcttagattttctccgaggattcttgaactcggtaataaactagcttcaagaatgcgtaaccaaggacagtatctctcacttcatctaagaatggagaaagatgtttgggttagaactggttgtctccctggtttaactcccgagtacgatgaaatagtcaacagcgaaagagaacgacaccctgagcttcttaccggtagatcaaacatgacttatcacgagagaaaacttgccggtttatgccctttaactgctctagaagtcacaaggtattataccaactctatgaacaaatccttttgcttatgttttttcaagtaatactaacattttgttgtcattctacaggctgcttaaagcattagaagctccaaaggatgcgagaatctattgggcaggaggagagcctctaggaggaaaagaggttttggagccactaactaaagaattccctcagttctacaacaagcacgatcttgctttacctggcgagcttgaaccatttgccaacaaagcttcggttatggctgctatagactacattgtctgcgaaaagagcgatgttttcataccgtctcatggaggaaatatgggacacgcgttacaagggcaaagagcttacgctggtcacaagaaatacatcactcctaataagagacagatgcttccttatttcatgaactcgtcgcttcctgaatcggattttaacagaattgtgaaagatcttcatcgagaatcgctaggacagccggagttgagaatgagcaaagctggtaaagatgttacaaaacatcctgttccagagtgtatgtgctcggatagacaacaacaagaacaacagtccgatgcttaagccttgaaggacattttggacattatttggtgcgcggaaaatgaagaagacgccgattttttcccgatcacccggaagattgattgaggaagacgattcatggtggttcgtgcgatattc

SEQ ID NO: 603 - DNA, 1567 bp, Arabidopsis thaliana
acctaattgggtgctccgacttcttttcgcgccgctcgcttgtacatgtcctcttcttcgacttccagataaaatcgcttcctctgtttttttccgatctaaattcacagctcatcgaaaatgggctcacggcaaggaccaccgaagcatcagaacaaattcgcctgggttcccaaagccggcgtcaagatcaacgaaacggtaagctatttgctcggctatgagattaacgaaattgagtgagtactgtagctagacccttgattttttcggaaatttatgaattgttaggaagtcggcgggagatttagaccattatccgagattaccggagtttgctaccgatgtcgagagcagatcgcctggaaacgcaaatacggcaaatacaaaaccctaactgaagccaccaaatggtatcgtttgatttgaatttagagtcttctttgtcattctctgttggattttgaaattgatttgttttgttgtgtgggtttttttttcttaaaagagcaacctttttgtttgtgggtgcagtcagaagtgtacaaagcgaaatgttcgtcaagcataccataagttatgccctggttagtgttttctttctttgcttttgttctcgtactttcttggctaattagagtgtatagatcagtatcttgttttataagttgatgtgttatggtattgaaatgggtatgaaactgataacaggttgtgccaaggagcaaaaggtgtgtgcaaagtgttgtcaaagtgttgatcaaatccttggaaggtacttgtaccttgaagacagtctttcttctacttatgctagatgctggtttccttaagagtgggtttagtagacaagatattaaactaatcttgaggtaattattcgtttctcgcagagatatttacgaagtagaggctgaacagaagctgcttgatgaggtttgtcttttaattattccgcttttggcttctaatgttcaatttcatgcttgtttttgggaggttgttgctgatttcttattgatgtgatgcagactatcaagaatgctagggaaagagatcgaaggaccctattacgtgctgtaagcttctctagttactttgaagagtttttgagatttgtaaatgtgtatgtttgtgtgatttggtcctgaagttgcgtatttgcttgacatagatgaacaaagataacaaaccaaataaatcagatgaagaagcgtcaaggagtgatagcagcaaggttggtgatgtgtttccctcaacttcccttgaagaatatgcaaacaagtccggaagagttagcgggattattggtcatggtagtgtgcctgatcatgcccatgatgatgctagtggacctgaatcagatgaggatgacaatgttggtgatgatgagcatgatttgcgcgaagacagtgatgaaaatgagcaatctcaactgcagaaataaactcatgtttggttgtactactgtcaatttggtaggattgtgagattttgcaagactgtttattcctgttgttttgataaaacttttacttggtcacctgcaatgcaagactagcaaaga

SEQ ID NO: 604 - DNA, 564 bp, Arabidopsis thaliana
cctaaatatctacatatccattttcttttcttaatccaaaaatttacaaatccttaatctttctcttcttcctaaaaacagctttgagctttctctcagataaccacattttacctaacaatggctacaatcatctcctgctccgctctttcctcgatccgagcatcttccgaatcggatccagcccgtaagaaacctgtttcgtcggtttcatggtgggctcctctttttggcatgtcatcggaacctgattacgtcaacaaaaccgtgaatctggaatcagatctggataaagctgaaaagaggtctctgcgatgttgtctcacggaggagaaggctaagcagctgcggaggaaaaccgccgaagcttctacattccacgacgttatgtaccattctgcgatcgcgtcgcgactcgcgtctgacgttcgggtcaagaagtaactggatcgggtcacggatccagaaataatcaataattcgtcgaacttaaaatgtctctcttttatgggatgaagaataactttttgtttacgatgatactcaagaaccgctttattgtgc

SEQ ID NO: 605 - DNA, 1352 bp, Arabidopsis thaliana
tcacgtgaaaatgttacgagctagtaactaaagcatttacactaacggtaaaaaaagtatctataaatgtttacacaaggtagtagtcattagcactcaacttaaactcttttagtaacaatggtttcttcttctttaaccaagcttgtgttctttggttgtctcctcctgctcacattcacggacaaccttgtggctggaaaatctggcaaagtgaagctcaatctttactacgaatcactttgtcccggttgtcaggaattcatcgtcgatgacctaggtaaaatctttgactacgatctctacacaatcactgatctcaagctgtttccatttggtaatgccgaactctccgataatctgactgtcacttgccaggttcttttcaatttctccctcttcttgtggataaataaataaatttcctatctatataacttgtatattaatgttatactttctcttattaatcatgtttgggaatgttgtgaagcatggtgaagaggaatgcaaactaaacgcccttgaagcttgcgcattaagaacttggcccgatcaggtatataaagaattgatttatttcctaagttttttattcagggaaaactgaatgttagaattacagtttgacaaatgtgatggttatggaacgcagaaatcacaatactcgttcatacggtgcgtcgaaagcgatacgaaaggctgggaatcatgtgttaaaaactctggacgtgagaaagcaatcaatgattgttacaatggtgatctttctagaaaggtacgtatatattaaaaaaacaaaaaaaaattcataatatacacatataaccaacttttatgtgttatttgtaattgcagctgatacttgggtacgcaaccaaaaccaagaatttgaagccgccacatgaatacgtaccatgggtcacactcaacggcaagccactcgatgacgtataaagtcttataaactctttatttcatgaataatctgacttcattcattacatttttgaatcaatcaaaaaagtatatcactgattgtgttctcttttttggtattgggaatgcagagcgtacaaagtacggatgatctcgtagctcaaatctgcaatgcatacaaaggaaagactactctcccaaaagtttgcaattcatccgcctcaatgtctaagtcgcctgagaggaaatggaagcttcaagtctcttatgccaataaagctaccaattattaagttaactatcaaacttcgtattgaactaagatggatttaagctttatgttataagtggaatgatgaataaaggcctgttctaaacttttatggttacgaattgatgtattaaaaaagaac

SEQ ID NO: 606 - DNA, 804 bp, Arabidopsis thaliana
ctttgaaaacgattatccaaataaattatttattaaaacaagtgaataatacttctatataaatgggtttaagcctccttcattaaacacatctcacaactcactaatctctagctaaccatggcatttctagtagagaaacaactcttcaaagccctcttctcattcttcttattagttttactcttctccgataccgtcttatctttccgaaaaacaatcgaccagaaaaaaccctgcaaacacttctcgttctatttccatgacatcctctacgatggcgacaatgtagcaaacgcaacctccgccgccatcgtgagccctccaggactaggaaacttcaagttcggtaagtttgtgatctttgatgggcccataacaatggacaagaactatctctcaaaacccgtggctcgcgcacaaggcttctatttctatgacatgaagatggacttcaattcgtggttttcctacacgttggtgtttaactcaacggaacacaaagggacattgaacataatgggtgctgatttgatgatggagccaacaagagatctatcggtcgttggtgggacaggtgacttcttcatggctcgtgggatcgctaccttcgtgactgatttatttcaaggggctaagtatttccgagttaagatggatattaagctctatgaatgttactaagtagctaagaatgtgtgttttgtttgaaaattttatgttgacacagagaaatgtgtttacaataattaagttttttttttgccttttcttttgctgttgtctttttgtttatctataatt

SEQ ID NO: 607 - DNA, 404 bp, Arabidopsis thaliana
ttaattaaagaaataaaacgagatgggaagtggcatgataaggacattggttattctagcaatagctttattcatgatcggttccgacaacgtccacgtggcaaaagcccaggtctgtggagctaacttgtcgggactgatgaacgaatgtcaacgctacgtcagcaacgccggaccaaattctcagccgccgtctcggtcttgttgtgctctaatccgtcccattgacgtaccttgtgcttgccgctacgtttcaagggatgttacgaactatattgatatggacaaagtggtttacgttgctcgttcttgcggcaagaagattccctccggttataaatgtggaagttacaccattccggcggcttaaaaaggaacgaaaccaacagaatttggggcgcgcc

SEQ ID NO: 608 - DNA, 354 bp, Arabidopsis thaliana
ttaattaaaatgttgaaatttccactttgttgcagtgagttatctttagaaccgaagattctagcttttgaaagtcagcttgtttcggggcgacgcgatacaatcaaagtttctgcgggaaaaatcggaaatttctctcttggttcgatattcaaaagttgtgagacttgtggagccaaaggagcaattgaatgtcccggttgcaagggaacaggtaaaaataagaagaacggaaatatgtttgagaggtggaaatgttttgattgtcaaggatttggtatgaagagttgtcctaaatgtggcaagggaggcttgacgcctgaacagagaggggaacgatagacttggcgcgcc

SEQ ID NO: 609 - DNA, 2298 bp, Arabidopsis thaliana
aaccctaacaaatcctcctcttgttccgccactgccgccgccgctactcaacggtggtgaattttctatacggtcagttcgatcctctttttatcgacaatcctacacaaatccataatcatggccgccactgcttcctccgaagcttctgaaggaccagtgatgggtctcatcaacaagcgtctccgtgctctccgtaagaaatacaaccgaatcactcaaatggaagaatcgatttctcaaggcaaaaccctaaacaaggagcaagaagaagtcctccgctctaaacctgccgtcgtcatcctaatcgacgagcttgaaaagatccgtgctcctctctccgccgctgtgacagaggaaatcagcctcgctactcagcttaaccgtgcttcatccgatcaaaccaccgcatctgagcaaaaggaagtcactgatatcccgcaggaagttagcggcggcgatgatggcgctaagttggaggatctggtgaatttcctctactttggttcactcttcgacgtcaagtcacagaacgagttcacttcgataatgttgaccaggactcatgagagaagttgctgcttgtcttacgattacgttaccgatgatgccactgatctcctcggcgatcgggatttggattctatttctcagctttggagcctgatggtttctcgtccggtggattcaagcttatctcacaagaacgctttggagcgttgtgttgagcacgctaagctatggttagctaattccgagcagccaatcgaatcaaactgcaatacttcatgtaaaataaaaattcctaaatctgtttgtctcttacatctctgtgttttagtttctctgtgttgattacttagatttgtgatgcagatgctgcattgagagagaagttgaagaagattatggcgtctgactatttcaccactactccggaaatgaaagctccggttgatgtggcggctgcagctggtaactatacttcttaccaggtgcctgtggacgtggaggcttcagggcattaccagcaaaaggtatccactttagattaggttttgttgatttcctgaagtctctgactttcatcaaattggtagtgaatttcgcggactagttgttctgattcattacatactatatagttcagggctttgtggtatgcaaagctcttacttaatctgaaggaggaaattaacaatcacatttctttagttgtggtgagattgagcttaattttcaaggattcagagtttattattgtttctcctataaagtagaagatgtctgaagttgaattatgcagcattagagtgagatgtggtatgagatcattagtgagttaagttgtttggataggatggagaagtacattcttaatttttgatatggcctgttgcttatttgatttttcgactgttctcttggtatttggagaactctatcctggttagaataatctttgtggtgggtctacgatatgagctgtcaatatatttttgtttatacatgtgatcgatgttaacaaactgtgacaatatgtgtcttcactgtagtgaatgttgacatgtttcggtgtgtctcattatatgaattagagaacataaatccctcccatgtggtctctaatgatttatgtgggtctgatattccctgtttacaggaagaagatgcatcaaattccaaagaagtagaatcagttgttaatgatcaatctcaacaagatgagcatcaaaaggtaatccagtgaattgtagagctcgaatcatctttcaatgagttactcaaggatgaatctgatgatattgttttgttgtgaaggttgagttagtgaccgaaggagaggtggtccatggacagcaagaacagggctatactcaggtgggaggagcagagaatgctaaaagagactatgtgccacgtgggtcttaccagaaccaaagaggtcgtcgaggtgctcgaagaggtggtggtggctatcagaatgggcgaggaggacgaggtggtggtggtggctaccagaatgggcggtacgaatcttatgatcaatctggtggaaacggttatcaaaggaactactacaacaacagaggaaggggacgtggtggtggtggtggtggaggaaatggccattcatacaacaactaccaagaccccaatgttgctgttgcgtcttagcttttgtgcctctgtcttttgggtgcgtctctttcattatcttgcgtttatgctataacgcatataagcctaatctcgtgtttgaaacgtttgacaatggctcggttattgctatgaact

SEQ ID NO: 610 - DNA, 1143 bp, Arabidopsis thaliana
gacttaagatgaatgatctgtaaatatttagatctaacatgtcttgagaaagtttcaattttttcttaacggtgaatttgatttcttattcttcagtatatatactcttccacaaagaagatgctcaaggtccctgaacaccaagttgctggtcacattgctagtgatgggaagctcggtccactcgtagatgaccaaggccggttcttcaagccacttcagggagattctcgtggcgaacacgaggctaagttctatgagtctttcacatcgaacatgaaggttccagatcacatccatagatacttcccggtgtatcacggcactcagctagttgaagcatctgatggatctggcaagcttcctcatcttgttcttgatgatgttgtttcagggtacgcaaacccgtcggtaatggatgttaagattggatctaggacatggtacccggatgtatcagaagaatacttcaagaaatgtattaagaaagatagacagaccaccacggtttcgttggggttcagggtttcaggttttaagatttttgatcaccaagaatcaagtttttggagagctgagaagaagcttgttcttgggtataatgcagatggtgctagattggctctgaggaagtttgtgtcatcgaactctcccgctgactctaacttgacaccaaactgtgcttttgcatcagaggtttatggcggttgtaacgggatcttagcgcagttgttggagcttaaagattggttcgaaacccaaacgctttaccatttcaattcctgctcgattctgatgatttacgagaatgaatcaatcttgatgcaaggaggagatgatgcaccggcaccacgggcacaagtgaagctggtggatttcgcgcatgttcttgatggaaacggtgtcatcgaccataatttcttgggtggactctgctctttcataaagttcatcaaagatattcttcagagcgttgaaaagcacgatgaaaccgatacttccctacttgagaacgggcgctagagaaacgtcgttcttcccggctccatttcaaataatctccaagtttttcctttcttggactagttgggttttggacatgaacgtttgtccctttcaattgtataatttcgttaactaaac

SEQ ID NO: 611 - DNA, 2937 bp, Arabidopsis thaliana
gtgtgattccttttaagcaagatcaatgaataaaaaagtttgctctttgatctgaaaatcagcaatctattggatattgactttgttcttactactgtaggatcttgtttagattctgcaatggctttcaggcaaactttatctataaggtccaggcttttcgctcgtcgtaaccaaccagtttatcatattatccctcgtgagagtgatcatgaaagggattcattctgtcaagaaacatctcagagaagttaccatagctttcttcaccaaagatccgttaacaattctgatttctccaaagtttctggaggaagcttacatttgcctcttgctcccacgtctggttttgctttctatcgttatatgtcaagtgcacctggtgttggttcagagaagattggtgtgatgtctgacattgcagaagtcataaccgactcaacattgcaagatgtgccagctcaggctgctgctgctgtcagtgaagttacacttgcagctgctgactctttcttccctatcgcggcccttcagcagtgcattgatatggtgcatacattcacaggctttgagtggtaagaaactttaatattgtttgttgtgtcatgtttcactttaatcagtctgctggagttgatcttaagtatacatcacatgttagctgagtactgttgagataagattcggatatttatgagttaaaaagtctgaaaacctcatctggaccaagatattactatatccttatattctttctggctatttacaggtgggcatccattgttgtagcaaccattttgatccgatcatcaacagttcctctcttgatcaaacaaatgaaagacacaaccaagttagcggtatgtgtctcccttttgtccctttttcacaccttgcagatcatttaggatggtgcatatataaagtaatttcaaatatagagactgactgtagttagagaattagacatgcttctttcggttataaaaatatgaatatgttatatgtagactttgatctctgtatagaataggaagttgagatccacatcactgtagtcaataacacaagtctacataaatcataaactactgcaaaggatgtatttgtgaacttcatgaaaaaatttctactttccaaccgttacagtttcttcttgctttttgtgtttttacatactcaggttgtgaaacaaatttgacatacaaaaggaaagcaatgtctatgcacattaacttataacttctgtcatttatacttggttatttttttctgccttatgctacatccatcagtagtctattctgtgatcatgcagctgatgaggccacggttggagtccatccgggaggaaatgcaaaacaaggtatgtgaagtttgttattaatacatcatggaagtcatcctcacttttgctacctgctaatagcttttgtactgactgcatgtccactcagctttagctcagcatgttaattttgattttctccatattctttcctactatttttgttcagggaatggactcggttacgatggcagaaggtcaaaaaaagatgaagaatttgtttaaagagtaagctgcttttaaatttaaacattttctgaccagaaaaatcaaatttaaagatctctttggagtttaaacttcttttggtcgtaaaaactagaattctatactagttttaatataagttttccctcgtggatcatagttgggtagggagtgcgctatatgtagcttgtctgttctactggttattgtattggtgcagtctcctgacattttgaatatattggtagatatgtcctaataaccatatactgtttgtttataatttacagatatggtgtcactccattcaccccaatgaaagggatgtttattcagggaccgctgttcatctgctttttccttgctgtaagacgttttaatcttaagatgttttttgggctatgttgtttgttatatcattaggctttttgtctcaaatgagttattttttccccagattcgaaatatggcagagaaggtaccttcattccaaacaggaggtgcattatggtttaccgatctaacaactcccgacagcttatacatcttgccggttataacaggattgacattcttgataaccgttgaggtacagtttctgctaacttaataaactttttgacatcaacctttaacagacttgctgacttaagcttaaacatgtccacttcgcagtgtaatgcacaagaaggcatggaagggaatccgatggctggcactgtaaaaactgtttgtcgggtttttgctctcctcacagtcccgatgacaatgagttttccacaggttattatcatttatcggaaaaaacctcgaaagactttgtataatggatgttctaacgaatttccgaaaatttgcaggccatattttgttactggatcacatccaacctgttctctctcatgtatggacttggtgagtgagtgtgtaatgaagattttaactgtggcatattcttggtttgaaacattaacaaggaatggttattaatgacagtgataaagcgtcctcaagtgaagaagatgttacgcatacctgatctgcctccacctcctccaggtcaacaaccttcatttgacctgttttcagctctcaagaaaatgaaagccatgacacaggaccatacacagaaccagatagaaccaccttcgccagtaaacccgaggctttcctcaacatcgctgagtcctgttagtaagaggctcaaggctttggagagccaagtaaagggaaggaagaagaatagcagcaagaagaagtgatttaaaacggtgcatactatttttgttaagagggccaaacgaaaaaaataataaagcttttgagtcgaaagtgaacacagaattttctcactgatgaaactactctgtgagctaaaaagc

SEQ ID NO: 612 - DNA, 1230 bp, Arabidopsis thaliana
gcaatagaccctaaaattaaaccattgaagctgttactaaaccgaacggatttaaacaaaccactgaagtctcatcatcacccaaattcatcgaaattttcccggtaactaagaacaggcatggccagggagcttgtgtctcttcaatacctccgacctccacttcacatttctcgtcaatttctaaacctctcttctcctcctttaactctcaatctccggccaaaacctccgcaaaatccaatctttatccgaaccgactctcaccgcaacaaaacttccgccgacgataacggaatcccagcagaggacgtcaaaaccatcgccaaattcaaatcccgtcacaattacatcagagtcatcgaagtttcacgaaaaaccaatcacccactcgctggttctcgtctcctccttctcgataatcccggtaacatccatagcatctctttccttcttaaaaccttaaccgatagttacttcgacgttttcgctactctgcctccgattatacctcccggaccaattggtattctcggattcggagctggttcaacagctagattgattcttgagctttatcctcctgagatcgctgtccatggatgggaacttgacccttccgtgattgacgttggtagagagttctttggtctctctaagctcgaaagagatcataaagataggatttttatcaacattggtgatgctttgaacgctagtgttaaaaccgggttttcgggtattttagtggatttgtttagtaaagggagtgtgatcaaagagcttcaagatcctcaagtgtgggaggatttgaaatctaggttgagatatagagggaggattatggtgaatgttggaggtaaatgtgtggaagctgaggattcagatagagatggagctttggttatggaggaaacgttgagagtgatgagtcaggtttttggagataagctatttgttctaacgcttgggaatgggaatgatagctcggtagctttaacgggtgatttaccggatcttgatgcgtggaagaagagattaccgcgtagtgaattgagaagctatgttgatatgtggataccttatagagaattctgcttgagatattagtctttagatgatattggttgataatcagtttttgtgatggatgctgcaatgtgtttggaattcaagctatgatgaaacctgattagctaatacacaaaacttgttctgtctcagagagtg

SEQ ID NO: 613 - DNA, 1005 bp, Arabidopsis thaliana
cgaataaaatgtcgaaagaagaaaaaaaaaagaaaaaaatcgtaaaccctataatttttgctcagaaccctaattccgcaaacgtaacctgtgttcattgcgccgtcttctcaccggagaatgagtactactactactacggctgcacttccgcagcgacaccagtcgaaggttgacccgcagaacgttaacagagccgtgaagtctctgctaaaatggtgggactccaaatccaagaccgagaactctgaatcactcgagaacgacggtttcgtctatctaatcgtgacactgaagagaatccctcagttggatcgtactaaccccttgatgatccctcttcctcatcctctcatcgatctggtcgccgaagatccgccggagctctgtttgatcatcgacgacaaacacaagaacaaaatcacaaaggaagcggctttgaagaagatcgaagcagagaagattccaatcaccacagttattaaagtctccaaattgaaatccgatttacgcaaattagaggaggagaagcgattcgagttgtatttcgcggagaggaggctaatgccgatgttgccgaagctgttggggaaagagtttgttaagaagaataagactccgattgcgattaacttaaggcatggtagttggaaagagcagatcgaaaaagcttgtgaatcagctttgttcttcgttggtacaggtacttgcagtgttgttaaagtagcgaagttgtcaatgggaaggaacgagattgcagagaatgttgtagcggccatgaatgggattggtgatttagttcctggtagatggaagaatgttaaattgtttcatctcaagttacttgagagcttggcattgcctgtttatcaatcagttgcttgatgaatttgtttaaagaagctgatggatgatctggttccagtgagtcacaagttttggtttgttttcttagtggaatttgtgatgctgtaatgtttaagataatgcctagactgaacaaaa

SEQ ID NO: 614 - DNA, 1437 bp, Arabidopsis thaliana
agaatcttgatttttctattcttcttcttccttagctgcaggtttctatacttctgttagtactctaattcaaccgagaaagtcgaatacatacacacattcataacacttttgaggaagatgttaagtggaaacaatggaaacactgcaccaccggttttcatgaacgagaaccagttgcaataccagacaaacctacgatcgaatcagcttcacttgctcggaaacagtaagtttcgttttctctcataatgtcctcgtcgtaaactaaacatcattaagaaacttagaatctttgtctgtttttctttttgtgcagtgggaggtggatgcactgttgatccagtaaactactttgctaacgataacctcgttccaatgatccgccctaacaaaagaggaagggaagccgaaagcattagtaacaacatccaaagacaacagcagaagcttcaaatgtctttgaactataattataacaacactagtgttcgagaagaagtgcctaaagagaatctagtctcaactggtctgagactatcttatgacgacgatgaacacaattcttcagtgacttctgctagtggtagcattttagctgcttctccaatctttcagtcactcgatgatagtcttcggattgatctccatagacaaaaagatgagtttgaccagttcatcaagatccaggtactgattgtctctgcatgtaggctctgtttttacgtgaaaaggttcttcgattctaatgtttttgtttgcttttatgtggttcaggcagctcaaatggcgaaaggtgtgagggatatgaaacagagacacatcgcgtcttttctcacaacattagagaaaggagtgagcaagaagcttcaagagaaagatcacgagatcaatgatatgaacaagaagaataaagagcttgtggagcggataaagcaagtggcaatggaagctcagaattggcactacagagcaaagtacaatgagtctgtggttaatgtcttaaaggcaaatctccaacaagcaatgtcacacaacaacagtgtgatagctgctgcagatcaaggcaaagaaggttttggagacagcgaaatagatgatgcagcttcatcatacatcgatccaaacaacaataacaacaacaacatggggattcatcagaggatgagatgcaaaatgtgcaacgtcaaggaagtatcggtgttgatagtgccatgtcggcacttgagtttgtgtaaagaatgtgatgtattcactaagatttgtcctgtatgcaagtctttgaaaagttcttgcgtccaagtcttcttttcttgatttgtgaccaaatggaacagaaggaaaaagagaatccattatataagtctttcatactctttttaaaaaaatattttgttatataaatttatttgtatcggtgtattattatgcatctgt

SEQ ID NO: 615 - DNA, 820 bp, Arabidopsis thaliana
ttaattaagaaggagctctgaaggaaacaaaaatggcaggcagaagcggcggcggaagaggaggaggaggaggaggagcatcggctgatcttcactccgcggcaagatccggtgatttagcagcagttcaatctattatcagctctaatcctttggctgttaattctagggataagcattctcggactccactacatttagcagcatgggcagggcacaacgaggtagtgagctacttatgcaagaacaaagctgatgttggtgctgcagcaggagatgacatgggtgcgattcactttgcttctcaaaaggggcatttggaagttgtgagaactttattatctgccggtggttctgtgaagtctatcactcgcaagggactcactcctcttcactacgctgctcaaggttctcactttgaaatcgtcaagtacttggttaagaaaggagcaagcgtcagagctacgactaaggctgggaagagtccagctgatgttgcgggtaatgcagaaacgcaaaatttccttgaagaatgtgaagagcaagcaaggaaagctaaggtgaacaatgagaaaaagacggaaatagtgaaaccagagagttgtagcaatgaaggagatgtcaaggatctgaaaagaaaggactctgaggatggaaacgagggtgaggaagaagaagcttcttcgaaaccgaaaaagccaaaagttgctctttctcatcttcaggacattgacgacacagaagctgatcaagaagaagagtaactcttctattccatcagaagtttcttaacaagagttgtaagatcctccatcaggcg

SEQ ID NO: 616 - DNA, 2462 bp, Arabidopsis thaliana
ctaattttcaaaattcgaactttacgctcttctctcttcttcttcaacttcccaccttcgtttgaataatctcattgccgttattctctctagctcttcccatttccaggattcttcgatatgggagcatctcacagtcatgaagatctagagatctgttcctccgatgaagatgaatatgaagaatatgaagaaggaagagagggagaggaagaggaagagacgtttcaggactcgcgggatgatacgttaggtatatcttcctccggtggtcgtcgtctccggcctaaatctccttcatcatcactcgacgacgttgaggcaaaactccaagccctgaagctgaaatacccattgacgcaatcagccccgtctactcagaactcagctcggcttttccgctacatcaatggcaacactcccaaagccaaatgggtcacagctgagaaactgactgcttattgtttcgtcaagactaacaaaggagatgaagatgatgaagacgacgatgagaacggagatgtggaaaacgaatggtggattttgaaagtcggaagcaagatccgtgaaaaggtatcagatgaaatgcaattgaaagcttataaagatcaacgccgtgttgatttcgttgctaaagctgtttgggctatgaaattcgccagcagtgaagatttttcggtttttgtaagcagctataacaattgcttgtttgagaacaatcatggtgttgagtttaatgaggctaacaaggcaaaaatctatgggaaagatttcattgggtgggctaatcctgaagctgctgatgattccatgtgggaagatgctgatgatattttgcttcaaagcccaggaggaggatctgcaactccggctagagatacacaggatttgactgaggcctttgaagaagctacaagtgagggcatacatagcttagctctaggtgctttagataatagctttctagttggagattctggtattcaggttttcaagaacatgagacaggggattcaagggaaaggtgtttgtgttaactttgagcctggttatggtcgaactcattcttcagcaccgaagaaggctcttctcatgagagctgagactaatatgctgctcatgagtcctatgagccaaacgcctcattcacgaggtatccatcagcttgacattgaaaccgggaaaattatttcagagtggaagtttgagaaagatggagtggatatctctatgagtgacattactaatgatggtaaaggtgctcaattggatccatctgcgtcaacgtttcttggtctggataacaataggctttgcaggtgggatatgcgtgaccgatatgggatggttcaggatcttgctactgcgaatactccagtcttgaattgggcacaggggcatcagttttctagagggactaactttcagtgctttgcaactactggtgatggctcaattgttgttggctctcttgatggcaaaattagactctactcgagcaacactatgaggcaggcaaagacggctttccctggacttggtgcacctgttactcatgtggatgctacattcgatgggaaatggattgttggtacaactgacacatatttgattgttatctgtacccttttcactgacaaaagtggcaaaacaaagaccggcttcgagggtcgcatgggaaataagattgccgcaccaaggttgcttaagttgaggcctcttgatgcacatttagctggatctgacaacaagttccgcaatgctcagttttcttgggtaagcagaactctagttgcagtgtatattcttgctgagaaagtgacattcttgaaattttcatgttttgctcatagcataagtgcatataatattgaagtcttaagaatttttgtggaaattgaattatagtgttcctcagttgccttgtgtttcaaccttgatttttgatagaggaacttttactactgttgaatcattcatcaattgaaataactttttactaatagttgattcctgactctttttgtctatcttttcttgttgaaaatgtcgatatataggtcacggaggatgggaaacaggagcgtcatgtggtagctactgttggcaagttcagtgtgatatggaactttcagcaggtgaagaatggatctcatgaatgctaccatgatcaggaagggctgaagaaatgctactgctacaagatagtccttcgaaatgaatctatagtggacagtcgcttcatgaatgacaactttgcaatctctggttcacctgaagcgcctttggtcattgcaacgcctatgaaagtcagctctttcagcttatccagcaagcgatgaaacaagcaagtgatggaccggaccactagttattttcatttgaattctagtctatttgtaaccatgtgaaattacaatgttctggctcttagaacgatgttagattcagagataagacac

SEQ ID NO: 617 - DNA, 690 bp, Arabidopsis thaliana
ttaattaatagtaggcttttgttttgatggaggaaaacccgcatcgagtttcacgtagaaaccatggcgggacccactgtcaaaacgacgccgtggacgaagagaaccgtcgacgacggcataaccaccacactcacggcgacgaagtcaaatgctccagtaagagatgccgatcgtgggcggctgcggcgattgctgactgtgtagcgctttgttgctgtccatgtgcgatcatcaaccttcttactcttactctcgtcaaagtcccgtggatgatcggacggcgatgtctcggcggcggcggtcggaataagaagaagcggagagtaatacacaggaggaaacgccgcgggaatatcaacggtgaagatgagttttatcatcataataaccatcaccgccggtttgagacagccgaggagggtgagaaatgcggctgcggcggtggcggaggaggatgttatggcggcggagattatgatgatcaccggtttgtggtagagagagatgggagtttaacgaaggaggaggaggaggaggagagaacgacgtcgtgtaaaggagaagatcatgatgagtcgcgaataagtgcaagagttgaagccgagagagtgtggttagagttgtatcagattggtcatcttggatttggtagagtctctttcactggaattcaatgatggcgcgccc

SEQ ID NO: 618 - DNA, 2735 bp, Arabidopsis thaliana
gagatccactatttcacggcggaaaagatgcattcgcctcttcagactcagcagccggagcagcgatgctggccgatgacctcgacggtatcggagatcgaggaagttctacccgatgaggactccgatagaacgactcttcttaacggtgaaccgttacgtcgtcgagtttccgggaagtcgccggttgacgaaggacctcgtcggattttccggcagcaatcgttcggtcgcgatatcggccacgcggcagctgaaacgtatctaattactggacttagcttcaagcttcttcgatacctcgggtactgatctcgattgtccctgtttttggatttaggtatattgatgattacgcttagggaggtaattcgtgtagatattagctggctttgccttgctctgcaaagaatccaatgatatataaaagttctctgtcttttattttggaactttactctaattatgaaagttactccatgtgctgttgttttgctcttgtttaacttcttctttttatatttccagttgagcaaggattgatctaattgttaagttttgttcagggtaggctatcgatggatgacaaaattacttgcccttacatgttatgctatgcttcttatgcctggctttcttcaaggtttgatttttttttttttttctttgctgataaataaattcatagaaaggatttttccttttgattaagatgttgttttaattggaaaattagtctttgattcctcgtctcaagtttgtattatcttgtgcagttgcatatagttattttttctcaaagcaagtccggaggagtatagtgtatggagatcaaccaaggaacaggtttgtgtgtgaactgaatagaatcttaccttctcctttcacatcggccttaagtggtatgttgaatgcctgcttttatcacatcacctttgtcttgagattattgatgtatgaacggtgatttgataggctggatctgtacttgccaagcaacaacgatggcttgaagccggttgtggtttttgtgacgggtggagcttggattattgggtgggttgcacatcagatttacagcattctcttctgcataatgttgaaatttgtttgttttacaatttctcgtgtcccacttatagaagttttccccttcactgttcttttgttgatgtttgagttacaaaaagaaaaaagtaaagatcatgatgggctctgtattcttatctcactgactcactcaagtttcatcttcttgtactagctggttgcttgttaataagttcatgtttgctaatcttgtactgatatttaggtacaaagcttggggctcgctcttgggaatgcagctagcagaaagagatatcattgtagcatgccttgactacaggtaaacaaattacacaattcaaaaaactagtcgtcttttatgaatataggaagaactttcatgcatttaccaagcaatccgttctttatggtataggaactttcctcagggaacaattagtgatatggtgactgatgcttctcaaggaatctcatttgtctgcaataacatctctgcatttggaggtgaccccaacaggtttcatctcattggctttgtttttatttaccatttgatcttccaattggtctctcggctattaaactgcatgtatctgcttgtctctctaggatctacctgatggggcaatcagctggtgcccatatagccgcttgtgctctattggaacaagctactaaagaattaaaaggagagagcatctcctggacagtgtcccagataaaagcttattttggattatctggagggtatcttctaagcttttggattcccgttggcttctatgtgctttttggtctacagcaattgatctgcttatcattttgaacttcaataggtacaatctatacaagttggttgatcacttccataatcggggtctgtatcgctcgattttcctaaggtaaatgcttggttaaccaaatcctaaacgcagtctgatcagatctaatgttcaactccaacttgcagcataatggaaggagaagagtcctttgagaaattctctccggaagtaagactgaaagacccagttgttggaaaagctgcttctcttttacctcctattatacttttccacggatcctcagattattccataccatgcgatgaaaggtatatatgatcatcttcttgaagtgatacattactgatgaaaccttttgggatactaaaaccacctcgtttgcagcaaaacttttacagacgctctgcaagctgttggagcaaaagccgagcttgttttatacagcggaaagacacatactgacttatttcttcaggtaagccacataaatcagtcaacttaccttacattgtgtcacacacacaaacacttagctcagtgtgagtacaataaaactcatgagagtattgtttataggatcccttacgaggaggtaaagacgaactctttgatgacatagtctctgtgatacatgcggaggacaatgatgggctgaccaaagactcgttggctcctcccagaaagcgtcttgtaccagagttgttactgaaactggctcgtgagattagccctttctgactgccaagaaaggaaaacaagctttgtttgttgatcctcagtttttacctttgttagttgctgtgtttttaattgcatcagtagaacatcatgtaaataaaaacaaactttgttgctcca

SEQ ID NO: 619 - DNA, 1254 bp, Arabidopsis thaliana
gatgggccgggttaaaccgtacccgccacaacacacctacacctactttccacagtatcgatcctgcaagtcatcgtcttcaattggcatctgaagaagaagaagaagaagaaaggagccatgacaatgtttagatctatctccatggtaatgctgctcgtcgcactagttacattcatttctatggtttcttctgctgcttcgtccccagaagccgactttgttaagaagactatctcttcccataagatcgtcattttctccaaatcctactgcccgtatgtctctttctctgctcatgtttaatcactttttatccgattcgcagaaaaattggatcttgggtgacttcaatttgcgattttgttttttagatcttaatatctgaaatatgagtgaaaacttgaacccaatgaacttgtattcgttagatttggatttttatgagacaactttgttatctctgtttacaaatggtggttgaaatcaatatggattttcgtttaagatatattcaggttcagttctcagtatttgttctctttgcttttcctttggccttaattgagttgtgtagagagatcatgtacctatgtatatgactcatctctacttttcctttgcttccttgtggtttggtcaacagctactgcaagaaagctaaatcagtgttcagagagctggatcaagttccttatgttgtcgagcttgatgaaagaggtgtgttttaaggttaaagggaatcatgtcttcatcatccaacaatgtttcttagctctcagacatttctgtcatttgaaactttgtccgatcactatgtagaagattcatttgtgactaatggttggtaaaaatttggtcttgcagaagatggttggagcatccagactgcacttggagagattgttggaaggcgaacagtaccgcaagtcttcattaacggaaaacatctcggaggatcagatggtatacttaacactccttttccttcaacaaaacgtctttgcttatgccaacatttgctgatcgatagatttatctttgtttctggttatagataccgtagatgcgtatgagagcggtgaactcgccaagcttcttggtgtttccgggaacaaagaagctgaactctaggttatatatagttggaagaattgataacactctctgtgatgcttaggtgtaagcaattcaatttccatttgtattgtgttctgcagcttgatcatgaccttgtgacagcttgatcttgcc

SEQ ID NO: 620 - DNA, 3583 bp, Arabidopsis thaliana
aattggtgctataggaatttgatccggtttaactgaaaccgaaaacggtgcgtttaaagtcaccaagacgaagaaaaagggttttagtttttgtgaggggagagagactgagaggttatcatggtggcgcgtcgtaacaaaccaaaagcgccgctggtgaaacaccgattttccggcggcgacagtcacaaaccaaaaccaccaccggctactaaacaaccattttccggcgtcgagagccacaaaccaaaaacatcaccagctacaaagcaaaagttttccggcgtcgagagtcacaaaccaaaaacgccgccgggaaaacaacgattttccggcgccgagagtcgcaaaccaaaaacaccaccagctactaagcaaaagttttccagcttagagagatcagctctctacgccagaagagaagcagctaatatactccgtaccgttctccgtggtgacgccgagcgacgagccgttgcttccatcaaatcactcgtcttaagtccttccgttcgcaacaaacgcggcactttcgctcttgtctgcgagactctcaaatgtaactaaacttcttcttcttcttcttcgttcctaattttgagcttaaggaactaatttgttgtgtattcagatcttactgtgattaaagatgttcttgatatagctaatgtattgaatagtaaatggaaggtatgtatttgttcatatgaatttgctaaaattgctctgtttcacttatctttaatgcttagtttacttttgtttgtagaggcaagagccattggtcttcatcgtttgctacgatatcctctttggcaaggtaggtggtcgccagttgcgactggttctgttgtaatagcttaattcaattttctgtgatgaattaagatgttttggtttactagaagaggaatttgtgattgtaggatactccatcaattggtgatgcagagaagtttcttatgcggcataaagaggcgttattgtcaggtttagctacgcttttagtgaggaagaaagtcgatagtgttgatcagttgttgggttctaagcttactggtattttgttaccctcctttatataatgtgtttcacttacttttggcttttgagtatgtttctgtagcttgatttttaaatttggatgcaggtcatttgaaaccacggtatgttcgtgttaatacgcttaagatggatgtggattctgcagtgcaggagctggagaagcattacacggtactttccaagttttttatataaaccttgaagaatacttgtgtgctagatatgttgtttagttctcgcaggatgagtgttagaattagttattgtggaagggaggtctagtttaagtcattcaccgggggagttttctctgaatcctcgtatagttagtgatgttaaaatcttggatgtgtacaatatatgtgaactgtgctttctatgatgtcacaatcttctctttgttatgagatttcattttaactcgtattttttcactataaaaacaggtgcagaaggacgagacagttcctgacttgttggtgttgccccctggcagcgatttgcatgctcatcgtttggttgcgaatggacgtatatttttgcaggtaaattgtgaatgatctttgtgaattctgtttgatatttggttaatttgactgacatttattctttcaaatgataggggaaagcaagttcaatggtagcagcagcactgcagccacaagcaggatgggaggtaggccacagttctcgcattcatttaccagtatttttccatttgacaaaaaatgtcccatttggtgtttctcatggtgattgtggaatagacttaatgtatcttgtctgcctagttaatgtgctttatttttcctatgttatcaaggttcttgatgcctgttcagctccaggaaacaaaactattcatcttgctgctcttatggaaggacaaggaaaaatcatagcatgtgagctaaatgaagaacgagttaagcgtttggaacatactataaagctctctggtgcctccagtatccttctcttgccttctttctcgtataactcttttagcttctgtttgataatttgtcacaagtgagtttaattacatggaatttgaagaaaaaacttgattggataaatgcttgtcaagtcatgtccgtctatgagggcttttcttaatgccaatttgtagatatcgaagtctgtcatggtgattttttgggcctaaatccgaaagatccttcttttgcgaaggtaagcattacttagtctgtagcatgactatctatttttcttattgttccatgaaaggttcccacaccaacgttcttaaaatcatttcttgattttggatctatttaagatagtacaagtccagtattttcattatcttttgttttgatagtctaccgtgaagagtcactctctaaaatgaacaagagtacccatctgatagcattgtctagagtcttgtagcaaaagcagatatagtcatttgagttattcttgatgcttgggtgtggctgactattgcagattcgggctatattgttggatccttcttgctctggctctggcacgattacagatcgtttggaccatctccttccttctcattcagaaggtattagctgatcttctgtgtgtgtgtgttatgttacgaagtgactgaaccttaacacacctttccatgtagataataacatgaactatgactccatgagactgcacaagctcgctgttttccagaaaaaggctcttgcccatgcactctcctgtaagtttatatacttgtctcatgttagctaaaacaaaaaatgagggttttacttagcttttgaagaatctcccaaacacgttgatccatgttaaatttcccctctatgaatgcataaaccatatatacactaagagaatcttactctatatgtagatatgaatgagaactaaaaacttatatgttttaattagttccaaaggttgagagagtcgtatacagcacatgctccatctaccaaatagaaaacgaagatgtcgtctcctctgttttacctctggcatcatccttgggcttcaaacttgctaccccctttcctcagtggcagcgtcgtggtctccctgtatttgcaggatgtaagtatcacccttaccatcgggtttcacctgattgactctgtttctaaccttttgatcatgttggctttggcttgcagctgaacatctacttaggatggatccggtggaggacaaagaagggttcttcatcgctttattcgtcagggcaaacaaactcgataacccaaaatcgtctgaacttcccgatagagtgtgtagacgaagacccaaagaaagaaccatgcagttacatccctatctttgtcccaaaatgttcagagcttggagtgggaccttgcacaggctcaagactaggttcctgttatcacgtaatggttgttgaattttcaattttgtttatgcctttgatcttcatgttgtcgtcaaaattttgcaacaaaggcatgaaaggaacatcgtaaggtaaaatcagaacctctttaactttttatcacattacaaa

SEQ ID NO: 621 - DNA, 2253 bp, Arabidopsis thaliana
aaagaactcgaagatgatttgtcaaaattaaacttgattctgtagatccgtgagttgaatcagatattaacgtgtctctatgtttctatgtatcaatttggtttgataaggttacttagaatggcacaagaagccgatgggatcagattggaccaaagacatgggaaggctcgagtgagagttggaagagtttggcgtcatgctcatgatggatctcatcactttgttgaatggaatgttagcatcagtcttctctctcactgtctctcttcttaccgtcttgatgataactctgatattgtcgccacagataccattaaaaacactgtaagtcaaccaaaatatttgttggtcttagagtcattctagtgaacaaatgtttctgttcttattcatggttatatcctagtgtctgacaaatgttttatgttggaatgaaggtttatgtgaaagccaaggaatgtggagatcggctctcggtggaggaatttgccatacttattgggaaacacttttgctcattttatccacaggtatgtatgcactatgcactatcaccatatcttttttagtaagcaattggatatattcaccttaaagatgttttattcattttgctgttttgtttcctctctgtttaaccaggtatttactgctatcgtgaatatcattgagaagccctgggagcgtgtctccatcgatggaaaaccacatttacatggttggttctgacacttttttctggaacgaatatttgctatagtttaatggtttttctaaatcaatcttttgttttgaaggttttaagcttgggtcagagaaccatactacagaggcaagagtagaaaagtctggtgcattaaacttaacttccggtattggaggactagctctactgaagacaacccaggtatataaacatctttctgtagatatatgtttttttgttagaaaggtgttgaattgtcagtgttatcactgttatattttggataatggcgagttagatgtgttccacggtctttggacaagcgttttccagttttttctcgtcaataaagaagctccagtagtgtttccatattttgtaaaccactagatctcggagacaaatattatacctggcaatctgtagttttagagatagaagtctactctaacttaggaactttatggagaggaatttcaaagaagaatgatatgaacaatgagtgaagatctagatttgatgttattattgtctatctagtttgtatcttaatcctaggatattgacaataatggatgtcaaaagacaagatctgataattgattgttcacaaaagccgctcttatgcaaatgaacagtcaggatttgagaggtttgtcagagacaaatacaccattctgcctgaaactcgtgagcgaatgctggccacagaggttaatgcatcttggaggtatgtgttaattagtgatgttacatttcttatttgtgattgattcttgaaaccgacatacacgttcatgatgacaggtactcgtatgagtcagttgcaagcattccaacaaaaggactctactttagcgagaagttcatggacgttaagaaagttctgatggatactttctttggtccaccagaaactggtgtgtatagcccttctgtccaacgcactctctacctcatgggaagcgccgtactgaaaaggtatcacatatcagtctatatttatttcgctgtttgtgtgatgatgtgattcttgccatgataaaggttcttattaacatgatcaggttcgctgatgtatcatcgattcacctaaaaatgccaaatattcattttctaccagtaaatctttcaacgaaggaaaacccttcaatggtgaaggtaagaacctctatgtgatgttgtctttatgatgaaaccacaaaacgtaaacgaaaatgataagtagataagtagcagcagtaatacatagttataaacttaaaatcagacaacaaaaaagccgcataaaagctaataatttcagggtatgaatcgtttccaatgacttgcatttgcagtttaaagatgatgtgtacctgccaaccgatgaacctcatggatctatagaagcaactctaagccgtataacctcgaaactatgaggttttaagacaatacatcatacatggaaatatcaaacacaatttcacaggttctgcaacttttggcgtttgcctcgtttatgaaataacaatttaaatgaagtgtgtaaggtcaacttt

SEQ ID NO: 622 - DNA, 2430 bp, Arabidopsis thaliana
tttatatagctacctttatttatgagtaatggtttagaagttgtgatgtttaatacactctgtttctgttttatggctcatagggtttaaaaggcagagaacataaaaaagagtgcaaagatgtttacttgcataaattgcactaaaatggcagacagaggtgaggaggatgaagaagatgaagcgcgtgggagcaccactcccaacactaaagaagccgttaaaagcctaactacacaggtctctttctctccctaaagatcaattctttcctttgttgatccttaagactctttttcactttacttttgttgcttttttcctaattgccttggtcttgaaataaacaaagccaaattgagaaaaatggtcctcttaaactgttttaacaattgtagtgaaaagtgaaataaacagttttgaaatttggctgtcaagtacaaaagtatagaggttactgtagttaaggctgcaggttacaaacaatattaggatctttagacaagattttacagtgatgcaacatcacttctctggaatctattacaaatctctctttaataggttatgtcagtgttttattttctgcactctatgtgactagacataaaaaatctagcaaccaatttagtaaaataattaaaatatcaaaattatgtttcacattgaatttaccaatgtagtggctgatgatttgtgtggaaaaggctaatggagtcacgccttgttgaacatgatttttgcttgttattgaagattgatctatatactttcctagaataagtccctagtgggttcttatttagattaggatggtggggcaagtatatagtaaatcaaaagaagcaaaaaaaagaagctatgattatgttctagtcatggagaagacaagatgaactatattatttgtttcaaattatatcagatcttctagctttattcatgctctttatgaatgatgatagtagactctttttttcctagttgggatcaaagaaaaatcatccatttcttgactcttttttttcatgttagtagactttattgcttacttacctgttctgtccaacattattctgtccaatgatcacctagtaaggttgtgttttaagattttactttaatcaacttcttgggcacggatgctatgcagatcaaagatatggcgtcgaaattctcaggttctcataaacaaagcaagccaactccgggctcttcgagcagcaacttgaggaagtttccggattttgacactgcatcagagagtgttccatacccttatcctggtggaagcacgagctccactcctgcttgggacttaccaagatcctcctaccatcaatctggacggccagactcaagattcacatcaatgtatggcggtgaacgtgaatccatctctgctcagtcgtgtgatgtggtactagaggatgacgagccaaaggagtggatggctcaagtagagcctggtgttcatatcacatttgtctcacttcccagtggaggaaatgatcttaaacggatacgtttcaggtatttgaaacccattctctccataacattttcaagaatatgtttcacttaaggacatagaatgattcaatgtgaaatgaagctaacatatacttgtatcgtttttgaagccgggaggttttcgacaagtggcaggctcagaggtggtggggtgagaactatgacagaatagttgagctttacaatgttcaaagatttaaccgacaagctcttcaaactcctggtagatccgaggaccaggtaaaacacatcactctttagatcacaactttaagagaaggtttatgagtaatcttatctttcaacttctgtttgtttcttctaacagtcgcagagagattcaacttacacaagaattgattcagcaagagaaagcagagactggacacaaagagacaacaacttcagaccaccaggaggcagtgtccctcatcatttttatggacctccaatggacgcagcaagaatcaccacctcatcgagggacgaaccgccttcaatgagtaatgctagtgaaatgcaaggtgagtgggttgaagaggacgagcctggtgtctacattaccatcagacagttaccagatggaactagagaactacgccgcgtcaggttcaggtaaaccagagaaccgattttttcagcactatcctaatttatttggcgattaaccgtaaacctttcgaaccgggtttgtacagtcgggaacggtttggggaagtgcatgccaagacatggtgggagcagaacagggacagaatacaaacccaatacctctaagaggacaaaaaacgagatcaatattgtagtcttctttaacacaacaaaggtatacacaaaaatcagaattttgttcatcttctaaaattttgaagaaaatcagaatgtgatatgaaaaca

SEQ ID NO: 623 - DNA, 808 bp, Zea mays
ttcttgtttgttgattaacccttaattaatccgggcgcgcctgatttatcacaagtttgtacaaaaaagcaggctcctgcaggaccatgaagctgaagctcctctctccctgccttctcctcctcgccttctttgccaccgcggcgtacgcggcgtcggcgtcggcgtcgcgcgcggcggccgtcgtcaggggcgcgggcgccccgtcgcagtcggagttggagtcggacccggagaaccagtgcgtgtacacggtgtacgtgcggacggggtccatctggaagggcggcacggactcgaccatcggcgtgacgctgctgggccccgacggcacgggcatccggatccgggacctggcggggtggggcggcctcatgggcgccggccacgactactacgagcgcggcaacctggacatcttcagcggccggggcccctgcatgagccaggcgccctgcgccatgaacctcacctccgacggcaccggcgcgcaccacggctggtactgcaactacctcgaggccacggtcacggggccccacctcgggtgcgcgcagcagctcttcaccgtcgagcagtggctcgccaccgacgcgtcgccctaccgcctgtacgcggtcgtcgacaagtgcaagacgaagcggcaggagccgcgacgctcgccggccggcgaggccgaggccaccgtgaccgcgctctaggtacgaccagtagtaaatcatcgacagaggctagctcctcgagacccagctttcttgtacaaagtggtgataaattggagctctgcagagctttcgttcgtatcatc

SEQ ID NO: 624 - DNA, 1704 bp, Zea mays
ttcttgtttgttgattaacccttaattaatccgggcgcgcctgatttatcacaagtttgtacaaaaaagcaggctcctgcaggaccatgtcagcggctcgtcgtcggtccccaatccccgttctcctcttcttcctcctcctccactccgcgtcgccgagccccatcaagacggtggtggtgctggtgatggagaaccgctccttcgaccacatgctggggtggatgaagcggctgaacccggagatcgacggcgtgacggggcgggagtggaacccggccaacgcgtcggacccggcggcggggcgcgtctacttccgcgacggcgccgcgtacgtggacccggacccgggccactcgttccaggagatccggcagcaggtcttcggctccgacgacgacgccgcggacaacccgccccgcatggacggcttcgcgcagcaggcgcgctccatcggcggcggcgccatgtccgacgccgtcatgcgcggcttcaaccccgccgacgtcgccgtctaccgcgagctcgtctcgcagttcgccgtctgcgaccgatggttcgcgtccgtgccgtcgtccacgcagcccaaccgcctgttcgtccactccggaacgtccggcggcgccaccagcaacaacccgacgctgctggcggagggctacccgcagcggaccatcttcgacaacctccacgacgccggcctctccttcggcgtctacttccaggacgtgccggcggtgctcttctaccggaacctccgcaagctcaagtaccttctggacttccacccgctgcgcccctccttcgccgaccacgcccgccgcgggacgctccccaactacgccgtcatcgagcagcactacctggactccaagctggacccggccaacgacgaccacccgtcgcacgacgtgtaccagggccagatgctcgtcaagtacgtctacgagacgctgcgcgccagcccgcagtggaaccagacgctgctcgtcatcacctacgacgagcacggcggcttcttcgaccacgtgcccacgcccgtcgccggcgtgcccagccccgacggcatcgtcggcccgccgccctacaacttcaccttcgaccgcctcggcgtccgcgtcccggccatcctcgtgtccccctggatcgacaggggcaccgtcgtccacgggccccacggccccacgcccacgtcgcagtacgagcactcgtccatcccggccaccgtcaagaagatcttcggcctgccgcaggacttcctcacgaggcgggacgcgtgggcggggaccttcgagggcgtggtgcaggggaggaccgagccacgcaccgactgccccgagcagctgcccacgccgacgaggatcaggcagacggaggcggacgaggaggccaagcttagcgagttccagcaggagatcatccagctcgcctccgtgctcaacggcgaccaccacctcgccaccctgcaggaccggatcaagaacgacatgaacgtcagggaaggcatcgactacatgaaggccgccgtcaaacgctacttccaggccggcgcgtccgccagaaggatgggcgtcgacggcgaccagatcgtcaagatgagaccctccctcaccaccaggatccaacgcccatagctcgagacccagctttcttgtacaaagtggtgataaattggagctctgcagagctttcgttcgtatcatc

SEQ ID NO: 625 - DNA, 1206 bp, Nostoc sp. PCC 7120
ttcttgtttgttgattaacccttaattaatccgggcgcgcctgatttatcacaagtttgtacaaaaaagcaggctcctgcaggaccatggctaaagcctcagaatccttggatttgtctgtcaacgagtctacagataaagctctagaccgcgattgtacaaccttatcccgtcacgtcctccaacaactccaaagtttttccgcagatgcacaagatttgagtgcattaatgaatcggattgctttagcaggtaaattagttgcccgtcgccttagccgcgctggtttaatggaaggggttctcggatttactggggaggtaaatgtacaaggtgaatccgtcaaaaagatggatgtctatgccaatgacgtgtttatctcagtgtttaagcaaagcggcttagtttgtcgtcttgcatctgaggaaatggatgaaccatattacattcccgaaaattgccccataggtcgttacaccttactgtatgacccaatagacggttcctcaaacacagatacaaatctcagtttgggttccattttctctatccgtcaacaggaaggtgatgatagtgatggccaagctaaagacctcctcaccaacggacgcaagcagattgcggcgggttacattttatatgggcctagcacgatgctagtttatacaatgggtacgggagttcactcatttacccttgatcccagcttaggagaattcatcctcagcgaagaaaatatccgcattcccgaccacggcgcagtttacagcgttaatgaaggtaacttctggcaatgggaagaatcaatgcgggaatatatccgctatgttcaccgtacagaaggttacacagctcgttacagtggtgcaatggtgagcgatatccatagaattttggtacaaggtggtgtgtttctctacccagggacgattcaaaaccctgaaggtaaattacggttgttgtatgaatctgctcctttagcctttttaattcaacaagctggtggtcgggcaactacgggattagtagatatcttagatgttgtaccgaaaaaactacaccaacgtacacctctgattattggtagtaaagaggacgtagccaaggttgaatcatttattcagaatggtcattaactcgagacccagctttcttgtacaaagtggtgataaattggagctctgcagagctttcgttcgtatcatc

SEQ ID NO: 626 - DNA, 1830 bp, Sinorhizobium meliloti
ttcttgtttgttgattaacccttaattaatccgggcgcgcctgatttatcacaagtttgtacaaaaaagcaggctcctgcaggaccatgtatcgttacgacgaattcgaccacgccttcgtttccgcacgcgtcgagcagttccgcgaccaggtccagcggcgactgtccggtgaactcgcggaggatgcgttcaagccgctgcgcctgatgaacggcgtctatctgcagctccatgcctatatgctccgcgtcgccattccctatggtacgctctcgagccggcaaatgcggatgctcgcccatatcgcccgcaaatatgaccgcggctacggacatttcacgacccgccagaacatccagtacaactggccgcgcctttccgacacgcctgatatccttcaggaactggcaagcgtggagatgcacgcgctgcagacctccggcaactgcattcgcaacgtgacggcggaccatttcgccggtgccgcggctgacgaagtcgccgacccgcgcccctatgccgaaatcctcaggcaatggtcgagcgtccatccggagttctcgttcctgccgcgcaagttcaagatcgccgtgaccggcgccgagcgcgaccgcgccgccattcaggtgcatgacatcggcctgcacctgaagaaggacgagaatggcaagcttggctttgccgtctatgtcggcggcgggcagggccgcacgccgctgattgccaagaagatccgcgacttcctgccggaagaggatctgctttcctacacgaccgcgatcatgcgcgtttacaacctccatggtcgccgcgacaacaagtacaaggcgcgcatcaagatactggttcatgaaaccggtgccgaggaactggcccgtcaggtggagctcgaattcgccaatctgaaggacacggaactgaagctgccggacgcggatatccaggcgatcgctgcctattttgcgcccgcgacactgccgaaccggacggagggctggggcagtctcgcccgctggaagaaggccgatccggaatttgcccgctgggtgcaccagaacgtccagccgcacaagcatcccgactacggcatggtgacgatctcgctgaagccgatcggcggcattccgggcgacgcgagccacgaacagatggatgcggtcgccgatatcgccgaggaatatgccttcgacgagatccgcgtcagccatgagcagaacctgatcctgccgcatgtggcgcttgccgacctcgagccggtctatcgcgccctggtcgccgccggcctcgccactgccaatgcggggctgatcaccgacatcattgcctgtccggggctcgactactgtgcgcttgccaatgcacgctcgattccggtcgcgcaggagatttcgaaccgtttcggctcgcccgagcggcaggccgaaatcggcgagctcaagatcaagatttccggctgcatcaatgcctgcgggcaccatcacgtcggccatatcggtcttctgggcgtcgaaaagaagggcgcggagctctatcagatcacgctcggcggctccggcgacgaacatacatcgatcggcgagatcattggtcgcggcttcgagccggaaagagtgaccgacgcggtggagacgatcgtcgatacctatctcggcttgcgccgggacaagtcggagaccttcctcgaagcctatcgccgggtggggccgcagcctttcaaggatgcgctctatggcggcggtgcccaggcagccgcgtgactcgagacccagctttcttgtacaaagtggtgataaattggagctctgcagagctttcgttcgtatcatc

SEQ ID NO: 627 - DNA, 1584 bp, Bacillus halodurans
ttcttgtttgttgattaacccttaattaatccgggcgcgcctgatttatcacaagtttgtacaaaaaagcaggctcctgcaggaccatgtttcgcggaaagctatatattgatgggacgtggactggtgatcttttagacacatttgacgtgaagaacccagcaaccggtgaggttgtcggggtaatgccgaacggaggaaaggcggaagctgctgcagcgattgaagcagcccagcgcgcttttcttaaatggcgtaagtacacggccgcagagcgtgcaaactttttgatgacatggcatgatttattgctacaacaaaaagaagagatagctgaaatgttaacgatggagatggggaagccgctagctgaagcaagaggtgagattgaatactcagcttcgttcattcgctggtttgcagaagaaggaaagcgagtctacggacggacggtccctgcttcagctgaaaataagcgaattcacgtgcaaaagcagcctgtcggggtcgtcgctgcgattacaccttggaactttccagctgcaatgatcgttcgaaaaatggctcctgcattagcggctggctgcacatttgtcggtaaaccagcagagcttaccccgctaacagcggtaaaaatagttgagctgtgtgaagaggctgggtttccaaaaggggtcgtcaatcttgtatgtggagatgcaaaagaaataggggaagaaatgacgagccatgagcatgtccgaaagttaacgttcaccggatcgacggctgttggaaaattgttgatgaaacaaagtgctggacgaatgttaaatttgtccttggaattaggtggtcaagcaccgatgatcatttgtgacgatgccgaccttgataaagccgtggcaggtgtcgttgcctcgaaatatcgaaatgcaggacaaacgtgcgtttgcggaaatcggatttacgtccaggaaacgatcgttgatgaatttgttaagaggctaaccggtaaggtagtacagctcaaggttgggaatggtctagaagagggagtacatatcgggccactcatcgagaagaaaggttatgaaaaagtgaaagctcatgtagacgatgcggttgcaaaaggggctcgtgtcgtgattggggggaaaggacaagaaggaaacgatagctatttctatgacccaaccattttgaccgatgttcatgatgaaatgctcgttatgcaagaggaaacctttggtccggtggcgcccattcaaacatttgcaacagacgaagacgtgattgaaaaagcgaatggaacacgctatggactagcggcatatttctttacagaaaattatgcacgagggattcgcttatccgaagcgttagattttgggattgttggttggaacgatggagcaccatccatagctcaagcaccgttcggtgggatgaaggaaagcggacttggccgtgaaggtggccaggaaggaattgaggcatttctggaaacaaagtttgtctctattggtctatagctcgagacccagctttcttgtacaaagtggtgataaattggagctctgcagagctttcgttcgtatcatc

SEQ ID NO: 628 - DNA, 2877 bp, Pseudomonas syringae
ttcttgtttgttgattaacccttaattaatccgggcgcgcctgatttatcacaagtttgtacaaaaaagcaggctcctgcaggaccatgaccagcatggccatccagaccactcaggtgacggcatccacctgctgctattgcggcgtcggctgcggggtgctgatcgagcatgacgggcagcgcattctcggcgtcagcggcgatccccaacacccggcgaacttcggcaagctgtgcagcaaaggttcgagcctgcacctgaccggcgacatcgaagcacgggcgttgtacccggagctgcgcctgagcaaagggctggcgcgcagcgtgaccgattgggacaccgcactggagcacgccgccaccgtgtttgccgagagcattcgcgaacacggccccgacagcgtggcgttctacatttccggccagttgctgaccgaggactactacgcgttcaacaagctggcccgcgcactggtcggcaccaacaacatcgacagcaactcgcggctgtgcatgtcttcggccgtggccggctacaagcgcagcctgggggccgatgcgccgccgtgcagctacgaggacctcgagctgagcgactgcgtgatgatcgtcggcagcaacatggcctacgcgcatccgattctgtttcgccgtctggaagaagcaaaaagccgccgtcccgcgatgaaactcatcgtcatcgatccgcgtcgcaccgatacctgcgaactggcggacctgcacctggcgattcagcccggcaccgacgtcgcgctgtttcacggcatcctgcacgtattgatgagcgaaaacctgatcgacccgcaattcattgccgcccatacgctgggctatgacgaactggcagcgctggtatgtgattatccgcctgaacgcgtggcaaacatctgcggtatttcacagcaacacttgcacacctgcgcccgctggctaggcaagtcggcgggctttctgtcgctgtggtgcatgggattgaatcagtccactgccggcagcgcgaaaaacagcgcactgatcaatctgcacctggccaccgggcagattggccgacccggcgccggccctttctcgctcaccggccagcccaacgccatgggcggtcgcgaaaccggcagcctgtccaacctgctgccaggccatcgcgatgccgccaatcccgaacaccgcgccgaagtggccgagtactggggcatcgacagcctgccggctactcccggcctgtccgccatcgagctgttcgagcaactgcaaaacggcacgatcaaagccttgtggattgcttgcaccaacccggcacaatcactgcccgaccagaacagaatccgtcaggcgctggaaacctgcccgttcgtggtgcttcaggaagccttcaagaccaccgaaaccgcacgctttgccgacctgctgctgcccgccgccagttggggggaaaaggaaggcacggtaaccaactcggaacggcgcatctccaatgtgcgcaaagccattcaggcacccggtgaagcccgttcagactgggccattaccgtggatttcgcccagcgcctgcaaaagcgcctgcagccagaagcgcctgcactgttcgacttccagacgccaaaatcgctgttcgatgagttcaagggcctgacggtcgggcgcgatctggacatgtccggtatcgaccgcgaactgattgaccgccaaggcccacagcaatggccgttcccgacaggcgccagcgtgggcacaccgcgtctttatctcgatggtattttcccgacggcttcgggccgcgcacagtttttggccgagccctatatcgccgcccgagaattgcgtgacgctgaatatccactgacgctcaacaccggcaggctgcgcgatcaatggcacggcatgagccgcaccggcaccgccgcgcgcttgttcgggcatgtcagcgaggcgctgttgagcctcaacccaaagcaaatgcttggccatgacctgcagaacggcgatctggtcaaactgatcagccgacgcggcgaactgctgctgccggtcagcagtgatgacagcgttgtcgccggccaggcttttttgccgatgcactggggcgagcggtttctcaagggcggcgtgaacgtcctgacccagcctgccttcgacccgctctccaaacagccggagctcaagcactccggggtcagaatcgaaaaagcccggctgccctggcagttcttcgccttgatcgagggcaatgtgcaacagcacatggagcgcctgcgaccgctgtgcgaagcgttcacctacctgagcatgggcctgatcgggcgagaacgaccggcactggtggtgcgcgcggccagcaccgaagcgccagactcgacgctgctgcagcgcatcgacagcctgcttaacctcgatgaaggcccggtcatggcctacgacgaccccaagcgttcaatcggcaaacgggtgcggatcgacaacgggcgcatcaccgccatccgcctggcgggagaaacgctcgcccagcactggctacagacgttatggctgcaagagcgtgccgatcccgcgctacggcgatggctgctggcgcctttgagcagcgagcccggcaaagactcgaccctgtctcgcgacaagaccttgtgcaactgcatgaacgtcagccagagcacggtgatgagcggtatcgagcgaggcctgaacctgaatcaactcaaaacccaattaggctgtgggacgcagtgcggttcgtgtgtcccggaaataaaaagactgatcaacgccgtggcagtgactgaatgactcgagacccagctttcttgtacaaagtggtgataaattggagctctgcagagctttcgttcgtatcatc

SEQ ID NO: 629 - DNA, 2454 bp, Nostoc sp. PCC 7120
ttcttgtttgttgattaacccttaattaatccgggcgcgcctgatttatcacaagtttgtacaaaaaagcaggctcctgcaggaccatgagaatagacgtagaatcacaaaatattaatgttactagtttaaaggaagcgccaattcatctttccgggcaaattcaaccacatggtgtgcttttagttttggaagaaccgggtctgaaaatattacaagtgagcaataatacctggggtattttgggtatcaatgctgaaaatatattacagaaaaaattagaagatttactcgattcctttcaaatagaacggattcaatcaggcttatcttctgggaatctggaatttattaaccctacaaaaatttggattagaaagaagggggatgattacgcagtatttgatgcggttttccatcgcaatacggaaggctttttgattctggagttagaaccagcaattactcaagaaaatatcccgtttttaagcttttatcatttggcgaaagcttcaattaatcagttgcagaaaacagcaaatttgcgggatttttgtcagataattgtccaagaagtccgaaaagtcaccgattttgatcgggtaatgttatataaattcgatgatgatggacatggttcagtcatcgcggaagaaaaactagacagcctagagccatacttaggactccactatccagaatcagatattcctaaaccagccagaaaattatttatttctaattccatccgggtgattcccaatgctcaggctcaggctatacagatgatacccgctttgaacccagtgagcgatcgcccggttgatttaactaactcaattctcagaagtgcggctaactgtcacctggaatatctacataatatgggtgtcggtgcttccttaactatctcgttaattaaggacaataagctttggggattaattgcttgtcatcacctgtcagccaaatatgtttcctatgaattgcggaaagcctgcgaatttttgggacgggtgatatttgcggaaatctccgccagagaggaaacagaagattacgattatcgaatgaatctgacccatattcaatcactcttggttgaatatatgtcccaagaagataactttgttgatggtttaattaaacatcagccgagtcttctagatttaaccagcgctcaaggtgcggctgtatgttttggcgaccattgtacattaattggtgagactcccaaagcagaagatttagttttcttagtccagtggttgaagaataacgtcgaggaagaagttttctacacggattccttaccgcaagtttatccagatgcggaaagatataaaaatgtcgccagtggtttgttagcgattcctatttcccaacgtaattatgttttgtggtttcgaccggaagtaattcaaactgtaaactggggtggtgatcctaatcaaccctttgaagttaataagttagatgggaatgtgcgcctctgtccgcgcaaatcctttgaactgtggaaagaaacagtccgcctcacctctctaccttggcgatatgtggaaattagagccgccttagaattgcggaaagcaattgtgaatatcgttctacgccaagccgatgaactggcgcagttagcgcacgatttagaacgttccaacgccgaactgaaaaaatttgcttatgttgcatcccatgacttacaagaaccgctcaatcaagtagcgaattacgtgcagttgttggagatgcgctatcaagatcaactagatgcagatgccaacgagtttatcacctttgccgtcgagggtgtgagcttgatgcagacgttaatcgatgacgttttggcgtattctaaagtagatacacaagcgatcgcttttcaactaacagaagtagaaaaagcattagacaaagctttgggtaacttgcgccaacgcatcgccgaaacaggcgcaaacattactcacgaccccttaccaaccgtcatggctggtagtacccaactcatgcagctattccagaatttgatagccaacgccattaaattccgcagtgaggaagcgccacaaattcatataggtgcagaaagactagaagacgaatggctattctcagttagagataacgggattgggattgacccccaatttagtgatcgcattttcgtaattttccaacgcttacacacacgggacgagtatcatggtacaggcatgggtctagcaatctgtaagaaaattatcgaatgtcaccggggacgaatctgggtagagtcacaacttggtgaaggtgctaccttctactttacgataccagttggaggtcgagagcgtgagcgtagaaacggaagaaaaacacagaacaatctttttagttgactcgagacccagctttcttgtacaaagtggtgataaattggagctctgcagagctttcgttcgtatcatc

SEQ ID NO: 630 - DNA, 2147 bp, Nostoc sp. PCC 7120
ttcttgtttgttgattaacccttaattaatccgggcgcgcctgatttatcacaagtttgtacaaaaaagcaggctcctgcaggaccatggttaaatctgctcctcctccaaccactggccgtaaaccttctaaagtcgaagggcttaaagaaaacagtaattttttacgtgaacctgtagcaacgcaaatccttgaggatactactcattttactgaagatgcggtacaaatcctgaagtttcacggttcttatcaacaagataatcgtgacaatcgcaccaaaggtcaagagaaagattaccagtttatgctgcggacaaaaaatccgggtggcttggttccgccgcagctttacttggctttagacaagctagctgatgaatatggcaaccataccttacgagctaccactcgtcaaggtttccaaatgcacgggattttaaagaaaaatctcaaagcagcgatcgctacaattgtgagaaacttaggttcaactttgggtgcttgtggcgatatcaaccgcaacgtcatggctccaccagcccccttcaaaaaccgggctgaataccagtatgcttgggaatatgcccaaaatatcgctgacttactctcaccccaaacaggtgcttattacgaaatctggctagatggagaaaaagccatcagtgcggaagaaagtccagaagtaaaagcagctagacaaagcaatggtaacgggacaatcattcacgacaccgaagaacccctctacggcacttattatatgccgcgtaagtttaaggtgagtgtgactgttccaggggataattccattgatttatattcccaagacctgactctggttgttctgactgataaaaaaggcaacctagaaggatttaatatctttgctggtggtggtttaggacggacacacaacaaggaagaaacttttgctcgattggcagaccccattggctatgtagccaaggaagatgtgtatagtgccgtcaaagctattgttgcgactcaaagagattatggcgatcgcactgaccgccgtcacgctcggttaaaatacttaatcaatgattggggtgtggataagttccgcgccaaggtggaagaatattttggtaaacccattgcccctttcaagcaactaccagagtttaaatatcacgatttcctgggttggcatgaacaaggcgatggcaatttatttttaggcatttccatcgataacggtcgggtaaaagatgaaggcgcgtttcaactgaaaaccgccttacgggaaatcgtcgagcaatttaacctacccatccgcctgacacccaaccaaaacctgattttctacgaaatcaccccagagaacaagccagcaattcaagccattctcgaccgttgcaatgtggtttccgaccccaccaccattgagcctttagtccgttatgcaatggcttgtccagccctacctacctgcggtttggcaatcacagaatcagaaagagccatccccggcattttggagaggattcgtactctcttagataaattgggtttacaaaatgaacattttgtggtaagaatgacaggctgccccaacggttgcgcccgtccttacatggcagaactaggctttgttggtagcgcgccggaaagttaccaagtgtggttagggggttcacccaatcaaacacgcttggcacaaccttatgtagagaaactgcacgataacgacatagaaagcttcctagaaccgatttttgtgtatttccgcaaatatcggaagtctggggaaagttttggcgatttttgcgatcgcgtcggctttgatgccattcgtgaatttgttgccgagtatcaaccggaaacaacaccagtcaccatagaaccagaacagcctgaagttgtatctaagtcacgtaaagctcggtatcgggtcagcctgcacgatgatttgtataacaaagtgaaggcgacagcgacaagtcaaggccggtcgatgactgatttagtcaaagatgccctagaggcttacttccaaagcctttcttaaagaaggggtcaaatacagacctaacccccagccccttcctcgagacccagctttcttgtacaaagtggtgataaattggagctctgcagagctttcgttcgtatcatc

SEQ ID NO: 631 - DNA, 2904 bp, Chlorobaculum tepidum
ttcttgtttgttgattaacccttaattaatccgggcgcgcctgatttatcacaagtttgtacaaaaaagcaggctcctgcaggaccatggcgaactcgcacgctaacgaagaatccgccgcagccaagaagtacatttacagctttgccggcggcgccgcagaaggtgatgcctcaatgaaaaatctcctcggaggcaaaggagcaaacctggctgaaatggccaacatcggcctgccggtacctcccggcttcactctctccaccgaggtctgcgcctattactacgatcatcagaaaacttaccctgcaaacctcttcgaaactgaaattccggcagcgctaaaaaaagtcgaggactatctcggaaagaagttcggcgaccccgaaaacccgctccttgtctccgtccgctccggcgcacgcgcctcgatgcccggcatgatggacacgatcctcaacctcggcctcaacgacaagaccgtcgaagggctggcccgcaaatcgggcaacccccgcttcgcctgggactgctaccgccgcttcgtgtcgatgtacggcgacgtcgtgctcgacctcaaaccggctgacaaaaagcagattgatcccttcgaagagattctcgaacagaaaaagcaagagctcggcatccacctcgacacggaacttggtgtcgatgacctcaaagacctcgtaggcaaatacaaaaaagcgatcctcgaaaagaccggtaaaaccttccccgaaaatccggaagagcagcttcgcggcgctatcagcgcggtgttcaacagctggaacaacgagcgcgccatcgtctatcgcaagctgaaccacatccccggctggtggggcaccgcctgcaacgtacaggcgatggtgttcggcaacatgggcgaagactgcggcaccggcgtggccttcacccgcgacgcagcgactggcgacaacatcttctatggcgagttcctcatgaacgcccagggtgaggatgtggtggccggcacccgcacgccgctgaaaatcgagcagctcgcacaggaaaagcctgccatctacaaccagctcgaagagattcgttcgatcctcgaaaagcactaccgcgacatgatggacatcgagttcaccatcgagaacgacaagctcttcatgttgcagtgccgcgtcggcaagcgcaccggtttggccgccatcaagatcgctgttgacatgtacaacgaaggtctgatcgacgagaaagaggtgctgcgccgtatcgaacccgagcagctcaaccagcttctccgtcctgttttcgacctcaaggaaaagaaagccgccatcgacagcggacgcctgctcgccaccggcctcaacgccgggcctggcgctgccacaggccgcgtctacttcaacgctgacgacgcgatggaagccaacgcgcgtggcgaaaaggtgattctggtcagaatcgaaacctctccagaagacatcaaaggcatgaacgccgccgagggtatcctcaccgagcgtggcggcatgacttcgcacgcagcactcgtcgcccgtcagatgggcaaggtctgcgtcgctggctgcggcacgctccgcatcgactacaaggctggtgaaatgcgtgtcgcaggcaaggatatcgtcatcaaggagggcgagtacatctccatcgacggcaccacgggcgaggtcatcgccggtgaggtcaagaccaaaaactccgaaattctcgaagtgctgatcgacaagaccctcgacccggcggacgctccgaccttcaggatttacaaccagctcatgcagtgggccgacaagtaccgcaagctcaacatccgcaccaacgccgaccagcccgaccaggctgaaatcgccatcaccttcggcgcggagggcatcggcctgtgccgcaccgaacacatgttcttcggcggcgaccgcatcgacgccatgcgcgaaatgattctggccgacgacatcgcgggccgcaaggtggcgctcgacaagctgcttccctaccagcgcgacgacttctacggtctcttcaaggcgatgggttcgcgcccggtcacggtgcgcctgctcgatccgccgctgcacgaattcctgccgcacaccgacgccgaaattgatgacctggctggcaagatcggcaagaccagcgccgagatcaaggcccgcatcgagagcctgcacgagttcaacccgatgctcggcctgcgtggctgccgcctcggcattctgcacccggagatcatcgtcatgcaggtgcgcgccatcatcgaagccgcctgccgcatcaagcaggagggacaggagatcgtgccggaaatcatggttccgctggtcagcaccgtcaaggagctcgaaatcaccagcgaagtgattcacaagaccgcccgcagcgtcatttccgagcagggagtcggcgtgaagtacctggtcggcaccatgatcgaggtgccgcgcgcagccatcacctccgaccagatcgcgcaggccgccgacttcttcagctacggcaccaacgacctgacccagatgggcctcggcatgagccgcgacgactccggccagttcctgccgatctaccagcagcaggagattttcgcccgcaacccgttcgagagcatcgacatcgatggcgttggccgcttggtcagcatctcggccaaagaggggcgctcggtcaagccggacctcaaactcggcatctgcggcgagcacggcggcgacccggccacggtcgagttctgccacaaaaccggtctgaactacgtctcatgcagccccttccgcgtgccgattgcacgcctggcggcagcccgcgcggcattgctctgactcgagacccagctttcttgtacaaagtggtgataaattggagctctgcagagctttcgttcgtatcatc

SEQ ID NO: 632 - DNA, 1489 bp, Synechocystis sp. PCC 6803
ttcttgtttgttgattaacccttaattaatccgggcgcgcctgatttatcacaagtttgtacaaaaaagcaggctcctgcaggaccatgactggatcactgtttgccgatgccagtaaaagattagaaaaagccctgaaatatgtggccatttccgacgatgccggggaaaggctgaaatatcccaaaaccagtctcagtgtttccattccggtgcggatggacgatggctctttaaaaatctttcccggttaccgagtgcgctacgacgacaccagggggccaggcaaagggggcgtgcgctaccatcccaacgtcaccatggatgaggtgcaatccttagccttttggatgacctttaaatgtgccctgttaaatttgcccttcggaggagctaaggggggcatcaccctcaatcccaaagaactcagccgagcagaattggagcgtttaagtcggggttacatcgaggcgatcgccgattttattggcccggacatcgacattttagccccggatgtttacaccaatgaaatgatgatgggctggatgatggaccaatacagcatcattcgccgcaaaattagtcccgctgtggtcaccggcaaacccgtcaccatggggggcagtcaaggtcgcaacacggccaccggcactggagctttttacatcatgcagggcatgctacccaagtttgaccaatatcccgaaaataccaccgttgctgtccagggtttcggtaatgcgggtatggtggtagccgaatgtttataccaagatggctacaaagtggtggccatcagtgattcccaggggggcatttataacgaacaaggcatcgacattcccgctgtgattgattacaaacaacggcatcgcactttagcgggtatgtactgtgaccaagccatctgcgatttaggggaaaatcaacaaatcagtaatgccgagttactagctctggacgtggacgtgctcattcccgccgccttggaaaatcaaattacccgcgacaatgcagaccaagtcagagctcgctacatttttgaagttgctaatgggcccaccaccaccgccgccgatgatattttggctagcaaaggtatctatgttttccccgatattttggtcaatgctgggggggtgacggtgagctactttgaatgggtacagaaccgcagtggactttattggagcgccaaggaagttaacgatcgcctgaaggaaaaaatggtggaggaagcggaacatgtgtggaacattacccaggaattggatgtgaatgtgcgcactgcagcctatatccacgcccttaaccgcctgagcgaagctatggatgctaaggggactagggattattaccaggacagctaggaaaatctgaaataataggaatggtgtttttctgctgcttcctaatctcgagacccagctttcttgtacaaagtggtgataaattggagctctgcagagctttcgttcgtatcatc

SEQ ID NO: 633 - DNA, 1614 bp, Chloroflexus aurantiacus
ttcttgtttgttgattaacccttaattaatccgggcgcgcctgatttatcacaagtttgtacaaaaaagcaggctcctgcaggaccatggtggattacccgttttttcacgtcagtcactacattgatggtcagttcgttgacggaggatcgcggtttgatattctctatccggccaccaaccaggttattggatcggcaccagaggccggagccgatgaggtggacgcagccgtcgccgccgcttcccgcgcctttcgccaatggagccggatgccggctgccgaacgccgcctgattctcaagcggtttgcccaattgatccgcgatcacgaagcagaactggcggccatcgaaacctgggatgtcgggcgtccaattaccgagaatcgatccggctacatcccccgtatcgcggccaatatcgaattttttgccgattttgccgttacccacggcagtgagtcctatccgatggataacggctatatcaactacgtgctgcgccagccggttggcgttgccgcactcatcgcgccctggaatattcccctcctccaggcgacctggaaaatggggccagcgctggcttttgggaataccgtcgtactaaagccggctgaactgaccccaatcggtacctggcggctggcgcaactggctcatgctgccggggtgccggcgggggtgattaatgtgattcacggcttcggtcccaactcggcaggtgcgctgctaacccgtcaccctgatgtaaagctcatctctttcaccggtgagaccaccactggcaagatcatcatggctactgcggcaccaactcttaaacgggtctcgtttgaattgggtggaaaaggggcgaatattatcttcgccgatgctgatcttgatcgcgccgttgcgattagcctgcgctcctcattctttaatcagggagagttctgtctcgccgggccgcgattgctcgtacaacggccaatctacgaagcatttctcacccgctttcagagggctacatctcagcttcaggttggcgatccctttgacccccaaacgcgggtgggggcactcatttcgcgtgaacattacgaacgggtcaccggttttattgatctggctcgcgccgatggcgctcacatcctcaccggtggcacagatcccgtcttgccggaaccattcgcccaaggcaactttctccagcccaccatcattaccgacgtcaagccgcatgatcaggtttgccaggacgagatttttggtccggtcgtcacggttgtgccctttgacgatgaagaggaagcgattgccatcgccaatggcgtcagctatggactttccgccgtggtacagactcgtgatgtcgggcgagcagtacggatgggatcggccctggaagccggaacgatctggatcaacgacttttttgtgcgcgatctgcgcgtacctttcggtggtatgaaacagagtggaattggccgggaaggtgggcactacagccttgagttctacacggaggcaaagacgatatgcctgagcaatcagtaactcgagacccagctttcttgtacaaagtggtgataaattggagctctgcagagctttcgttcgtatcatc

SEQ ID NO: 634 - DNA, 1477 bp, Chloroflexus aurantiacus
ttcttgtttgttgattaacccttaattaatccgggcgcgcctgatttatcacaagtttgtacaaaaaagcaggctcctgcaggaccatggacaagaagaccatccgtgatgtggattgggccggaaaacgtgcgctggtacgagttgatttcaacgtgccactcgatgatcagggtcagattaccgatgatacccggattcgggcggcattaccgaccattcgctatctgctggaacacggtgccagtgtggtcttgatgtcgcacctggggcgtccgaagggtaaacccaatccgaagtacagtttacgtccggttgttgagcgtttgtttgaattgctgcccgaagcgaaagaggtcaagaagaccgaggcgatcaccgggccggcggctgaagcggctgtggcgatgctgaaaccagggcaggtcctggtactcgaaaacacccgcttcgatccccgtgaagagccaaacgatccagcgatggccgctgaactggcgaaattgggtgatgttttcgttaacgatgccttcggcaccgctcaccgggccaatgccagcactgagggtgtagcgcactacctgccggcagttgccggttttcttatggaaaaggaactgacgtacatcggtggcgccctgaataatccgcagcgtccattcgtaaccgtcatcggtggtgcgaaaatcagtgacaagatcggcgtgatcgaaaatctgctgggtaaggtcgatgcactgctcattggtggtggtatggccaacacctttctgcttgccaaagggctgaatgttggtgattcgctggtcgaaccggacagtgtaccggtggcccagcagttgatggcccgtgctgaagagcggggtgcccggctgcttttgccggttgacgtggtgattgccgatgcgtttagtgccgatgcccagcgccaggttgttgatgtaagtgacattcctgccggctggcgtgtgctcgatattggccccaagaccatcgaacgatacagtgccgagattcgggctgcccgcacggttatctggaatgggccaatgggtgtctttgaactagagccgtttgccgtcggtacacgcgctatcgcccaggcaatggccgaagcggctgccaatggcgcaatcacaattgttggtggtggcgatagtgtggccgcagtggaacaggccggcctggccgataagatgtcgcatgtgagtaccggcggtggtgcctcacttgagttacttgagggacgagtcttacccggtgtggctgcgttgcaagatgcagagtagtctgggttaagcaggatcgtcttcgggtgacctatggacgtagtttgatccatcctacgcccgccgcttttttggtacgggttaagcaggatcgtcttcgggtgacctatggacgtagtctcgagaccagctttcttgtacaaagtggtgataaattggagctctgcagagctttcgttcgtatcatc

SEQ ID NO: 635 - DNA, 1578 bp, Synechocystis sp. PCC 6803
ttcttgtttgttgattaacccttaattaatccgggcgcgcctgatttatcacaagtttgtacaaaaaagcaggctcctgcaggaccatgaccagaaccccccaggaagtcctcaagtggatccaagacgaaaacattaagattatcgacctcaaatttattgacacgccgggaatttggcagcactgctccttctattacgaccaacttgacgaaaactccttcaccgaaggtattccctttgatggctccagtatccgggggtggaaagccattaacgaatctgatatgtgcatggtgcccgacccaaacaccgccaccatcgatcctttctgcaaagaacccaccttgtccatgatttgcagcatcaaggagccccgcaccggggaatggtataaccgtgacccccgcaccattgcggccaaagccgctgaatatctccgcggcaccggcattgccgacaccgtttactttggccccgaagccgaatttttcctcttcgatgatattcgctttggccaaacggaaaactccagctactactttgccgacagtgtcgaagggcgttggaacactggtcgggaagaagaagggggcaacctcggctacaaaccaggctacaaacagggttatttccccgtggctcccaccgacaccgcccaggatatccgcacagaaatgttgctcaccatggcggcctttggcgttcccattgaaaagcatcaccatgaagtagcttccggtggtcaaaacgaattgggcatcaagttcgataagttggtcaattccgctgacaacttgatgatctataagtatgtgatcaaaaacgtggccaaaaagtacggcaaaaccgttacctttatgcccaagcccatcttcaacgataatggttccggtatgcacgtgcaccaatccctctggaaagatggccagcccctctttgctggggacaaatacgccggctttagccagatgggtctgtggtatatcggcgggatcttgaaacatgcccccgctttgttggccttcactaaccccaccaccaactcctacaagcgcctagtgcccggttttgaagcccccgttaacttggcctattcccaaggtaaccgttctgcttccgtgcggattcccctctccggtggtaaccccaaggccaaacgtctggaattccgttgccccgacgccacctccaatccctatctggcctttgccgccatgctctgtgcgggcattgacgggattaaaaatcaaatcgatcccggcgaacccttggatgtggatatctacgacctcagcccggaagaattggctaagattccttccacccccggctccctggaagcggccttggaagcgttggaaaaagaccatgaattcctcaccggcactggtgtattttcccctgactttgtggaaagttggattgagtacaaactggacaacgaagttaaccccatgcgtctgcgcccccacccctacgaattctccttgtactacgactgctaactcgagacccagctttcttgtacaaagtggtgataaattggagctctgcagagctttcgttcgtatcatc

SEQ ID NO: 636 - DNA, 1296 bp, Arabidopsis thaliana
tgttctatgtatataaggtcaataatggagcgtaattttatattagtaaaatgctgcatttaagtttagcactttaaaatcaactaaaatgttcacttaacaaaacaagaaccaaaaaaaatggatgagaaagatattctaaggaacttgagggaagaagaagaagaagaagaagaaaatcaaagcgaagaaaccaaaattttgatctcttcacttccttgggagatagattaccttgggaacaagcttttcaagtaccaaggatattggtactacgaagacgttctccaatcaatccccaatatacactcgagttttcagccacaagaaaccgatatagttgttgcttctttctacaaatcgggcacgacttggctcaaagcactcacatttgcactcgttcaacgatcaaaacactcgttagaagatcatcatcatcctctgctatctcataaccctcatgagatagtaccgtacctcgagctagatctgtatctcaacagctcaaaaccggacttgaccaagttcttatcatcatcatcatcatcatcatctccgagattgttctcaactcatatgtccttggacgcgcttaaactacccttgaagaagtctccttgcaaggtagtgtacgtgtgcaggaacgtgaaagacgtgttggtgtcactttggtgtttcctcaatgccaacaagggagtagaatggggagattttagccaaaatgaaaagatcattcgagcggagaattattctttcaaggctatatttgagtcattctgcaacggagttaccctacacggtcccttttgggaccatgcacagagctattggcgaggcagcttggaagatcctaagcattttcttttcatgaggtacgaggagttgaaagcggagcctcgtactcaggtcaagagacttgcagagttcttggattgtccattcactaaggaagaggaagatagcggaactgtagacaagatcttggaactttgctctctaagtaatttaagcagtttggagatcaacaaaactggatccttgggtggagtagattacaagacttatttccgtaaaggacaagttggtgactggaagagttatatgacctctgaaatggtaaataaaatcgatatgatcgtcgaggagaaactcaaaggttccggtttgaaattctagaattatgcgtgtgctttgtgaagaactgcagaaaaagtgttcttgaatgcgttatttaataataaaagttacattgtcatatatataactttgatgtatcattacaactgatgtgtggtt

SEQ ID NO: 637 - DNA, 1900 bp, Arabidopsis thaliana
ttcctcctttcttcttcactcatctcttcttcttcccttcaaccttcataatcagtggctccttcgcttattagtctttgtcaatcttaaatcgttgagtatccaaaaatcttaaactcaatggatccgtgctctttcgtacggatcatagtcggtaacttggccgttaggtttccgtcgtcgtcttcttcttcttcttcctcatcaggaccgtctgtttccggaatcaatccaacggctcctaactgttactgtaaaatcagattcaagaactttcctcgtgagattgtttctgttccggttatgttccgaactgaatctgaatccgagactcgttgctcctcctccggtaacgtatccaccgttgctgcttgtttcagtttaagtaaagctcagatcgaagcgtcgttgaagaaacctaaatttagtgttctctccgttgaggcttattcccgcggaaatagcgacggagacgacggtgttagcggcgcgtcgtgtggactcgctacggcgggtgagaagttgcttggtcgatttgaggtttcgcttgatttgaaatcggcggagacgaagagttttttggcgcataacggttgggttgctttgccgtctaagaaaacgaagagtaaaactggatccgatccggagctccacgttagcgtacgggtcgaacctgacccgagattcgtgtttcagttcgacggtgagcctgagtgtagtcctcaggtttttcaagttcaaggaaacacaaagcaagccgtgttcacttgcaaattcggctctagaaactccaactccggtgatcgaaatcttcttcacaggtcagttaaatcatcatcttactggaataattaagaaataggaacattgcctttttcagatagattctttacttaccaatttagcaaagagatgcgaacttagaaatatgtattttcatgctttgattggtgattgagatttgttttgtgatcgtatattgattttatggtttatattttgcagttcttcgatgatgtctgagataagctcaacgagaagttgtatatcgtcgatgaattcggaaaaagaacaaccgtcaaaagagagaaaaggatggtcaataacggtccatgatctctccggttcacccgtggctatggcctctatggtaacacctttcgtaccatctcctggttcgaaccgggtgactcggtcaagtcccggagcgtggcttattcttcgacctgacggttgcacatggaagccatggggaagactagaagcatggcgtgaggctggttactctgacactctaggttatcgtttcgagcttttccaagacggtatagccaccgcagtttctgcatcgtcgtcgatcagtttgaaaaatggcgggagttttgttattgatgttaccggcggtacaagcacaacggcgtctacgccgacaacgagtcctcaaggaagctgggatctcggatccggttcaagcgccggttcaagacccgcgtcgagaccaggatcaggatccgggtcggatttcggatatctactaccgcaacatccgtctgcggccgcgcaaaacagagggttcgttatgtcggctacggttgaaggagttgggaaacgaagcaaaccagaagtagaagtcggtgtgacgcacgtgacatgtacggaggatgcagcagcgcacgtggcattagctgcggcggtggatctgagtttggatgcttgcaggcttttctcacacaagctaaggaaagagctgagacagcaaagccagcttggtgtcgtttgacttgtttcgctttgtcgttttaccaattcatgagttgtcttccactcacatttttttggtttgaattttctatttttttctttttaagatagcgttaggaattagccagccatttttttg

SEQ ID NO: 638 - DNA, 849 bp, Arabidopsis thaliana
aacaaagacataaattgtggtttttgattcgtttaatatcttggctgctgtgttggatggatgtaacatgtatatagagtgaggaagctgtcaaaggcgactgagaatctgagcaagacgatgttgaatggtgcgggagttgtgagcggctctgtgatggtccctatgatgaagtcgaaaccagggatggccttcttttcgatggttccaggggaggtcctcttagcttcacttgatgcccttagtaagttatgatatataactatgtaaaatctttttttgtggtcaaaaactagagcaaataaaagttatgggtgtgaaaaaaaaaactttaatgaggtgtaatgtttggtttgatccaatagataaaatactagatgcaactgaagctgcagagagacaaactctatctgcaacatccagggctgctaccagaatggtcagtgagaggtaacattttcaccttataatcctcaaatctaacatgtgtccattgagaagtcattagtgatgatacacatttttaagagttttaaggtgataataaattaataataacatgtttggcaaaacaggtttggagataacgcaggggaggccaccggagatgttctagcaacagcgggccacgcagctggaactgcctggaatgttctcaagatccgtaagactttctatccttcatcttctcttacatcaggaatcgtcaaaaatgctccaagaaagtgatatatagtgggttatagtttcagttacgtttatcaatgtatgatcgatggaaacccccaaaaacaagctcagtttttatatttagattctctacataatgtggactcatcagctatagtt

SEQ ID NO: 639 - DNA, 2108 bp, Arabidopsis thaliana
acgccgttttcagctatcttaaacgacataaagttttgccttaaaccctaccatcgtcactcactctgtcctcgataggtttagagaagaaatagattttgatcgatccttacaacaaaaatgaatttccgtaatctgattgcttccggttctcgcctcggcaagaggttctgtgcaacggtatttgctccggcgtcggcgactggcatcgtcgaagcctctgtttcttctccagcggcggcgaatgtcgtcgaagcctctgtttcttctccggcggcggagaatggcgtcagaacctctgttgctgctccgacggtggcttcaaggcagcgagagttgtacaagaaactttctatgcttagtgtgacgggaggaacagtggcagagacgttaaatcagttcatcatggagggtattactgtcagaaaagacgatctctttcgctgtgctaaaacccttcgcaaattccgtcgacctcaacacgcttttgaggtccctcttcatatctcttaagcaagtatctgattttaacattgaaattggagatatttcattatctatggaaaattactcttaaaggggctggctttagatttagggtttagtgatttcactagttttagggtgtaattagggtcatgctcgttgttgaatgaaatttcacttttttcgaatggatagagattaaaaatggcatttttaagtttgttagagtttgattgagtccattgttgatgaaatttcagatctttgattggatggagaagaggaaaatgacattttctgtgtctgatcatgcaatttgtttggatctaattggaaagactaaaggtttagaagcagctgagaactactttaacaacttagatccttctgcaaagaatcatcagtcgacttatggggcgctcatgaactgttactgtgttgaacttgaggaagagaaagcaaaggctcattttgagataatggatgagcttaactttgttaacaattcgttaccgtttaataacatgatgtctatgtacatgcggttgagtcaaccggagaaggtacctgtgttggttgatgcgatgaaacagaggggtatatctccttgtggtgtcacttactctatatggatgcagagctgtggaagtttgaatgacttagatggattagagaagattatagatgagatggggaaagacagtgaagctaaaaccacttggaatactttctctaatctggctgcaatctacactaaagctggtctttacgagaaggcggattctgcactgaaatctatggaggagaaaatgaatcctaacaaccgtgattcccaccattttctcatgagtttgtacgctggaatctcgaaaggtcctgaggtttatagggtttgggaatcgctgaagaaggctcgtcctgaggtcaacaacttgagctatctagtcatgttacaagcgatgagtaaactaggcgacttagatgggattaagaagattttcacagagtgggaatcgaaatgctgggcttacgatatgaggctggctaatatcgcgattaacacgtatttgaaagggaatatgtatgaagaagcagagaagattcttgatggtgccatgaaaaagtctaaaggtcctttctccaaagcgagacagcttctgatgatccatctgttggagaacgataaagcggatttggctatgaagcatttggaagcagcggtttctgattctgcagagaacaaagacgaatggggctggagctcagagctggtcagcttgtttttccttcactttgagaaagctaaagatgttgatggagcggaagatttctgcaagattttgtcgaattggaaacctcttgattctgaaactatgacatttctcataaagacttatgcagcagcagagaagactagtcctgatatgcgagagagattgtctcaacagcagatcgaagtaagcgaggagatccaagacttgcttaaaacagtttgtccctaaactaagtaataaatgtgattagcacgttatgtttaaacttgtgtcccgtttagagtttccagttccagaaaacaaagcttagttctttttttaagtctttgacatatgtgtcggttacat

SEQ ID NO: 640 - DNA, 853 bp, Arabidopsis thaliana
gaattcgttccctctgtagatgtttttatgtacatgtcaataagattcgtgaagctgttgatttatgtttttgcagtttttgaaattttgaagaatggtgagaatcagtgtgctcaatgatggtcttaagagtatgtacaatgcagagaagagaggaaagaggcaggttatgatcaggccttcttctaaagttatcatcaagttccttatcgtcatgcaaaagcacggtatgctagtaactttgcagagctagcgtttgattcctgtatacagttttcaagtgtaatgatgcttcttggtttttaggttacattggcgagtttgagtatgttgatgaccacaggtctggtaagattgttgttgagcttaatggaaggctgaacaagtgtggagttatcagtcctcgtttcgatgtcggtgttaaggagattgaaggatggactgctcgtctacttccttccagacaggttagtctagagactatatagtagtggtaccaatcaatgttttagctattgatctgctgccttactttgctgttcctattatggtttaattggatgtttagtgtcattactttgccttactttatctttcaatgttacaacttcattgaacacttctctatgtgcagtttggtttcattgttctgacgacctcagcgggaatcatggatcatgaagaagctaggagaaagaacgttggtggcaaagttcttgggttcttttactgaagcagggtctcgagatctatcttatcgggttatagtttggttctctgtaagtcgattgacctcactgtcaaagtagtagttttatatgttgtggtcactcggatacgtaaaaacttggag

SEQ ID NO: 641 - DNA, 747 bp, Arabidopsis thaliana
gtcctcttcacatccttctaaaaccctataagtacccacaccctctcttcatatatcttcatctctcactctctcaaagacactgaataaatccttaaaacaaacttttgaaagaaaaaaatggcttcaaagaactcagcctctattgctcttttcttcgcccttaacatcatattcttcaccttaaccgctgcaacagattgtggttgcaacccaagtcctaagcacaagcctgtcccaagtcctaaacccaagccggtcccaagtcccaaacccaagccggtcccaagtccttcagtaccaagtccttcggtcccaagtcctaaccctaggccggtcacgcctccgagaacccctggctcatctggaaactgtcctatcgatgctctcagactcggtgtatgtgcgaacgttttaagcagtctactcaacattcaattgggtcagccatcagctcaaccatgttgctcgctcatccaaggtttggttgacctcgacgctgccatttgtctttgcactgcgcttagggctaacgttcttggtatcaaccttaacgtcccgatatctctcagtgttcttctcaacgtttgtaacagaaaggttccgtctggcttccaatgtgcttgaaggatatcagctatgcatacgatgtgatgcccgtgcacaaatatcttcttcgaaattgttacagtatgaataaatgcatgtaagctatagagtttatgttttaaattttgaatttgttaa

SEQ ID NO: 642 - DNA, 1563 bp, Arabidopsis thaliana
gtcgtcttctggggaaaatatctttttttttaaacactatcaattcgactggaaaaaggatatttccagattaggtagagagagagcaaaagtactttcattcagacttcagtttaagctatggcggcgaacgattcttcaaatgctattgacatcgacgggaatctcgactccgattcgaatcttaacactgacggtgacgaagcgaccgataatgattcctcgaaggcattggttactatccctgctccagccgtttgtcttttccggttcgccggagatgctgctggtggcgccgttatgggctctatcttcggatatggtgctcttcttctttctattttgtttcttctattgcttggttttatctgctattgctttactctctgatagtgaattgagaattactggcaaacaattgagtttgtactcttttcttcatttaagttgatttcaaaacatgtttcgtggataagggtttgagaaatcatagttgttttagcagactagccttttgagttattttcaggagtaatctagatttaggggattcaacattcctcaagtttggttatgttttgctcctggaagctatagaattgaattagcttagttttcattaaagagcgtcaatgtgataagattggctactgatttgattacgatgatggaattgtgaaatattatctcactatataagttgggattcaggttcaggattgttcaagaagaaaggcttcaaaggatcatttgcagatgcagggcagtctgctaaggtacccctcatctttatgctatagcatatatatgcttattgttccaagaaactgagtaatttgctaattttttgttcaagacttttgctgttttatctggagtccacagtttggttgtttgccttctgaagcaaatccgaggcaaagatgacggtgagactcttcagattgcttccttcttgtgtaaatgattagtttttacatgaacttgtaatctctctcctacttatattgcttttgttctttttttacagccattaatgttggagtagcagggtgttgcactggtcttgctcttagtttccctggtaatccaaatccattatgctcattctgatttctactttggcgttatgtatcatatcaaagatgcaatcatcacagagaggagagctaatagattctttcttatatggccttttttacaggtgctccacaggctcttctacagagttgtctcacgtttggggcattctcttttattcttgagggactcaacaaaagacaaacagctttggcacactcggtctcgttgagacaccaaaccggactgttccaagatcatcatcgtgctttaccactctctcttgctctcccgatccctgaagaaatcaaaggagccttttcttctttctgcaagtccttagctaaaccaaggaagttctaatctcgtcttattattctccctttcttgtgtcttaggctctctctatgtagatgtaaaattttcccgcttttgttgtactttgtgagacatgttttgtgaaaggctttttgcaagagccaa

SEQ ID NO: 643 - DNA, 1983 bp, Arabidopsis thaliana
aatacgacgtcgtagagaaggaactcgttcgtcatctaagccaaggactagggttctctgagggtacagaactaaacttaatccgttaatcgtagcaaagaactacactcagtggtgaaaatggagaatcaagagcctgatatcgagaaattgcctcgagacgatgttcctgatagagaaccagaccataagaagctcaagatttcgaccaccggccaggaaactgattcctcggctgttaccaccggcggaagcaatgtcgctgagcgtagagcgccgaaatacagacgccggaaagtcgcaatcgtgtttgcgttctgcggagtagggtatcagggaatgcaaaagaatcccggcgccaaaaccattgaaggcgagctcgaagaggctttgttccatgccggagcagtacctgatgctgatcggaacaaaccaagaaattacgaatgggcacgatccgctagaactgataaaggagtgagtgcggtgggacaagtggtttctggtcgtttctatgttgatccgcctggatttgtggagcggctcaattcgaagctccctgatcagattcgtgtgtttgggtacaagcgtgttgcaccgtcgtttagctccaaaaaattctgtgatcggaggaggtatgtgtatctaatcccggtttttgctttggatccatgcgtacatggtgaagctgagatggttagaacggatttaggttacgaatatgtcaaatgtgtagagtgctctgagaaaggctataagattccacttggtgttatgggtaaagacactgattgttgtgatacaaaatcattggagattcagtcagacatttcgtcgagcacctgtgatgcaataggagctgatgtcaagtgtgaaactttgagctctagtgtacctagtgcagaaaataacttaaactcagaagttctagatggggctgatgtatctgctttaagctctaaagcagagggtatggaagaatcgaatactttggctaaggtagagatgaacaatggggaaggagaagacatgactaaaagcgagagcaagttctgttatggagagaaggaaaaggagaggtttaacagaatactaagctattatgttggttcacataacttccacaacttcaccaccagaacgaaagcagcagacccagctgcgaatcgttacattctctctttcaatgcaaacacagtgattaatctcgatggaaaagattttgtcaaatgtgaagttgttggacagagcttcatgcttcatcaaatccggaaaatgattggacttgctgttgctatcatgaggaactatgctcctgaatcactgatcgaagcttctttcaagaagtaagctttttgtttcttattatttccctgaatatataattgtttgagtcgttttgatttgtattgattatggaattggtaactcttcaccagggatgtgagaataaatgtaccgatggcgccagaagttggattataccttgatgaatgcttcttcacgtcttacaacaaaaggtttaaaggcagtcatgaggaggtgtcaatggaagagtacaaggaagtagctgaagagttcaaatggaagtatgtttattcacatattggctctgctgaagaaaaagatggagctgtggcgatttggttgcattctctgaaccagagaaactatcctgatctacgaagcaatgaataccaaccggatgaagtcattgtctataagaagattggtgaagcctctgaagaaaatatccatgaaggcaatgctgagctattcgttgtcgataaggtgaatgatgaaacctctgaaggaacgactatggaagagaggaccacactagaggagaaggcaacagggtgaagccgcttttatctactgcggatcacaggattaaggtggaagcatcaagcttcacccgcaggtccaaactggactagtgagccagatgagtaccatttggacatttgtttcagtgtgtcc

SEQ ID NO: 644 - DNA, 1050 bp, Arabidopsis thaliana
tttttaaaatgatcatcatcttcttcttcactcgcctcaatttttgttcccttcttcttctataattcaactgtgaatttcaccgacgaaacaaaaaagagagagagagagagagaaacgatgagttctcagatttcggagattgaacaagagcagctgatcgagaagcttgagatcttcaagatccatggcagagacaaacgtggccgtaagatccttcgtattatcggaaaattcttcccaggtactgatatatcaatcggatctgtttctttttctctctgtgtagatttgttcttatatttgagttttttttgtttctgaaatcagctcgatttctgtcactggatgtgttgaagaagtatctagaggagaagatatttcctcgattaggtagaaaaccattcgccgtactctacgtccacaccggcgtacagagaagcgagaacttcccaggtatctcagctctacgagcgatctacgacgcaattccggtaaacgtcagagacaatcttcaggaggtttacttcctccatccaggtcttcaatcacgtctcttcctcgccacctgcggccgatttctattttccggcgggtgagtaactaaccgccgcgttttttaattttctggtcaacgacttttcttgatactatagttttttttagaaaaacgttgattaattaattggtgtggtgattggctgcggtaggttgtacgggaagctgaggtacataagcagagttgattatctgtgggaacatgtgaggaggaatgagatagagatgccggagtttgtatacgatcacgatgatgatctggagtatcgtccgatgatggattacggtcaagaaagcgatcacgcgagggttttcgccggagccgccgtggattcatcagtctcaagtttctccatgaggtgtatctcatagcgtaaaaggctaaaactccacccactagatatcggatcgtatcttataaaccatataatatacgaatacgattaataatatatcaaaaagattggaaataggtgtgctttttgaaattag

SEQ ID NO: 645 - DNA, 2364 bp, Arabidopsis thaliana
ttttttttttttttgaatctctcttcgtccttcgccgtttcgatttcttgtttcctctacttgatgatgaaattttgatcagatctagtgtagaatagttaggatttacccagagagattatgtttatggatcgagagagacggagttctggtcgtaatgggactcctgaatatagcaatggcaaattccgagatgataatggttttggattcttagatcgattggaaaattgccgtgagaagagtcctcctagatcgaagatccttcggatcccgtctccgacctcgtctcctccaccttctagctcttctccgccatttcatggttccaattcgcctgaccgtggatatatcgaacaccgcatctccaagtttgatactctcgccggcgttgccatcaaatacggtgttgaggtataattctgctaacgatttaggtttggtttgtgtagtgatggctatttccagctccagaatatttgactttggttaaggttgttgagtaatattgacatacaacggtatttttattagaggcaaaaggtagaattaatggtactggtaaaaagcattaggatttttttttgtttgtgtgggaattgacgcatgatgaagaacaacacatgaggaaaaagttatttgtcagagagagctggattatttctaaattgtataagcttcgcttttgatgctggattattcctaatcgttgttcttatttttttctttgtgttgtgaaactttctacttcaggttgcagatgtgaaaaagatgaataaccttgttactgatcttcaaatgtttgctctcaagtctcttcagattccgttacctgggagacatcctccttctccatgtttatctaatggctccttaaaccatgggtactaataaagcttattacttttaaatgatttattatttgctatcatttaagttccagtgatggattcttatagctgattgttgttgatgctttgttgcattttgtgttccaccatcagcagagcagttgttgatgctttgttgcattagtttgcattttgttgcattttgtgttccaccatcagcagagcagttgttgatgctttgttgcattagtttgcattttgttgcattttgtgttccaccatcagcagagcagtttacaccatcagcagagcattttgtttcttatttcttaatttattcaaagagccctataccagcttttcttgattggtaaaatggttttggtactttgctgtaaaagtctcagcgaaggtagaactaggatcctattttctttatatcacctgcagaactagaaattctataggaaacatctcaatttcgagacaaacaactagtgcctttagttgtgttggactgaaactgcatattatcattatggagtaatcctcttttcatggctctaatacatggaatcttatttgcagagagggatgttcatgccacgaaccggaatcaccaaaccatagcgaacaggaagtgtttgactcatttcagtctctgagattgaaatcttcggaaaagaaagtttctccagccatgtactcactgcaaggttattacgggctaaaaccagcagacagaacagtctctgatggaggatgcttcgagatgggaaattacaagacggaaacttctcatcatatcttcaacaacggtgataacggatatctcagacctttcccatccacaaatactcccttaaatcaccacaggaaatctagaagcttggtcaatgcgcttatcgaagaggttaaccaatcacctgataataatactcaagaaccaacatctgataagtttatgagaagacgccaaaaatctgaggccgatttttcatcccggactccagaacttgtgttgaaagaagagaacggtagcagcaatggcggatttttatcaatagctggaaaaggcttagctttgagatcgaaagcgtcaagcagaaccaatctagcagcagaatctgagaacggtaatttcaatccggtatcaatgaacttgatggatgctccagtttcagacagctttagcagtgtaagaaaatcgtcgagtgcatcgagtctacaagatccagatggtaacagcaataatggttcgttgtcgctatggccaacgtcaaagtggagcttgaaaccggatttgcttacacctgcggccattacaagttccatctttgatggattaccaaagcctttaactggtcgaagaaacaaaacggctctggactaaacacaaggtcagtttctggttatttataactgccttattcttttttggggtactatacaaatcaattgtcaaaagaagctatttagcttaatgcggagtaaatacaaaagtaaagagatt

SEQ ID NO: 646 - DNA, 1278 bp, Arabidopsis thaliana
tagaataagtcaacaagtcaatgaaggatgctaaccatatattaatatatgttctactttacatacagatctgtgattaccctttttcttctacttcaattgtgagaaagagatcaacaaatggagacgaatagcgaagagaagctaagtgtcatcgaactactaaaacgagctcttaagctactctttggtaacatcaatctcttgctcttcctatgcctctgctctctcccactgttttttttcttgatcttctttgagctctccctccaaaccaccgtctatctcacttcccaattcctctggaaactactcattctgggagaagacttgccggaaaatgatctgattctcatatcagagaaaaagaatgatctgatttcatggctgatccagacatttctgctctacttcttcccctacaccattcttgaccttcttaccaccaccacgatcgttgcagcatcttcgattgtttacacatccaaggaagagccgttagggctgctttatttggtagagagatctatcaaaatatgtcagaacagagtaggaggttgtctgatcacatctctctatgtcctcctttggtcaacctcagtttttcttttctttttcttgttcttttttcttcagtttctctctggttcaaccaactacgtatccattccttatctctcacgcgaatacaaagggttccactaccaaccaacgggtctattcaacgtggtagtgcctctgactcttctgatgcaatgtactctatttatagttctgactgcaaagtatagtaagtggagctccggatggaacatgggtttggttgtttcggtcttggaagaagacgaagatggtcaaggcatctacggaggagatgctctgtctctttcaggttggtatagaaaaggacatgagaagcgtgacctctggttgatgttaatgttcttggtcttcggtcttgcgacaaggatgccatgtttatactccaaatgcagtgcgagtggaaatggagtgatgtacactggcttctatgtaggcttgatttgtgttggcaatttacttaaatgggtgacttgtcttgcctgttaccatgattgtaaaactatggttttgagaaaaaagcgtgatgtagaacaagctaaaactcctgctgcttaagagactttggctgagatcaattcaaagtgtgaatctttataataaatggtataaaagcagaaaggttattagacttctcagcttcaacgcaaaagcataagaacatgttgtaaataggat

SEQ ID NO: 647 - DNA, 1371 bp, Arabidopsis thaliana
atggcagcggcgagacgattacggacgctccaatctcagccggagaacaaggtctgtgtcgattgctcccagaagaatccacaatgggcatcgatttcatatggaatcttcatgtgcttggaatgctccggtaagcaccgtggtttaggtgttcacatctcattcgtcagatccgtcaccatggattcatggtccgagatccagatcaagaaaatggacgctggaggcaacgagcgtctcaacaattttctcgctcagtacgggatctcgaaagagactgatatcatctccaagtacaattccaacgccgcgtctgtgtatcgagatcggatccaagctttagctgagggaagacaatggagagatccgccgattgttaaggaatcggttggtggtggattgatgaataagaagcctccgttgtctcaaggcggtggtagagattctggtaatggtggatgggataattgggataacgatgattcgtttagatctacggatatgaggaggaatcaatcggcgggtgattttaggtcatcgggaggtcgtggtgctccggcgaagtcgaaatcgtctgaggatatatattcacggtctcagctggaggcgtcggcggcgaataaggagagtttctttgcgaaaaggatggctgagaatgagtctaagcctgagggacttcctccttcacaaggtggtaagtatgttgggtttggatctagtccaggtccagctccgagaagcaatcaacagagtggtggtggtgatgttttctctgttatgtctgagggttttggaagattgtctcttgttgctgcatcagctgcaaatgttgttcagactggaaccatggagtttacttccaaggtcaaagaaggtggcttagatcagacggtcagtgagactgttaatgttgttgcgagtaagacaacagagataggacagaggacatgggggatcatgaaaggagtgatggcaattgcctcacaaaaggttgaagagttcactaaagaagaagcatcaacttggaatcaacagaataaaactgagggcaacggttactaccagaactctgggattggaaacaaaacagcaaattcatcttttggaggatcacaatcatcatcaagtggtcacaacaacagttatcgtaactcgaattcttgggatgactggggagaagagaacaatagcaaaaaggaagcagcaccaaaggtgtcgacttctaatgatgatgacgacggcggttgggctggttgggatgataatgatgctaaagatgatgatttctattatcagcctgcaagcgataagaaatctgtaggtcacaatgggaaatcagacactgcttggaccggtggaggttttctctaa

SEQ ID NO: 648 - DNA, 2804 bp, Arabidopsis thaliana
tatatactcttccctccggtcaaatctcgtcgtcttgtttggtctctgtttttcacgccggagatagagagagagaagtaaaaaagcgagaaaaagctagaaactttagaatacccaataatggatccgatcgaatctgtcgagtacaatggcttcgagacctctaacggtaacgtcgaccatggttggaagaaagtcgtgtacccgaaacgtcaccggaagcaaaaacaagcggatcaagcgacggcaaatggtggcaaaactgttgcttcaaatggaaccgtagctaacggcggagataacgttttccgttcgttggaagagcaagctgaggatcgtcgacgacggatcttagcggcgaagatgactgctattgattcagatgatgatggtgttgttagatctaaacatcgatctaatggttacggtgatgatgggtatgattttgatggtagtgatgatgagatcgcaacgctgaaggttgaggaagttaagaagccaaagcctaagaaggagaagaagcctaaagtttctttgcctgaagctgcatcaaagatcgatcctttaaatctcgaagcttttctcgttgaagcatcggtatgtgcatggatttgagatttgagatttggttttgatctgtttgtgatttagctgaattgtgatctaaagtttcgttttttcaatgttgggtttataggaatcgtatgcgagtcagcctgagattcagctaatgagatttgctgattactttgggagagcactttctggagtctcatctgtgcaatttccatgggtgaagatgtttaaagagtctcctttgtctaagctgattgaagtgagtttgtgtttttaacattgtttgaggttttggaattggattctaggtttaggttttgataaaggtgagatcgtttttgtttatgaataggttccgttagctcatattccggaaccagtgtataagacatcagttgattggatcaaccatcgtccaattgaggcacttggagcctttgtgttgtgggcttttgattgtattctcacagatttagcagcacaacaaggtggtgctaaaggtgggaagaagggtggtcaacaaactacttccaaatctcaggtgatttggaaaacctttctcgatctctaaactctgatctttgattatcaatgttattacctttcgattactaagtccattattgtacattcgtataggtggcaatatttgttgcattagcgatggtattgcgtaggaagcctgatgctttgactaatgtattgccaactctgagggagaatcctaagtatcagggtcaggataagcttccggttacagtttggatgatggctcaggtttgtgtgatttgttttgtaaatgagtattaattgtgtcaagatttgtgttttctgtgatctttattctaatttttgtaaaactgtaaaatgtggacaggcctcccaaggtgatatagctgtaggcttgtattcatgggctcacaacttgttacctgttgtcggtaataagaactgtaaccctcagtcaagggatctcatcctgcagttggttgagaagtgagtaaaaaacttcttgtggtcttattcttgctgtgtttgtagtcagtcatctaatcttgtttatatgcaattttcttatcagaattttgacgaatccaaaggctcgtaccatacttgtaaatggagctgttaggaagggagagcgtttgattccacctccttcatttgagatcttgttgcggcttacattccctgcatcatctgcaagagtaaaggtaagtcgtattgctggaattttgtaaaacgaaaccttgattcattttgttgattctcacaagcatgatcttcgttgcacacaggctacagagaggtttgaggcaatatatcccttgctgaaagaagtggctcttgctggtgcaccaggaagcaaggcgatgaaacaagtcacacaacagatattcacttttgctctgaaattagctggagaaggtactattaacaatcttgattcccttagttttctgcttccctcagctccgctagattagagttttaatgttatcgttgttacaggaaatcctgttttagccaaggaagctacagcaattgctatctggtctgtgacccaaaactttgattgctgcaagcactgggacaatctctacaaggagaatctggaagctagtgttgctgttcttaaaaagcttgttgaagaatggaaagagcattcggtcaaactatcatcatcaccgaatgatgctctcactctcaaccgaactatgaaaagcttcaggctaaaggtaagagcctccacaatttctaagctttaatttcaccctccagtctcttgtaaatttaatctccgatatttccctgtgatgttttagaacgaggaggtcatcactgagggaggagccaatgcttctctttacaaagaagctgacaagtcttgcaaaacgatctcggggagactctcccgtggaagtggctgcctcaaaggaacagccattactttagtgtttctagctgctgcaggagccgctgctgcagctgttctatcttccaacccggaggttacaaacgagctgaagaacctggtggactcattggagctgcatgaatacatcaacaaatacactgaggttatctccacagctttgaagaagtaagagaaaagaaacaatcaaaaacctgaggatgatatagagaggtaactcttaatatcatcggtgtagagaattacttaaaagttaaagccttttactctccaagatacaaaattttgaaca

SEQ ID NO: 649 - DNA, 2454 bp, Arabidopsis thaliana
agacgaacaacaattcaaaaccgtattaaatgttgtctttttgatcactcaagaagaaaacaacaagacagcagatgttttcatcattcttcacaacaagtttcgttcaagtctgatccgatgttctcctctagctttctcagattgattcttttactctgtctcgtctcttcttccttctcctccaccacttcttcctccaactccactgccgccgatcaaactctccggccgcaagaagagctccagaagctaacactgattagacaagaactcgacaaaatcaacaagccggctgtgaaaactattcaggcaatttctctattctcaaatatctcaatttgataaatgtatatatatacagacatctttgtttactttgttactctgtttcgactctgtttttgctctgtttttactctgttttgttaattaactgacatgcaagttttgttactctgttcttactctgttttttgctctgtttcttttccatgtgttatgtttgcagagctcagatggagataaaatagattgtgtttcaactcatcagcaaccagctttcgatcatcctctcttacaaggacaaaaaccattggtaaatattattttccctcctcttctccattttatctcttttcattagtattcttatcaaagatttcaaatgttcttatttaggatccgcctgagataccaaaaggatacagcgaagatgatggatcatatgaaaactcccagctttggagtttatccggtgagtcttgtccggaaggtacgattccgataagaagaacaacggaacaagacatgttaagagcaagttctgtccaaagatttggtcggaaaatcaggcgcgtgaagagagattccacaaataacggacacgaagtaagtaccattttgataaccataattaagcaaaaagtcagaggtttcttaccttttttatcctctataaagaaaaagatagagaatgataccaaaattcagctttttcgtaattctttgcacgaccattactaagttgtatcatccaaaggagtgaagcgtgacataactaaagattattctctgttcacatcgtaaaaaagattattctctgttcctttttctctttttctgtgtttacgaaaatgatactccaattttagcgtttgagaatttatttgattgattatttttgtaaaaatgacttattttgtagcatgcggtgggatatgtaaccgggagacaatattacggggcaaaagcaagtattaacgtgtggtcgccacgtgttacgagccaatacgaatttagtctttctcagatttgggttattgccggttcgttcacacacgatcttaataccattgaagccggttggcaaattagcccggagttgtacggcgatacttacccaagattctttacctattggacggtaaatgttaccttcaactttagtatccttagtttacggtaaagtttttagttttattgaattaacattttgttaacaatggtagtgatagtgattttcagtccgatgcatatcgaacaacgggttgctacaatttgctatgttccggtttcgttcaaaccaaccgtcgaatcgcgataggagctgcgatttctcctagatcttcgtataaaggtggacaattcgatataagcttattaatttggaaggtaatttttcttcttctctcatatacatatttatgcatatcatcaatgaaaaatactaacaatattttacaacatactatacctataataattcagctgtattctgcaaaaaaattaccagtcacatttcttatataatttataatcttttaagaagaatttcacatggttcacatcaatgtttcgtgggtcaaccagctcctactttagaaagtcttaaataatttgactttttttagtcataacaataacattacacatgcttgtataatctacgtataggatccgaagcacggtcactggtggctacaattcgggtcaggtgcattagtcggttattggccagcgtttttattcacgcatctaaagcaacatggaagcatggtccaattcgggggcgagattgtgaacaaccgacccggcggttcacacactacgactcaaatgggtagtggacattttgccggtgaaggttttggtaaagcatcttatttccggaatctccaaattgttgactgggacaacactcttatacccgcttcgaatctaaagattctcgcagaccatcccaattgttatgatataagaggtgggacgaatcgtgtgtggggtaactatttttactatggaggtccaggaaaaaaccctagatgtccatgaagaatcaagaaaacaaaagcagaaaaaggttattgattattattcttacatgtagtgcacatgaattttgggattaagggagattaggaatttacattgccgctaggtgttttgcaaata

SEQ ID NO: 650 - DNA, 1434 bp, Arabidopsis thaliana
tcatcactctctctgctcccaaattcagaaaaaaaggaacgatttttatttccggtgaatgagaattttctctcgaatttgatcgatcacatatttcatctgtgtgttttcattttgaggatgccagcaacggaatatcaaagatcattcgggaggtcttttctgaatttacggcgagacacggcggtgaactcggttgagtcaacgacggttacccccgagttgactcagatggaagcagagcttgtttcgtttcagagaaaagttgctgagaggtttatcgatctcaatgcgtctagttgtgaagatctactgtctctcgaatgggttgggaagcttcttgattcgtttctatcttgtcaagaagagtttcgttccatagtcatcaatcatcgttcgatgattactaaaccaccgatggatcgattggtttcagattacttcgagagaagtgttaaagctcttgatgtttgtaacgcgattcgtgatggtgttgaacagatccgtcaatggcagaaacttatcgagattgtaatttgtgctttcaacaacaatggaggaggaagtagtggcaagagacctcttggagaaggtcagtttcgtcgtgcgaggaagactttgattgagttagctattggtatgcttgatgagaaggattcatcttctagctcagtgtcgtctcagcatcgtaaccggtcttttggaaggaacaaggagcagcttcatcaccgaacaatcgggcatttcaggtcgctttcttggagtgtttcgagatcatggtctgcttctaagcaactacaagctattggaaacaacttagctacgcctcgagctagtgacattactgcaactaatggtcttattgttccggtttatacaatgactacggtattgttgtttgtgatgtgggcacttgtagctgcgattccttgtcaagacagaggtttgcaagtacatttcaatgttcctaggaattaccaatggggaggttcgttgatgtcgttgcacgataggatcattgaggaatcgaagaagagagagaggaagaatacatgtgggttgttgaaagagattcatcagtttgagaagacttcaagattgatgaatgagttggttgattctgttcagtttcctttgtctgaagagaaagagatggaagtgagagagagagttgaggaattggggaagcttcaagaggctttgaagaatggtttggatccgtttgagaggaaagtgagggaagtgtttcatcggattgtaagaagcagaacagaaggtcttgatactgttggaaagcatcatggttctgaatgatgtttatcgaaaattcaatggaacatcatcatctgtttaatattctggagagttgaagtatgtttatcaaattgtgggtttgtttgtctggtgaacgtgaagatcatggagacaaattgc

SEQ ID NO: 651 - DNA, 2497 bp, Arabidopsis thaliana
tgaattaaaagacttcttcattttgactattgtggtagactagtagttgccatattcacatactaatattggcttgtgttgtttcttgggcaatgcaggtttgttttagttctatacattatggggaagtctacaaaatggttgaagaatgtattgcttgggaaaaaaacttctaaatctagtggttccaaagacaaagaggtaacgcttttgtaagagaattctatattatgtatgtgatgattaaatactgtatgtggagaatttggatcataattgagaaaacagtgatggttttaggctaccaatttgcttatgattgtctttttttttttttttttttgttctaattatagttataataatgcgcagagagttgtgagtggaaaagaggtactggttacttcaaaggtggaagaatcagatgtggtatcagatcttccatcttttgaagttgcagagaccaataccgttgatagaagtggtggtatgttagagactcaaaatgtaggacctgaagagatctcagatgatgaaattgagcttcctgaaggaaaatcaacagattctcagaatgttgcacctgttcaagatcattcattatctgatgcagagagaatccaacgagagattgcagcaacgtctgtgcaggctgcgtttagaggttacttggtaataattccagctgtttcgattttattaggcttgtctctctctctctcttgattgctgcttctggtgtgttgtctttttgtatatcctaacatgagctctttgtgtgaaggctcggcgtgctttttgggcactcaaaggcataataaggctacaagcgcttatccgtggtcaccttgttaggagacaagctgttgcaactcttttctctgtcatgggaattgtcaggttgcaagcatttgctcgaggaagagagatcaggaagtccgacattggagttcaagtttataggaaatgcagattgcagctacttcaggtaatgatactttcatttctttgtaagttcaaacttacacttaaatacaaacttagtcgaggaagatattctagtttgggttggtggggaaataattgttagaactggctttttttatcaggggaacaagcttgcaaatcctacagatgcttaccttggaatcaagaaactaacagccaatgcttttgctcagaaggtacgcttgttggtagagttatttattataatgatgttcactgtatccaatatctcttttatactatggagtctctaattttatttaaagatcttgatggataattttgtttacagcttctcgcttcatcaccaaaagtgctacctgtacacgcatatgatacatccaatccaaactcaaacttgatctggttagagaactggtcagcctcatgcttctggaaaccagttcctcaaccgaagaaaacgataagcagaaaacctcagaacaggcttttagtcgaggctgagtctgctaaacccaagaagagtgtccgtaaagttcctgcttcaaactttgaaagttcctcagtacagacatcttttgagtttgagaaacccaaacgcagtttccggaaagtttcaagccagtcgatagagccacccgctgtcgaagatcctcagattgaacttgaaaaggttaaacgtagcttgaggaaggtacataatcctgtagttgagagctctatccaacctcaacgatcccctcgtaaggaagtcgagaagccaaagcttggcgttgagaagacaagggaatcatcatatccgctggttcatgaaactgcagaagaacctgtgaatgtttgtgatgaaaagaaaaagcaagaaatttccgaacagcctgaggaggaggtacatgctcttgagatggaagtacatactcctggaccattagaaactaatgaagcacttgattcctcactggtcaaccaaattgacagcaatgaaaaagccatggttgaggaaaaaccctcaatggaaaaggataccaaagaagaaaagactcccaaaccaaacaataaagagaattccgctgggaaggagaaccagaaatccaggaaaaagggttcagctactagcaagactgagcgtgaagagagtaatgggcatcacgagactagcccatcaatcccaagctatatgcaagcaactaaatcggcgaaagcaaagctaaggcttcaaggctcaccaaagtctgcggagcaagatggaactgagaaagccactgttcccagacgtcactctctaccatctccaggtaatggtaggatcacttctcactctccaagaacaacgagactcgcaaactcaggtgacaaaaccgggaataagaaggagaaacctcttctgtcgtcccgagaaggaaacggttagtgccaaaagctaatacatgcaaactacattctccaaatctctcagagtgctttctttgataatcttactgaaaatcactagagaacttacacattctcttgcatctaactgctctcaact

SEQ ID NO: 652 - DNA, 2967 bp, Arabidopsis thaliana
tcagcttttctctagcgtcggggcctcgatctcttgatttgagcttttcttaggtctgtctctctctgtacactctctccgccgtcgtatctcgccgtcgatttcaatttttccgacgatatgaagctcaccgttaaaactctcaagggcagtcattttgaaattagggttttaccctccgatacggttagttctactttcttcgtccatgcgtttacgtaattttcgcctagtatagtagagagaagtaggaatctcacatagaagagactcagatccacaattttgaatgtttggtgatcaaatttttttattctataagtgtttaatagctttattaactgctaaaattatgactcgcgaatccaatctggtttggtcaagttgattatgttagtcttcaaatcattaaatctgggcatgatgtgcttgtttttaagataatggcggtgaagaagaatatagaagattcacaaggaaaagacaattatccatgtgggcagcaattgttgattcacaatggaaaagttttgaaagatgaaactagcctggtggagaacaaagttacggaggaaggatttctcgtcgttatgcttagcaaggtaacagttcaaatctggctactgcaaagatcatacttcttttatcttcaacaaatcagtcttcttatttaccttaaacaaggataaaagctgatgaataagtgtctttaggcatatgttcctagatgtctctttcatgattgtttcctacctatgaaacatcatttatcttgtaatggcactgacattgtcttttcctttggttattgatgaattgtagagcaaatctggaggttcagctggtcaggcttcggttcaggtaatttatttatttctcatattttcacatcattggcttattctgatgattcttagtgtgtcagacttcttctgtttcacagcctgtttccgctaccacatcttcgactaaggtaactttcttgcatatattttatttgttgaaatatgcgatgagcagcttgttatactggttgttttaatacaaacacgtcttggaaaaccagcctgcagctccatctacaacccagtcttcacctgttcctgcttcacctattcctgctcaagaacaaccggcgtaagtttataattggaaaatgagattatttagagctcttttctctctacctctctctctctctttctagtgtctatgctttcgtcttttcttttgcagggcttgccttttgccccttatatggttttccaaaagtttccatgtttgacctctagtataagttttataacttagttgttgtggattcattaatacattatagtctccacaattgaatggtgtggcagggcacagactgacacctatggacaagctgcgtcaacattagttagtggtagtagtcttgagcaaatggtccaacagataatggaaatgggaggtggaagttgggacaaagaaacagttactcgtgcacttcgtgcagcttataacaaccctgagagagcagtggattatttgtactctgtatgggctctctctgtaacattattcgctaaaggttcaaaggatgaaattattgacaatttttttcttatattagggaattcctcaaactgctgaagtagctgtgccagtacctgaggctcagattgcaggatccggtgcagcccctgttgcacctgcatctggaggacctaactcatctcctttggatttatttcctcaggtacttttgtattaattgtgtatccaatagaattgaaaggtatatttagttaccatctcactctgtggcttaatttccccaggaaacagttgctgctgctggctctggagatcttgggacacttgaatttcttagaaacaatgaccaggttgctattctaactatatctgcattttccctaaattgcgaagttcttatcttttaactatttggatctctcctcatcattcttgaccgattgtgaatatgaaaaggcatctagattggttagaaccacatttgatcaacttatgtggagattgtttgtctggtatagccattctatcaagggatgattaaccgagatgatattaacatgctttgactgttcgttctaacttttgtaaatttactccatatactcattctcttgtatttgctattacattagttccaacaattacgcaccatggtccattccaaccctcaaattcttcaggtaagactcgtctagttttcgttatcctggtccagtagtttgtaagacttctcactgattccgaacctcttatgttggaacaactgcttttgttaccagcccatgcttcaggaacttggaaagcaaaaccctcaacttctgaggctaattcaagaaaaccaggcagagtttcttcagttagtaaatgagccctatgagggttctgacgggtgagtcctccaatctgtttattgtaatctaaggttctgtcagatgtaattatatgcttcttattgatatttcattaaactaaataatttgattcacaaagtttaaaaacataactcatcagggagggggacatgttcgatcaacccgagcaagaaatgccacatgccattaacgttaccccagcagaacaagaagcgattcaacgggtaaaacaccattaatagtaacactctgtttccacacttttttctttgcaacccttattaactatatccctggcctctggcctatctaacagctcgaggcaatgggatttgatagagccttagtaatagaagcgttcctcgcatgtgaccgaaatgaagaattggcagctaactatctattggagaactcaggtgactttgaagactgagttcacaaaacgttatctcttcttcgaaaaagttttggctcttttcttacgttgaattacatatcttccgtgaattaatgtgtgggatttgatctctctctctctgtgacttagtttgtc

SEQ ID NO: 653 - DNA, 826 bp, Arabidopsis thaliana
tctttttaacacaaaagagactaaatttgattagtcaatgtttattggtgttagcattagtacgtttggtatcggctcagatttgttgttaatttggtatcaggttttgagctttgaaaaatggtgagaatcagtgtgcttaacgatgctcttaagagtatgtacaatgctgagaagagagggaagaggcaagtcatgatcaggccttcctctaaagtgatcatcaagtttcttatcgtcatgcagaaacacggtatgttgatcctgcattgtttagctcattttcacattttgtaataaccttgattctgtgtttgatcaactgttttaacatttttgatgaaactgcaggttacattggtgagtttgagtacgttgatgaccacaggtctggaaagatcgtggtcgagcttaatggaagacttaacaaatgtggagtcatcagtcctcgtttcgatgttggagttaaggagattgaaggctggaccgctcgtcttcttccttccagacaggtctgtcttttaagtcttgttcatattttggttctggttttttaaagagcaatcttatattcagtgatcttacattgagttcttaaattgtgcagtttgggtacattgttcttacgacctcggctggtattatggaccacgaagaagccaggagaaagaatgttggtggcaaggttcttggcttcttttactgaatcaagtcttgaagaagagaatcattatggttggtgatactttgcttctccttttggtgagaagaggattccgattgagctaaatgtttaagggtagtagagtttttgatgtcttcttct

SEQ ID NO: 654 - DNA, 2193 bp, Arabidopsis thaliana
tatctgttatatccggctcgtgttggtttcagatttaggcactggtctagaaggtctttcttcggctactgcttcttctgttcaccaaaagaagccttttttggtttcttcttctgtttcatgtcgaggaacttagacagtcctgttcagacacaaatggcagtggcagttttcaagactcctcttactggagctagtaagatggaagggaagcagcatcataagcatcagcatttacagaggcaatcatcggggaggagagttttcgtgcagactgaaactggttgtgttttggggatggagttggatcgtagtgataatgttcatactgttaaaaggaggcttcagattgctcttaatttccctactgaagagagttctttgacttatggtgatatggtgttgacgaatgatttgagtgctgtgaggaacgattctccgcttctgctgaaacggaactttatgcatcgaagctcgtctactccttgtctttcgcctactgggagggatttgcaacagaaagatcgaagtggtcctattgagatactaggccattcggattgcttttcgattgttaaacatatggttaaggacattgttaaggcgatgaagatgggtgttgaaccgcttcctgttcatagcgggcttggaggtgcttactattttaggaacaaaaggggtgagagtgttgccattgtcaagccgacggatgaagagccgtttgcacctaacaaccctaaaggctttgttgggaaagcccttgggcaacctggattgaagtcttcggtgcgagttggggaaacggggtttagagaagttgctgcttatcttcttgattatggtcgctttgctaatgtccctccaactgctcttgtgaagataactcattctgtattcaatgtcaacgatggggtgaaggggaacaagcctcgggagaagaagctggttagtaagattgcttctttccagaagtttgtggctcatgatttcgatgcaagtgatcatggtacttcaagcttccctgtaacttctgtgcaccgcattggtattttggacataaggatcttcaacacagaccgtcatggtgggaatcttttggtgaagaagctcgatggagttggtatgtttggtcaagtggagcttattccaatagaccatggcctctgcctgccagaaacacttgaggatccttattttgagtggattcattggcctcaggcatcattaccattctctgatgaagaggttgactacatacaaagtcttgatccagtgaaagactgtgacatgcttagaagggaacttccaatgattagagaggcgtgtcttcgggttcttgttctctgtactattttccttaaagaagcttctgcatatggtctgtgtcttgccgagattggcgagatgatgactcgggaatttcgtcctggagaagaggagccaagtgaactggaggttgtgtgtattgaagccaagagatcagtcactgaacgagatgttttctctccaaggtcagatgtagtaggagaagcagagtttcagtttgatctagactgtgatgatttggagtcagtctacagttctaagatacaactaaccgatgactatttcaccaaaaaccctttttcaaatggacgttcttcgctcgggaagcttgaagaaagcatcaaggaagaagaagaagatgaagaagaagaagaggacaaaactgaaaatactgtccctatgatcattatgaaagacagtttttttagttcagctgcttttcatgacaaggctccatctctttcaaagctttccacttcaatgaagaacacacatcttagtgacacgacacgtaaaaacccaaaacccttaaccagaggcaaatccgagaacacatcgtctggtcacaaaagcgcaaacgaacagcttccagtgagtgcaagctttgtgaaagtagcagacatgaaagaagacgagtgggttctcttcctcgagaggttccaagagttacttggaccggctttcgcaaaacgcaaaaccgcaacgttgagtaagagacagagacttggcacttcatgccagttttgagagtcgtatagtaaaaagtaaaactcgagaagttaaaagagacagtatggagtaaaaaactgaagacttcttcttcagttctatggtagtaaaaaactagtagttacttttggaaggttt

SEQ ID NO: 655 - DNA, 1425 bp, Arabidopsis thaliana
tttcaaaagcccacgaaagcacctcccctacaataataatattcacagtcgtaagaaattggggacaaagggtttaagagttatcgtctcgaagcttaagcttgatcctaagattcaacaatggcgataatgtcagatcttccacgggatttgttagcagagattctcagtagggttccattggcatctttaagatcagtgcggttcacttgcaaaaaatggaacgatttatccaaagatcggagctttctcaagaaacaaatcgtcgaagcaaagaagaagcaattgaaatcgaaggagtttgaggtgatcatgatgaggaattttagagtttatctaacgagcgtcgatctccacaacgatgttaatccatcttttacgcctaaaggtacacttactagctttagcgatgatgcaaatcagcatcaagtcgataatgtgtctagtgtctttcactgcgatggtttactcttatgcatcaccaaagacctcaactttaggcttgtggtttggaacccttattttgggcaaacaagatggatccaacccagaaattcttaccacataaaggacatttacgctattgggtacgatgagaataagaaccacaaaatcctgagattgaaggatcagtattacgattatgattcacatccacgggcacggatttgtgagtttgaactctacagttttgagtctaattcatggaaggttgttcttgatgttagtcctgactggtatatacactcttatcaccgtggcttgtctgtaaaggggaatacttactggtatgcaacagagaagcatggctatgttaatttcttgatctgttttgatttcacaactgagaaatttggaccgcgtttgcctctgccttttaacgctaccgagtcttttacttatgatgatgttgttactctctctagtgttggagaagagcagcttgcgctgttgtttcagagtgatgctacattgatgatggagatttgggttacgagcaaggttgaccccacagaggttttgtggaacaaattgttcttagcggttgatcatgatatgatagaattcgactatgagttaaagtttgtggcagacgctgggagtttcttcattgaccagaagaagaatgttgttgtggtttttgataaagatatgaatgagcatacccatcgtggcatggcttacattgttgggaagaacggatacttcaaaagagtggatattggggaagaagcatacacgagttgtttcccacttgtctgttcttatgttccaagctcagtgcaaatcaggcagctaacctgattactttctttttctggcatcttcgattgtataaatctgaccactgttatcagttatctggaatctcagagacatggcctctctactactatatgtaaactctcgtgtggctcttccaga

SEQ ID NO: 656 - DNA, 571 bp, Arabidopsis thaliana
cacatgttacctacatagaggccacgtattcaattctcttgcatcgctcagtattcttatctatatgaaatgtaaaaaggatgagctagtgagataaaaaaaaggaagagaaaacaaaaaatggcagacacaggcaaaggaagtgcaagcgctagctgcaacgatcgttgtggctgcccttctccatgtcccggtggcgaatcttgcaggttagttttttatatatatgatccataaaattgatattatgtgatcttaaaaacgttgttccattccatgaaggtgcaagatgatgagcgaagcatctggtggggatcaagagcacaacacgtgtccatgtggggagcactgtggctgtaacccttgcaactgccccaagactcaaactcaaacctctgctaagggttgcacttgtggtgagggctgcacctgtgccacttgcgctgcttagacatccttaactatggttataccatacttgtataataggtactactagctagtcgatctgaaataaagctgcacaacaaaatatatgtatcgtatgctctgcttcttgtgtttccttttt

SEQ ID NO: 657 - DNA, 1491 bp, Arabidopsis thaliana
ttgtccatttgtcaaacactatctatatatgttttgataatttcatagtcgcttttaaagagcatcaacaacaaccacacgcttctcaaacatcaaaccaagcctctctttcacttcctcatggaatattccgacgacggcagattcgacgtgattgtcgttggagcaggagttatgggaagctccgccgcgtatcagctggcaaaaagaggccagaagactcttttgttagagcaattcgatttcctccatcaccgtggctcttctcacggcgagtcacgcaccatacgtgccacttacccggaggattactactactccatggtttccgagtcgactcggttatgggctgcggctcagtccgagattggatacaaagttcattttccaactcaacaattcgacatgggtccggcagatcagcagagtctcctctccgttgtggccacgtgtcaaaaacacgggctagctcatcgggttatggattctcatgcagtttccgagcatttctccgggaggattagtatcccggagaattggatcggagtttcgacggaacttggtgggattatcaaacccaccaaggccgtctccatgtttcagacgcttgcgattggacatggtgccatcttaagagacaacaccaaagttgcaaacataaagagagatggtgaaagtggggaaggggtaatagtctgcacggtgaaaggagataagttctacggtaaaaaatgcattgtaaccgcgggtgcatggataagtaagctggtgaaaacggtggccgggatagattttccggtggagccccttgagactacggtgtgttattggagaatcaaagaaggccacgaggagaaattcacgatagacggagagtttccgactttcgcgtcatacggagctccgtatgtgtacggaactccgtctttggagtatccgggactgatcaaagtggcggttcacggtggttattggtgcgatccggataagaggccatgggggccaggagtgaagttagaggagcttaaagagtggataaaggagagatttggagggatggttgattccgaaggacccgtggcgactcagctttgtatgtattcgatgacaccggacgaggatttcgtgattgattttcttggaggggagtttgggagagatgtggtggtaggcggcgggttttccggtcatggttttaagatggcgccggcggtggggaggatactggcggatatggcgatggaggtggaggccggaggtggaggagttgagatgaaacagtttagtctccgacggtttgaagataatcctaaaggaaatgcaaaggagtatcctgaccaagtgatacttgatgtcccattgaaacattaaactttgttacaaaatgtcaactgctgaattaaaaaaaaaatatggttttaattataagtctttttctagaaatcataatgtgtgtctcgttgtttttttgttttgtttttggggcaaata

SEQ ID NO: 658 - DNA, 1790 bp, Arabidopsis thaliana
acttcacattctccgatattctctctctctctatcaatctctcactctcaaactttctacatacctgaagaaaaaaataatctacgaattcgagccaaaaagatcgaaactttttaatctatgggtgcttcagggaaatgggtcaagtccattatcggtctcaagaagctagagaaggatgaaatcgtaagttcattatcttttttttttgttctctcgttcaaaggttaaagctttatcgagagatactctgttttcaggaaaagggtaatgggaaaaacaagaaatggaagctatggaggactacttcagtagattcatggaagggttttcgaggaaaacatcggtctgattcagacggtgttgattcttctactgtttactctgctgctgttgctactgttcttagagctcctcctaaagatttcaaagctgttagagaagaatgggctgctattagaatccaaaccgcttttcgtggattcttggtgagtttgctaattggttttgattagaattgagaggaatagaacttagtttaatttgaggatttgttgttaattaggcgagaagagcgttgagggcattgaaagggatagtgaggttacaagctttagtgagaggaagacaagttaggaaacaagcagctgttacattgagatgcatgcaagctttggtgagagtacaagctcgtgttagagctcgtcgtgtgaggatgactgttgaaggacaagctgttcaaaagcttttagatgaacatagaaccaaatctgatctcttgaaagaagtcgaggttcttgtctttacctttttagctcattggtttgatgattgtttattgttttgagatttgttatgttctcaggaagggtggtgtgataggaaaggtactgtggatgatattaagtcaaagttgcagcagagacaagaaggtgcttttaagagggaacgtgctttggcttatgctcttgctcaaaaggtaactaacttgtccacattcaacatcttgtttaagttcgtgtctgaagctgaatcgggaatcttgttttgtgtagcaatggaggtcaactactagctcaaaccttaagacgaatagttcgatttcgtatcttaaaagtcaagagtttgataagaatagttggggatggagttggttggagcgttggatggctgctaggccatgggagactagacttatggacactgttgataccgctgccacgcctcctcctctgcctcataaacatttgaaatcaccggaaactgcggatgttgttcaagttagaagaaacaatgtgaccactagagtatctgcaaaacctcctcctcatatgctgtcttcaagtcctggttatgagtttaacgagagctcaggttcatcctcgatttgtacttcaactacgcctgtttctggaaaaactggacttgtttcagataactctagcagtcaagcaaaaaagcacaagccaagttacatgagcttgactgaatcgacaaaggctaagcgaagaactaaccgcggtctcaggcaatctatggatgagtttcagtttatgaagaactctggaatgtttacaggggaattgaagactagtccttcctcagatccttttgttagtttctccaaaccactcggtgttcctactcgattcgagaagccgagaggttaaatgtgaccttgttagattggagtttcaacagcttgttgttgtcttgtgtgttgtgagatatctgtgtatgttgttaattgttctttttcctttggaactacattggagttttgaatttaa

SEQ ID NO: 659 - DNA, 2019 bp, Arabidopsis thaliana
attaattttttttctttcttcatatatataattcgtttcttcttcctttttccccgagatttttttcctctgttcggtcggccattgaattgttgttgattcattggctctaaaacgaaaatgggaattctcaacgacgacgccgttttaatcgaaccgggaaaaatctccggagatcccaccgtcgttaccgtcaattgtcctgatgaatccggtctcggttcaactctgtgtagaatcatcctcgaatttggtctctccattacccgagcaggtcaatattcaattttacttcgtatctgtttaggggaatattctctgtttgtcgtttagcttcacggaatattcttctttatgattcgaaaaattcaattctgtttttcttattttgagggtaattaatatgtttgtaaaaatggtgtttgcagatttttcaacagatggaagatggtgttatatagtgttttgggttactccagatattagctctcctaaaattgattgggacagcttaaagaatcgtcttttatcagcttgtccttcttgcttaggctctttctacttctgccttcaatccaatgtctctaagcctccttccctttatcttctcaagttcttttgccgtgataggaaaggattgcttcatggtatgtgtaaagttattgtcttttgtcttgtgcttggtgttttctttatatggttgattaaaagtttgtgtttttttggtgattcgtagatgttactaaagttttgacagagctagagtttacaatacaaagagtcaaagtcatgacaacaccagatggaagagttttggatatgtttttcatcactgacgcaatgtgagttttcttcttctttctaattctgatgtttcatttgagagaagaaccaacattaacgttgtggtttgtgactttgtgtaacagggatctattgcacacgaaacagagacaaaccaaaacgtgtgaccatctaacggctgtgcttggtgagcatggtgtgagttgtgagcttgaactagctgggcctgagttagagagtgtgcaacgattctcttcacttccacctttggctgctgatgagctgtttggcccagatgggtttgatattagcggctctagctctaacaaagcggttcttaccgttgataatcagttgagccctgcacatacgttgcttcagattcgttgtgttgatcaaaagggacttttctatgatatcctcaggacttccaaagactgcgatgtccacgtacgttaaaactgatctctctaacattaagagaacctaaccttacctctgctaagagaagttgggacttctatggttgaaagatttgtataactcaagtagttcttgtttctttatccagattgcatacggtaggttctcctccaaggttaaaggttataggaatttggagttgtttgttagaggcacagacgggaataaaataatggacccaaaacatcaagccaacttctgtgctcgacttaaggaggaaatggtgtgtcctttgcgagtgattatcgtgaaccgaggaccagatactgagctattagtagccaaccctgtggaactatccggaaaaggaagaccacgagttttctacgatgtcacacttgcgttgaaatcactaggaatctgcatcttctccgtaagtactgtataataatacattgtgttctctaagctttttgaacggttattttcggtttgttttaagattggcattgcgttttcttgtaggctgagattgggagacattcgactttagatcgacaatgggaagtttatagatttcttttggatgagagtcgtgaattcccattggctagcctccgtgcgagaaatcaagtagtagatagagtcacaaagacacttatgggttggtgaagcggatgagagtgagctttcatgaacgttatgctacactcaaggggacaaagaaacaaagtcttcttcgcttgcggcttcgggtcgatgaaaagagtgatgcaagggggttgtgattgc

SEQ ID NO: 660 - DNA, 1293 bp, Arabidopsis thaliana
tcgtcttcttcttcttctccttcttcgtcttcccttaaacccattaattcaatttcctgataaacgagcagagagagatctgtcaaaatcacaaaccgtgaattcgggaagaataagccgatgatgcttcgtattgttcaaatcgcgtttctatgtctcgttctcgtcgccgggatctcgatctccacggcgatatcagagactgagactatatacgagatcctcctggcaaacggattaccttcggggatattcccgaaaggtgtcagagaattcaccttcgacgtcgaaacgggacgattctcggtttatttgaatcaggcatgcgaggctaaatacgagactgagatacattacgacgccaatattacggggactataggttctgctcaaatctctgatttgtctggaatctcggcgcaagagctattcttgtggtttccggttaaaggaatccgagtcgacgtgccgagttctggtcttatatacttcgacgttggtgttgttcgaaagcaatattctttgtctttgttcgagactccgagagattgcgttccggttcgtgggattcacaaggtatgcagaatgagttttttcaattgaacctttaaagttcttgaaaattattgaaggatactaatgggctatagtgtgaatagagataattcaaatgttcttatcgctggattttgtggtttttcaatgtcgagcttttgaatattcacaagtttcaggcttgccactaagaattcaaatgagaatcctttttcaaagtttttttagcttatctcattcgtcatcatctgaaacttttgagattcctttcaatggtcattttttctccattcttgacttggttgcgatttttgattggtcaggaactgttagacatgtgacatgaagaattatctttagagctaggaaagattgttcctttttagggttatgttctccattcttgaattggttgagatttttttatcggtgaagaactgttagacttgtgaaattgggaatatctttcgaactaggaaagatggttttgaaagttttgcattgatcagattcaatcatgtaatggaaaataagctaatgtgtgctcaatgggtcttcttgcaggttgagttgccattgtaccgagtagatcaaaatcttgggagaaacatcatttagcaagagttttaaagaattgttgtataccataccagaaagaaaggaagatagatgttctcatcaatcaattcttgaagatacttcaactgttttggtctcaaatcttaggcatgattcaaa

SEQ ID NO: 661 - DNA, 2239 bp, Arabidopsis thaliana
aaaaccaaaccggttttagcttcttctttgaatttttgttgtgacggaggggatttgctttaaaagtttagggcttttaaaatcggcgacggcgagcggagaattcccaaggaagagtcgatgaagttgaaatcggtgttcgatgcttcggaaatcaaatcggaatttgaatcagcgggaataaaccctaaattcgcgattcaaatctggaagtatgtaattcagaatcctgattgcgtttgggacgagattccttcattgccttccgctgcatactctcttctccattccaagttcaagactcttacttcgtctcttcactcgctatttcattcctccgatggcaccacctcaaagcttctcatcaagctccaggtactctatactctgttactgtatacaacacattgcttttatggattctgaaaaacttgtaatgtctctgtttcctgacgaactcatattggattcttgcttttggttttgaaattgaagaatggagcttttgtggaagctgtggtaatgagatacgatactcggttggggatgttaggagggaaaccacgtcctggaggtataagatctacgttatgtatttcatctcaggtattgatttttatcacgcaatgttatcttggttttatcgaatgaaagacatgtgatgtgaaagtatttatcaataggttggttgtaagatgggttgcacattctgtgctactggtaccatgggatttaaaagcaatttaacatctggagaaattgtggagcagcttgttcacgcctctcgcattgctgatatacgcaacatcgttttcatggtatatttctgcttctgttattgcattttatctacactatgtgcaccttgccttatggttatttattttatatactctgcattgatgaattttattcaccagttgttgccttggtttgatgattgtgatcagggaatgggagaacctttaaataactacaatgctgttgttgaagctgttcgtgtcatgttaaaccaaccatttcagctgtcgcccaaaagaattaccatatcaactgtaagtactcagaaagctaccttgaaacattcgtaaaacagagaaacttattcactgaattttgtaggaatactttagattatggaatttgataaagggaactgatagataaacttcaatccattaaacctcgcagtatgcagcttccaagacatctttcagctttttttgtctagttggttacttttaaattttggtgttttgggattttcttctgatttccttgtccttccgtaatgcttgtaccgtatattccaggcataaatctaaatcatgcaatgctgcctgtgttgacacttttttttactagttagcaaataaatttccctgtatcctaatgtcatttgcataggtcggaattgttcacgcaattaacaagctacacaatgatctacccggtgtaagtttagcagtatccctccatgcaccagttcaagaaatccgctgccagatcatgccagcagctagagcctttcctttacaaaagcttatggatgcacttcaaactttccaaaagaacaggtagttcatgtactcttgactggttcgttgctgttaaatattaaaaccacaatcccttcagttacattgacgattataacattatgccacattgtcattggatttaacagtcaacaaaagatcttcattgagtacataatgcttgatggagtaaatgatcaagagcagcacgctcatctactaggcgaattgctaaagacatttcaagtggtaaatcttcgatgtcttaatactcttaaaggttctgcaattatctgatgatattttttatggaaactctgtgctcttttcttgaacaggtcataaatttgataccatttaatccaattggatccacaagccaattcgaaacaagcagcatacaaggcgtgtcaagattccagaaaatcctgagggaaacatacaagatccggactacaattcgcaaagaaatgggtcaggatattagcggcgcttgcggtcagctagtggtgaaccaaccagacatcaaaaagactcctggaactgtggaacttagagacatagaagatctgcttctctaactttaggaccagagacatgaaacagacatttggaatggttgtgtagtatctttgaagccactcttcaaaacccttttcttaaacttcacattttgtcctctcatcactttgtggaaaaca

SEQ ID NO: 662 - DNA, 1465 bp, Arabidopsis thaliana
ttcaatactctcttctcctgaatctctttacctttttacgttgacattgatcctcgcagtgtctgattttgatcgaagaagaagaagagatcgggattttttcgcggttgtatatcgcctatggacgaggtgatgacagcggcggacgttggttcgttaggtggcggcaatagggcgttgtacggatctcctccgtcgcataatctgtttcctcacaatctcccaatcttctccgcttttcttgccttcgctcttgctcagttcctcaaagtcttcactaattggtctgttcaaatctttcgttttctcagattagtttgatctctgcttaagatctgtgattgaacaaatttcttactgttagggtttcgattttcgatggattaattaggatttgcaaatttttgctcatgattaggtctcagaagttgaatgttggcatttgtgtagctatagatctgttgtagttaagattgaaagaagtggaattctcagttgtttcgtgatgtatgttagatgttcaggtacaaagaaaagaggtgggactctaaacgtatgattagttctggtggaatgccttcttctcattctgctactgtcactgccttagctgttgccattggctttgaagaaggagctggagcaccagcttttgctattgcagttgtcttggcttgcgttgtgagtgttcttctcatcttcttttccacttcacaatttgtcttacaaatgccttgctttgtttagtgtagaaaagagatttttgctttcattgtgaatagcctatttggtttcatagtaagaccaatcttttgtatatttctgaattgggctgcaggttatgtatgatgcctctggtgtcaggcttcatgctggtcgtcaagccgaggtaaagctatagaaaagttattaatctcatctgttttcatcttcttttattgttccatgctttctgaaaccgcaagcctttttcacttgattggaaatttcagctgctgaatcaaattgtttgtgagtttcctccggagcatccattatcaacagttagaccattgcgtgaactgcttggccacactcctatccaggttttctatacccaccagtcaattctttttatcattccaatcattaaacatttttaagtccaatgactgtgtcataaccatgttagaattagatctagatttcataaagctgaaacatatagaactaaagtcaccgtattcgccatgtattaaccataggatgttacattctattgctaagttatgagattgaaatacaggttgcagcaggtgggattttaggatgcgtggtagcttacttaatgaggagctcaagctagtcagtctctctacacaagaacaaatcccgaattcttttgaaatcatagacccttcaggtactaagatagattcagcgatatcaagtgacgctagattattggagtaaatggaaattgtta

SEQ ID NO: 663 - DNA, 2761 bp, Arabidopsis thaliana
tgggcctccataaatatgggccgatatttctaatttttcgcctctctcatagacgcgaacagttttagaaaggaaccgagatatttttctcagtagagagcttgaacacacgaagaaaccatggcgggaatcgatacgcagaagcagcttctctctctgatccgcgatttcacctctgaaagatctcgtggaggtaagatacttcatacattttcttcgttttctggagatttcgcgaagaagaagaaatcggaatgtgtttaatagaaatttgtacagattctggagaagatgatatagatttccattattttgagttttagttgttgattgtatgcgattttgatcttatcagtctctgtaattggagaatttattgttctgattgtttgtgatttttcaaattaagagcaaagagttgttggattgaagaagagaatagagattttacaatcggaagttgaagcagcgaattcagaagttgagaaagcgaagcgtatcaaagaagtagcggaagaggagcttaatggttacgaagttgaattgtctttgaatgatgctacgattcaatctctcgaggttttgattttctttggttttacttgattttctacgattcaatctcgatgaataagaagttttggtgtctaatgagatcgaaactgtgtttcgttttttttttctcaggcaaggattagtcttcttcaggatgaagttactactattggcagtgaagttgatgctcttaaggtttggctacactttgtttgttgaaattgttaatgcttggttggttgatttcttcgtttgatattctggaatttttgttaatgacttgatggttggtgaaataaagaacaaggaaggattactcaggtgattttgatatttctaacgtcttaataagttctagttcttgatgtatacttaggttatgtttgttaaattgcttgttctctttgtgatattcagagatcagtttataagccaaatggaagaactgaacaaggagataaggttattttctattctttgcgttatcatcttgtacctggtgtaacacatctaagttgcttggttggtaatagggagttccagaaaacagtagattcgagtttgagcagtgatgatggtattggcattacagcaagtgagtaacgaatgtttgtagtttactcttcttgtctgatttttcactgttttagtaagagacgatggcttctggatatgtttcataattgcagatgtcaaagcttctgaagacggttctggagctgatttagaagctataaagggaatgctatctgaagtaaattctcaattggcaaaagaggaagaaggatacctggcagagcagaagatacaagaacaggtaatgtaataggagtcaattgtaaactttgctgcttcaaatatcttttgctagcttatccattccctgttttttagattttgtttaatcattcagtgaggagaacaaattggtatttgataatttggtgtttctatctgtagctgcagaaggagcttgacgactatgagaagaaaatgtcactcatggaggccattacagacaaaacgaattcagtgcaagttctcactagatatcctttaattctgttagctggtgaagcataatttataaaatgataattacggtcgcagtaatcatttatcacatttacgccagtgcttgtacctttcatttcgatttgccattctttcaaaagaatagtttccttgacaaaaaacaagcagacttctgagttggaacagacattggcttcacttggggaggagctgcaaaggagatgccgatgccaacattgcgaggcggaaaatttggaagtcctgagcttacttcttcagggagatcaagtatgttaacccttacaaactatttttttctcatttctaaataacttttttgaactaccaccaagatactggaaccaaaagcttttacattcgtatgttatgggcttatctggaaagtggaatgttgacaacggtctggtgtatccatgttcagatattttccgtttctctagttttttttactaaaacctatttgaaatctgttagtgtaaaccttattacagaaaccaataaaacttttaaccagaatttcaaagttaagatagaaggcatctatcacatgtagacgaaccaagtttctcttagacagattgaagcaggcagtctctagttaaggctcataaatagacttttgtggtctattgatcatctagttttcactgatactgctttgtaaaacgtatagtcaagaaaagactccgtatatatgttctgcttcattttagctggaattatcatccttaaagaatgtagacttgtgtttgggtagctatgattttaagaagcatactctctgtatatgagttacctttctaattttgggcacttcgattttaccttattatatactagtgatgagactggtgatgctaaaaaaactggctctcacttatctgtgtgagggtagtatctgtcaacatgactagattgtactatcaaatttgtaatcttagactaagcttttcgtttctgtttgatatttccctgcaagctttcatgttgaaaacattgttatattttgcaggatatggaggtgtcttagttaaaagccgatctcacttgtggttactggggaaaagattaatatactcgggtctcaagatggtaagtcatttactttcacctctcaggatctaagaaacatacttgtctagaaatttta

SEQ ID NO: 664 - DNA, 1149 bp, Arabidopsis thaliana
attaccagacactattaactcttgttcttgttatttaaacacctaaccagaaacacactagaaacacacaccaaaaacaatctttcccgctccttcttacaccaaccagagaactagtctatggatccatatagtcatggatcaagcttcatgaacctcttaactagtcaacaagaggctcacaatttagaaaccaatccgtatgatgatgatgtttctccaaaccaagctgcacacacacctaaggtgaaaagagagagaaggaaatggtctgccggtgaagacttggtgcttgtcagtgcttggctcaacacaagtaaagatgcagtaataggcaatgaacaaaagggttatgccttttggtcacgtattgctgcctattacggagcaagtccaaagctcaacggtgtggaaaagagagagacaggtcacataaagcagaggtggactaagatcaatgaaggtgtaggcaagtttgtagggagctatgaagctgcaacaaagcagaaatctagtggacagaatgacgatgatgtcgttgcattagcacatgaaatctacaacagcgaacatggtaagttcacccttgagcatgcttggagagtgcttcgctttgaacagaaatggctctctgctccttctactaaagcaactgtaatgtccaaaagaagaaagtctgacaaggcttcaacctcccagccacaaacccatgaagcagaagaagcaatgtctcgtcctattggtgttaaagctgcaaaggcgaaagcaaaaaaggctgtgagtaagacaacaactgtggaagacaaagggaatgtgatgttggagattcagtctatttgggagataaagcagaaggattgggagctaaggcagaaggatcgagagcaagagaaggaggattttgaaaagcaagaaagattatcaaggaccaaattgctggaatctctcttcacaaaaaaagagccacttactgatatagaagtggctctcaagaacaaattaatcaatgagatgttgtcaaactcatagtttcaattcactctctgttgcaacattttagtttcatgtgtcataatttagtcttctttttgtttttgttatttcatctttgtaatgcttgagcatgttaatcagtttttaaaatgaatg

SEQ ID NO: 665 - DNA, 1106 bp, Arabidopsis thaliana
caacgaggcatgccatcaacacgtgtcgacacgagtctctctaaaaatggctactacaaagtacaaactttctttaatcagcgaggaaacgcagaaaacaaaaattgtgtagaaagctagatgatgatgcaatcccgattattagcgtttgcttcagcggcgcgttcacgtgttcgaccaatcgctcaaaggcgtttagcgtttggatcatccacgtctggtcgcacagctgatccagagatccatgccggtaacgatggagccgatccagctatctatccgagagaccctgaagtaataattgtttcttttctcttgttttcaattttagaccatgttgaaaataaagaaaaatgttctaaaatacacaaagaaatcaactttgtttaagtttttggtgattgcttgtgtttcagggtatggatgatgttgcaaaccctaaaacggcggcggaagaaatcgtagacgatactccccgaccgagtttagaagagcaaccgcttgtaccgccgaaatctccacgcgccactgcgcacaagctagagagtactcccgttggtcacccgtcagaacctcatttccaacagaaacgaaaaaactccaccgcttctccgccgtcgcttgattccgtgagctgtgctggtttagacggttcaccatggccgagagacgaaggagaagtggaagagcaaaggcgaagagaagatgaaacagagagtgaccaagagttttacaaacaccacaaagcttctccgttatcggagattgaattcgccgatactcggaaacctattacgcaagctaccgatggaactgcctacccagccgggaaagatgtgatcggatggttaccggagcagctagacacggcggaagaatctttgatgaaagcaacaatgatattcaaacgcaacgcagaacgtggcgatcctgaaacgtttcctcattctagaatcttaagagaaatgagaggcgagtggttttaaactaaagaccacaataaaatgttaagaagtgtctgaataaacttttgtcaattagcttcattgagacattttggttccttacgaaagtgaacaaagcctctttatgtcccaaatctctag

SEQ ID NO: 666 - DNA, 1199 bp, Arabidopsis thaliana
cctctctagacttccttaaatcgattctcccgaattcgagaacagagcctttttttctttaattccaactctttctctcttgttctgaattcgtggttcgtcggtattataaaaaaaaacatgacagggttctctgtgtctctttttgtgtcaaacttgtcaaatgtggcctcgtatttgtcgcccatcttcgagaacatcccctccaccaaggttgttcccgcacagatcgagaaagttgtctctttggtctctcgtaccggtcgcgatttgcagcgttacgatcacgctggctatcgtcaagtcgtcgggtacgtcttaacgcctcttcgttcatttttttccaaaaccctaatttttgttcttatcaaattaattttacccctaattagaaattagctttggccgttgttcaaattcacaataatgattagtttggtaaatatttaggtgtaatttgatatagttttacaacgaacgttagaataattaaagttaccaattttaaaaaattcgtgttcaatagaaagatcgttaaacggttaattattcccgcggcaatttggaataacgtgttgaagttttcaaaatttgaggactatctctattcattttttctggaatctaatatcaactttttctgcagatgtgtaccgtatagatacaagaaacaagaagtcaatggagttgaaacccaagtaatccaagttcttcttgtcagtgctcaaaagggcaaaggaatgttatttccaaaaggaggttgggagacggatgaatcaatggaggaagctgctttgagagagacgatcgaagaagcgggtgtaacaggagagctcgaagaaaagcttgggaaatggcaatacaaaagcaaaagacatagcataattcacgatgggtatatgtttgctttgcttgtcagtcaagagttcgagcgatggcctgaggcggaaatgagacaacgcagatgggtaagtttggatgaagcaagagaagtatgtcagaattggtggatgagagaagctcttgaagcattcattaacctgaaatgtctagctgacgatgatgaaagtgggaactgaattagtagcactcagaagaaaaatacgatgtttatttagagttggtgaaacagagcttttgacttagataacctctacatggagctgaagcttcctaagggatacagttggtcatagctt

SEQ ID NO: 667 - DNA, 885 bp, Arabidopsis thaliana
tctaaacagtttctctctctccctcacagggctctctcatggcggagctaatctgtctatttcactggtgattctgtttcactatctgagaatttgtttagagtttccgttaccgagtcgatgatgagtgaactcgatctcggaacgagtcagaggatgacggaaacacaccgcacgacgacgacgtttcttgatttgctccgacgacagatgagcggtcacgatctcaccagaaggaaacggacgttaaaagaacggttgagattcaaatgcatcggatgctgtggtccaacctggaatctccgtctaactaacaacaccactcttcacagtccaacctcaagagacgacgaaatcgaagagttacaaattgaaaccggactcgttctcgaatcggatcatggatcgggtacgggtatgaatctcgcgacagcgttagaagcggagaggtataaccgtggagaatcgacggaggcggaggcagatatgacgccgaggagagtttcgttgatgagattgttggaagagacggcggagaaaatcgttgatgacgacgggaaagaaacggagatattaacggcgtctattgggacgttaacgggtaatgattcggtgtgttgcgtgtgtatgggaagaaagaaaggcgctgcgtttattccatgtggtcatactttttgcagagtgtgctctagagaattgtggctgaaccgtggatcgtgtcctctttgtaaccgtccgatcattgagatactcgatattttctgaaaacgatcggacggctaaaagttctcgatccacgtgagtaagtgaggtgatccctagatacgtttccaaagttttaactacggtttgtgtactttgtacgtttcttttggttattgaaga

SEQ ID NO: 668 - DNA, 1781 bp, Arabidopsis thaliana
gtgaaatagaaatttgatatctctttattagtttctgcatctcgaggggtttttgggattctctgattcgatcgagttctatttgtcgttgtgtacaacatctcgggtggatctttgttgatggcgaaactgagacactcgcgatttcaagcgaggaaatggtcgacattgatgctggttctgtttatgttgtttatgttaacgattgttctcttaatgcttttggctttcggagttttctctcttcctattaacaacgatgaatcctctcctatcgatctctcttatttccgacgagctgccactgagaggtgagctttgcatgaatttcttgatctctctggaatttttatattaaatttgtttaatttcctttttgtttgtgtatcgaattcagaagtgaaggacttgggaagagaggagaccagtggactgaagtgctttcttgggaacctagagcttttgtctaccacaatttcttggttagtctgattctttattccacagattttattcgattaatttaccactgattgtgttaatatcttcagtttgatcattgtttaagatttagtatctggaggattgattaattaattattgatatgattttgaccagtcgaaggaagaatgtgaatatttaatcagtcttgcaaaaccacatatggtgaagtcaactgttgtagatagcgaaaccggcaagagcaaagatagcaggttcggtctcatcatgcttcttcgtgtctgagaattttttcttttttatattcttaaaaaaaggcaagcattgtggattgttgtgatgatttgtgaaatgaaaacactttcagggtgcgaacaagctcagggactttccttaggagaggaagggacaaaatcattaagaccattgagaaaagaatagcagattacacctttattcctgcaggtatcagagacttatacttattttaatcatcaatttacagttttggactatcattatctctcaaatttgatcataaatagatgcattcatctgtatattagatcatataagcttttttatgtatgatgaactatgaatcaatgaatgtgtgcagatcatggtgaaggacttcaagttcttcactacgaagcagggcaaaagtatgaaccacactatgattattttgttgatgagttcaacactaaaaatggaggtcaacggatggctacaatgcttatgtatctgtaagagttttctaactttacttgattttaaaggttgctatgttcaagtatctactaattttgccttcaaaatccttattctacaggtcggatgttgaggaaggcggtgaaacagtgtttcctgctgccaatatgaattttagttctgtaccatggtataatgagctctctgagtgtgggaaaaagggactttccgtaaagccgagaatgggtgatgcattgcttttctggagcatgaggcctgatgctacactagatcctacaagtttgcatggtaaactaccttcagttttgaaagtcattcgaaacactcttgttatttttttccgataccattgagtttgtggttgctaatatatgtcttcttgtttctaggtggatgtcctgtgattagagggaacaagtggtcatctaccaaatggatgcatgttggcgagtacaaaatctagcgtgtttggtttctggtaactgtccattcctcctaagtttcaaataagcaaatttgtccatatctcagtaatagagtggttaagggattagaatcacttatcatcagtgatcatatgttg

SEQ ID NO: 669 - DNA, 978 bp, Arabidopsis thaliana
acctatacatatatgccatcacacttcctattcttcaccaaaaacaagctcaatattctcttctttcatttcactcgatcaagtttgagcttagcttttaaaaaaagagagaaacaaatcatgaggacaatggttgatttaggaaagcaaagagatcataactatcaccacatgcaaatcataaccactcctacctccgtggattgttctcgcgaattccgtcaccgacgaacacttcgttcactcatcgaatgcatgattccatactgttgcacttaccaacaacaaccataccaaaacgacaccctttcagtctcttccacttcatcctcgtcttcatcctcagaccactcttcctcctcccagagtagcagtaccgtaagtggaactttcttcggacaccgtcgtggccgagtcagcttctgccttcaagacgccgccgtgggatcttcaccgctgctcctcctcgagctagctgttcctacggcagctttagccaaagaaatggacgaggaaggtgttctacgcatagccctcgagtgtgaccgtcgtagaagcagcaatagtcgttcgtcttcgatctttgatgttcctgtttggtctatgttttgtaacggaaggaaaatgggatttgccgtgaggagaaaggtgacggagaacgacgccgttttcttgaggatgatgcagtctgtgtcagtcggagccggagtggtgccgtcggaagaggaggatcagatgttgtatttgagggctaggtttgagcgagttactggttcgagtgactcggaatcgtttcacatgatgaatccgggtggtagttatggacaagagcttagtatatttcttttgcgatcgtgaaattaagtacggtatactatgtcatgttcgtttttatttttataaatgtaaatcttaaagtaatatatatgcaatttttatcatttccactaaaaatatagaattggttcttgagagaga

SEQ ID NO: 670 - DNA, 717 bp, Arabidopsis thaliana
aattgtagtatacacatatggctaaggccaattgttgaaatggaaaaacaacttgtatattttcttgagtattagtttttttggggggacaaacttgagtattgtttaatgttggtatatatgtttgcgagaacaagccaaatcacacactacaataacagaaaaagaggagctttgcgggacgagtacggggattggcgaggaagttttgccctgaatttagggcggtgcacggctccgttagcagagctttggggtgtgtactacgggttggttatagcttgggagaagggtataacgcggctggagcttgaggtagattcaaaattggtggctggttttctcacgacagggatagaagactctcatctgttgtcattcctagtacgtttgtgctatggcttctcatcaaaggactggatagtccgagtttcgcatgtttatcgggaagctaaccgttttgctgacgagttagcaaactatgcttttagtttacttttaggctttctttcttttgactcaggtcttccgtttgtcgattcgattatgcgtgaggatgctgcaggtgttgctggggctagacatgtgcccatgtaattttttatttttggttctattgaataaagacggcagtccctcccgttggtttaccaaaaaaaaaataacagaaaatgaaaggaagtctagccaggaactgggccaaggctcttttgttaa

SEQ ID NO: 671 - DNA, 1091 bp, Arabidopsis thaliana
attttctcatttaaataccattgtgaagaatctaaaccctaatctaccagcgcgactcttcatcacgtcaaagttgtcaattattttgaaaaaccctaaggagattcaaattacgacactatgtcgacgacggcgaatactaacgcgacgactgcgccgaagcgtaaaccagtgtttgtgaaggtggatcagctcaaaccaggaaccagcggccatactctgatcgtcaaagtccttgaatcgaatcccgttaaaccggcgattcgtaaaagttcgttgacgcagcagccaatttcatctcctcgtatcgctgagtgcctaattggtgacgatactggatgcattcttttcaccgctcgcaacgaccaaggtaaggatcttaattatttacatatataagttctcttggttagggtttcgtaatcgtttctctatcgttttcactcgaaattgcgttcaatctttccataatttctctgtttctaggtttatatatgccttgattggaatctctatgtttgtgaagatctaaaacatttatacttcagagattttgataaagtttaactttttttatagataattttgcttatagtttagtttattgatgaacagagtatatctatttatatatgtctaagctttgattagtgttcaatatgttccacttcattaatctctaagctttgattagtgtgtttgtgtttgacatttatacaacttcctattcaatatgtgagaatatgtatggtactaattaatgatgttcttttggggttgcaaatgcagttgatctaatgaagactggagcaacagttatactgaggaatgcgaagatcgacttgttcaaggacactatgagaatggctgttgacagatggggacgcattgaaataaccggtcctgtttcgttcgaggttaaccgggccaacaatctctctctggtcgagtatgaagtaattactgcttaatgactacaaccggtgtctgtctctacttctcttcgttattatttaatttaaattttcagagaactctctaggtcactgagattatattcagttatgattacttttgagattatgatggtg

SEQ ID NO: 672 - DNA, 1373 bp, Arabidopsis thaliana
cagtctcttaagttcaatgaaaacataatgtggcacagaggtctttgcttttgtacctttcagaatcttttattgattgatgatgtttacatacaggataacctctactgaggcatccaaatgttgaacggaaaagaagagcctaagcagaagaaaggtaaggttttgatttgacatttgtgtgattaatgtactaattagagatcataatgtgtttgctacttttcttatgtggctcggttcttcatcggcaggttggtcagagtcgctgctagaatttcggtcagggtttggggaaaagatgaaagttgtgtcgaagaaacgttggaaatctcttggtcctcttcatctgaaaagcaaatcagttgcacggttttgcttcttttcgaagttgaagtcaaacaaccatggtccaggccgtgcaccagtgtatctcaatgtttatgacttgactcctattaacggatatatctattgggcaggccttggtatatttcactctggtgtagaaggtaagctttaggcgctcgcttgtgttttcttgttcatatggttgaagtatccaaagatttgcatctctggtgtacttatagttactgctatagctaactctgaacatttggcgtttacagttcatggagtagagtatgcttttggtgcccatgattatgcaacgagtggtgtttttgaggttgaaccaaggcaatgcccgggcttcaagttcaagaaatcgatattcattggaaccacgaatttaaacccaacacaagtgagagagtttatggaagacatggcttgcagttactacgggaatatgtatcacttgattgttaagaactgcaaccatttctgccaggacgtttgctacaagcttaccgggaaaaagatcccaaaatgggtgaatcggcttgcacaaataggtaacaaatgtttgttgcatttgagaattgttgaagaagtcttatttgaaagactaatttacttttttttctgcaggttctgtgtgcagctgcatacttcccgagtccctcaagataacagcggtctgccacgatccagacgggcaaatcccggaggaagaaaacgaaaagagaagtcttagaagctcattcagctgtttatcatccatctccatgagacaaaaacagctttcaacatcatcattgttcctacaatcacctctcagaggctgcttacctccttggcaactcaaacgctcaaaatctaacagcagctccttgaaagaaaggtagacattccaacaaaaaccattgcggtctctcattcgtttcgttagcaacacaaaccacgatttatccttcttctatctttgtaatggagttcgaaaacagatttcccgcgccatcgctttt

SEQ ID NO: 673 - DNA, 705 bp, Arabidopsis thaliana
cagaataatacgactcgtcaaactttatataaactctatttccctcgtccttaacaatacatttcacgatcccaaatctctctttctctcaacttctctttttaacaaacgaaaaaagacatggggcatagaaataccgtattgacaatacttctaaccatttctatagccataatggtactcattgctacagtatttgttagcaacaacaaaacagaaacgttgttacaaacgcatacgcagacgcaaacgctaattacaacgggaagggtgagccgtttcttagcgcaaaacgcaaagaacggtcgtaatcttaacgcagcggatcattgcaataaagaagaggagatatgcaagagtcaaggaatgtacaactcaaccatggcgtgttgtagcaacaagtgtgttgatctggcgtacgataacgataactgtggcgcatgtaagaaccaatgcaagttcacgcagacttgttgtagaggagagtgcgtttacttagcttatgataagaggcattgtggggagtgcaaccatagttgtttggttggtgagttttgtgtctatgggttgtgtaattacgcatgatatgtgattagttagtttttatatgttaaactttggtattttattagtgttttgtttatttcgatttataaattttaatcgataatttgatacgactagattggttttctttgtgatatg

SEQ ID NO: 674 - DNA, 1128 bp, Arabidopsis thaliana
ccacatggccacatgctacaatataactctggtttatctctgccactatatatcgtgatcgcttcatctatctttgccaaaaacaataattttgatatctttgacctctaatctctctcaatggctgtatcatttcaaaccaagaaccctctaagacccatcaccaacatcccaagaagctatggtccaacgcgtgtacgtgtcacatgctctgttactaccaccaatcctcagcttaatcatgagaaccttgtagttgagaaacgccttgtgaatcctcctctttccaagaacaacgacccgactctgcaatcgacatggactcatcggttatgggttgcagcgggaagtacaaccatatttgcctctttcgctaaatctatcattggagggtttggttctcatctttggctccaaccagctttagcgtgttatgcagggtacgtgtttgctgatctaggctccggtgtttaccactgggccattgataactatggtggtgcatcaacacctatagttggagcccaacttgaagcgtctcagggtcatcacaagtatccctggacaatcacaaaacgtcaattcgccaacaattcatacactatcgctcgagccataacttttatagttctaccactaaaccttgcaattaacaatcctctgtttcatagctttgtgagcacatttgcattttgcattttgttaagccaacaattccatgcttgggctcatggaaccaagagcaagcttccacctctcgtgatggcgttgcaggacatgggactgcttgtctcacggaaagatcacccgggacatcaccaagcaccgtataacagcaactactgtgtagtgagtggggcatggaacaaagttttggacgaaagtaacttatttaaggcattggagatggcgttgtttttccagttcggtgtgagaccaaactcgtggaacgagccaaactctgactggacagaagaaaccgagactaatttctttacaaagatttaaagaatatctgaatatgtatgagtgtgtcgaataaagagcatgtattaggtttaagtatcagatcttgtaagctgattaaacctccattgttgatgatctttcgtaagcatgcaaacttca

SEQ ID NO: 675 - DNA, 1479 bp, Arabidopsis thaliana
acagagattctgaaacctttctgaaaaaccattccggcgggaaaatagaaaaaggcgattagggtatatactcatctattgacattgtagcgaagctaatcccatcgaaatccgatagccatgtccggagaagcttcgaccagccgccgtaagaggcaacgtgttccttccagtgttgaatccgtagaaaatggcggaggcgatgcggtggcgcgatctgggacattgttcgagctagatctactcgattgtcccatttgttgtcacgcactcacgtctcctatcttccaggtattgtttcttacctcttcctcatcactcactcttccttctttgggtttgtttgagaattttgaaaactgttgtgattttgggtttatgtatgattttgatgagaatgttgcatatgtgttagacttttaggattaccgtaattagctttaaatccatgccttaaagatgtttaatttcgttatagtcactgaaatgttggagaatgagtctgtatatgacttaccagtatttggttatagtttcagagacttgtaatctgaataactgagtattgtgagtttttgtgtgtatcagtgtgacaatggacatatagcttgttcttcttgttgtactaaactgaggaacaaatgcccttcttgcgctttgccgattggtaactttcgatctaggataatggagagagttgttgaagcagtcatggtcacatgcccaaatgtgaaacatggttgcactgagaagttttcttatgggaaagagttgatccatgagaaggattgcaggttcgctttgtgctactgtcctgcaccaaactgcaactattcgggggtgtataaggatctctacagtcacttctacgttaaccactatgacacatggaatcaaatcgggtgtggcaatttcgctggtgcatggctacgtatcagtgagaagattttggtccttcaatatggacagggtcccttgattgcggttcagtgtttcaaggagacacaaggaatgtatgtgactgtgaactgtatagcaccttgtgctccaggagttggggagttatcctttgagctctcgtacaagatgccgatgggaggtaacagcactatgatgtttaagtcagaggagatgaataggattcagaaagtgagtttccaaactccggagaaggacttcatgttagttccttattatttcttgggtgatttctctacattgaagatggaaatttgcatacgcaagttaaaaaaagatgaagaagaagctgatgaagatgaagaatctgaagaagaagaagatgatgatgatgatgatgatgatgatgatgaagaagaagatgctgatgaagaagagtaataatcatcatatcatatccattgtaggtcgttctgttcataacttcatctaccctttaaatacatttctgatgtttttctgcagctactttagtttgtcatctatgcactctaaacgaat

SEQ ID NO: 676 - DNA, 1520 bp, Arabidopsis thaliana
ttatggagagtggtgaattgcatttaacgacgcggactttgatgccacagtatcagcccatatatacccagtctcttatgttcatacaacttataactcaaacaaatacaattcgtcgatatgtgtgatcccactagagacgatggctccagccgaagcagagtggtgagtactatgcaaaagagggcgtattttcagagacaatggccgttggtcgatgtcgtaagagcgtcagtcgttgtgattgtgcactttttgtgtctcttggcgccgtttaacttcaaatgggaagctttacggttcggtttggtgctcttcgcgttgactacactcagcatcacattctcattccataggaacttgtctcaccgtagcttcaagataccaaaatggctcgaatatccttgggcttattctgctgttttcgctcttcaggttaacaccagcgttttgagaatctaactaagtgttaccaccatgtcaaatgcttttctttctttttcccaagtatatgattagagaagaaaaaatatattttcagggtgatccaatggattgggtgagcatacataggttccatcaccagttcacagattcggaccgcgacccacatagccctaaagaaggattattgttcagccatatcttgtggatatttgacacccaatacatcaaatacaaggtaatgtaacgtatagatatctctcattttcttatattatatgttttatgacgttgttgcaataatacaaagtaatgcaacagtgtggaggacgtgacaacgtattggacttgaagaagcaatggttttataagtttctacgaaggactattgctgttcacatcttaatgttttggaccatcctctatctctatggtggtttaccttaccttacatgcggcggggtaatttgttttaggatttaattattactatatatttttcaatatcacaccaaattatttatacgtatccaaatgaaaatcaatatattttatgacagggcgttggaatttttatcgggtatcacgtgacatggctcgtaaactcggcatgccatatttggggttcaaggtcgtggaatactaaagacacatctcgtaacgtttggtaatataatactatataagaacctatatatatatatattcaaattagtcttaggaaaaagggatttgacgatcttgtgaacatattcaggtggttaagtttgtttacgatgggagaaagttggcacaacaaccatcacgcgtttgagtcatcggcgaggcaaggattggagtggtggcagatagacataacttggtacctcattcgactatttgaggttctcggtatagccactgatgtgaaattgccctcggaactccagaaacaaaagatggctctcgttcgttaatgtttattctgaaatctgtattattattcgttaattaagaagctatttatgcacttcttaccaacaacacaaaaaagaagaagctatttatgcactaaataaatgagacactacagttgt

SEQ ID NO: 677 - DNA, 1668 bp, Arabidopsis thaliana
caattcgctgcttgcttcttccctgggaattttagggtttttagggttttgtaatttccgattgaaaagtttcgtgctttacgagtctctgtaactcaatttttggcagggagaagaaaaatggtatctgggttgattaatgagaaccctatcatttacccaaagaaagagaggcgtcttcgtactgatacaagcattactgatgagcttacaccagaaccaattgatcaacttgagatttttgatatcctttcttcatcaagttttcttagaactactctaattgcaaaccttaattggtgaattggtttgattgtgtgtgattgtgaggatgtgattatcgtcttacagctattagcatctgaaattaagagtagctagtgtatgcataggttttggaacaacttgacatgcctcttagcttgaagtttgcttctttacactattagaagtcatgaatcttttgttctcatatgcatatcttttcgaagtaggtgttggaaccatttgacatgcttcttagcttaaagcctacctatgaatcttttgttctcgaatgctaaatttcttgtaattatgcgtggtatcggtttggtaatctgtgaacaaatggaatctatgttttagttgatacagaatgatattggattatttctgttgttttctttaacaatacacaaatcatataagagatatcaaagatccagagcatcctaatactctggaagatctcagagtagttacagaagactcagttgaagtggatgatgagaacagttatgttaggtaaaatgttgggattgaacgttttgttatggatttttagtgttcctttgagccaatctgttgagctctaccatttcttttcagggttacgttcactccaactgtcgaacattgtagcatggcaaccgttatcggtctttgtgtccgtgtgaaacttctacgaagccttccttctcgatacaaggtacaaagctttcttgttatttcatttctaagattttccggttcccttttcctgtaagtttgtcaagatgatcttctgagcccattttctgatttatacattatcgagagtggtttgaacgtaactgagatccaacacatgttctccttgtgatgatatatgaggcagagaaattttttaatttttcattcttaatcaactgttcttgatacttgcgaagagaagatagccctagcctctactatatatagttaggactgccttaaaacacactcgcacaatgttttatgtgcctcagtcctctgaaacgaatcttcatttttcagattgatataagggtagcacctggttctcatgcaacagaagatgcatgtatgtcatttttcaatatctatccatcttttttggtatgcatgttttgctttacatcgagtgtacttctttaacatgatgtctggtttcttggtgtttaaaatgcagtgaataaacaactaaacgataaagaacgtgtggcggctgcactagagaatccaaacctcgtggagatggttgatgaatgcctgccatcagaagagtgaattgcttttattttcttgtgagcaagtaatttacacaagcctggtggtctcagtttacactatcaatacatgtctctgttttatttgcaaagattttgatccatcacatcgactaggact

SEQ ID NO: 678 - DNA, 2698 bp, Arabidopsis thaliana
cgtaagatgattcaccttctcaaagtttgatccttttttcatatctgatcaaaggagagttttgggtttgatttctaattgttaaagttttaatctttttatttgggtttgtgttcgattatgtggatggctactcaatcaaattctgggttcgattctttgagttctatgatgagtcgtcacgctattaatttccaatctaacacttcttcggagatgactccaatgagtccgtacttggggatgaatatgaatatgatcaatgttggttctcctggttttcttcaaaccgggaattcttcgaatggttccgattcgggttctggtctaaagcttgatacttccatggttagtgaatggtcaaatgaagaacaatacatattggatgctggtcttgaaaagtgagtctttcttgttttgtgatttcttaacattaatgaggatatgaagatagttttttgttctgtggaatttgatatgatctgattctgtgttttttgtagatataaggatatgccaagtattgatatgtatattcaaattggaaacactttacctgataaaagtattcgagatattgctttgcggtgtaggtggctgagggtaagtatctctcttcacatatctgccttgttctgacggtttttgtagctttcttgtgaccatttttcagtcatgtagttctacgcttatgccatgaatgatatatgtatagcaaagaaaaatgatacacagggaacagtttctacatgttctgatttcatacatagcttcttaaactacagtacacagaatgaaatggttttgccttaggatggactttttggtcttattgatgcctgagttgtatcaatattgagttcttgagatgagaatagtgagcataacagtctttgagttttgaacaaaatcttctcttctcttatatactgaatcatttcttacttttaccttttgtcttcgtctgttgatgtactgactttgttttgcatagagaaagagaagaaaatcagaagaattaaactgtggaagaagagcaagttctagcaaggtatattggaaattcttgccatttgttcaattttgatgagtgacttttttgtaagttcgattgaaagatgatgctaggattgagattgaatatcttttgattaatttaggtttttgtactaaaagatttatatttcttcagggcaagcaggtggaatcgtcgtctaagtcaagcattccctctgttttgcctcataacatggcttcatatcctttctcagggccatctacaagcaccagtaaacaaattacgtctgaaggttaacatctatctttatctgagagatttccacctgaatttgctaactccaggtcttttttttcattgacatgcacacattaacatcatattttgttttcaaaaggaggcaatacgttttgatgtatgtattatggtgcaaatgtcgtttaagtatgtattttgttatataaataagttcataggggattagtgtatttcagctagacttttagcttcttgggacgatgctaacataactacgtctctaaagtagtttagtcttggaagaagcctttacccatagatactgaaattggtttcttaactgcattgtccttctctagaggtgcattcttgagattatttatttcatacatctagtaaaggagtataatgactattgtatgtttaaatggtgaaattctatttaagtccgctctctgatcctattaccttgtaaagatgatcctttaagctctctttcatatgaagttttgttgaagtcacaataatctttagtctcttttcttttcttactgattctttcgtggttctgtttcagatttaagtagctatgcaacaaatcttatagaacagaatgtacgagcttttagtcaaattagagctaatctctcctcatataaggtaagttctagattaccttgtttaaaggaatgcaaatgtgttcttgctaaaaccgctccgtaatgataattgcaaacaggcaggggataacctagatctctttcgtcaggcaaggaacaaccttatcaccatccaaaatgagtaagttgatactttaaacattttgtgtataagttttgtggagcttagtgaccagacgttgtcttgatttggcaggataaataatatgcctggattgatgaacaagatgccaccattgccagtcacaatcaatgatgatctctcggtgagtaatactactttagtaagttaataggctgctcacttttgcattaacagtccattgttttagatatcaaaatgtccacatcacccatttgcttgttttacctcagacactaccgtagttcaaaccccatatctctggttcaagtgctcaaaatatagaattattgtgcttctaactagctgagtatcttaagaccagtttttcaatgttttggtttgtagaaatgtctatcaagagcaaatagagcagaagaataatagcttcccaatatcaatgactttggtttcctcgatttgtaccaggtgatgatgccattcaatacgatgcaaagtggcggcttccataggaagtagaagtcttaggaaatcatctggtttcccttagttacctgtaaattatcctaaagaagctggaggaggtaaaaaaaagctcatcaaatgttgggaagtttgtagaaatgtgattctttcgta

SEQ ID NO: 679 - DNA, 1022 bp, Arabidopsis thaliana
tttcctctttctctatcttcctctcaattcttttactgtttattttctttgtaatcaacaacagtttaactcttcttcttcttttctttatcaagaacagtagtttctcaattcttgattatgatactaagcaagagacctcatctaatgatccgtaaattgtctgagatgttggttccaagaagcagatctgctgctattaaaccggaggagtacacggccagtccgagaagtccgttggatttgaacttcccctccccggttcactcgaagcggttcggttctggtggtgtcggtttgggtattgttgctgcgttggaggaaactagcaacgggattaaccggcatgatccggttcgttactccgggagattcaggtgcccggagattgatctgtcggatgaggaatacacttatgttacgagcccaaacgggccgaccaaagtgtattacaacgacgacgggtttgaattgtctgaaaatgattatcggagagttcataaaccgatggttaccgtcgatgaaccaccggttattgaaagacagagtgttaggggtccaacagagtttctgagttcgtgttgcttgtgtaagaagaaacttcaaggcaaagacatatacatgtacaagtaagtttcatcgcattattgcttcttggatctttgttaaattggagactaattcaatattttattggtattttttctagaaactgatccttttttttttgggttgtgtgcagaggagagatgggattttgtagtgccgaatgcagatcagtgcaaataatgaatgacgaacgacaagagcaatgtaaaacgcaagtttcaagaaacgccgacgttttgagctctccttacgccgccggacagagattatctgccggagtattcgtattttaggatgatcacaattcacaataatacgaagagaagtatattttatttatatataaaaaaaaaagtgatcatcattccattttaccttaatagaagaaaaaaggttagaaaataacaaaaaaa

SEQ ID NO: 680 - DNA, 1522 bp, Arabidopsis thaliana
tggatttaacggccgttgttagtattaggctaattattaacatggcttttgttcattgtagttaattttcacagagtaaagagattttgatacattggacccaaagtgcaattttcaaaaatgtttcgctggaagaattcttctcaaaccgaacaagagcagaaagaggcagctctcagagaggcaaaggtcaaatatttcaaggccttgttgatgattttcatttcacttaattacctagttgattcgtagaagctataatgccttctgatttttatgattatagatgaaagagcttaagactctcataggtcagctttctggaaggaattcactgtattgttcagatgcatgtctgaagagatatctggaagctaggaattggaatgtaggcaaagccaagaagatgctcgaggagacgctcaaatggagatcgagttttaaacccgaggaaatccgatgggtatgtatcataactgcatcatgctactaaatcttagagaattcctatccaaccaaaacttataattcttggtttctattagaatgaagtttcaggtgaaggtgagactggtaaggtttacaaagctggattccatgacaggcatggaagaacggttcttatactgagacccggcttgcaggtttctattcatcatttttcttagttaatgagttaacttcaggtcacaagctgaaacttccattttcattgacaacttttgtagaacacaaaatcgttggagaaccagatgaaacatctggtgtatctcattgagaatgctattctgaatctgccagaggatcaagaacagatgtcttggcttattgacttcacgggttggtcaatgagcactagtgtgcctattaaatctgccagagaaactattaatattctgcaaaatcactaccctgagagactagctgtagctttcctctataatcctccaagactctttgaggcgttctggaaggttagacaaaacaatacttctatctcatagttagacaacaagacaactttgtttgtgttttgttcgtctgtatgtgcaggaacatgatggcattttcattttttctttaattatgtgttgttccacagattgtgaagtacttcattgatgcaaagacattcgtcaaggtgaagtttgtttacccaaagaactcggaaagcgtggagcttatgagcacatttttcgacgaggaaaatctcccaaccgaatttggagggaaagctttgttgcagtataactatgaagagttctccaagcaaatgaaccaagacgatgttaaaactgctaacttttggggattgggtcacagtaacaataaccagctgcacgcgagcaacgggttttctggagctgagattgcccctgagccaatccaaaaccacccttgactggttctgaaggcaatgtattattaaaaccaacccttttgaaatggactaaccttagctcttgatgctaagtagagaggttgtatgatttagacatagcatttgattaaaataaagagg

SEQ ID NO: 681 - DNA, 1022 bp, Arabidopsis thaliana
gatcatcacgttactctttaagtctatctgctcatttcctcacacgatcaaaaagatagttcaaatttttctttaaagcttaagaaaccactcagtggaaaccaagactaattaaggctaatggtttctcgacaagaaggaaccctctactctagaaagagggatttcacagtctgtggagaagagtttcacaattcattcaagaagagcaaacaagaagatcaatcacagagcactctgttcaatgaacgaccaaaatcggagagtatgagatcaattacctttgattttgaacttcatctccacactcctctaccatcagattggcaaactaaggtatctatattcatatatgaattgaagtatcttatatttgtatcaatatgaagataaatatgcgttatgatatgtgcataaacatgcatctaaaacaacgatacttatattttcagggatattcaagaacatctgatgagcatagggcatatcccaaagatccagtgatttttggacaacctaagatgagcctagaccttgagctgaacctttcaccttcaggttcaccttcacgaaccacaacgaagaaatatgaatcctcctcaattcacaatgaaacagtatcatcatcaaagattaaagttttgacgaacacaagtaagaagagcataattgggacaggactaagtcgatcaccatcctggctagcgtttgaaggtggtgatgataacgatgttgatcacaaggggcaagagatggtaacaacagtttgcatgaaatgccacatgctggttatgttgtgtacatcaactcctgtttgtcccaactgcaagttcatgcacccacacgatcacagctctacaaaactgtttaaaccatcaaatttgcttaggcttctatgctaggctctttcaaggttactgaatctataaaatttgtacggcagataataagccaagagactagatatggacaaagttatgtatatactaaaagtaccagaaagtttgtattaattctctgct

SEQ ID NO: 682 - DNA, 618 bp, Arabidopsis thaliana
cttcaaactcatccacaggtaataatattaatcaaccaatcaataatctctcttccaacttctcttccgatcataaccatttcttgaatctgtgaatcttgttttctttttcagcaaggaatggcgacagcagcagcaccagcagtgatttcatggacaagatcaggcattgtgtccaaatccggacaaacccagaagaaatctgagatgaaagtttcttacataactggacttaactcatatggtggtctcaaggcacagaacaacaaggttgtctcaatgggatcaccactctgcacagaacagtgttttgctaacgttgtgatgtctctcaaaggaagaagaggtaatggaggagccttatccaccacgtgtaacgctgtcggagagattttcaagattgcagcaatcatgaacgctcttactcttgttggtgttgcagttggattcgttcttcttcgaatcgaaacttctgttgaagaagctgaagcagagtaaatagagtaaattgctgctcttataattatatatttttggttattgttgttgtcaagctttggtaaaacttgatggatacatgttacatttgtttatgaagaagctcttttcttggtagat

SEQ ID NO: 683 - DNA, 1519 bp, Arabidopsis thaliana
ttttttgttttcttcgttctcttaagattagttttctcatcacaaataataataaactcttttcttttgtttcatctctttcttcttctctgcgtctttgaggcaagaaaaaaagagaagatgaaagcacccaacatggagacgataacggagtctctagagaaatcgatgatgaattgttctctgaatgatcggagaagaagggtcgtcggagatgggtttgggagatcgtcgagcaacgaacacatgactccgatctcagatagaacattggagctcaattctcacttatctcttccttgtcactgggaacagtgtcttgatcttaaggtaaactttaaacaaatgagattcatctttctattttttttcttcttttttttctgctttctaggttaaactaatcactacagaaacttcgaactcgtgtcgttttcgtgttttggattgcattaaatgtacattgggggataaatttttcatgttaatataatgttttttcttgtatctttgtgatgcatttattgcttcagaccgtataaatgtttactcatagggctttttggtttcaggctttgtgtttagggaaagatgtttgccttatatggaaaacttttgcagagattttaaatggctaaaaaaagtttgaaagcttgaccatgaaactaaattctgggatttttgcttttggataaaaacaaaataatttttgtaaagctatttgatgctttttatcagccaatctttcatctcctagatatgattattctcataaggaagtaaaacaaacaaacaaatgtttttgtttttcatgttcaatgatttgtctaaagaaatcaatgccgcactaccacaaaacatacatacaaaaagtacatagtcatttgctcatatatagatctaggaccaaagctttttgtcttaaccaaaatttgggaggtgcattgcaatttgccaagaaagaaaaaagataaaactttatagtaataagagcactttatgattgaattcatgaggtgagctttttgttttgttttagacaggagagatttactacataaactggaaaaacggaatgagagtgaaagaggatccaaggaaagtgatgaatgcagatcctgacagtggagactcatatggaaccgtgtgttcagaagaagatagctcatattacgacagcgaagagtcttcatcagagtcatctccatcatcaagagagaatcataaagaagaagaagaagaagaagaagaggaggaagaagaagaagaagatgtgctagtggttgctggttgcaaagcttgtttcatgtacttcatggttcctaagcttgttgaggactgtcctaaatgtgcagcacagcttcttcactttgatcgacctcattctgcatcttcttgaaacccttgtctttgtttggattttccctttattcagatgagaatttgtttaggtttccactttaatcttatattgttgttataatttagtggtttctcatgtgagtggcattaacacgag

SEQ ID NO: 684 - DNA, 864 bp, Arabidopsis thaliana
cacatacttctcctccatacactttcctcttcaatcctcagttttttttctaagccctaataccatctcaaagaagagatcaagatttgaaatcaagaagacaccattactcagatcaacatgcttgccgttcaccgtccttcttccgccgtatcagacggagattccgttcagattccgatgatgatcgcgtcgtttcaaaaacgttttccttctctctcacgcgactccacggccgctcgttttcacacacacgaggttggtcctaatcagtgttgctccgccgttattcaagagatctccgctccaatctccaccgtttggtccgtcgtacgccgctttgataacccacaagcttacaaacactttctcaaaagctgtagcgtcatcggcggagacggcgataacgttggtagcctccgtcaagtccacgtcgtctctggtctccccgccgctagctccaccgagagactcgatatcctcgacgacgaacgccacgtcatcagcttcagcgttgttggtggtgaccaccggctctctaactaccgatccgtaacgacccttcacccttctccgatctccgggaccgtcgttgtcgagtcttacgtcgttgatgttcctccaggcaacacaaaggaagagacttgtgacttcgttgacgttatcgtacgatgcaatcttcaatctcttgcgaaaatagccgagaatactgcggctgagagcaagaagaagatgtctctgtgatgagtctttgtcgttgtcgggtagtttcgttagatccgacgtcgttttctagatttttagccgtcgtgtgatctatgttttttcggcttatgtgtgaaaaaaaagttacattagtgaatt

SEQ ID NO: 685 - DNA, 1363 bp, Arabidopsis thaliana
ttcgaagttattccatgttttatcttcaattctagatcatagtttttggaaatttaggttttagttttttttgttaagctcgatctggatttgccgatttgaaattttgagtaaatcgcaatgccattacatatgaaaatccaaccgatcgacgaatccgatgtatcggaagaggtaccttacccggagacgatgagacagatgccgaaatcgaggctgaagcgtctctttgagcgtcagttcactaataagaacgtttcggagaaatttaccggctcagatgttgaggcaccgctttcgagaggtaactctggagattttgagccgagctctgtttgtttggccaagatggttctaaattttatggaggacaacaacggcggcgagaaacagcggtgtggacgtagccgatgtaactgttttagcgggagtggtacagagagctctgatgatgaaactgaatgttcttctggtgaagcttgtgagatcctcaaggtatgattcttcaattttgttctggattctaggttttgttagaaaagcagaacttgatatatggagattcgattttgtagagtttggttctctgtaagagcatccgtgtgaggaatttgctgactgatgtgaccaagattgcggaaacaagtaagaattgcaagcttaaagatggatcgtgcttgaaaagtgtggctaatgggttagtgagtttaggttatgatgcggctctatgcaaatctcgctgggagaaatctccttcttgtcctgctggtatagtctataactctttatcttctgtgaaaaggcaaagttgtaaagccaagccatttcttaggcttcttgcttgacagtagagttgattgttttgtgaaatgaaacaggggaatatgagtatgtggatgtgataatgaaaggtgaaagactgttaatcgacatagatttcaaatcgaagttcgagattgctcgtgcaacaaaaacgtataagtcgatgctacaaactctgccttacatatttgtggggaaagcggataggctgcagaagatcatcgttctaatatgtaaagcggcaaagcagagcttaaagaagaaaggacttcatgtaccgccatggaggagagctgagtatgtgaaatccaagtggctgtcttctcatgttcgtgtagaccaaaactcaaatggagaagtcaagcaggaatcagtagaggtgatcgctgagtcggtcagttccatagtcttcggtgtctgaaggtttatatatatggcataaccttcaagagaggtgtgagatataggagtattcgaatcccttaaagtttttgatattaagggtatgttacaggatccatgcatacgtagaagtgtctct

SEQ ID NO: 686 - DNA, 1026 bp, Arabidopsis thaliana
atggtggtcttgttcacatggtcagtgtctcccctcctatctcatacattgccgttggttccatcggttttatgactttttatcatcttcttcactttgcaggattttagcaaggagcacatggataaattggggcatgggatttacactcctatggatatcagtctcctccctcctctgcatctcatctatgctgagaatccgagcgactcagggaaggtacttacacttattcaatgattctggtttatgcatcaatcaagtgaaattcctcaaaaagcatttatgacactagaactcagatctttggggcataactcagtagaatttagaagtatctctctgttagatgtttcataatattagcattgccttctaatgcaggtacatagtatggttcggcaaagatggttagacggtgatgagtttataatctcatcaatgaaagaagtcggaagtctagcagaagaaggtcgaactgcattactcaacaaggaccattccaaacttgtggaactcatgaaccttaatttcgacattcggaggtaaatataattccagacaaaactcgaacctatacacaacttaagattaaactccaagctcacatgatgttgaaatagatgggaatacacacatataatagtgatgtctttttttcccgataggcggatgtttggggatgaatgcttaggagcaatgaacatagagatggtggaagtagcaaggagggttggtgcagcctcaaagttcactggaagtggaggagcagtggtggttttctgccctgaaggtccatctcaggtgaaacttctggaagaagaatgcaggaaagcgggatttacgcttcagccggtaaaaattgcgccttcatgtttgaatgattctgacattcagaccttatgaaagccttgatcaagtcttcttattcacacgatagagccattttccagagaaataaacatgtgagctttaattgggtggttgttctgtttctttttcttgcccatttttgttgtttgttcc

SEQ ID NO: 687 - DNA, 1261 bp, Arabidopsis thaliana
agattgatatctctctcgttactatatatgaacttatcgatcatatagtttctttcatcacacactcacaaaaacaaccaaataaacagaacaaaaatattaaggcaattagcttatttaatggagagaagagaggaccactactcaaactacttcgtccaaagtccttcaacggttttccatgaccctgaatccgaattccaatccccgattcgatctgactcagcgccattggtcctatccagcgtcaatgaattcccgaggtactcagatttcttgagaaactccgaaaacaacttcttgtatgaggatgatgagaaaagattggtgccattggggacctccaattcgagttggtggatcgtcctccaagtaggttggaggtttttgtttagcttaggagtggcattgcttgtcttctacattgctactcagcctcctcatcctaacatttcttttcgagtaatataaatcttctaataatctactaagctagtaccaaattttgttgatgcatgcatggagttttaacgatgagcttgagttttggcttgtatactctacctaaaaaaagtatgtaattttacagattgggaggtttaatcagttcatgttagaagaaggtgtggattcacatggagtgtcgactaagttcctcactttcaattgctctaccaagctcataatagataacaagtctaatgtctttggccttcacattcatcctccatctatcaaattcttctttggcccactcaactttgcaaaggcgcaagtaagtcttaagagatatatttatttaatatcaacttcagttaccatatgcattcatacatctcttgtttctgtaaagggacctaaactatatgggttgagccatgagtcgacaacatttcagctatacatagcaacaacgaaccgggcgatgtatggggcgggaacagagatgaatgatatgcttctgtcgagagctggattgcctctaatactgcggacgagtataatttccgactatcgagttgtctggaacattataaaccctaagtaccatcacaaagtcgagtgtttattgctccttgctgacaaggagaggcacagccatgttacaatgataagagaaaaatgtagattggtatcttgatcaaagattatatccaaagagatgccataagagagctaataatcagtatgacgaccaacttaagagaaaataaaaaaaacttcgaatgatacgggagaattctataataagaggctatga

SEQ ID NO: 688 - DNA, 2665 bp, Arabidopsis thaliana
gctttagtcctctacaccaaaacatgatcaagaggtatctcatccgaatattccacgtgtcaagcaagcggtggctaggattgattacacagtccacgtcagctctctagaaacggctcaatgctcttgtccttgacacttttcttccacttcttcttcatcatctttaatcgttgggaaaagtttgatgatacggagtggacaattcttggtgtagaaggagaatctgagagagagagagtcatggaagctctgaaaaccgcaacttttagccctatgtcggtgttatccgagaaaagatcagaaccacgaaagcctttctcgctccctaacctctttccaccaaaatcacagagaccaatctcccaagaaagcttcttgaagagattcaatggtggattggctcttctaacttctgttctaagcagtgcaacagctcctgctaaatccctgacgtacgaggaagctctgcaacaatctatgaccacttcttcatcttttgattcggatggtctgattgaagggatatccaattttgtcacagacaatcctttggttattgccggtggagttgctgcattggctgttccatttgttctgtctcaggttctgaacaagaagcccaaatcatggggagttgagtctgctaagaatgcttataccaagttgggtactgatgataatgctcagttgcttgacataagagctactgctgatttcagacaagtgggcagtcctaatattaagggtttgggtaaaaaagcggtttctactgtttataacggtgaagacaagcctggtttcctgaagaagctttctttgaagtttaaagatcctgagaacaccacattatacattctggacaagtaaggctcttggaatcttacaaaatatattgaaagttataatattgaggcttatagttacattgagtagcttatattgtctgatcactgaataattatagtctcagcattccttcattatctatgaacctgtgattgtttgctttgtggaagaatattcaaacttgagtagtgataatcataagtgttattgtacatctgatagaatattgcaatgggagagaaattgaaaagcattttagattgcacacattgttgttaatacagtctaactctttgaatggaaagccaggtttgatggaaactctgagcttgttgctgaattggtggctcttaatggattcaaatctgcttatgcgattaaagatggtgcagagggacctagaggctggttggtgtgtgttccctttcctcttatcccacaatgtgtccttcttcaacaaatcctttcgattcgacttatttacatttgtcattatatatctggtttgcagaatagcagcttgccttggatagagccaaagaagactctcagccttgatttaagcagtttgacggatagcatcagcggtgtatttggtgtgagtatccaattttacattcatttaatttaagtttctgtaacaaacatcgaacaatgatttaacataaatgtacaggagagttctgatggtgtatctgtcgctcttggagtagctgctgctgctggattaagtgtttttgcatttacagaggtcagtctttcggtattatccctcttattgtctccagaaaattccggtattaatcttatatctatcatcatccctacagattgaaaccatactccaactactaggttcagctgcacttgttcaacttgcaggcaagaaacttctatttgctgaggcaagttcttcccatcttttcattcatcaagattcagtttgaatgtatttatcgcaattggtgatgttttgatggttacttttctatactctctacaggaccgaaagcaaactctaaaacaggtggatgagttcttgaacacaaaggttgcccctaaagaacttgttgatgagttaaaggtaactaatttagatacatatctccattagtaataaaaccctttatagaaataactctacgtggaataacaggaaataggaaaggctcttcttcctcaatcaacaagcaacaaagctctcccagcaccagcaacagtaacagcagaagcagaatcagctacagctacaaccaccacagtcgataaaccagtacctgagccagaaacagttgcagctacaacaaccactgtagataaaccagtacctgagccagagccagtgccagagccagtgccagtgccagcgattgaagctgcagtcgctgcacaagtaatcacagaaccaaccgaaacagaagccaaaccaaaacctcattcaagacctctctctccatatgcatcggtaatgtttctactttctcataaagaggctcttttggtgggaaataaagaaacctttaagctgtttataattataatttggacctccgttgatccttgaagaagtatctttatgatttacgagttcgtacatgggtttctgttatcgtttattaatatgatgtctttcttaactcttttacagtaccctgacttgaagcctccatcttctccgatgccatcgcagccctgaaaacagctaagaacagtctctctctcgttacttagtctggttttgtcctcctgcaaacagaagaacaaaagtggtcgaatattgtaacttgttcttttttctctcgttttttctcccgaa

SEQ ID NO: 689 - DNA, 690 bp, Arabidopsis thaliana
ggaaacaaattaaatctaataacgtcatgggcatcaacatcgaagatttcttatatatactaatgcaaatcaaaaacaaaagtagaaaacgctttcggatcttcaaagaaaatgacaaccatgctaaaaacacaagttcatgtggtggtaatatatctactcatccaaatagctttctcacaagtgaaacccggttctgatctaaagtggtctactttaaaatcagtggtgacgatcacaaaccgccttggcgatggttcgaccttaaaacttcattgtaagtccgcagatgacgatcttggcctcaaaatcctcgctccgaatggttcttggtcgtttaaatttagaccaagtattgttcctggagtgacacttttcttttgtcatttcacatggcctggacaatcaaaatggtttaacatttacgatgatgacagagatggtgttcgtatgggtattccatgcatctactgtatctgggatataggcaaatatgggccatgcaggtttagtgaaatagatgatgcatttaatatttgttatgattggaatggaaaccgaagatcataatttgttgtgttgccaagaaaaccacaagaatcattcgtttgtttgtttgttttcgttttaaattgttgttctattacttttggtatgaactacacaattgtccaaaaaaaaagaagtata

SEQ ID NO: 690 - DNA, 2449 bp, Arabidopsis thaliana
aaatttttctttattgctttgctcgagagtgcctgcaactgcaacagttgagattttgagcgtgtcaaggattctgattgataacgatattcaagttcagcaatctcattgcagtagaaaatggaatcgaatcatcctcacttcaaggtccgcttcttttcaataggtttctagttcgattcatgaactgtttctgcagtcaatttcgaacttgtgaaatctccataacttgtgctttgaatgtatttgctaaagctataatcttgttgcgtttcaaaaaccatcctttggaaaaattggagtcttttggttgcttattgaaatttgtttgcagctaattttgggatcttcttcgattgctcgacgtaagatactaacagatatgggataccaattcactctcatggtaatttcttgttcctttgaaattattattcaaagactgcatttttgtatttgggcttctagttcaagtagaagtttactggtaattgttaatgtagagtgctgatattgatgagaaaagcatccgcaaggagaaacctgaagagttggttttggctttagctgaggcaaaggtaacttcattagtcatctgcaataaaatggttgcttttatggttcatgtttctttttgttaatcttgtcatcacaggctgatgctattgtgtcaaaactacaaattagtgaatgtgaagatgaggaacaaccgagagtcttgattgcatcggatacagtatgtagtttttggtttagctaattactagtaaagtctccatctactatcaccaagttccattttatgttcttgggaatgcatcatcatcttctttggaaatatacactcttacgtcgtaatagctctgatttgtcctgcaccagaagttgctttatgggttttatctctttagggtcctctatatcttactctgaagctagtatttgtcattctttaggtcttgatctactcttgtttattctgtgaaatttaagtctttatgctctgcctacatgatttgatatcgcatgttttgtagctccgcctacaattatcatttctgcttccaccagtgtttttattaactggagggacctgtttcatgcatatatcttttattaagccaaaggtgttttatatagcatttgctcttcatcagtctcattgataaaccggcataattttttcccaggctgaagcaatcatgcagcggatccctgatggtgaaaacatagaggaggataagtcgaccttacttattacttgtgaccaagtactgagctatatttaaactttctgtgtttgctcaaagctttactatgatattatcaactagctagctgtaatggacacccatgttaggttaggttagtgattaaatggagtctaaagagctaagattgtttaaacattcaggttgtttgtaatttataggagttgactaatgaaagatggggcattctaaggacagaaatggaatttggtgataatagatagtctatgagagacttgggtttaatgttttgaattgtatgaaggtggttgtctatgaagatgctgttagagagaaaccctcgagtgtcgaagaagcaagggagtacataagaggtaagctcacatgatttgttttgcttactataactcaaggcttaaggttaaagaactaaattcaaaacacaggctattccaaggggcatacagcaacagtgagttctgtggctgtgacaaatctcaaaacaggagtcagaaaaggaggcgtcgatagagtggaggtaacactataatcttgcgtttcattaaagttaggattgttacaatttgggaaatatatagcatcagctgatgatgtaaattcctaacagatctatttcaatgaaataccggaagagactatcgagaaactggtgagtggtgttttgtacaagtttaagacatatatttcaccatatcaatattgaagttaaggctgtgttgatgagcagattgaggaaggcatggtgcttaaggtggctggtgcactcctaatcgagcatccgctaatcttgccatgcgttaaggaagtggttggattccttaccttgtccattttaaaatatgaaccattatatgaatttacaaggatttaagtctatatagtctatcccttcttcttcatagatacacatgttgatcatacggtttcgttcctcttgttcttttaataccgttttggagcatgggatgttaaactaggttgtattgttgtatcaggttgggacaacagatagtgtgatgggtctgcccaaagaattgactgagaaactgataaaggaagtattggcaagcacataggtacattcgtcgcctctgaatgttggtgtattcatgttgtgaggattatagataagtttcggagtttaatttgggaaatgagcttaatgttacagtcaaactagtttattcagttgtttt

SEQ ID NO: 691 - DNA, 1530 bp, Arabidopsis thaliana
taccactatactacaacgactttgttgtttggttgtttagaacataactatttaacaacaaactaatttgtatttcttgaaggctgacgccaacaccgaaagctctatctccaccactccatgtcttcttcgtacgcgtcgagctgcactaaattgatctctctcaccaaacaattaagctcttacgcgaaccaaggaaaccatgaacaagctcttaatctctttcttcaaatgcattcttctttcgccttacctctcgatgcacacgtcttctcactcgctctcaaatcgtgcgctgcagctttccgtcctgttctcggtggatcagtccatgcacactccgtcaaatccaattttctgtcgaacccatttgttggatgcgcgttactcgatatgtatggtaaatgcttgtctgtttctcatgctcgtaaactgttcgacgaaattcctcagaggaatgcggtagtatggaacgcgatgatttcgcattacacacattgtgggaaggttaaggaagcagtggagttgtatgaagctatggatgttatgccaaatgagtcttctttcaatgctatcataaagggtttagttggtacagaagatgggtcttatagagctattgaattctataggaagatgatagagtttagattcaagcctaatttgattacccttcttgcgttagtatctgcttgctcagccattggggcttttcgtttaataaaagagatccattcatatgcttttaggaatctaattgagccgcaccctcagttgaaaagcgggttagtagaggcgtatgggaggtgtggaagcattgtctatgtgcaattggtgtttgatagcatggaagatagggatgtggttgcttggagtagcttgatatccgcttatgcacttcacggtgacgcggaatctgctctaaaaacatttcaagaaatggaattggcgaaagtaacaccggatgacatagcgtttctgaacgtgctaaaggcttgtagtcacgctggtttagctgatgaggctcttgtatactttaagagaatgcagggagattacggtttgcgtgcaagcaaggatcattactcgtgtttggtggatgtcttaagcagagtagggagatttgaagaagcttataaagtgattcaagctatgcctgagaagccaacggctaagacatggggggctttgcttggagcttgtaggaactacggtgagattgagctagcagagattgctgcaagagaattgttgatggtagagccagagaatcccgcgaattatgtgttgttggggaagatatatatgagtgttggaagacaagaagaggcagagagacttagattgaagatgaaggagagtggagtgaaggtttcaccaggtagtagttggtgtttgttcaaagattgacatattaccatgctcatgaaatttttgtaagctcatacacaattttcgaaatcaaggttgtataattatacttaatactattcttaaattataagaaaataatatgcaaaaatacctgca

SEQ ID NO: 692 - DNA, 2065 bp, Arabidopsis thaliana
gtttgaagctaaatctctctctctctaactacctctgtggtacagagtctccgtgttctaaaagctttgagaccatcttcaatttcacagagaaaaacaaaacaagcaaggagaagaaacatgaacatcttcactaagaaacctaatcccagaggtttaattccaccggatttttcttttgtatcattatggattttgttttctcaattaggttttttttttctccgattgatcaacctaaatggaattttgatcatctgggtttcttccggttgacttcttctgtaattttgtggcgcgttcgtgatcatgtttcttttggaatctggcttggtttcgtctgaattcgagaatcttaatgtctattgaaatcggactgtcagaatctgaatgtttcgtttttttttttggcaattgcagaagtgcttcgggagagtaagagagagatgacacaagctaccagaggtattctttgttcatatgcttggattattgaatctagaaaaaggttaattcattgtttttgattgcttgattgataagctactatgttccatggctttaactagatattactcaagtatttatcgccatatacctaaattcctctcaaactgatgaaattttccaccttttcgtgttttggcttcaggaatcgaaaaggaaatcggatctctgcaatcagaagtatgagtgtggctcagttagtaacgttttcatccatctttttaaaagggacatatctaaaaaacgttttctttcatgtttgataggaaaaaaagctcgttctcgagatcaaaagaactgctaaatcaggcaatgaggtatttcaagcattccttatcagtaatagcatctagtttatgtacactacatcttttgtttttatgcagggagcgactaagattcttgctcggcaattgatccgtctaaggcagcaaatagctaacttacaaggtagccgagctcaaatgcgaggcattgctactcatacacaggtttcttaatttaaacaacttctatcctttcattctaaagtatttctgtttataaaccaagaagattgagtattggaagctttctctttggtgtttaggctatgcatgcacacacttcagttgctgctggaatgcaaggtgccactaaggcaatggcagctatgagcaaggtcagattccctatgtaacacaaatctgatttgtccatgtttaattatttgattggattcatcaagttaaattagtagaaataacttaaatccagtaggaattttgaggggctcttttgttaagatcttgttgtttctgtgggttttccagaatatggatccagcaaaacaggctaaggttatgagagaatttcaaaagcagtctgcacaaatggacatgactgtaagttctttcaaatccatcgtttctttaaatccatgaacactcaaatagtcattaatctgactaatgcatgtggaatccagactgagatgatgtcagattccatagatgatgctttagacaatgacgaagctgaagacgaaacagaggatttgacaaaccaggtacatttccgggctctatccatcaattcaatttctaaaaatagactgtttcaaagggttaacaaatgctttttgttttactgattaggttcttgatgaaatcggcattgatatcgcctcgcaggtttgtttataaccatcgattcttgtcattgtttccgtataatcacgtattctccgtgattcatattcgcttgtctctgtatttatccatctgcagttatcatctgctccaaaagggaaaattggtgggaagaaagcagaggatgttggcaggtatggtatccactaaacacaactagaacatatctgtatcgaaaccaaacctctatgtttctgtgcagttctggaatcgatgaactggagaagcggttggcggcgcttagatagaaagaagaagtaccatgagcttgaagatgtttcagacaaaaaatattatacattcaatgtgtcttctacagtttgctttctgggaagatttgtggatatatatataataaacaatattta

SEQ ID NO: 693 - DNA, 4476 bp, Arabidopsis thaliana
agaaagaagaagaagcacttaacttaatagaaacaggatcaagattcataagatctaaagatggattacgatccagctcatgctatgagcagaggtgggagtatgcggcaaaccataagtcgtagtgtaagcaaagcaagcagaaacatggaagacatattcaatacaagctctagacgaaccaaatctgtcaacgaagacgaagaagctctcaaatgggcttccatcgagaaactccctacctacaaccgtctccgcacaagtctcatgcctgaattaggcgaagacgacgtctacggtaaccaaatcctcaacaaagcagttgacgtcacgaagcttgacggcgaagaacgtcagaagttcatcgacatggtcttcaaagtcgcagagcaggacaacgaacggatcttgacaaagctaagaaacagaatcgacagagttgggatccaacttccgacagtagaagtgaggtacgaccacttgactgtgaaagctgactgttacaccggtgatagatctcttccttcgcttcttaacgcggtgagaaacatgggagaagctgctctaggcatgatcggaattaggcttgccaagaaagcacaacttactattctcaaagatgtttctggtatcgtcaaaccttcaaggatgacacttttgttgggtcctccgtcttccgggaagaccacgcttttgttggctcttgccggtaaactcgacaagtctcttgacgtctctggggaggtaacctataatggttatcgcctcaatgagtttgttcccattaaaacatctgcttacattagtcagaacgatcttcatgttggtatcatgactgttaaggagactcttgatttctctgctaggtgtcaaggagttggtacccgttacgatcttttaaatgagttggcaagaagagaaaaggacgctgggatttttccagaagctgatgttgatttgttcatgaaggcctctgctgctcaaggcgtcaagagtagtcttatcactgattatactctcaaaattctagggcttgacatttgcaaggacactatagttggagatgacatgatgagaggtatttcaggaggtcagaagaagcgtgtgacaactggtgagatgatcgttggacctactaagactctgttcatggatgagatatccaccggacttgacagctccacgactttccaaatcgtgaaatgcttgcaacagattgttcacctcacagaagccacagttcttatatctcttctccagcctgctcctgagacgtttgatctattcgatgatataatcttattgtcggagggacagattgtgtaccagggacctagagaccatattctagagttctttgagagctttgggttcaagtgccctgaaagaaaaggaacagctgatttcttgcaagaggttacctcaaagaaagatcaagaacagtattgggttgatccaaacagaccctatagatacattccagtgtcggagtttgccagcagctttaagaaattccatgttggatctaaactatctaacgagctatcagtaccgtacgacaagtctaaaagccacaaagcagctctaatgtttgacaaatactcaatcaagaaaacagagcttctgaaaagctgttgggacaaagagtggatgctcatgaagcgaaactccttcttctatgtcttcaaaaccgtccaaatcatcatcattgccgcaatcacctcaacactttaccttagaactgaaatgcacacaaggaatgagattgacgccaacatctacgtcggatcactgctattcgcaatgattgtcaacatgtttaacggtcttgcagagatggccatgacgatacagagacttcccgtgttctacaagcaaagggatcttttgtttcacccaccatggacatacacgcttcccactttcttgctagggattccaatctccatcttcgagtctacagcatggatggtggtgacatattactccataggatatgcacccgatgcggaacggttctttaaacagttcttgattatattcttgatccaacaaatggctgctgggatattcaggttcattgcatctacatgtagaaccatgaccatagctaataccggcggtgtccttgttctactagtggtgttcttgactggaggtttccttcttcctcgaagtgagattccggtttggtggagatgggcttattggatatcccctctttcttacgctttcaatgccatcaccgtcaatgaattgtttgctcctagatggatgaataaaatgtctggcaacagcacaacgaggttgggaacaagtgtgcttaatatttgggatgtatttgatgataagaactggtactggataggagttggaggcttgcttggttttactgtcattttcaacggcttttttacattggcacttacttatctagaccttacttatatgtgtatcatgacaacagcccttgggaaggcacaagctatacttccaaaagaagaagacgaagaggctaaaggcaaagctggatccaataaggagactgagatggagagtgtgagcgccaagaaaggaatggttcttcctttcactcctctagctatgtcatttgacgatgttaaatactttgttgacatgcctgcggaaatgagggaacaaggagttcaagaaacgaggctgcaacttctaaaaggagtgacaagcgcatttaggccaggagttttaactgcgttgatgggggtgagcggtgcgggtaagacaactttgatggacgttttggccggaaggaaaacaggtggatacatagaaggagacgtaagagtatctggattcccaaagaaacaagagacttttgctagaatctctggttactgtgaacaaacagacattcactctccacaagtcacagtaagagaatcacttatcttctctgctttccttcgccttgctaaggaagtaagcaaagaggataaattgatgtttgtggatcaagttatggagttagtggagttggtggatctgagagatgcaattgttggtttaccgggggtcacagggctttccacggaacagagaaagagattaacaatcgctgttgagcttgtagctaacccttcaatcatcttcatggacgagccaacttcagggttggatgctagagcagctgctattgttatgagagctgtgagaaacacagtggacacagggagaactgttgtgtgcaccatccaccaaccgagcattgatatctttgaggcctttgacgaactactactaatgaagagaggaggacatgtgatctactctggtcccttaggccgaaactctcacaaggttgttgagtactttgaatccttccctggagtgccaaagattccggaaaaatacaacccggccacttggatgctggaagctagctcccttgcggccgagttaaagcttggagttgactttgctgagctatataaggcttcagccttatgccagcggaacaaggcgctggtgcaagaactaagcgtgcctccccaaggagcgactgatctctactttgccacacagttttcacagaacacatggggacaattcaaatcatgtctatggaagcagtggtggacttattggagatctcctgactacaaccttgtcaggttcatcttcacattggcaacatctctcatgatcggctctgtcttctggcaaatcggaggtaagagatcaaacgtacaagatctaacgatggtgatcggagcaatctacgcagcagttgtattcgttggtataaacaactgctcaacagtacaaccaatggtggcagtggaaagaacagtgttctacagagaaaaagctgctgggatgtactcagctataccttatgctatctcccaggtgacttgtgaactaccttatgtcttgattcagaccacgtactattctcttatcatctactctatggttggattcgagtggaaagcttccaagttcttgtggtttatcttcatcaattacttctccttcctctactggacctactacggcatgatgacagtttccctcacacctaaccaacaagtagcttctatctttgcatcagccttttatggtatctttaacctcttctctggatttttcatccctagacccaaaattccaaagtggtgggtttggtattactggatctgccctgttgcttggaccatatacggtttgatcacttctcaatacggtgacgttgagactcccatcgctctccttggtggtgcacctggcctcactgttaaacagtacattaaagatcaatatggttttgaatcagactacatgggacctgtggccggagtactagttggcttcactgtcttttttgccttcatcttcgcattttgcatcaagactctcaacttccagtctagataaccactatacactctgttttcttgtgaaacatttcttgcaataaagctttgcttcctcttt

SEQ ID NO: 694 - DNA, 2698 bp, Arabidopsis thaliana
tgaactcctccgatacaactcctgtttccttcaggccaaagcctaaaattcacacaaccaaaaaaaccaaccttttttttccacctaaatctttgaatatcacaatatttactatttacaatggcgccacaagaacaagcagtttctcaggtgatggagaaacagagcaacaacaacaacagtgacgtcattttccgatcaaagttaccggatatttacatcccgaaccacctatctctccacgactacatcttccaaaacatctccgaattcgccactaagccttgcctaatcaacggaccaaccggccacgtgtacacttactccgacgtccacgtcatctcccgccaaatcgccgccaattttcacaaactcggcgttaaccaaaacgacgtcgtcatgctcctcctcccaaactgtcccgaattcgtcctctctttcctcgccgcctccttccgcggcgcaaccgccaccgccgcaaaccctttcttcactccggcggagatagctaaacaagccaaagcctccaacaccaaactcataatcaccgaagctcgttacgtcgacaaaatcaaaccacttcaaaacgacgacggagtagtcatcgtctgcatcgacgacaacgaatccgtgccaatccctgaaggctgcctccgcttcaccgagttgactcagtcgacaaccgaggcatcagaagtcatcgactcggtggagatttcaccggacgacgtggtggcactaccttactcctctggcacgacgggattaccaaaaggagtgatgctgactcacaagggactagtcacgagcgttgctcagcaagtcgacggcgagaacccgaatctttatttccacagcgatgacgtcatactctgtgttttgcccatgtttcatatctacgctttgaactcgatcatgttgtgtggtcttagagttggtgcggcgattctgataatgccgaagtttgagatcaatctgctattggagctgatccagaggtgtaaagtgacggtggctccgatggttccgccgattgtgttggccattgcgaagtcttcggagacggagaagtatgatttgagctcgataagagtggtgaaatctggtgctgctcctcttggtaaagaacttgaagatgccgttaatgccaagtttcctaatgccaaactcggtcaggtatattttttttgggaaatacggaatcatacgaatttggaaaatcgaaataactatacggaatgaaatctcataattaactgaaaaacataacataagtaaatacctatatacagtttgtattttgatcaaataaagtaaaaccaaattattcaactgtgtgcgatttttttatattttctgcataatcacatttttggctactcagatgacatatttttatttatttcttatagtaaaaaaaaatataaatgttatacaaaatttgaccaaaaacgtttttaagaaatttgccacttcagttttaaattttacgtaactaactttaatttattaaatgattagggatacggaatgacggaagcaggtccagtgctagcaatgtcgttaggttttgcaaaggaaccttttccggttaagtcaggagcttgtggtactgttgtaagaaatgctgagatgaaaatagttgatccagacaccggagattctctttcgaggaatcaacccggtgagatttgtattcgtggtcaccagatcatgaaaggttacctcaacaatccggcagctacagcagagaccattgataaagacggttggcttcatactggagatattggattgatcgatgacgatgacgagcttttcatcgttgatcgattgaaagaacttatcaagtataaaggttttcaggtagctccggctgagctagaggctttgctcatcggtcatcctgacattactgatgttgctgttgtcgcgtaagttcaaatttttaaccgttgttcgttttgcagtcgctaattgaattgcgccaaaatatgttgttgaaccaacaactacaaaacggacattgtttgatcatgaccaaataatgttgttggttcaacaatatatttaggctaatctatgttctgagtactaatctattattaaagtatgttgttgaaccaacatgaatgattaaaacataatttaagcataatgacaaaaggagatcaatgatatcaataacagagccgatcttgatttctctagcatctctgtttcaaactgcttacactttttgttgttacgtgtatgattaaacagaatgaaagaagaagcagctggtgaagttcctgttgcatttgtggtgaaatcgaaggattcggagttatcagaagatgatgtgaagcaattcgtgtcgaaacaggtaaaaagtgaattacaaagcaagttcttgattttgattaatgcatgagaaatgaatcattattgatgcaaactttgtatatatctgaaatcacaggttgtgttttacaagagaatcaacaaagtgttcttcactgaatccattcctaaagctccatcagggaagatattgaggaaagatctgagggcaaaactagcaaatggattgtgatggatgatttcaaccaaaaagcaaaagatgatttcaatgtgtatatacatacaactgtttgacccaaccaaggaaacaaactcatacgaaccattgtcttttgttgttgttgttgttgtt

SEQ ID NO: 695 - DNA, 1059 bp, Arabidopsis thaliana
agcttcacctatttttatcaaacctcaacaaaaatactctctcttatttcagacttttcagacaaaaacagagagaaactttttgtgtttatgtgttttaagatctgattgataaaaaagatgcaagttatttctccttcgtctccggcgccgagattcgccggaaaagagagattttcagaagtttacggcgaactaaacgacgattttggctctaaactgaagattagttctaaagaggaagaaaacagagatgatgattcatggtggaatcagaacggaactgataaagatgatgaaggaagagaagaagatttctcattcgcaagtgtaaacgcagataattcaccgataaccgcagatgaagcattcgaagacggtcagatccgaccggtttatcctctgtttaaccggaatattttcttcgatgatccagaggaaaaaactttacgttcacctctcaagaaactcttcgttgaatccacaaccacagaagaagaagaagaagagtcagatacggtgggtccatattgttcatggacaaatcgtacggtggagcaagcatcaccagagacttgtcggaaaagtaactcaacagggttctcaaagctatggagatttagagatcttgttttgagaagtaacagtgatggaaaagatgcgtttgtgtttttaagcaacggctcttcatctacatcgtcgacgtcgtctacggcggcgagattgagtggtgtggtgaagtcgtcggagaaagggaaagagaaaacgaagacggataagaagaaggataagatgagaacgaaatcggcacatgagaaattgtatatgagaaacagagcaatgagagaagaagggaaacgaagatcgtatcttccgtataaacatgttgggttcttcactaatgttaatggtttaaccagaaatgttcatccctattgattaaaccgatctgtcgtaccaaaatctctaccgacaaatctttgccttttgtatatatctaaccttttttttggtttctgtgtattataaaaccttctttttgtaagtaaaagtgaaact

SEQ ID NO: 696 - DNA, 1125 bp, Arabidopsis thaliana
ccaatgaacccctgttccctcttaatagcatcaaatctccaagaattggtttaaaattaaagaattctgagtttgttttcatgcagtagagttgtttggagagcaaaagtctgagaggacatgccaaacccattgcagaaatcgctgcatggttacctgtcaaagatcaaaaaagagacagggaagctgcaactgtcttcctcacattcattctcatcctcaaagaattgggtgcttggtaagcatcccaagaagctctccttctccttcaagcacagacgacgcagcagcaagaccagattcagcaaagaagaacccgtttaccaccaggactctgctcacgccgccaccttgtccgacattgatcgttttcttgaggaaaacttcaaatccctctgcatcagagacgaccaggaggatgatcagcatcaagcccgggtgaccaaaaacaaggagaaaagggagtcatcatcagacgacagtgatgatgatgatgatgacgacgactatcgtcacagattcgagaggacatggggacatgccgtctacgactccccgaaacagcccccggatttgctgagaacagagaggctatctcctccgcctggatcttcggagggcaggcctagcatggaaacaacgtcaacatcgtcggagaggcaatcgagatccaccttggtgctgccggagaactgcatcgcggtgttaagatacacggatgagccgcaagaggatttcaggcagtccatggtggagatgatggagtccaagttagggatgcgggaaagcgaagtggattgggacttgatggaagagctactcttctgctatctggatctcaacgacaagaagtcacacaagttcatactaagcgctttcgtcgatctcatcattgctcttcgtgagaaggagaagagaatcaccaggaaaggtcatgtgaggtcgctcagtactcgtgccgccagggacaggcttaggaagaggatgatcatgagtgacaactaactctcatgcaatttcgttttctttttgtcacaaaaaagttttactttccttcctttcttctcagcagccttaaggctgttgttgacttgttgttacttacaaaaagaatgaagagcgagt

SEQ ID NO: 697 - DNA, 1578 bp, Arabidopsis thaliana
acaaactatctctctttctctctgttcctctctttatctctctaagaaaccagagaagaaaagacaaaatctctcttatctctttctctctaagaaacaagaagagaagagaccaaacaaatggaagagttgggttctatttggttttaccaagaggttagttttccttaataatatgaattttaaaggccattttgtgtaattgttctattaaccaaatcaacattttagcatgatgttcaattttttgcatttttatatggatgatcaattctagagtcttgtccttcagaatgattgtgtgtgtgtgattggaattctaatcactttggtttactgagtaataatctatctttcttttttcttcccaacattttacttttagttaactccgacattataaaactctaagatctatgaaaatctatcagaacaatccatttcacctacataaaatgtgacttcttgtacttttctgacccttttaacacaaaaagactattttctttttttgtctttttatttaattattttctagccctgacgtttatatataataataataattaatatgtttggtttacatttagtaacgttttgagtgaattcttgaccccatgaacccaaggttgttatcacacatgattagtaaaaccaatgtattttttattattatgtttccttttcactatactttttttctagatgttgatgtcttcaatgattcagccaatctttttttcttcattttaatatcaattaatttctgacttttaaccctttttgatattattacagagtatggatgaattaagacaaaagcttcaatatagttcctttgaactcgaagccgtgaaagcaaaagctaatgaagaaacaaaacttcaccaagaagaagtgaagaatcttcttcatcttctcaaacttgctcgtcaagaaagagacgaagctaaagatcaattacaaaaacttctcacaatcaaaacaaattcaagcataaccgagtcaaactctcacggttcttcaccggttgactcgttcttcgaaccggtctcatcctcggaattctccaatttcaacatggtacctgaaccgattaaccaagtcaaattcaagaaccgacaacaactcgttaaccggaacttgaagaagattgatcctgtggatgctctaatggatgagatcataaaaggtaaagctttaccggagaaagggaagcttcttcaaactgtgatggaatctggaccgttgcttcaaacacttcttgttgctggtccacttccacggtggcgtaatcctcccccgcttcaacagagctttagagtccctccgatctctaactcttacggttgtttaccggcgacgacaacgacttcaatgctgaattttagaggttgctctgttcctagaattgctaccggaattgaagttgcaactaaacgacaacgatttcattagtgtttttgttgttacaattatttttcttttattgctctgttttttttttggttatttacttagttatttggaattatattattgtaaagatttaaaaatcgtttttggagggtttaagag

SEQ ID NO: 698 - DNA, 1806 bp, Zea mays
  misc_feature (1)..(85): n is a, c, g, or t
  misc_feature (1774)..(1806): n is a, c, g, or t
  unsure (1)..(1806): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnncatcaacaacacagatcgatttcgatctaaaggcaatggcgattgctgcattagagctgctctacgtgctgggaagcttggtggcgctacggctggcatggcaggtgctggagtggggctggctgagcccgcggaggctgggccgggcgctgcgggccgagggcctccgcggcacggcgtaccgcttcccggccggcgacgccaaggacgaggagcgtctcctggcggcggcgcgggccaagccgatgccttcgctctcgcacgcgatcagcgctcgggtgggcccgctcgtccacaacgccatccacgaacacggtaaaatttcggttgtctggatcgggcctaccccgaaagtgatcctcagcgaccccaagctagtccgggaagtgctgtccaagtccagcaagttcggggacttccagaaacccaagctgccctcccacttcatcaagctgatcgcccaggggctgacggttcacgaaggtgagaagtgggcgatccatcggaagatcatcaggtctgctttccttgtcgagaagctgaaggaaatgctgccggcttttactgcctgcaccggcgagctgatgggtcgatgggaggaatcgatggggtgcgacggcgcgcgcgagatagatgtctggccggagatgcaggacctcaccggcgacgccatctcccgcgcggcgttcggtagcagcttgatcgaagggagaaggatcttccggatacaggccgagcaaatcaagatcgccaacgagatgacaaacctatacatcccgggttacacctacctaccaaccaagccgaacagaaggatcaaggcaaacgcacgcgaggtcgaagcgctgctgagaggcatcatcaccaagcgggagaccgccatgaagaacggccatgccgacgacagcgacctgctcggcaagctaatgcagtccaacgttgaagaggcccatggaggcggaggaagctccaagccgatgatgaccatggaagacatcatcggcgagctcaagctgttctacttcgccgggatggagacgacctcggcgctgctcgcgtggacactgatcgtgctcagcatgcaccccgagtggcaagaccgcgcgagggaggaggtcctggaggtgttcgggaagaacgagcccaacatcaatggcacaaatagtttaaaagtggtgaccatggttctatacgaggtccttaggctgtacccaccgatcatagatcttgagcggcaaacgtggaaggaaatggagctgggaggggtcaggtacccacccggagtgacacttctgctgccgatactggccattcaccatgacccggacctgtggggagaagacgtggaccagttcaggccggagaggtttgccgacggcatatccaaggcgtccagagacacgccggcgttcttccccttcggctgggggccgcggatctgcgtcggccagaacttcgcgctgctggaggccaaggtagcgctggccatgctgctgcaacgcttctcgtttgggctctcgccgtcctacacgcacgcgccgttctccgtctccaccgtgcagccggaacacggggcgcagatcgtggtcaagaaaatttaatcattttattgtatgtacttattacatatagtatggtcatcctgtcgtgtatgcatggatttatgtcgcttctctctatagataaatnnnnnnnnnnnnnnnnnnnnnnnnnnnnnnnnn

SEQ ID NO: 699 - DNA, 1206 bp, Zea mays
  misc_feature (1)..(116): n is a, c, g, or t
  unsure (1)..(1206): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggcatggtctcggtcgacgatgagggcgggactcacgaagggataaagaccattccggtgcagagagcctgcgagttcaccacgaactccgtgctctgcgtctgcatcgtcacttggaacatgaacagcaagatgtccgcggaagatgtggcgaagctggtgagctccgacaggaagttcgatctgctggttgtcgggctgcaggaggcgccgaagccagacgtttcgcgggtcctgcaggaggcgttggcggggacacacgtgctgttgggtcagaagagcatgcagtctctccggatgcttcttttcggttcaaggagctcggagaagtacatcagagagatgaaggtggacaaacacgcggttgggggctgcgggggtatcatcgggaggaagaaaggagcggtggccatgtacatcaacttcagcgggatccggatggtcttcgtgtcctgccatcttgcagctcacgagcacaaggtggagaagaggaacgcggagttccagcacatctcgcagtcgctcttcgccaggtacggcgcgccgacgccgtacgcgcagtctgccgacataacggtgtggctgggcgacctcaactatagactccaagggataagctcgacaccggcgaggaagatgatcgaggagaaccgccagagcaagctaagaggcagagaccagctgctgcaagaggccgagaagggccaggtgttcagcggctactgcgaggggacgctgtcgtttaagcccacgtacaagtacgacgtcgggggcagcgtctacgacaccagctacaaggtacgagtgccttcgtggacgggcaggatactgttcaaggttggccagtcttcaggcctggatgcagtgctcagctcgtacgaatcactcgactgtgtccggagctccgaccacaagcctgtgaaggcgcatctctgtctcaaagtacgcagtgatggtgatgctgactgatatccagctggcgcaggagggtttcaactggcggttacttctgcagattaacatgacatgctaattaagatgaaaatgttctagtttggaagggtgattatactctagtatattttataa

SEQ ID NO: 700 - DNA, 1707 bp, Zea mays
  misc_feature (1)..(2): n is a, c, g, or t
  unsure (1)..(1707): unsure at all n locations
nnttctggttccttaagtttgtgggccgtggctatttaatctccaactgcatccccagatattcaccaaattctgtgagactgggaactccgggattggtttggataaggtgttctgggaatggggaaccaatgcccaaacgggacccttgggagtgactactacaaccgccccgcttccaggttcgctgatggttgccttgaggacgatcgctactctgacttgaagaagtttgacaagccatggcctgaggtgaactcgtttaagcccactgctgttggtattttgaagaggggattggatccaacgtcaatcactgtccttgaaaggaagacggccgacgtaagggaacattatatcatcggtcggaggcttggtcaaggccagtttggcacaacattcctctgcaccgagatcagtacagggtgtgagtatgcatgcaagacaatcccaaagcgaaagctcatcaccaaggaggatgttgaggatgtgcgccgtgagatccagataatgcaccatttgtcaggccacaagaatgttgtttccatcaaggatgtatacgaggatgggcaggcggtgtatattgtgatggagctctgcgccggtggggagctctttgatcgaattcaggagaaagggcattacagcgaacagaaggctgcagatctcataagaatcattattagccttgtggctatgtgccattcacttggggttatgcaccgtgatctaaagccagaaaacttcctcctttgggataaagaagatgacctgtcaataaaagcaatcgattttggtctatctgtgttcttcaaaccaggtcaggttttcactgagctggttggaagtccatactacgttgctcctgaggtactacacaaacggtacggaccagaagcggatgtgtggtcagctggagtgatactgtatgttttgcttagcggggtgccacctttttgggcagagacgcaacaaggtatatttgatgctgtcttgaaggggcacattgattttgactcggacccatggcctaagatatctgaaagtgcaaagaatctcataaggaagatgctctgcccttgtccttcagagcgtctgaaagcccatgaagtactacgccatccttggatctgtgaaaatggagtggctactgatcaggctcttgatcccggtgttctctctcgtctcaaacaattctccgcaatgaacaaattaaagaagttggctctgagagctgataatgacaataatgtgaccatcaattatgaagaatttatcgctgcaactgtgcctcttaacaaaatagaacgtgaggagcacctgatggcagcttttacctacttcgacaaagatggaagtggttatatcacagtcgacaagctgcaacgagcttgtggagaacatgacatggatgacactttccttgaagagataattttagaagttgaccaaaacaatgacggtcagattgactacgccgaattcgtagcgatgatgcaaggcaacaaagttggacttgggtggcaacaaatggaaaccactttgaatgtaaccttgagagatgcacctcaagtacactgtcactgacgcgctcgccatgtacagattttgttctcttctcgtgttcatcgtttctccacacgacctgagagttccggtcgacatgacatgtatcatgaggagagagcaaatcaatcgattcattta

SEQ ID NO: 701 - DNA, 444 bp, Zea mays
acaagtttgtacaaaaaagcaggctcctgcaggaccatggagatagaatcggtcaagtgcgagtgctgtggcctgaaggaggactgcaccccgcactacattgccagcgtgagatcaggcttccatggccaatggttgtgtgggctgtgctgtgaggcggtcagagatgaagcatgcaggaggaaggctcaccatggagtagaggaggctgtgagggctcacatggcgttctgcaacatgttcaagttgaaccccgccgtccgcgtggccgacggcatgcgccagatgctccggaggcggtccggtgatatgtcaaagccagaatcggccaagaagtacgaatcatcagtgacactgtattgaagagttcatccatcctaaggcctgtagaccgtctagccctcttctcaggcctcgagacccagctttcttgtacaaagtggt

SEQ ID NO: 702 - DNA, 481 bp, Saccharomyces cerevisiae
acaagtttgtacaaaaaagcaggctcctgcaggaccatgatgaaaggttctagaagaacaggtaataacactgctaccacgctaaacacgcctgtggtcattcatgccacgcagctgccccaacatgtctctactgacgaggttcttcaatttctggagagctttatcgatgagaaggagaacattattgatagtactaccatgaataccatcagcggcaacgccgctgacgcggacgctgccgctgtggctaacaccagcctcaacatcgacaccaacctttccagctccatatcgcaattaaagaggattcagagagacttcaagggtctgccacccgcccaagacttttccgccgcgcccattcaggtctccacgacggagaagaaggagacaagcataggtgttagtgccaccggcggcaagaaaactacattcgccgatgagtgactcgagacccagctttcttgtacaaagtggt

SEQ ID NO: 703 - DNA, 3945 bp, Arabidopsis thaliana
ataaggagaagatccgccctttatgcctctcgaaatcggaaatcgaaaatctctaatcagttttttttttttaagtagaagaagaaaagttcttacgaagaacccagattttgttaagaaatggatgtgccagaggagacgaggcttcgccacaagcgagattttatccagttcctcgatagtgtaagtcgatttctatcacttttctcaccagacatttctcgagcttctgttcttatctaatttgaaaaattggattttttttacggattgtgtagatgtatatggaggaaatcaaggctttggtacatcaaaagcgtcaccgtctcattattaatatctctgacattcaccaccacttcagggaagttgcctctaggttcgtcatcttctcaatttgtcttcctcgaatttttaatcggttctttagtataaggttatgaatttacggcagattttagggttttgttagattcagtgaggttaatttggggatttttaaggattcactacaattgtcatatgttttgtgaccttaaagttgattgctttggtttttttggataggatactgaagaatccaaatgagtatatgcagtcattttgtgacgcagccactgaagctactcgtgctattgaccctaaatacttgaaggaaggagagcttgtccttgttggttttgaaggttattttgtttctcgcgttgttactcctagagagcttctctctgattttattggatctatggtctgtgttgagggcattgtcaccaaatgtaagctcatcattttcactctattcctctgcttttcttctgtttcctttgtgttttacgtagaagattttgaacctctgacacatgctttgctttcaggctctcttgtgaggccaaaggttgttaaaagcgttcacttttgtccatcaaccggtgaatttaccaatcgagattatcgagacataacatctcacgctggtttacccactggctctgtctatcccacaagggtaattacatgttttttgttttcgttttgttcatttacctgtactgctggaagatttgcctcttactgaagattgagtttttttttgttcaggatgataagggaaacttattggtgactgagtatgggctgtgcaaatacaaagatcaccagaccttgtcaattcaagaagtgcctgaaaatgctgctcctggtcagcttccacgaagcgttgatgtcattgctgaggatgaccttgttgactcatgcaagccaggagatcgagtatctgttttcggtatttacaaagctcttcctggaaaaagcaagggtagtgtaaatggagtctttaggtgcgttttcttacacatctgttagttcaagatgttttcactctgatagtcttgaccgagttctttctgtgtaggactatcctcatagccaataatatcgctctgctcaataaagaagcaaatgcacctatatacactaagcaagacctagataacattaaaaatattgcacgaagagatgatgcatttgatctccttgctcgttccttagcaccttctatttatgggcacgcttggataaagaaagcagtagttttactgatgcttggtggtgttgaaaagaacctgaagaacggaacccacttgagggggtaagtcttgcttgaaaacagatttcagattcgactcattggatactttttgtctaactcatttttctttcttcacttgaaaacaaatcttgtgctttcagagacatcaacatgatgatggttggtgatccatctgttgccaaatctcaacttctgagagcgataatgaatattgcacctttggctatatcaaccacaggccgtggttcttccggtgttgggttaactgctgctgtgacttctgaccaagaaacaggtaaaaagcacacaaaagcgtttccacatttttttatcaaatgctaaaatcaaaatttgaaggaaggtcaaaagtgctatttctcattaaaatcaaattctcattttcatcaggggaacgaagactagaagctggtgcaatggtcctcgctgataaaggtatcgtgtgcattgacgagtttgataagatgaatgatcaggaccgagttgctatacacgaagtgatggagcaacagactgtaacaattgcaaaagccggtatccatgcatcactgaatgctagatgcagtgtggttgcagctgcaaatcccatatacggaactgtaagttctcaccgaagttttcctaatctacttactctactgactagtatttttttgtcctaatacctactcttgctcctgcagtatgacagatcactgactccaacaaagaacattggacttccagattcgctgctttctcgttttgatctactgtttattgtgttggatcaaatggatgctggtatcgacagcatgatttcagaacatgtcttgcgcatgcatcgttacaagaacgatagaggtaggaaacaaatcatgcttctatgttttactaaacatttcacaacccatgtcttgaaacgcatctgacttttgagtgaaccataggtgaggcagggccagatgggagcttgccttacgcgagagaagacaatgctgagagtgaaatgtttgttaagtataaccaaacactacatgggaagaagaaaagaggccaaacacatgataaaacccttacgattaagttcttgaagaagtacattcattacgccaagcaccgtattacaccaaagctcactgatgaagtgagacagtgaactcaaatatataaatttttatgtatctgataatctcttccactaaatctcttttgttattaaatttgcaggcatcggaacgtattgcagaagcatatgcagatctcagaaatgcaggttccgatactaaggtaatttatttcataaaataacattggacactgtatctttttcgtcttgggaacttgtatttgacacaaccatcgaaatctctgcagactggaggtacgcttccgataacagccagaactctagagacaataattcgtcttgctacggcacatgccaaaatgaagttgagtagcgaggtaacaatctaactcaaatcttctgtttccccacctggtcgtgaatatgttctattcagattctttctaaagtgataactttattttgaaaggttactaaagctgatgcagaggctgccttgaagcttatgaactttgcaatatatcatcaagaattaactgagatggatgatcgtgagcaagaagaacgtcaaagggaacaagctgaacaagaaagaacaccaagtggacgtagaggcaaccaacgcaggaataatgaagatggagcagagaatgacactgcaaatgtcgacaggtaaactaatttgatctcctccatggaaacctatatcacagctttctcaacccttatacttttttctttctcttttgctggtccattcagtgaaacagcagatccaatggaagtagatgaaccttctgtagagcaattcagcggcacggtctctgcagcaaggattgaaacctttgagcgagtgtttgggcagcacatgaggacacacaggctcgatgacatctctattgcagatatagagactgttgtcaacaacaatggggttggagcatctcgttactctgcagatgagattatggctctcttagaggtaattcacaaattaagagacaagctttctcattctttaactttttatacaatatcttcataactttactctattgtggattttatgcagaaactgcaagatgataacaaagtgatgatcagcgatggcaaagttcatatcatttgatcatatgaagaaatcaatattgattgcatcatcatcatcatattagaactcaaaaatagtgtagtagtaaactcttggaaaccaaaatatcattttgtaaaatctttattcatacgttat

SEQ ID NO: 704 - DNA, 2493 bp, Arabidopsis thaliana
ttcttgtttgttgattaacccttaattaatccgggcgcgcctgatttatcacaagtttgtacaaaaaagcaggctcctgcaggaccgttaaaaatcgcatgaatgctggaaatggaaagagttgctgagctcaagagacttcctagtaaaggtcctgtctctggtcacttatcaagaagaccatacttagactttgaaactagagatgccccgggtatgcatttggagagtttgagggaacgagctgctcgatacaacacgggaagatctgtgaatccaactacgacattggggagagaactaagccaagttctgaatgtgcatagggaagatatgatgatgactcagtttggtggtaacatgaatgattttcaggagtttgagcctgttgtatcgtctgttagaacgatgaaggccaagtatcctttgttggagattgaagaaattggagctgctgatgatgatgttacttgtaagggaagcaatgatatgtctgaggaagctggttctagctccttccgtggagttagtcatcctccagagcctgacgatatggatctaataacaactgtttatgtgcccatcagcgagaaaaacaaacctgattcggtttgcttgatgaagagcatgtctactactaaaggaccctttatcgaggatatttcgctctgtgtgcctccaaagaagccaagcccgagagtactttcacctgcagaaagcatagttgaggaacctgctacatcgctgtccccgttctctgtggctcgtgcatcgcagaacactgaaaactctctgctaccaccagattcagacaaagaatgtgtttgggatgcttctctgcctcccagtaccaatgtgagcccacatagcagtagtgttgaaagtatgaatttggctcgggctatgagtattgctaatagctcttctgcaacaagtactactcagcggagcgatgttgtgcttagtatggacaagaactactttgacaggagtatcagtatggttttggattcgtttgaaagcaccaagaccagtgcaagcagagcaagtgatagtagcggcctaagcgaagagagcagctggagcaatttcacgggaagccttaataagccacacaaagggaatgatccttggtggaatgctatcttggctatccgaacccgagatgggattttgggaatgagccacttcaagttgctgaaacgattaggttgtggtgatattgggagtgtctatctggctgaattaagcggaactcgatgccattttgctgtgaaagtcatggataaagcgtctcttgaggaccggaagaagttgaatcgagctcagaccgagagggatattctacaactattggatcatccgtttctaccgacattgtacactcattttgagactgacagattctcgtgtttggtcatggaatactgtcctggaggtgatctgcacactctaaggcaacgtcaacccgggaagcatttctcggagtacgctgctcgattttacgctgcagaggtgttgctagcactagagtatctccacatgctcggtgttgtttacagagacttgaagcctgagaatgttctggttcgagatgatggtcacataatgctttcagactttgatctctccttgaggtgcgcggtttcgccaacactgatcaaaacattcgactccgatccatctagacgaggcgcattctgcgttcaacctgcttgtatggagcctacatcagcttgcatcattcaaccctcatgcttcttaccgcgcagcatcttccctaacaaaaacaaaaaaaacaagtcccgtaaaacccaggcggatttcttcaaatcacactctggttctctcccagagctagtagctgaacctaacacacggtccatgtcctttgttggaacccacgagtacttagctccagagatcatcaaaggagaaggacatggaagcgcagtggattggtggacttttggtatctttgtgcatgagctcctatatgggaaaaccccgtttaaaggatcaggaaatcgagctactctgttcaatgtagtcggcgaacagttgaaattccccgagtcaccagcaactagctatgcaggcagggacttgatacaggctttactggtgaaagatccaaagaacaggttagggacaaagagaggagcaacggagataaagcagcatccattctttgaaggtgtgaattgggcattgataaggtgtagcactccacctgaagtaccgagacagatggagaccgaaccgccaccaaagtatggaccgattgatccggttgggtttggtagtaatagcaaaaggatgatgggaccaccagcagtatcagcagcagcagcagacacgaaatctggtggtaaatttctagactttgagtttttctaaagcttccaagatttggttccgtactcgagacccagctttcttgtacaaagtggtgataaattggagctctgcagagctttcgttcgtatcatc

SEQ ID NO: 705 - DNA, 3322 bp, Arabidopsis thaliana
gcgttgcgatgattttgtgcctcgtggaatcatcacactacaacgtattcacctgaaattcagacaaaacagtttgaggaaactgggaagtgataagataagagagtgatagagagagagatgacggaaaacggcgtcgttacaggaggaggccatactgttatggtgggcgtaaagttcgatgagtcgagcaatgagctacttgattgggctttggttaaggttgctgaaccgggtgatactgtaatcgctcttcatgtactcggcaatggtaacacttttttgtttctctgtattaaagctacgatttttggaaatgggtttccatgtttactctctcttattggatttgtgtagagatcgttgaccgagcagacaactcttctctcgtctccattgttaaaaactttgattctgttcttgaagtttatgaaggtttctgcaaattgaaacaggtatgcttattaaagtggaaaactttcatgctctattctctctgctctagctgatgatggttgaattgcttttaatagttggaattgaagctaaaattatcccggggttcttctactcgaaagattctagttaaagaagcaaaaatgtgttctgcgtccaaagttgtagttgggatctccagacgtttccatacaattcattcatctgtctccgtggctaagtacttagctaggaaagtagcaaaagattgctgggttctggctgttgacaatggaaaagtcatgtttcagaaagatggttcctcatcgatcattcatcactctaaaggtttggcctttctctataagtttcttttgtatgtgatgatttctgtgtctgtattagggttttgaactcttcttctttcttgggcattggtttgtaataggtaaaagtgatgctcgtaggaacactttgtctagtttctttcagatgcctgtcacattgagaaagaataccaaagtagtaaaccattctgaggtggaagaggaagaggcagaggaagatcattccaatggtcagagtcttcggcggtctttagtgtatgcatgccttgggaattgctcggttcgtgatatgaattccttgcctacgcctggaaatttatctcgatcgtctagctgtaatggtgatcaagatgataatgctgatttgcacaaggcaatggcacttgttcctgcaaaatttccagaagatttgaccccattcattacaatgctggtaaaagaactgcctgaatttagaccaggttggcctttgctttgtcgtgtagcttcttcagatgtattagcttctgctccgagaagttcttcgttccgaaagataccagttgtgcagtgggtgctgaagctgcccgctaggaccaattctgttgttggaagctcagacacaaagcagattggttttgattcttctgaatctgaagaaaatgataagttgtctagctcaaacgttgaaaggcaagcaattgttcctgatgaatctatgatcgtgaaatgttctcttgatcatagctcaggtagatttccagagaatgtagagggtcttcaggcaaggatctccacatcttgccagttttttacgtataaggaacttgtgtcggtgacatccaatttctgtgctggtttgttcctctcttctcataattaagctaccgctttgttttgaactttcttaagactcttgtcatttccttttgtctaaataagaaaagcaatgtactttcagataatttcatcggaaaaggaggcagcagccgggtttttagaggttatctgccaaatggaagagaggttgcagtgaaaattctcaaacgaaccgaatgtgtcttgaaggattttgtggcagagattgacattatcacaaccttacaccataagaacgttatttcccttttaggttattgctttgaaaacaataacctgttactagtatataattatctctcaagaggaagccttgaagagaatcttcacggtaagcctctgaccatttagccacttgcagattttcttgtgttctggttctaacaatcaaggtttgagattgagattaggcaacaaaaaagacctggttgcatttcgttggaacgagagatataaggtggccgtgggaatagctgaagcgttggactatctgcataacgatgctccacaacctgttattcacagagatgttaagtcatctaacatattattgtctgatgattttgaaccacaagtaagtttcttttagtttccaatgtttacatcgaagaggaaaaattcacgagatactaaaaagagaaatcttgttcacagctttctgactttgggcttgcaaagtgggcgtcggaatccacaactcagataatctgctccgatgtcgcaggcacctttgggtgaggaaaaaaaatatatatatgttgatgctgcgtgaaagttgtttaggagataacaatcttgaaaatgttctacgtttcttgttgcagctacttagctccagagtactttatgtatggtaagatgaacaataagatagatgtctatgcttacggcgttgtactcctcgaacttctttctggaagaaaaccggttaatagcgaatctccaaaggctcaagacagtcttgttatgtgggtatgtggatactaccggcaaaatgttcttacattgaaatgtctaagctttctttgttattgctaaacagacatgcatgtacacttgcaggcgaagccaattctggatgataaagaatattcacagctattggactcgagtttgcaagatgacaacaatagtgaccagatggagaagatggcgttagcagccactctttgtataagacataaccctcaaactaggccaacgatgggaatggtgagtcaattcttaatcctccatttcattgccagtttcatcattttagagatggctactatatcaaacaagttattaacacgatatgtcttttggaaatgcaggtcttagagcttcttaaaggtgacgtagagatgctaaaatgggcaaagctacaagttagtaacccgttagaggattcaatgctactcaaggacgagaaattgcggaggtctaatctgcagtcacatctaaacctagcattccttgacatggaagatgactctctttccatgggaagcatggagcaaggcatctccgtggaggagtatcttaaaggcaggacaagccgttcatcaagcttcaactgagccattatttttgttcactacaacaaatcacaattgcaatactcaacaatgtgagatggtgaaaaaaaagagttctcctgtgtgtgagtgagtgtaaagtgtatatttaagaaaatgtgt

SEQ ID NO: 706 - DNA, 900 bp, Zea mays
ttcttgtttgttgattaacccttaattaatccgggcgcgcctgatttatcacaagtttgtacaaaaaagcaggctcctgcaggaccatgccgtctttcatcgacggccccactttccgggcgctgctccggccgtccaccaacgggcgccggaccaagatctcggacagcggcggcggcggcgggggcatcttcaagatgttcaagctcatgcccatgctctcgtccgggtgcaagatggtggcgctgctgggcaagcacaacaaccgggcgctgctggccgaccacgcgacgacggtgacgctgttcgggccgcgccggggccgcgtgagcctggccatccacgaggacacgcgcgcgccgccgctgttcctcatcgagctgcccatgctgacgagcgcgctgcaccgggagatctcgtccggggcgctcaagctggcgctggagagcgacacccgcagcgcgcgccgccgcctcgtggaggagtacgtctgggccgtctactgcaacggccgcaaggccggatactccatccgcaggaaggaggcctccgacgacgagcgccacgtgctgcgcctcctgcgcggcgtgtccatgggcgccggcgtgctcccggccgcccccgagaaggagggcggcgtgcccgcggggcccgacggggagctcacgtacgtgcgcgcccgcgtcgagcgcgtcgtcggatccaaggactcggaggccttctacatgatcaaccccgaggagggcgggaacggcgccgataataacgggggcggtggaggcgccggcggcgcgccggagctgagcattttcctagtaaggatgaaatgactcgagacccagctttcttgtacaaagtggtgataaattggagctctgcagagctttcgttcgtatcatc

SEQ ID NO: 707 - DNA, 2280 bp, Zea mays
  misc_feature (1)..(42): n is a, c, g, or t
  unsure (1)..(2280): unsure at all n locations
nnnnnnnnnnnnnnnnnnnnnnnnnnnnnnnnnnnnnnnnnntgagcagtcccagtttgctcatcctctgcggactgcggccgaacgcccatcacgccacgcgccccttccccaatccccatggagatctccgccggcgtcaccactgtcaccgccgtgtcgatcctcatcctcctgttgctgccgcaacccgcggcgccgttctccttcacatacaacttcacctcgccctcggacacgccgccgcccgggattgccttccagggggacgccttctacaacaaggccatccgcctcacccgcgacgagcgcctcggccccatcaccagcagcaccggccgcgccttctactcccacgccgtcccgctcgccgaccccgtctcccgccgcccggcctccttcgtcaccgccttcgccttctccatcgccgcccccgacccggcctccgcctcgggcgacgggcttgccttcttcctctccccgttcccatccgtcctccccgaatcctcggcggggggactactcggcctcttcaattcatcctcggtccgcgccggcacgctcgtcgccgtcgagttcgatacccacaagaacgagtgggaccccagcggcgaccacgtcggcgtcgatctcggggggatcgtctcctccgccaccgccgactggcctaccagcatgaaggacggccgcacggcccacgcgcgcgtcgagtacgacggcgtcgccaagaacctcaccgtctcgctctcgtacggctccgcgcgcccgaacaccacgggtgacgtccttctctggtatgccgtcgatctgagggaccacctgccggactccgtcgccgtaggcttctccgcagccacgggcgaggccgcggagctgcaccaggtgctctactgggagttcacctccaccgtcgaccctaaggaggagacggtggtcctgtgggtggtgttagggctgtgcgctttgcttctcgtactcgtcggcgcgggcatcgtctggttcgtcaggcaatggaggaaggccggacaattcgacgacggtgacatcgaggtcgacgacgtcatgggtggcgagtacgacgagctcgcggacgagttcgttgtccagtgcggcccgagaaggttcaggtacgccgaattggcggcggccacgaagaatttcgcggaggagcggaagctcgggcaaggcgggttcggcgccgtgtaccgggggttcctgaaggaactcggctttgaggttgccatcaagagggtgtccaagggctcaacgcaggggcgcaaggagtacgccgccgaggtgcgcatcatcagccagctgcgccaccggcacctcgtccgcctcgtcggttggtgccacgagcaccggggcgacttcctgctcgtgtacgagctgatgcccaacggcagcgtcgaccaccacctctacggcaagggcatgctcctcacctggccgatgcggtacgacatatcgctgggcctcgcgtcggcgatgctctacctccacgaggagtgtccacagtgcatcgtccacagggatgtcaagcccagcaatgtcatgctggacgccgccttcaacgcgaagctcggagactttggcctcgccaagctcgtggaacatggtagccagccgtacaccactgtcctggccggcaccctgggctacttggcgccggagtgcgtgatgacaggcaaggcgagccgggagtcggacgtgtacagcttcggtgtcgttgcactggagatcgcgtgcggccgacggcccgcagagctcaacaacgagccaagcaaggcgagactggtgccttgggtgtgggaactgtatggcaagaacgccctccttgaagcagcagactggaggctgaaggggcagttcgatgagaagcagatggagcgcctgatgattgtgggtttgtggtgtgctcaccctgactatgcgcataggccaagcatcaggcaggccctgaacgtgcttacgtttgaggcgccattgccggtgctgccggagaagatgccggtgccgacgtatttccccttgcctgatctcgttgcttcgatttctgttgggggaacctcgagcgccgaggatccagatccaggtgttagtgattatgggtcctcgggtaaagtttcatcagtcagggataggctgctggagccatgagccgatgacggagttttctgtgttttactgcaaacacgaggagtgaatctacggttttcagattcaggtgtatagcatcgaaatgtattgattgttaattcataggtaagggtggcaaaa

SEQ ID NO: 708 - DNA, 2985 bp, Zea mays
  misc_feature (2949)..(2985): n is a, c, g, or t
  unsure (1)..(2985): unsure at all n locations
ctactaccagatcgatcctgcctgcctgcctgcttgtaacagcaacagcagcagaagtggcgcactgtgctttgcggtggcggaggctgcgagagaggaggaacttgcaagccgacttccatggctgccgccttctccgccgctatcctcttccacctgctgctgctcctcttctcgccttccgctgcgcagcctggtttcattagcttggactgcgggggagctcgtgatcacacggatgccattgggatccagtggacctctgatgccagcttcgtctctggcggccaggccgcgcagctgctggtccagaatggcctgcagcagacccagcagcagctgaccaccgtgcgctacttccccgcggacaacaggaagcactgctacaccatgaacgtcaggaacaggacgcgctaccttgtcagggccactttcctctacggcaacttcgataacagcaacgtctacccgaagttcgatatctccctcggagcgtctccctggtccaccatcgtcgtcgacgacgccaccacccccgtcgttgaggaagccatcatcttggctgctgctcccacgctcagtgtatgtctctccaatgccagcacgggacagcccttcatctctactctggagcttcgacagtttaacggttcgctctactacaccactgacgagacacgcttctttcttggactgtctgcgaggataaattttggcgcaggaagcaatgattcagtgagatatcctgatgatccatttgatagaatctgggaatctgattctgtgaggagagcaaattaccttgttgatgttgctccagggactgaaagaatatcaactacaaaacccatatttgtcggtaccaacgaagaaccacctgaaaaggtcatgcaaacagcagtagttggccaggatgggtcattgaactaccgccttgatttggaaggtttcccagcaaatgcttggggagtctcgtattttgcagaaattgaagatttggcaccaaatgaaacgaggaaatttaagttagaggtccctggcatgccagcactcagtaaaccaactgttgatgtggaggagaatgctcaagggaaataccgtttgtatgaaccaggctacacgaatttgtcacttccgtttgttttctcctttgggttcaggaagacgaatgattcttcaaaggggcctattttgaatgccctggagatttacaaatatgtccaaattactatgggatcacaggatgcaaatatcatggccagcatggtatcacgatatccacaggaaagttgggcacaagagggtggtgatccgtgcttaccagcatcatggtcctgggtgcaatgcagttcagaaacttctccaaggatattctcaatcacattgtctgggaagaacattaccggaagtatcccggtggaactgacaaagctatcagggctggttgagctaaggcttgatggtaattcattttctggccaaattcctgatttcagagaatgtgggaatttgcagtatattcaccttgagaacaatcagttaactggtgaattgccatcttctttgggtgacctacctaacctgaaagagttgtatgttcaaaataacaagctgtctgggcaggttccaaaagcacttttcaagagaagcattattttgaacttctcaggcaacagtggccttcacatagtaagcaatggcattagccacaccataattattatatgtgtggtgattggagccgttgtcttactgggtgttgctattgggtgctatttcattacatgtaggagaaagaataaatctcatgaagacactgttgtcattgcagcagcaccagctaaaaaacttggttcatattttagtgaagtggctacagaatcagcacacagattttctttatctgaaattgaaaatgctactgacaaatttgagagaagaattgggtctggaggctttggcatagtatactatggaaagttggctgatgggagagagattgcagtcaaacttctcacgaatgactcgtatcagggaatcagagaattcttgaatgaggtgacattgctttccagaatacatcatagacacctggttacattccttggttacagtcagcaagatggcaaaaacatactagtgtatgagttcatgcataatgggacactaaaagagcaccttcgtggagctgataatgaaaagataactagctggctgaagcgtctcgagattgcagaagattctgcgaaaggtatagagtatctccacacgggatgctccccaacaatcatccatagagacctgaagagcagtaacattctcctagacaagaacatgagagcaaaagtggcagactttgggctttcgaaacctgcagtggatgggtctcatgtgtcaagtatagttcgagggacagttggatacctggacccagagtactacatctcgcagcagctgacggagaagagcgacatctacagcttcggcgtgattttgctggagctcatctctgggcatgaacccatctcgaatgacaactttgggctcaactgccggaacattgttgcgtgggcccgatcgcacatcgagagcgggaacatccacgccatcattgatgagtcgttggacagaggctgctatgacctgcagtcggtgtggaagatcgcggaggtggccataatgtgtgtgaagcccaagggcgcccagaggcctcccatctcggaagtgctcaaggagatccaggacgccattgccatggagcgggtgctcgtgtccaattgcagcaacaggatgggttcaggtagcgtggagcagaatggaggagcatctttcgacgagctgctcatgcagccgggtctcagatgagatgagaacctactcgtaccttgagtccattgtatgtagtaattaatgtgtttactacattttttttgagaaacaaattaagtnnnnnnnnnnnnnnnnnnnnnnnnnnnnnnnnnnnnn

SEQ ID NO: 709 - DNA, 506 bp, Zea mays
ttcttgtttgttgattaacccttaattaatccgggcgcgcctgatttatcacaagtttgtacaaaaaagcaggctcctgcaggaccatgatgatgcgaggtggaaggctcacgggtttgacctctcaggttctgaggtgcttcagcacggagatatttgtcagcagattatcattctatacgacagaggaagaattcaaagatattttttcaccatttggcaccgtagaggaagctcgacttatgagagaccaccaaactggaaggatgaagggatttggttttgtcaaatattcatcgcaagcagaggcagagaaagctgtcaaggcaatggatggcaggattctacgtggaagattgatctttgtggagatggcaaaaggacacgaaagcaagtaggacaccctccccacgagaggatttcacgaacagaaacactcgagacccagctttcttgtacaaagtggtgataaattggagctctgcagagctttcgttcgtatcatc

SEQ ID NO: 710 - DNA, 2805 bp, Zea mays
  misc_feature (1)..(78): n is a, c, g, or t
  unsure (1)..(2805): unsure at all n locations
nnnnnnnnnnnnnnnnnnnnnnnnnnnnnnnnnnnnnnnnnnnnnnnnnnnnnnnnnnnnnnnnnnnnnnnnnnnnnntgtgacctgcaagagctaaaagtggcagcgattgacttccagatgagtccatttgtgctggccgtggtgagcgttgcattcctcaacttgctgttcctgcaagctcatggaagcggtttgcttctgagctgtggctcgaacagcactgtcgatgctgatgggcggagatggaccggcgacataacccctgaggggaattttaccttgagcagccctgggcttgcggcgtcactggtcgggaagagcagttctgatgagatattcggaccgctttacagctctgcccgtttcttcaacgcggcaacttggtataccattagtgtgctgccaggaagttactgtgtcaggttgcatttcttcccttcgaccttcgggaatttgagcgcaaacaactccgtgtttgatgtcacggcaaatgatttcaagcttgtttcaaaattcaatgcgtcagaggagattgcttggagagcctctgtgagcaattcggtcaccagtgcagttgtcaaggagtactttcttgtagtcggtgctcgtggcctgagcattgagtttgatccaagacctgggtcgtttgcctttgtgaatgcgattgaggtcatgctgaccccagataatttgttcaatgatacagtgagcaaagttggcagtgcaggcacgcagcttcctcttggtttgagcggcagaggtgttgagacaatgtaccggctgaacattggaggccctgcacttaaatcgcccagtgatcagtatctccacaggccatggtacactgacgaagcgttcatgttttctacaaatgctgctcagactgtgtctaatgcttcaagcatagtgtatgtatcaagcaatgattcgtcaattgcgccgattgatgtttacgagaccgcaagaatcatgggcaacaacatggttgtggacaagcggtttaacgtgtcgtggcggttctatgtccacccaaactttgattacttagtccgccttcatttctgtgagcttgtctatgacaagcccagccagaggatcttcaagatctacatcaataacaagactgctgctgagagctatgatgtgtatgctagggctggggggattaacaaagcatatcatgaggacttctttgacaactcgacacagcaggcagacacactttggcttcagctaggccctgactccatggccagcgcttcaggtgctgatgcacttctgaatggtgtggagatattcaagctcagcaaggattccgacctttcttatgtgcttggtcatattgacacgggcaaccagatggattcttcaaaaggggggaagattaaaggcctatgggaagaacttggtattggctcagcatcttttgttgcggttacaagcgttgttctgttctcatggtgttacataagaaagaaacgaaaagctgtcaacaaggaggcccctcccggctggcatccgttggttctccacgaggctatgaaaagcaccacagacgcccgtgcagccagtaaatcgtcgtcggctcggaacgcctctcccattggtcataggatgggaagaaggttcggcattgcggagatcagggcagccacgaagaacttcgatgagtccttagtcattggaactggagggtttggaaaggtctacaaaggtgagattgacgagggcgctacagtggccatcaagcgcgctaacacattgtgtggccagggcctgaaagaattcgagacggagatcgagatgctttccaagcttcggcaccggcaccttgtggcgatgatcggctactgcgaagagcagaaggagatgattctggtctacgaatacatggcgaaggggacactgagaagccatctgtacgggagcagccttcctcctctgacatggaagcaacggatcgacgcgtgcattggcgcggcccgcggcctccactacctccacacaggagcggaccgaggcataatccaccgggacgtgaagaccaccaacattctgctggacgacagtttcgtcgccaagatagccgacttcgggctgtcaagaaccggaccaacgctggaccaaacccatgtcagcaccgcggtgaggggaagcttcggatacctagaccccgagtacttccggaggcagcagctgacgcagaagtccgacgtgtactcgttcggagtggtgctcttcgaagttgcctgcgcgaggccagtgatagaccccacgttgcccaaggaccagatcaacctggcggagtgggcgatgaggtggcagcggcagcgctcgctggaggcgatcctcgaccctcgcctggacggcgacttctcgcccgagtccctgaagaagttcggcgagatcgcggagaaatgcctcgccgacgacggcaggagcaggccgtccatgggcgaggtcctgtggcacctcgagtacgtgctgcagctccacgaagcttacaggcggaatgtggtggagtccgaatcgttcgggagcggcgagctggggttcgctgatatatcatcatccttcttcagccttccccacgtcatcagggagggggaggaggaacaccaccaccgctcgaagaagccgtcaagtatcagagaggaactagacacacgtgagaacttctgacttcagcaaaacaaaaacaaaaaaaaatcttgctttgtagccatgatcatgatgtaaagttgtgttacatcattctctttagttttttttttttttttgcttcttattccattggggcgt

SEQ ID NO: 711 - DNA, 888 bp, Zea mays
ttcttgtttgttgattaacccttaattaatccgggcgcgcctgatttatcacaagtttgtacaaaaaagcaggctcctgcaggaccatgatgtcgtcgtcgtcggacgcggcagcggcgctggagctgcaggagtccgggtgggaggagctgcggcgggaggcgcgcaagctggagggcgacctcgacgtgaagctctcctcctacgcgcgcctcgccgcgcgctcctcctcctccgcctcgggcgccgcctcccccaccgccgaccgctcctcctggaagtccatggagttcgagatccagtcgctgctcggcaagctgcaggacgtcaacgacgccatgagccgctgcgccgcctccagcgccaccaccacctccgtctcccagaagctcgcgcgccaccgcgacatcctccacgagttcacgcaggagttcaggcggacgagggggaacctgagctccatgagggagcacgccgatctactcaactccgtccgagacgacatcaccgagtccagggcctccggtggcatgtcgccaagagtgcatttgctcagggaacgagcttccattcatggcagcatcaaccagattgatgaggtaattggccaagctcaaagcacaagagtagctcttaacaatcagagggccatgtttggagacattcaagggaaagtgaagcagctgggtgaaaagttcccggtaatcagaggtcttcttggtgccatcaagcggaagaaatcaaaggacaccataatcctctcggcagtgatcgcggcctgcaccatcttcctgatcatttactggctttcgaaatgactcgagacccagctttcttgtacaaagtggtgataaattggagctctgcagagctttcgttcgtatcatc

SEQ ID NO: 712 - DNA, 789 bp, Zea mays
ttcttgtttgttgattaacccttaattaatccgggcgcgcctgatttatcacaagtttgtacaaaaaagcaggctcctgcaggaccatggggtgggcgacgcggttcctggcggcggtgtgcttctttgctgcgggtgtcctcttcgtccccgaggctctccttggttccccctccggcgcaggcgccgtcaccgctgccaagctggcccacgtcctctcctttgccacttcctggggcgccgccctctgggccacctttatcggcggcatcatcatgttcaagaacctgccgaggcacatgttcggcaacttgcagagcaagatgttcccggcctacttcacgcttatctctgcctgcgcagccatctcggtcgccaccttctcgcacctccacccgtggaagacggcgtccaccgtggagcgctaccagcttggattcctcctatcagcgctcggttgcaatctctccaacctgctagtcttcacccccatgacaattgagatgatgaagaagaggcacaagattgagcgggacctgagtatcggtgaggaagtgggatggtcaaagaatcagcaggtggctaaatccaaccccacccttgctgcaatgaacaagaagtttgggatgatccacgggctgtcatcactggccaacatcatgtcgtttggtagcttggccatgcactcctggtacctggccagcaagctggagctgtgactcgagacccagctttcttgtacaaagtggtgataaattggagctctgcagagctttcgttcgtatcatc

SEQ ID NO: 713 - DNA, 1007 bp, Zea mays
ttcttgtttgttgattaacccttaattaatccgggcgcgcctgatttatcacaagtttgtacaaaaaagcaggctcctgcaggaccatgttgtggcgcgcagtacgcagtatggatgtaataatgcattcttcgagtttccttcttccgaaactgtatcaacctgtcaacaaaccagtcaagaactatgctttagttgttctaaaccagcatcttccacgattcatgcctcgactctgggatcatgcaaacttgaggatctgcgctgatggaggagctaatcatatttttgatgagatgtatcagataaccaatgatgaagacaaaaaaagcaccagaaataagtatgttccagaaataattgaaggggacatggattctataagacctgaagtaaaactgttctactctagtcagggatccaaaatttctgataagtcacataaccaggagacaacagatctacacaaatgtatttctcgaatccatcattgtacgcctgatgatgaaaaaccaaatctctgtgtacttgttactggagcactaggtggaaggtttgatcacgaggcggcaaatatcaatgttctgtatctgttttcggacatgaggattgtcctcctatcagacgattgcttgatccgacttcttccaagaacacatcgccatgagctttatattgagtcgtctgttgaaggaccccattgtgggcttttccctgttggagcaccatcaacaagcacaacaactactggcctgaaatggaatctaagtgaatcaaagatgagatttgggagcatgataagcacatccaacattgtgcagtcggagaaagtaactgtagaatctgatgcagatctcttgtggacaatttctctgcgaaatctgacataagcagttcctagtttgttatcttttttcttctctttcctgtcaagtggctcgagacccagctttcttgtacaaagtggtgataaattggagctctgcagagctttcgttcgtatcatc

SEQ ID NO: 714 - DNA, 591 bp, Zea mays
ttcttgtttgttgattaacccttaattaatccgggcgcgcctgatttatcacaagtttgtacaaaaaagcaggctcctgcaggaccatggccgccccgctccggcggagcctcccctcccttggtcgcgcgcttctcacgccggcgccggcgcggatgctctccgcggaggcctctgatgccctcgttgagatcaagcccggggagatcgggatggtctccggcatccctgaggagcatctccgccgtaaggttctaatttattcaccagctaggactgcatcccagcaaggttcaggcaaagtcgggaggtggaaaattaattttttgtcaacccaaaagtgggagaacccgttgatgggatggacatctactgggggtccatatgctaatgtcggtgaagcaggacttacgtttgacagtgcagagtcagcaaaggcgtttgccgaaaaacatggatggaattatgtggttcggaaacgccatgcacctcttctgaggcctaaggcctacgctgaaaacttcaagtggagaggccctccgaaagcggagcaagcatgactcgagacccagctttcttgtacaaagtggt

SEQ ID NO: 715 - DNA, 1057 bp, Zea mays
acaagtttgtacaaaaaagcaggctcctgcaggaccatggcagcctcgctccaagccgcggccaccctgatgcagccggccaagatcggcggccgggcgccctttgcctcgctgccgtcccgcccgtcgtcgcaactcgcctgcagggcgttcggcgtcgacgccggcgccgccaggatcacgtgctccctgcaggacgtcgccagcaggtgcgtcgacgccgcgaagctcgccggcttcgcgctcgccacctcggcgctcctcgtctcgggcgcgagcgcggagggcacgcccaagaggctgacctacgacgagatccagagcaaaacgtacatggaggtgaagggcacgggcacggcgaaccagtgcccgaccatcgacggcggcgtggagtcgttcccgttcaaggccggcaagtaccagatgaagaagctgtgcctggagccgacgtccttcaccgtcaaggcggagggcatcgccaagaacgccccgcccgagttccagaagaccaagctcatgacccgcctcacgtacacgctggacgagatcgagggcccgctcgaggtcggctccgacggcacgctcaagttcgaggagaaggacggcatcgactacgccgccgtcaccgtgcagctcccggggggcgagcgcgtgccgttcctcttcaccgtcaagcagctcgtcgccaccggcaagcccgagagcttcggcgggcccttcctcgtgcccagctaccgcggctcctccttcctcgaccccaagggccgcggcggctccaccggctacgacaacgccgtcgcgctccccgccgggggcagaggtgacgaggaggagctccagaaggagaacatcaagaacgccgcctcctccaccggcaacatcacgttgagcgtcaccaagagcaacccggagaccggcgaggtcatcggcgtcttcgagagcgtgcagccgtccgacaccgacctcggggccaaggcgcccaaggatgtcaagatccagggggtctggtacgctcagctcgagtgactcgagacccagctttcttgtacaaagtggt

SEQ ID NO: 716 - DNA, 517 bp, Zea mays
ttcttgtttgttgattaacccttaattaatccgggcgcgcctgatttatcacaagtttgtacaaaaaagcaggctcctgcaggaccatggcggaagaaaccaacatagaaaaggaggaagaggagttcagcaccggtcctctctcggtgctcatgatgagcgtcaagaataatacccaggttcttatcaactgccggaacaacaagaagttgcttggtcgcgtgcgagccttcgatcggcactgcaacatggttcttgagaacgttagggagatgtggaccgaggtaccgaagaccggtaaaggcaagaagaaggctctcccggtgaacaaggacaggttcataagcaagatgttcctccgtggggattcggtcatcattgtcctcaggaacccgaaatgagtagcctgtacacgtagagagtctatttgctagcagtacgttgtgcctcgagacccagctttcttgtacaaagtggtgataaattggagctctgcagagctttcgttcgtatcatc

SEQ ID NO: 717 - DNA, 661 bp, Zea mays
ttcttgtttgttgattaacccttaattaatccgggcgcgcctgatttatcacaagtttgtacaaaaaagcaggctcctgcaggaccatggccacttcctcctcgtcgctcacaacgctccactcccgcttcttctctcccaccccttcctcgccctacatggcggcgctgccccgacggcgaagggccggagcgcggtaccctcgcatccgggccattgacctcgaccagaacacgattgtggccatttcggtgggcgtcgtcagcatcgccgtgggaataggtgtccctgtgttctacgagacccaaatcgacaatgccgccaagagggataatacacagccgtgcttcccctgcagtggttctggcgcgcaggtatgcaggttttgcagtggaaagggcattgttactgtagtacttggtgcaggcgagactgaagaatcgcagtgtgtcaactgcgagggcatcggctctttgacatgcactacatgccaaggcaccggaatccaaccacgctatcttgaccgcagggagttcaaggatgacgattgatgaaggccttattgccatcttcggtagtatgtcaaatatgctcgagacccagctttcttgtacaaagtggtgataaattggagctctgcagagctttcgttcgtatcatc

SEQ ID NO: 718 - DNA, 2161 bp, Arabidopsis thaliana
tataccaatgattctgtaggatttaaacatttttttgtgttctgtcgtaaaccatgtaaaatgctttctcgcttcaacattcatcagccatttaaacgctgtaaatttcgattctttttgcgttccattggaaacccagataccattttggtggaatcatgttcgtcttcctcttgttcatcgccagagccatctctggttcgttccgattacttgactaaaccttctgatcaagaccagatttttccgttgaacaagataatagctaggtgtgtacgttcaggagatatagatggagctcttagagtgtttcacggaatgagagctaagaacaccattacctggaattctctgctcattgggatttctaaagatccaagcagaatgatggaagcacaccaactgttcgacgaaatccctgaaccagatactttctcttataacattatgttgtcttgctacgttcgtaatgttaacttcgagaaggcacagagcttcttcgatcggatgccattcaaggatgcggcgtcatggaacacgatgatcacagggtatgcacgaagaggtgaaatggagaaagcgcgggaattgttctactccatgatggagaagaatgaagtttcttggaatgccatgatctctggatacattgaatgcggagatttggaaaaggcatcacatttcttcaaagtggctccagttagaggcgtcgtggcttggacggcgatgatcacagggtacatgaaagccaagaaggttgaattagctgaggcaatgttcaaagacatgacagtgaataaaaatcttgtaacttggaatgctatgatctctggttatgttgaaaattctaggccagaagatggattgaagcttttcagagctatgcttgaggaaggaattaggcctaactcgtctggactaagcagcgcattgctcggatgcagtgaattatcggcgttacaattagggaggcaaatacatcagatagtgagtaaatctacattgtgtaatgatgtaacagcattgacgtctctgatcagtatgtactgcaaatgtggagaacttggtgatgcttggaagctctttgaggtgatgaagaagaaagatgttgtggcgtggaacgcaatgatttccgggtatgctcagcacggtaatgcggataaggctctgtgtttgttccgtgagatgatagataacaagatcagaccggattggataacgtttgttgcggttttactggcctgtaaccatgctggactagtgaatattgggatggcatatttcgaatcgatggtgagagattataaggtagaaccgcagcctgatcattacacgtgtatggttgatcttttgggtcgggctgggaagctggaggaggcattgaaactgataagatcaatgccgtttagacctcatgctgcggtctttgggacgctcttaggggcttgtagagtgcacaagaatgtggaattggctgaatttgcagctgagaaactgcttcagctaaactcgcaaaatgcagccgggtatgtgcagcttgcgaatatctacgcatcgaagaatcgttgggaagacgttgcaagggttcgcaagagaatgaaagagagcaatgttgtgaaggtagagcgagtcaaagttcgattctttattcgagttacaagactctaatgtatttacttgactgtttcaggtacctggatacagttggatcgaaatacgaaacaaagttcaccatttcagatcaagtgatcggattcaccctgaactagactcaatacacaagaaactgaaggagttggagaagaagatgaaactagctggatacaaaccggaactagagtttgctttacacaatgtagaggaagagcaaaaagagaagctattgttatggcacagcgagaagttagctgttgcatttggttgcataaaactccctcaaggttcacagatacaagtgttcaagaacttgagaatctgtggtgattgtcataaagcaatcaaatttatctcggagatagagaaacgagagatcattgtaagagacaccacaaggtttcaccatttcaaagatgggtcttgctcttgtggcgattactggtgaaaagagaagagctttgactctctcattggtcaaacctgactgtatttatatgcgttattg

SEQ ID NO: 719 - DNA, 630 bp, Zea mays
ttcttgtttgttgattaacccttaattaatccgggcgcgcctgatttatcacaagtttgtacaaaaaagcaggctcctgcaggaccatggcgaacgcgggcatgaagccggtggccggcctcctgctggtgctcaacttgtgcatgtacgtcatcgtggcggcggtgggcggctgggccatcaaccacgccatcaactacggcttcttcatcggcaccggcctgcacctcccggctcacttctccccgatcaacttccccatcgggaacgcggcgaccgggttcttcgtcatcttcgccgtgatcgccggggtggtcggcgcgggctcggcgctggcggggctcaaccacgtccgcgcctggagcaccgagagcctgccggcggcggcctccgccgggttcattgcgtggacgctcaccctgctcgccatggggttggcggtgaaggagattgaactgcacggcaggaatgccagactgatatgcatggagtccttcaccatcatcctgtcggcgacgcagctcttctacctgctcgccattcacggaggcttgagataactcgagacccagctttcttgtacaaagtggtgataaattggagctctgcagagctttcgttcgtatcatc

SEQ ID NO: 720 - DNA, 827 bp, Zea mays
ttcttgtttgttgattaacccttaattaatccgggcgcgcctgatttatcacaagtttgtacaaaaaagcaggctctgcaggaccatggacggtgtcgttgtcaggagggtcatcccttcggataacagttgcctcttcaacgctgtgggctacgtgatggagcacaaccgaaataaggcttctgagctcagacaggtcatagcagcaacagtcgctggtgatcctgagaaattcaatgaagtgtttcttggcaaaccaaatgaagcgtattgtgcttggattttggatcctgaaaagtggggaggagccattgagctctctattctatccgaatactacgggcgtgaaatcgcagcatatgacattcagaccactcgctgtgatctctatggtcaggagaagaattacagtgaaagggccatgctcatttatgatggtttgcattatgatgctctcgctatgtctccggctgaaggtgcacctgaagaatttgaccagacaatcttccccgtcaatcatgaccgttccattggtccagcagaaggccttgccctcaacttagtgagggaggcgcaaaggaagaggagctacactgacacggcaaacttcactctgcgctgcggggtgtgccagatcggcgtcatcggtcaacaggaggctgtggaacatgcgcaagccactggccacgtcaacttccaagaatacaaatgacagtacaagatcagactgttgtgctgtaaacttgaccatcatttgctcgagacccagctttcttgtacaaagtggtgataaattggagctctgcagagctttcgttcgtatcatc

SEQ ID NO: 721 - DNA, 522 bp, Zea mays
ttcttgtttgttgattaacccttaattaatccgggcgcgcctgatttatcacaagtttgtacaaaaaagcaggctcctgcaggaccatggcgagcacggggcggtcgatgctgctgtcactgctcctcttcgcagtgacgctgtcgctgctggagatgtacagggccaagttcgcctcgtcggagctcatgaccattgccggtggattcgtctgctccctcctattcctgctactcctcacctttattggaaactatcaagaagctagtggagatagaactgggtggggtgcagttgttgtagcacaacttgtagctcttattgtagccggcactgtccaccgtgtctgtatcacaacatgcttcctgttttccgctggactcctttacgaggttgacaagctctctggcatgatccttgcgaggagtgagtctaaggtgaggcggcactaactcgagacccagctttcttgtacaaagtggtgataaattggagctctgcagagctttcgttcgtatcatc

SEQ ID NO: 722 - DNA, 523 bp, Zea mays
ttcttgtttgttgattaacccttaattaatccgggcgcgcctgatttatcacaagtttgtacaaaaaagcaggctcctgcaggaccatgtcaggagtgatcacaaagttcgcggttacatccatggtgatgtggatggcccctgttgcgatcatgtatgggttttactaccaggtgtttccaggtgtgagtcagatgtcatcctcggcgcagacacttgccagtgggttcctggctgtcatatcagttaatctagtgatcggcttttacatattcatggcgatgaaggagactccacaccaagagccacagccagatcccaccttcctggagaaagccaaagcgagtatcaaccagccaacatcctctcgagtgagtgatgattccaaggggaagggaaaggtcgagtaagctgtagcatgttggcttaggtctcgtgtatgttaagtgcatgctcgagacccagctttcttgtacaaagtggtgataaattggagctctgcagagctttcgttcgtatcatc

SEQ ID NO: 723 - DNA, 561 bp, Zea mays
ttcttgtttgttgattaacccttaattaatccgggcgcgcctgatttatcacaagtttgtacaaaaaagcaggctcctgcaggaccatgggtaaaacatgggcgctcatcacccacctccacgctctcgcagggccgagtctcactctgatataccctctgtacgcgtcgatctgcgcgatggagagcgcgaccagggtggacgacgagcagtggctggcctactggataatctactccttcatcaccctcttcgaaatggcggccgagcatgtcctctactggataccgctgcggtacgaggcgaagctgctgctggcggcgtggctggtcctgccgcacttcaggggcgcgtccttcatctacgacaggttcgtcagggagcagctgaggaagaacggggtgaggctgcacggtcaccaccacggccacgccgccgaccacgtgccgcacgtcttccaggctgagcatcgtcatggcgtgcacagctgactcgagacccagctttcttgtacaaagtggtgataaattggagctctgcagagctttcgttcgtatcatc

SEQ ID NO: 724 - DNA, 802 bp, Zea mays
tgtttgttgattaacccttaattaatccgggcgcgcctgatttatcacaagtttgtacaaaaaagcaggctcctgcaggaccatggaaaatgatagaaggcaacttggtcagatcgatccaagaagagcccgctttccttgctgcgtagtatggactccaataccattcatcacttggttggtgccctttatcggtcacattggcatctgcagagaagacggtgtaattctggacttctctggtccacattttgtatcagttgacaattttgcattcggagctgttgcgcgctacattcaagtaaactgcgatgagtgctataagcttattgaacctgaaggagatgccacgtgggacggcgcgctgaagaaaggcacgcaggagttccaaaacaggaactacaacctgttcacctgcaactgccactcctttgtcgcaaacaatctgaacaggctgttttattccggccacgacgaatggaatgtggtcagcttggctgctgtgatgttcttacgaggccgctgggtgagcacggcatcggtggtgaagaccttattgccatttgcagttgtgctttccatcggtaccttccttggcggcacgaccttcctgaccggccttcttgctttcgccgctgcgatgactgtctggttccttgtgggcacctactgcatcaaaggtctcatagagttgtgattagagtatgttagactcgttgtagggggttcaagggtggcatatttttactcgagacccagctttcttgtacaaagtggtgataaattggagctctgcagagct

SEQ ID NO: 725 - DNA, 969 bp, Zea mays
ttcttgtttgttgattaacccttaattaatccgggcgcgcctgatttatcacaagtttgtacaaaaaagcaggctcctgcaggaccatgtgcatcgcggcatgggcgtggcactgccacccgacgcaccgcctgcttctgctgttcaatcgcgacgagtatcactccaggccgacgcagccggcgcagtggtgggcggcgggggaggaagccaaggaaatccttggaggcagggacgagctcggcgggggaacgtggatggggtgcacgagggatggtaagctcgccttcctgaccaacgtgcgggaacccagctctctgatcggggccaagaccagaggacagctcccggtcaggtttctacagggcagcctttgtccattggagtatgccacagaaattgcaaaggaagcagatcagtacaacggctttaaccttatattggctgatgtgaactcaggaaccatggtttacatctctaatagacccggaggcgatcctgtgattcaaacagttgctcctgggcttcatgtgctttcgaatgctgcaattaattccccttggccaaaggcaatgcgcttaggacagagtttcaaaaggtatttgacaatacacgatgatgcagaagcctctttaaaacaaatggtagaagagttgatgatggatactgccagacctgatagatctatggtgcctgacaccggcgacgaccctgagtgggagtacaagctaagctcaatattcattgacactgcaaaggaacaggcacgatatggaacacgaagcatggtggcactagcagcgaaattggaaggtgaggtaacattctatgaaaggtacttggagaacagtttgtggaaggagaatctcatacagttccagatggagaaggcacaatagctcgagacccagctttcttgtacaaagtggtgataaattggagctctgcagagctttcgttcgtatcatc

SEQ ID NO: 726 - DNA, 1494 bp, Zea mays
ttcttgtttgttgattaacccttaattaatccgggcgcgcctgatttatcacaagtttgtacaaaaaagcaggctcctgcaggaccatgcgacggcgagaccgacaccaccatcaccggcggcagccgcgggacgagcgctgcgtttcctgcaccacgtttaacatcctggcgccgatctacaagcgcatggacaacgagaattgcagggagagccagtacagggcctactggttcagccgcaacgagaagattattgaccgccttctcgctgatcactcctccatcatctgccttcaggaggtatggttggggaacgacgagctggtcgacatgtaccagaagcgtctgggagacgccaattacatgctcttcaagcttgcacgcaccaacaatcgtggagacggtcttcttactgctgtacatagaaactacttcaacgttttgaattatagggaactgctgttcaatgacatcggtgatcgggtagctcagctgttgcatgtggaatcagcgatgccattcttacaaaatcgaagcaccagctgtgtccaccagcagagcctcattgtcaacactcatttgttgttccctcatgatcacagcctttcaatagttcgcttaagacaggtatataagatccttcagtatattgaggcttacctagaagagcataaacttggtccactgccaatcatcctttgtggggattggaatggaagtaaacgtggccaagtttacaagttccttcgctcgcaagggtttgtttcatcatatgacactgctcatcaatacagtgacagcgaagaagatgcacataagtgggtcagtcaccgaaaccatcgagggaacatctgcggagttgatttcatatggcttttaaatcctgataagtgcaggaagcccctgaagaccagctggaatgaagctgtttttggtatcattaagtacttcctccaagttgcattcctttccgaggagaatgcatttgcactcctgaaggcagacagcctttatgatcacatcacatattcaagtttctaccgggcattgtgtcagttaggaatggtccatcctgatagactaaaatcagaagaaattgaggagttgtggagtgaagctgaccgtgatggcgatggtgttattaactacaaagaatttcagtgcatctggagcccaaactgctgtagtcaagaggaggatactgaaattgacatcactgatgaaagtctggacacttttgaggcaaacaacgaagccttcggcttcaccgtgaaggaagctgttctctttcccccagaagtagagaagggcatgtggccagaaaactacagcctctcagatcatgctcccctcactgtggtattctctcctattagaatgccttgctctccacgcaatcgtgggggagctctagctatctaactcgagacccagctttcttgtacaaagtggtgataaattggagctctgcagagctttcgttcgtatcatc

SEQ ID NO: 727 - DNA, 2088 bp, Zea mays
ttcttgtttgttgattaacccttaattaatccgggcgcgcctgatttatcacaagtttgtacaaaaaagcaggctcctgcaggaccatggctgcactgcaaccctcattttcaccagcaatgactttgaagagtagctgcagcgccctgaagttcccaaaaactgcactgttatctggttttggtggcattccacgccttcaagatgcgcaagacaggaacactagcgtcgcttatttgatccccaaggctgcttcagtgactgaccagtcaatagcagagccaccaaaaaccaagcaaaataggcacacagtcgacccaacagctccagaatttctgccactcccatcttttgaagaatgctttccaaggagtaccaaagaatcaagtgaaatcatccacgaggaatcaggtcatgtcctcaaggttccattccggagagtccatttgactggagatcagaagcactttgatacatatgacaccagcggtcctcaaaatataagcccaaggattggactcccaaagataaggaaggaatggattgataggagggaaaagctgggtagtcctcggtacacacaaatgtattatgctaaacagggaattgtaacagaggagatgttatactgtgccagccgtgagaaccttagtcctgaatttgttcggacagaagttgcccgtggacgagccataattccttccaacaagaggcacctggaattggaacccatgattgttggaagaaacttccttgtaaaggtgaatgcaaatattgggaattcagctgttgtgagctccattgaggaggaagttcacaagctccagtgggccacgatgtggggagctgatactgtcatggacctttcaacagggcgacatatccatgagacgcgggaatggattattcgcaactctccggttcctattgggactgttcctatttaccaagcacttgagaaagtaaatggtattgctgaaaatctgagctgggaaatttttagggataccttgattgaacaagctgagcagggcgttgattacttcacaatccatgctggtgtcctgcttcgttacattcctcttacagcaaagagaatgacgggcatagtttcacgtggtggctcaatccatgcaaaatggtgcttaacttatcacaaggagaactttgcatatgaacattgggatgacattcttgacatatgcaatcagtatgatgtggcattatcaattggtgatggtttgaggcctggttccatttatgatgcaaatgatagtgcacagtttgcagaactgctgactcaaggtgaactaacacgtcgagcatgggcgaaagatgtgcaggtaatgaatgaaggcccgggtcacatcccaatgcataaaattcctgaaaacatggagaaacagttggagtggtgtaatgaagcgcctttctatacattgggtcctttgacaactgatattgcacctggttatgatcacatcacttcagccattggtgctgccaacattggagctcttggcactgcacttctttgctatgtaacaccaaaggagcaccttgggttgcccaatcgtgatgatgtcaagactggtgtaatatcctacaaaatttctgctcatgctgctgatttggcgaagggtcatccctatgcacaagcttgggatgatgcacttagcaaggcaaggtttgagtttagatggcttgaccaatttgctttatctctggatccagtaactgctatggctttccatgatgaaacattgccctctgagggtgccaaagtggcacatttctgctcaatgtgtgggcccaagttttgttcaatgaaaatcacggaggatatcaggaagtatgctgatgaaaatagttatggaacagtagaggaagctgtgatacaaggaatgaatgctatgagtgctgaatttttggctgcaaggaaaacaattagtggggaacaacatggtgaagcaggaggggagatctatgtaccagaaagctatgcagctcagaaataactcgagacccagctttcttgtacaaagtggtgataaattggagctctgcagagctttcgttcgtatcatc

SEQ ID NO: 728 - DNA, 1017 bp, Zea mays
ttcttgtttgttgattaacccttaattaatccgggcgcgcctgatttatcacaagtttgtacaaaaaagcaggctcctgcaggaccatgtcgtcggggcggtacatggcgtactcgccctcgccgtcgaccaccccgcactccccccgcatccacggcctccgcaccccctctgccgccgtcgccgagcaggagaagtacctttccgaactgctcgcggagaggcacaagcttaccccgttcatcccagtgatcccacatagtgtacggttgctgaatcaagaaatttttcgtgtttccacactattggagaacgcgtctcttttaaatcaaagtggccttgaacatggtagtccactaacaacgggaggattatattcaaacggagcagctactgacatgaatgggtggccatcagcatttcaatcagaaagttctccagcttatagctggcttggaggatctcaaggcagctcctctggactcattgtcaagaaaacaatgaaggtcgatatcccagtagacaaatatccaacatacaattttgttggccgcatccttggtccaagaggaaattccttgaagcgggtggaggcaaatacggattgccgcgtgctaataagaggtcgtggcagcatcaaagatccagcacgggaggaaatgatgcgagggaagccaggatatgagcatctgaatgaacctctccatatattggttgaggcagagctacctgttgacatcattgatgctcggctgatgcaagcccgcgagatccttcaagatctgctaaagcctgtggatgaatcccaggacttcttcaagaagcagcagctccgggagctcgcgatgcttaatggcaccctgcgtgaggaagggatgcagaggttcggttcagcgtcccctttccacaacggccttggaatgaagagagccaagacaagggggtgactcgagacccagctttcttgtacaaagtggtgataaattggagctctgcagagctttcgttcgtatcatc

SEQ ID NO: 729 - DNA, 1338 bp, Zea mays
ttcttgtttgttgattaacccttaattaatccgggcgcgcctgatttatcacaagtttgtacaaaaaagcaggctcctgcaggaccatggggagttcggtcggctgcttgggaggcggctccaagtcgaggcaagatcagaatggtcaggtcgtcgcgggttcgtctccccgttcaggtcatgaattatcaagacctggaaataatgtacatgtattctccctaaacgagttgaagactgccacacgaaactttcacatgttgaattgcattggccgtggggggttcggagcagtgtataagggaaacctgaaaaatggcactccaattgcaattaaaaaacttgcagctgagtcaaaacaaggaattagtgaattcttgacagagattaatgtcatatcaaatgttaggcacccaaaccttatcaagctgattggttgctgtgttgaagggagtaacagactattggtgtacgaatatgcagagaataatagtttggcgaatgctttgcttggaccaaagaacaaatgtatcccattggactggcagaaaagagttgctatatgtattggaactgcttctggccttgcttttcttcatgaggaagcacaaccacggattgtccaccgtgatatcaaggctagcaacattttacttgataagaagctgctgccgaaaattggagattttggattggcgaaactctttcctgatactgtcactcacattagcacgcgtgttgcaggaacaatgggttatttggcaccagagtatgccttgttgggacaattgaccaagaaagcagacatatatagttttggggtgcttcttcttgaaatgataagtggtgaaagcagcagcaagtcgacttggggacctaatatgcatgttctcgtggaatggacatggaagctgcgggaagaaggaaggctcttggaaattgttgatccagaactggaaaagtacccagaggagcaaatgcttcgtttcattaaagtggcactgctgtgtacgcaagccacgtcccagcagaggccgtccatgaagcaggtcgttaatatgctatctaaccaaacagaaattgatctgcaaaatgtagctccaccaggtgtgctgaaagaacctcggcagcgtaccggtggctttgggggtttgatagcagacacgtcctcaagccaaagcactaaaggcaacccagctgaatcatacagcacacagaccaacatgaacagctctcagtttagcacaactgatgtatcaccacggtgactcgagacccagctttcttgtacaaagtggtgataaattggagctctgcagagctttcgttcgtatcatc

SEQ ID NO: 730 - DNA, 1728 bp, Zea mays
ttcttgtttgttgattaacccttaattaatccgggcgcgcctgatttatcacaagtttgtacaaaaaagcaggctcctgcaggaccatggcatcgccaccgccggccctcgagatcctagttcgcgagcccgacggagtcacggtgtggtccggacccccctacccgccgggcaccaccagcccgccgcagagactccccaagacggcgtgcagcgccacctctttctccaccgacggtgcccgcctgctcgcgacggtggcatcggcctcggccaccgtctacgactgccgcacactcgctgtagtcaagtgcttcgagctcccgggtctcctcgccgctgcgctatcgcccacgggggcgtatctgcagaccttccagaagtcatcctcgccgcaggagaagaatgtcacggtctggcacgtcgacacagctgccgctctttaccaacactatcagaagagcatgtctaaaaccacctggccaatggttcagttttctgcggatgaatcggtcgcttgccggatgatgcctaatgagatacaattctttgatccaaaagattttgcaaaaggaattttgtataggataagaatgcctggcatagctacgatgaagctagcaactgcaccaggatctcatgttgctggattcgtcccagaggctaagggtgttccagctagcgttcagatattttcttgcaacaaggatgcacaaaatcaagttgttgctcgcaggagcttttttcgctgttccaccgttcaattacagtggaacaaagggtccactggccttctaattcttgctcaagctgacgtggataaaaccaatcagagttactatggtgaaaccaagttgaactacttgacaactgacagggccttcgaaggaattgttccactcaaaaaggacgggccagtccacgatgtgcagtggtcttcctctggctctgaatttgctgtggtttatggtgttatgccgcccaaggcaacaatattcaacaagaagtgcaaccctcttgttgagtttggtgaaggaccctacaatacgataagatggaaccccaaaggacgatttgttgtattagcaggttttggcaatttgcctggtgatatggcattctgggattattcagaaaaaaaattggtagcgaaaacaaaggcagaatgttctgtcacaagtgaatggtcccctgatggtcgtcattttatgactgctacaacagctccgaggcttcaaatagacaattgtataaaaatatttgaccacaacggatctctgcagtttaagaagatgtttgaaaggctgtatcaggctgattggaaacctgaagcagctgaaagattcactgacattgctgacctgacaacatccttgagtaccttaaagattgaagaaacaaaaaaacaagtttcagcacaaggttccaagtcagcacaaacatcaagcaaggcccctgcaattacagcgccaaaacctacagcataccgcccacctcatgctaagggttctgcagaacttcaggacaagctctttggtggactagctcctgctgggggggagatgagcaaaaatgcattgcgaaacaagaagcgcagagagaaacagaaggaaaagaaagctgctgaagcgtcaggctctcctgctgatgaaagttgactcgagacccagctttcttgtacaaagtggtgataaattggagctctgcagagctttcgttcgtatcatc

SEQ ID NO: 731 - DNA, 1443 bp, Zea mays
ttcttgtttgttgattaacccttaattaatccgggcgcgcctgatttatcacaagtttgtacaaaaaagcaggctcctgcaggaccatgtcgtcgtcggcgcccgcaccggccgccatggccgtggacgacgcggaggacgaccagctcgcctccatgtccacggaggagatcaccagggcctcccgtctcctcgacaacgagatccgcgtccacaaggacgagctgcagcggtcgaacctggagctggagtctatcaaggagaagaccaaggagaaccaggagaagattaagctcaacaagcagctgccgtacctcgtcggcaacatcgtcgagattttggaaatgaaccctgaggatgaggctgaagaagatggtgctaacatcgatctggactcacaaaggaaaggaaaatgtgttgttctgaagacatccaccagacaaaccatattccttcctgtaattgggttagttgaccccgataagctaaagcctggcgatttagttggagttaacaaagacagctacttgatactagatacattgccttcagagtatgactcacgggttaaggcaatggaagtagatgagaaacctactgaggattacaatgacattggcggacttgagaaacagattcaagagcttgtggaagcaatagtgttaccaatgacacacaaggaccgatttcaaaaattgggcattcgtccccccaaaggggttcttttgtatggaccccctgggactgggaaaacgctcatggctcgtgcatgcgctgcacagacaaatgcaacatttctgaaattggctggtccacaacttgtccagatgttcattggtgatggagctaagcttgttagagatgcttttcagcttgctaaggagaaagccccgtgcatcatctttattgatgaaattgatgccattggaacaaagcgttttgacagtgaagttagtggtgatagagaagtgcaaaggacaatgttggaattgctgaaccagcttgatggatttagcagcgatgagaggataaaggtgatagctgcaacaaatcgtgctgatattcttgatcctgctctgatgagatctggtcgtctggaccggaagattgagttccctcatccatcagaggaagcaagagctagaatcctgcagatccactcgaggaaaatgaatgtgaatccagatgtcaactttgaagagttggcgcgttcaaccgatgatttcaatggcgctcagctaaaggctgtttgcgtagaggctggcatgctcgctctacgccgagatgctacagaggttacccacgaggatttcaacgaggggatcatccaagtgcaggcaaagaagaagtccagcttgaattactacgcgtaactcgagacccagctttcttgtacaaagtggtgataaattggagctctgcagagctttcgttcgtatcatc

SEQ ID NO: 732 - DNA, 1734 bp, Escherichia coli K12
ttcttgtttgttgattaacccttaattaatccgggcgcgcctgatttatcacaagtttgtacaaaaaagcaggctcctgcaggaccatgacggaaaacattcataagcatcgcatcctcattctggacttcggttctcagtacactcaactggttgcgcgccgcgtgcgtgagctgggtgtttactgcgaactgtgggcgtgggatgtgacagaagcacaaattcgtgacttcaatccaagcggcattattctttccggcggcccggaaagtactactgaagaaaacagtccgcgtgcgccgcagtatgtctttgaagcaggcgtaccggtattcggcgtttgctatggcatgcagaccatggcaatgcagttgggcggtcacgttgaagcctctaacgaacgtgaatttggctacgcgcaggttgaagtcgtaaacgacagcgcactggttcgcggtatcgaagatgcgctgaccgcagacggtaaaccgctgctcgatgtctggatgagccacggcgataaagttaccgctattccgtccgacttcatcaccgtagccagcaccgaaagctgcccgtttgccattatggctaacgaagaaaaacgcttctatggcgtacagttccacccggaagtgactcatacccgccagggtatgcgcatgctggagcgttttgtgcgtgatatctgccagtgtgaagccctgtggacgccagcgaaaattatcgacgatgctgtagctcgcatccgcgagcaggtaggcgacgataaagtcatcctcggcctctctggtggtgtggattcctccgtaaccgcaatgctgctgcaccgcgctatcggtaaaaacctgacttgcgtattcgtcgacaacggcctgctgcgcctcaacgaagcagagcaggttctggatatgtttggcgatcactttggtcttaacattgttcacgtaccggcagaagatcgcttcctgtcagcgctggctggcgaaaacgatccggaagcaaaacgtaaaatcatcggtcgcgttttcgttgaagtattcgatgaagaagcgctgaaactggaagacgtgaagtggctggcgcagggcaccatctaccctgacgttatcgaatctgcggcgtctgcaaccggtaaagcacacgtcatcaaatctcaccacaacgtgggcggcctgccgaaagagatgaagatgggcctggttgaaccgctgaaagagctgttcaaagacgaagtgcgtaagattggtctggagctgggcctgccgtacgacatgctgtaccgtcacccgttcccgggaccaggccttggcgttcgtgttctgggtgaagtgaagaaagagtactgtgacctgctgcgccgtgctgacgccatcttcattgaagaactgcgtaaagcggacctgtacgacaaagtcagccaggcgttcactgtgttcctgccggtacgttccgttggcgtaatgggcgatggtcgtaagtatgactgggttgtctctctgcgtgctgtcgaaaccatcgactttatgaccgcacactgggcgcatctgccgtacgatttcctcggtcgcgtttccaaccgcattatcaatgaagtgaacggtatttcccgcgtggtgtatgacatcagcggcaagccgccagctaccattgagtgggaatgactcgagacccagctttcttgtacaaagtggtgataaattggagctctgcagagctttcgttcgtatcatc

SEQ ID NO: 733 - DNA, 1740 bp, Nostoc sp. PCC 7120
ttcttgtttgttgattaacccttaattaatccgggcgcgcctgatttatcacaagtttgtacaaaaaagcaggctcctgcaggaccatgaatacagcggtgactctactaaccgaacaagcccctcaaccaatagaagagtttgggcagcttgagcgtcaaatcattatcatattagacttcggctctcagtattcagaactgattgcccgacgcatccgcgagactcaagtatactctgaagttttgtcttatcgcacccctgctgaacatttacgccaactcaatcccaagggaattattctttctggtggccccagttcagtttatagcgatcgcgctccccattgtgacccagaaatctggaatttgggagtccccattttgggtgtctgctacggaatgcagctgatggtcaaccaactcggtggcgaagtagccaaagctgaccggggtgagtatgggaaagcatcattacacattgatgatcccaccgatttactgaccaacgttgaagatggcacaacaatgtggatgagtcatggtgattcagtcacaaaaatgcccccagggtttgaagtgttggcacatacagataatactccctgtgctgctgttgctgaccacgagaaaaagctttatggcgtgcagttccatccagaagtagtccattccgttggtggtttggcattaattcgcaactttgtttatcacatttgtgagtgtgaacccacctggacgacggctgcttttgtggaagaagctattcgggaagtccgggctaaagttggtgacaagcgagtactattggcgctttcgggaggagtcgattcttctaccctggctttcttgatgcacaaagccatcggcgaccaattgacttgtgtatttatcgaccaaggctttatgcggaagtatgagccagaaaggttggtgaaactatttcaggagcagtttcatatccctgttgaatatgttaacgcccgcgatcgcttcttagatatcatgtcaggtgtgacagacccagaagaaaaacgtcgtcgcattggacatgaattcatccaggtatttgaagaaacatctaaaaatctgggcccctttgactatctagcacaagggactctttacccagatgtcattgaatcggctgataccaatgttgacccccaaactggggaacgggtagcggtaaaaatcaaaagccatcacaacgttggcggcttacccaaagacttgagatttaaactagttgaacccctgcggaaactgtttaaagatgaagtccgtaaagtagggcggtctgttggtttaccagaagagattgttcaacgccagccatttcctggccctggtttagctattcggattttgggtgaagtcaccgccgacagattgaacattctccgcgatgctgatttgattgtgcgccaagaaattaaccaacgcggtttatacaatgaatattggcaagcattcgcagttttactacctatccgcagtgtgggcgtaatgggtgatcaacgcacctatgcttatcctatcgtcttacgcattgtcaagagcgaagatggcatgacagcagattgggcgcgtgtaccttacgatgttttagaagcaatttctaaccgcattgtcaacgaagttaaaggcgttaaccgcgtggtgtttgatattacttccaagccacccggaaccattgagtgggaataactcgagacccagctttcttgtacaaagtggt

SEQ ID NO: 734 - DNA, 995 bp, Zea mays
ttcttgtttgttgattaacccttaattaatccgggcgcgcctgatttatcacaagtttgtacaaaaaagcaggtcctgcaggaccatggacctgcagctgcatgtcttctacagggcgctcgggctctcgttcgtcggcggcctcagcaccgccatcggtgcactgtttgtcgttttgaatcctgcccctaaccttaaagtgctcgggcttctacagggttttgctgctggacttatgctcagcatctcctttctagacctggcacacaatgccctgaattctattggcttcttgaaggggaacctctggttttttgcaggggttcttttcttcggtttcattattaagtttatcccagagccagatttttcgccaccagctgatccaagcgagaaagaggctgatgatggtgtatcaggtaaagatatgatgagaaaacatcgccggcaagtgctattcagtggtattatcactgctgttggaattagcttgcataatcttccagagggaatggctgtatttcttggatctgtcaagggtcttcatgtgggcctgaacttggctgttgctattgccttacataacataccagagggggttgctgtagctcttccaatctattttgctaccaaaagcaaaaaaaaggcattttatacggcagcattctctggtttggctgaaccactaggagtggttgctgtagctttgttgtttccaagcagtttgaatcctgacattcttgaaggcctacttggatctgtgggtggtgtcatggctttcctcactttgcatgaaatgctgcctcttgcatttgactattgtggccagaagcaagctgtcaaagctgtctttgtgggcatggcctgcatgtctgcaagcttgtacttcttggaagtcagcttaccaaaggagataagcttgtagctcgagacccagctttcttgtacaaagtggtgataaattggagctctgcagagctttcgttcgtatcatc

SEQ ID NO: 735 - DNA, 1959 bp, Escherichia coli K12
ttcttgtttgttgattaacccttaattaatccgggcgcgcctgatttatcacaagtttgtacaaaaaagcaggctcctgcaggaccatggtgaacaatatgaccgacttaaccgcgcaagaacccgcctggcagacccgcgatcatcttgatgatccggtgattggcgaactgcgcaaccgttttgggccggatgcctttactgttcaggcgactcgcaccggggttcccgttgtgtggatcaagcgtgaacaattactggaagttggcgatttcttaaagaaactgccgaaaccttacgtcatgctgtttgacttacacggcatggacgaacgtctgcgcacacaccgcgaagggttacctgccgcggatttttccgttttctaccatctgatttctatcgatcgtaaccgcgacatcatgctgaaggtggcgctggcagaaaacgacctgcacgtaccgaccttcaccaaactgttcccgaacgctaactggtatgagcgtgaaacctgggatctgtttggcattactttcgacggtcacccgaacctgcgacgcatcatgatgccgcaaacctggaaaggtcacccgctgcgtaaagattatccggcgcgcgctaccgaattctcgccgtttgagctgaccaaagccaaacaggatctggagatggaagccctgaccttcaaaccggaagagtgggggatgaagcgcggcaccgaaaacgaggacttcatgttcctcaacctcggtccgaaccacccgtcggcgcacggggctttccgtatcgttttgcaactcgatggcgaagagattgtcgactgcgtaccagacatcggttaccaccaccgtggtgcggagaaaatgggcgaacgccagtcctggcacagctacattccgtatactgaccgtatcgaatacctcggcggctgcgttaacgaaatgccttacgtgctggcggtagagaaactggccgggatcaccgtgccggatcgcgttaacgtcattcgcgttatgctctccgaactgttccgcatcaacagtcacctgctgtatatctcgacctttattcaggacgtcggcgcaatgacgccagtgttcttcgcctttaccgatcgtcagaaaatttacgatctggtggaagcaatcactggtttccgtatgcacccggcgtggttccgtattggcggcgtagcgcacgacctgccgcgcggctgggatcgcctgctgcgtgagttcctcgactggatgccgaaacgtctggcgtcttacgagaaagcggcgctgcaaaacaccattctgaaaggtcgttcccagggcgttgccgcctatggcgcgaaagaggcgctggagtggggcaccactggcgcgggcctgcgtgctaccgggatcgacttcgacgtgcgtaaggcgcgtccttattctggctatgaaaacttcgactttgaaatcccggtgggtggtggcgtttctgactgctacacccgcgtaatgcttaaagtggaagagctgcgccagagtctgcgcattcttgagcagtgcctcaacaacatgccggaaggcccgttcaaagcggatcacccgctgaccacgccgccgccgaaagagcgcacgctgcaacatatcgaaaccctgatcacccacttcctgcaagtgtcgtggggtccggtgatgcctgccaatgaatctttccagatgattgaggcgaccaaagggatcaacagttactacctgaccagcgacggcagcaccatgagttaccgcacccgtgttcgtaccccgagctttgcgcatttgcagcaaattccggcggcgatccgcggcagcctggtgtctgacctgattgtttatctgggcagtatcgattttgttatgtcagatgtggaccgctaactcgagacccagctttcttgtacaaagtggtgataaattggagctctgcagagctttcgttcgtatcatc

SEQ ID NO: 736 - DNA, 849 bp, Synechocystis sp.
ttcttgtttgttgattaacccttaattaatccgggcgcgcctgatttatcacaagtttgtacaaaaaagcaggctcctgcaggaccatgtcaagccgttctgcggggcggaattcccccatccttcctttgatgagccactctgatttgcctttggctaacgctgtccccctcgataaaattcgctacaacgaccagggattagtgccggcgatcgcccaagactatttggacggcacggtgttgatgttggcctggatgaacgaagcagccctggcgaaaaccctagccacgggacaggtgtggtattggagtcgttcccgccaagaactatggcataagggagcaacctccggccactttcaaaaacttttgggcatccgctacgactgcgacagcgacgcattattactgaccattgagcaaaagggggacattgcctgccacaccggggaacggagttgtttccatcaactggacggccataaatcccctcccccagcggatatgttgacggaattggctcgggtcattggtgatcgccgggatcaccccacccccgaatcctacacctgtaaattattggcggggggagataataaaattctcaaaaaaattggcgaagaaagtgcggaagtggtcatggcttgcaaagatgatgacccggaagccatcgccggagaggtagcggatttgttctaccacaccctggtggccctagcccatcacaacgttgatctacgggccgtttatcgcaagcttggcgatcgtcgccgttaactcgagacccagctttcttgtacaaagtggtgataaattggagctctgcagagctttcgttcgtatcatc

SEQ ID NO: 737 - DNA, 1573 bp, Zea mays
ttcttgtttgttgattaacccttaattaatccgggcgcgcctgatttatcacaagtttgtacaaaaaagcaggctcctgcaggaccatggatagattcaagttgattaaggaagttggcgatgggactttcgggagtgtatggcgtgctataaataaacagaatggtgaagttgttgctgttaagaaaatgaagaaaaagtattattcttttgaggaatgtatgggtttgcgtgaagtaaagtctttgcggcgcatgaatcatcctaacattgtgaagctcaaagaggttatccgagaaaatgatatattatacttcataatggaatacatggagtgtaatctctaccaacttatgaaggataaggtcaagcctttctcggagtctgaagtacgcaactggtgctttcagatatttcaggctcttgcttacatgcatcagaggggctactttcatcgtgacctcaaacctgagaatctgttagttagcaaagatgtcataaagctagcagactttggtcttgcaagggaagtttcatcattgccgccatatacagaatatgtctcaactcgctggtatcgggcaccagaagtattgctccagtcatctgcttatgattctgcagttgatatgtgggcaatgggtgccataatggctgagttgttgacactccatcctctctttcctggaaccagtgaagctgatgagattcacaagatatgcaatgtcatcggtagtccagatgagcaatcttggcctcaaggattgtcacttgcagaagcaatgaagtatcagttcccacagatcaaaggcagtcaactggccgaggtgatgacaacagccagtagcgatgcaattgatctcatctcatcactatgctcatgggatcctagcaagagaccaaaggccgcagaagtcctccagcataccttttttcagggttgtacatgtgttccacttcctgtccgtccaaaagcttcatcacttcctagaacacctccatgtgttggatcaaaaggaaattcagagaacagtgtggctagaagattctcaactggaactctatctacaatgaaatctcatagcaatgcatccgcaaaattaaatggtttatctaagactggtgtacaaagaaaacttaatttggatcgtcagccatcccaaaagggtatgaagccaaccgagactagcaataaactaactacgaatcgggtaccagctcggaatagcccagggaatcctgtacttaggcattcacggagcttgcctgaaactggccgaggagcaatacagaaggtctcatcaattacagagaaactatcccaaatgtctgtgacctctagaacacggagcgctgtgaagcctgctgcccccatgatgaaggccggacatggcaagtcggactttcttgggaagtctgacgatatccctccagcaaagaggctgacaagaaaattggtcagctaaatgagggtatgtggagtgaaaattcgatcagctgcagctcgagacccagctttcttgtacaaagtggtgataaattggagctctgcagagctttcgttcgtatcatc

SEQ ID NO: 738 - DNA, 724 bp, Zea mays
ttcttgtttgttgattaacccttaattaatccgggcgcgcctgatttatcacaagtttgtacaaaaaagcaggctcctgcaggaccatggccgtgcttaattattcaaaggctagtttcttgcctgttcaggtttaccactctagtttcgctgatgatgatgggatcacaaaagcttgcagctgtcctttgcttccactgaaaactcatatcaagggcccggcaccagcctctgaccctgataaagcggacattgttgatgaagccataactttctttcgagccaatgttttcttcaaaaatttccatgtgaaaagctcagcagacaagttattgatctatctgacgttttatatcaatattgccttaaaaagactagaaggttgtcggacactagctgttgggactaaagcaatcattaatctaggattggagaaagttcctgtacctggggaaccagggtttcctttccctggacttttcactcttccccagtcccaggaggaagcagaattgttgaggaattatttgaagcagataagggaggaaacaagtggaagattgctcaactgtgcatacagagctaatggctttccaaacaagtggtggttggcttttgctaagaggaagttcatgaacattgtcatcctttagctcgagacccagctttcttgtaacaaagtggtgataaattggagctctgcagagctttcgttcgtatcatc

SEQ ID NO: 739 - DNA, 402 bp, Zea mays
ttcttgtttgttgattaacccttaattaatccgggcgcgcctgatttatcacaagtttgtacaaaaaagcaggctcctgcaggaccatggctcccggagccggagacgactctgatcccgcctcttatatccacacggtgcagcacctgatagagaggtgcatgacgttcgggatgagcatggaggagtgcatggaggcgctggcgaagcgcgccgacgtccaacccgtggtcacctccacagtgtggaaggagctggagaaggagaacaaggagttcttcgacaagtacaggcagtggatctcggagaagagaagcgggagtacctcctagctcgagacccagctttcttgtacaaagtggtgataaattggagctctgcagagctttcgttcgtatcatc

SEQ ID NO: 740 - DNA, 837 bp, Zea mays
ttcttgtttgttgattaacccttaattaatccgggcgcgcctgatttatcacaagtttgtacaaaaaagcaggctcctgcaggaccatggcgacagagcaagcggcggagaactacacggtggaggacctcgtggccctgaacccctacaaccccgacatcctcaacgacctcgagaagttcgtcaatgagcaggtctcatctcagacatataacttggatgcaaatctcagccttcttcgcttgtaccagtttgagccagaaaggatgagcatacagattgtggcccacatactgattaaggctctcatggcaatgccagcccctgacttcagtttgtgcttattcttaatccctgaacatgtgcaaatggaggagcaattcaaggtattgatagttctttctcactacctagagactgctaggttcagtcaattttgggatgaagcagcaaagaaccgccacatatcggaagcagtgccaggtttcgaacaagcaatccaatcctatgcgattcatgtactttccttgacataccagaaagttccaaggcctattcttgtagaggcaatcaacatcgaaggtctcgcgttggacaagtttcttgagtaccatgccgcgaactcaggttgggtgattgagaagggtgggcagtctcaagtgattgttcttccgcgtaatgagttcaatcacccagagctcaagaagaacacagccgatatccttccgtttgaacacgtaacacgcatattccctgtccttggctgactcgagacccagctttcttgtacaaagtggtgataaattggagctctgcagagctttcgttcgtatcatc

SEQ ID NO: 741 - DNA, 1305 bp, Zea mays
ttcttgtttgttgattaacccttaattaatccgggcgcgcctgatttatcacaagtttgtacaaaaaagcaggctcctgcaggaccatggcgcatgctcaagaaattcagctccagatcagaggcattccggacgaggaatccgtcgacgcccgtgatggacccaaggtcgccacggggcggtccacgagaagcagcttccgatggtggatgacggtgctggtggacatgctgatggttctctgtgggacgactgtggccaccctcctcggccgcctgtacttcaactccggcggcaacagcaagtggatggccacgctgacgcagtctggcggctcgccgcttctggtcgtcccgctcctcctgtcgccggcgcgctcggcggaggagcgccggccggcggcgctcaagatggttgccatctacgcgggcatcggggtcatgatcggcttcgacaacctcatgtactcgtacgcgctgcagtacctgccggtgtccaccttctcgctcgtggccgcgacgcagctgggcttcaacgccatcacctcgcgcctcatcaacgcgcagcggttcacggcgctgatcgccaactccgtggtcgtgctcaccttctccgccgcgatcctcggcgtcggatcctcctccgacgagacctccagcaacgtgccgcgcggcaagtacccactggggttcgtactcgtgctggccgcctcggcggtgttcgcgctcattttgtccctcttcgagctcaccttcgagaaggtggtcagggtgcggacggcgcggtgggtgctgcggatgcagatgcacaccaacctggtggcgtcggcggtgtccgtggcggggctgctcgcgtcgggggactggcggacgatcccgggggagatggcgtcgttcaaagacgggaggacgaggtacgtgctgacgctggtgggcacggcggtgtcgtggcaggcagcggccgtgggcttggtgcggctgatcatgagggtgtcgtcgctgttcgcgaacgtgacgtgcacgctggcgctgccgctggtgccagtgtttgcggtggcgctgttcggggacaggatgaccggtataaagatcgtggccatgctcatggcggtatgggggttcctctcctacatgtaccagcactacatcgacgcacggcggcgggccggggccgagaacgccgagtgccgcgtctgcgccacacgcacgggaagccacgcggtcttgcccgcttgactcgagacccagctttcttgtacaaagtggtgataaattggagctctgcagagctttcgttcgtatcatc

SEQ ID NO: 742 - DNA, 1704 bp, Escherichia coli K12
ttcttgtttgttgattaacccttaattaatccgggcgcgcctgatttatcacaagtttgtacaaaaaagcaggctcctgcaggaccatgacggaccatacaatgaagaaaaaccccgtaagtataccacacaccgtctggtacgccgacgatatccgccgcggagaacgcgaggcggcagatgtgctggggctcacactctatgagctgatgcttcgcgctggcgaggccgcattccaggtgtgtcgttcggcgtatcctgacgcccgccactggctggtgctgtgcggtcatggtaataacggcggcgatggctacgtggtcgcgcgactggccaaagcggtcggcattgaggtcacgttgttggcccaggagagcgacaaaccgttgccggaagaggccgcgctggcacgcgaagcatggttaaacgcgggtggcgagatccatgcttcgaatattgtctggcccgaatcggtagatctgattgttgatgcgctgctcggtaccggtttgcggcaagcgccccgcgaatccattagccagttaatcgaccacgctaattcccatcctgcgccgattgtggcggttgatatcccttccggcctgctggctgaaactggcgctacgccaggcgcggtgatcaacgccgatcacaccatcacttttattgcgctgaaaccaggcttgctcactggaaaagcgcgggatgttaccggacaactgcattttgactcactggggctggatagttggctggcaggtcaggagacgaaaattcagcggttttcagcagaacaactttctcactggctaaaaccgcgtcgcccgacttcgcataaaggcgatcacgggcggctggtaattatcggtggcgatcacggcacggcgggggctattcgtatgacgggggaagcggcgctgcgtgctggtgctggtttagtccgagtactgacccgcagtgaaaacattgcgccgctgctgactgcacgaccggaattgatggtgcatgaactgacgatggactctcttaccgaaagcctggaatgggccgatgtggtggtgattggtcccggtctgggccagcaagagtgggggaaaaaagcactgcaaaaagttgagaattttcgcaaaccgatgttgtgggatgccgatgcattgaacctgctggcaatcaatcccgataagcgtcacaatcgcgtgatcacgccgcatcctggcgaggccgcacggttgttaggctgttccgtcgctgaaattgaaagtgaccgcttacattgcgccaaacgtctggtacaacgttatggcggcgtagcggtgctgaaaggtgccggaaccgtggtcgccgcccatcctgacgctttaggcattattgatgccggaaatgcaggcatggcgagcggcggcatgggcgatgtgctctctggtattattggcgcattgcttgggcaaaaactgtcgccgtatgatgcagcctgtgcaggctgtgtcgcgcacggtgcggcagctgacgtactggcggcgcgttttggaacgcgcgggatgctggcaaccgatctcttttccacgctacagcgtattgttaacccggaagtgactgataaaaaccatgatgaatcgagtaattccgctccctgactcgagacccagctttcttgtacaaagtggtgataaattggagctctgcagagctttcgttcgtatcatc

SEQ ID NO: 743 - DNA, 732 bp, Zea mays
ttcttgtttgttgattaacccttaattaatccgggcgcgcctgatttatcacaagtttgtacaaaaaagcaggctcctgcaggaccatggcaatcgccgggcagtgctcctcctgctattatacgtcacccaccctgcagctccagctccaacgacggcacagccacctgccgctgcagccccaagccgcacgaagagcgcggcggccgaggttgcaggtggccacagctgccggcagcgggcccatcagggcggccacggacgccgagttcttccagccttccgacaccaggccaatcatgctcttcgacggcgtctgcaacctctgcaacggcggcgtccgcttcgtgcgggagcacgaccccaacaggagcatcaggtacgtgccgctgcagagcgagtccgggaggaagctcctgcagaggtcagggaggtcccctgacgacatctccagcgttgttctcgtcgagaaagacaggtctttcatcaagtctgaagcggtgctgaggataatggagtacctcaacctgcccttcccgcagctcgccgtcttcctcaagttcgtccctctgttcctgagggacttcgcgtacgacaacgttgcgaacaacaggtacgccatgtttggccggtccgaagcagaagcatgcgagatactgtaactcgagacccagctttcttgtacaaagtggtgataaattggagctctgcagagctttcgttcgtatcatc

SEQ ID NO: 744 - DNA, 597 bp, Zea mays
ttcttgtttgttgattaacccttaattaatccgggcgcgcctgatttatcacaagtttgtacaaaaaagcaggctcctgcaggaccatgccccgcagcggcttctcggggtccttcaggtcgcccaagatcgacgtcgtcatcgacatgggaaaccccttcctcaaccgcaccgtcgacggcttcctcaagatcggcgccgtcggcgcctgcaaggtggctgccgaggagaccttcgagtgcctccacaggggggatgtttcgaagcacaaggttgagcatgccctgaggaagatgtgcaaggagggcgcatattggggcactgttgctggagtttatgtgggcatggtgtacggcgtggaaagggtccgtggccgcagtgactggaagaacgcgatgatcgggggcgccttgtccggcgccctgatctccggcgccagcaacagcgacagaggcaaggtcgtcaaggacgccatcaccgccggcgcggtagccacagccgtcgagttcatcaactgcattacctagctcgagacccagctttcttgtacaaagtggtgataaattggagctctgcagagctttcgttcgtatcatc

SEQ ID NO: 745 - DNA, 813 bp, Zea mays
ttcttgtttgttgattaacccttaattaatccgggcgcgcctgatttatcacaagtttgtacaaaaaagcaggctcctgcaggaccatggagatgggagggatgagcgacgctgagcggctgttcttcttcgagatggcctgcaagaactccgaggtcgcgtacgagcagaaccccaacgacgccgacaacctgacgcggtggggcggcgcgctgctggagctgtcgcaggtccgaaccggccccgacagcctcaagcttcttgaagatgcggaagccaaactggaggaggcacttcaaattgatcccaacaagtccgatgcactctggtgcttgggaaatgctcagacctctcatggattcttcactccagacaatgcaatagctaatgagttctttacaaaggcaaccggatgtttccagaaggctgttgatgtggaacctgcaaatgagctgtacaggaagtctctagacttgtcaatgaaggcacctgaactgcatttggagatccagaggcaaatggtttctcaagcggcaacacaagcatcctcagcctcaaatccaaggcaatcaaggaagaagaaggacaatgacttctggtacgatgtttgtggatgggtgatccttggcgccggcattgttgcttgggttggattggcaagagcaagcatgcctcccccgacgccaccagccaggtgagaactgatcgagtgacgagtgccaagaacgctttgcaaatgatggctcgagacccagctttcttgtacaaagtggtgataaattggagctctgcagagctttcgttcgtatcatc

SEQ ID NO: 746 - DNA, 471 bp, Zea mays
ttcttgtttgttgattaacccttaattaatccgggcgcgcctgatttatcacaagtttgtacaaaaaagcaggctcctgcaggaccatggtgcgcaaggcgaaggttgagttcgacgagcagccgccggataacttcgacccgaagaacccgtatgccgacccggtggcgatgctcgagtaccgggaacacctggtgcgagagaagtggatccatatcgagaccgccaagatcatccgggagcgcctccgctggtgctaccgcatcgagggcatcaaccaccaccagaagtgccgccacctcgtcgaccaatacctagaggctacccgcggcgtgggttggggcaaggatgcccgcccgcctgaactccacgagcccaagaagaccgtcaaggcggagtagctcgagacccagctttcttgtacaaagtggtgataaattggagctctgcagagctttcgttcgtatcatc

SEQ ID NO: 747 - DNA, 1422 bp, Zea mays
ttcttgtttgttgattaacccttaattaatccgggcgcgcctgatttatcacaagtttgtacaaaaaagcaggctcctgcaggaccatgggttgcttttctacattttgcaagaaaagaagggcaacacggcaaccaagttcccaccataatgaagacgtacctggctgttcaaatataacaaaatacacttacaaggagctagtaagggcgacaaataactttaacccattgaacaaaattggtgagggtgggtttggttccgtttacaagggacagctcaggaatggtacagttattgctgtcaaggtcctttcgtcggagtcaagacaaggagtaagggagtttctgaatgaactcgtggcaatttccgacatctcacatgataatcttgtgaaactttatgggtattgtgcggaaggagaccaaagaatccttgtttacaatcatcttgaaaataatagccttgcacaaacacttctaggctccagccacagcaatatccagtttgattggaaaacacgagtaaatatttgccttggcattgcacggggattagcatacctccatcatggtgtcagtccccacattgttcatcgagacattaaagcaagcaatatacttcttgatagggaccttaccccaaaaatctctgattttggtctagcaaagcttcttccaccaaacgcaacacatgttagcacaagagttgcaggaacactgggttatttggctcctgagtatgctattcgaggacaggtgacacgcaaatcagatgtgtacagctttggcgtgctgcttctggaaattgtttgcgggagatcaaacagcgatacaagattagcatacggagatcagatactcctcgaaaagttcccagagatcaccaacggggctctcctcttgcagacgtggatgcactacgagcagggttgtctggagaggatcatagacaggtccttgggcggcggcgacctggacgtggcgcaggcctgcaggttcctgaaggtcgggctgctgtgcacgcaggacgtgacgaggcaccggcccgacatgccgagggtcgtcgccatgctgacgggcgagtgggacgtcgagccggagacggtcagcaagcccgccataatcagcgacttcatggaccttaaggtcaggagcacgaggaaagcgagcgacaacgtggccacgccgcctacgtcctcctcgacgttcctgtcctccctcatggcgcactcctcgcccttgctgtcgaacgagtccacgcaggcctccatggcgttcaccggggtgtcggatcgcgagtgatccatgatcccttcgtcgaagacaggtcaggctggtagtgacctgagtctcgagacccagctttcttgtacaaagtggtgataaattggagctctgcagagctttcgttcgtatcatc

SEQ ID NO: 748 - DNA, 1191 bp, Zea mays
ttcttgtttgttgattaacccttaattaatccgggcgcgcctgatttatcacaagtttgtacaaaaaagcaggctcctgcaggaccatgggaatcctctgcctcggtgcttcctccacactgctctgcggggaggacaggaacaacgtactcggcctcggctgcggcaacgagctggtggaggtggggagcggccatgacggcttggactccgtcgtcggcgccgtgttccccgtggacacagatgaggccgtgcgggcgttgttggagaaggagacggaccacaagcctcaagacggctatgcggagaggctggagcgcggcggattggagtactcctggaggagagacgccatggattggatttgcaaggtccattcgtactacaggtttggaccactcagtctttaccttgctgtgaattacctggatagattcctctcctcatatgatctcccacacgataagccttggatgcgacagttgttgtcagttgcttgcctagctctcgctgtcaagatggaggagaccgtgctccctcttcctgtggaccttcaggtctgcgatgtgaaatttgagtttgaagcaaggactattgggaggatggagcttcttgtgctggccaccctgaaatggagaatgcaggctgtgacccccttcactttcatcagctacttcctcgacaagttcaatggtgggaagccgccgagtatggcactagcgtcacggtgcaccgagatcataattggcacactcaaaggctctacattcttgtcattcagaccatctgagattgccgcggcctcagctctagcagcagtttctgagaatcaggttgttggctcctcgagtgctctttcagcatctgaagtccctataaataaggagatgattgctagatgctatgagctgttgcaagagcaagcgctggtgaggaagacagggcacatcaatggaagcccttcagtgccgcaaagcccgattggcgtgctggatgcaacatgcttcagctttaggagtgaagatgtaagactaggatcatcgcaatcaaacaacatcagtagtagtagtaacgacaatcaagtttctaagaggagaaggctaagcatatcaccaatctgactcgagacccagctttcttgtacaaagtggtgataaattggagctctgcagagctttcgttcgtatcatc

SEQ ID NO: 749 - DNA, 771 bp, Zea mays
ttcttgtttgttgattaacccttaattaatccgggcgcgcctgatttatcacaagtttgtacaaaaaagcaggctcctgcaggaccatggcctgcctgcacgaccacagctgcgaggatcacaactgcgccgccgactggtcgctctacaaccacatcgacgtccccaaggtggtggctctcaacgaatcggtgcccgggagcgtcaagtccgtcttcaagccctgggagcagcgccttgacacctcggggggttttctggagagtaatgagggtgaccctgagctacttattttcatcccgttcacatcagatgttaagatcaagagcatttctgttgttggtggtgctgatggaacaagcccgtcaagaatgagagcgtttatcaatagagaaggtattgacttttctgatgctcaaaacatgcagccagtgcaggaatgggaattagcagagaacctgcaaggagctcttgagtaccaaacaagatattcaaggttccaaggtgtggctaacctaactctgcatttctctgacaactttggtggtgatacaactaaaatttattacattggactacgtggtgaagccactcagaacaaaagggatgtagttgcaacaattgtatatgaagtcatgcccaatccttctgatcacaaaacaaaatctgagactggaggaggtttctcgcatgtggagtagctcgagacccagctttcttgtacaaagtggtgataaattggagctctgcagagctttcgttcgtatcatc

SEQ ID NO: 750 - DNA, 831 bp, Zea mays
ttcttgtttgttgattaacccttaattaatccgggcgcgcctgatttatcacaagtttgtacaaaaaagcaggctcctgcaggaccatgcggttcacggcgtctccggtggtggagcttccggtcagcggcgcggtgttgactttcgaacaggacaacgactccttcgaggtgggcacctctgtgtggccctcgtccctggtcctcgtcaagttcgtcgagcgctgcatccgcgacccggccctcccctttgccgacgtgctccgcttcccgggaacccgggccgtggagctcgggtccgggtgcggaccggcaggacttggcctctcccgcctcggcctcaccgatctcgtcctcaccgacatcgccgccgtgctcccggcgctccgccgcaacctgcggcgcaaccgagttcacctcgcgcgcgcgccccgcctcgcccagctccactggaactgccccgcgcatctcgcgacgctagccaccccgcgccgcttcgatctcgtcgtcgccgcagacgtggtctacgtgcaggagtccgtgccgcacctcatcgcggccatggatgcgctcgccgacgccgagcgcggcgtggtgctgctcggctaccagatccggtcgcccgaggcgcaccaggtgttctgggagaccgttccggctgtcttcccggtcatcgagaaggtggcacgggagcacctcgaccctgagtacgcctacgaggaatccgatgtattcatactccgaagaagcccgcgtcagtgactcgagacccagctttcttgtacaaagtggtgataaattggagctctgcagagctttcgttcgtatcatc

SEQ ID NO: 751 - DNA, 1701 bp, Zea mays
ttcttgtttgttgattaacccttaattaatccgggcgcgcctgatttatcacaagtttgtacaaaaaagcaggctcctgcaggaccatggaagccgacatcgctttcaggtatgagatcccccggaccgcccagttcctccgcgacggcgcctacaccagggtcgcgctccagttccccgacgagatgctgaaggatgctgctgcggtggcgagggcgttgcggcgggagcttgcctccggcggcgccgacagtggggttagggtgttcgtgatggccgacacggcgtacaactcctgctgcgtggacgaggtgggcgcgtcccacatcgatgcgcagtgcgtcgtccactacggccacgcctgcatgagcccaacatcaaatttgccagctttctttgtatttgggaaggcaccgttggatgtccacgcatgtgccggcacattgctggagtgctcaaggaaaagcaataagcgcattctggttttatatggactagagtacgcatatgcattggatgaccttagacagactttcatggagtcatgtaaatcaaattctggcaatcatgaagtccagtatgcagaagttctatgttcagttatgagtccatcatcaagtactacagaagaaaacaaaattcctcagtcgagtggcccctcttgtaatggggatatctccagaaacagcgagtcggcaacattcctgaataatcgtaatggcatggaatgttccagttccacacaaaagtacagccttgctggcatgacatggaatatttcagttgaggagaaaatggaggactatttcatattttggattggacaagatagctcagcatttgccaacatagtgcttaccttcaataaatgtgaaatagttagatatgatgcaatagaaaatcaactcacagcggacgtctctcatctgatgaaaattcttaggcgaagatattacctcgtggagaaggcgaaggatgcaaatattattggcattttggtgggaactctgggtgtagctggttatcttcatataatcgaacaaatgaaagatctgatcaaggccgctggaaagaaatcctatacattggtcatgggtaggcctaattctgccaagcttgcgaattttccagagtgcgaagtttttatttatgtttcttgtgcccaaactgctctgctggatagcaaggattttttagctccagttattacaccttttgaagctgtactagcttttggcaggggaagagagtggaccggagagtatcttttggatttcaaggatttgatcacttcagagaaacaagaagctgcgagcacaacaggagaagcacgcttttcttttatcaaaggtgtctatgtggaagataattgccctcaagaaaatgaggaacaatcggaaacgtcgctcgctctggctgaggtaactgaaaaggcactgagcatccaaaaccagcacaacgacgctgtcctttaccaaggaagagcaatgtcctcaatcgactacctcaaggcacgttcctaccgtggtctaactggagaatacgaaggcccagttcctgattcagtcttggtaggcagaatgggcagggcagctggttacagtgacgagaaaactgagagcgcacagtgactcgagacccagctttcttgtacaaagtggtgataaattggagctctgcagagctttcgttcgtatcatc

SEQ ID NO: 752 - DNA, 1765 bp, Arabidopsis thaliana
ttaattaaccgatgggatgcgttttatgcaaagaatccaccggagacaaacggaaacacaataatcccgatgaacctcctccggcagacctccgtaatacggaggatttaccttcttcttcttcaaccaccaccgccgccatttctgtcgaaatcggagagaagaagaagaaagatttagattcgattcagattcagccggagagaagaacatggcacactggcgacttctccgccggctcttctcgccgtccggggatgagtctccgtacgccggaaggatggccaccttggcttattgctgcttgtggcgattcgatcaaagacttaacacctcgcagagctaccacatacgaaaagctcgagaagattgggcaaggaacgtatagcaatgtgtacaaggcgaaagatttattgagtgggaagattgtagctttgaagaaagttaggtttgataatttggaagctgagagtgttaaatttatggctagagagattcttgtgttacgacggcttaatcatcctaatgttattaagcttcaaggtttggttacttcacgggtttcctgtagtctctaccttgtttttgagtatatggagcatgatctttctggtcttgctgctacccaaggtctcaagtttgatcttcctcaggttaaatgctttatgaagcagctactatctggattggaccattgccatagtcgaggagtattacatcgggatatcaaaggttctaatcttcttatagataatgatggaatactgaagattgctgatttcgggttggctacgttttatgacccaaagcaaaagcaaacaatgactagtcgtgttgtcacactttggtaccgtcctcccgagcttcttcttggagctaccagttatggaactggtgttgatctttggagtgctggttgtattatggctgagttacttgctggcaagcccgttatgccgggaagaaccgaggtcgaacaacttcataagatattcaaattatgtggctccccttcagattcgtactggaagaagtacagactgccaaacgcaactctttttaagccgcaacatccgtacaaacgttgtgtggctgaagccttcaatggtttcactccatcctctgtgcatctagttgagacacttctcactatagaccctgctgatcgaggaacttctacctcggcattgaatagtgaattctttactactgaaccgttaccttgtgatccttcaagtttaccaaagtatccaccttccaaagaactgaatgtaaagctgagggacgaagagttaagaaggcaaaagggtcttgctggaaaaggtagtggtattgatggagctagaagaataaggtatcgaggggatcgcactgggcgagctattccagccccagaagctaatgccgagagtcaagcaaacttagatagatggagatcgatatcacaaacaaatggaaagagcaagagtgagaagtttccgcctcctcaccaggacggtgcagttgggtacccattggaagatctatcaaagaaaacctcagtatttggtgcaaagactgagacttcttttgggttatcgagatcattaaagtctggggaagggacatcaatgagaaagatttcaaacaaagacggggctcgtggggcttcttctagaaagtacatatggggacttaaacctcctccagcactcgggctatcgatggacttacttttcaggagcagatcagaagtttttgggatccggagataggaaggcgcgcc

SEQ ID NO: 753 - DNA, 2355 bp, Zea mays
ttcttgtttgttgattaacccttaattaatccgggcgcgcctgatttatcacaagtttgtacaaaaaagcaggctcctgcaggaccatgaggctactgcgggtcgccacgtgcaacctcaaccagtgggcgatggacttcgacaccaacctccgcaacgtcaaggagtccatcaagcgcgccaaggctgctggggccgtcatccgcgtcggccccgagctcgagctcaccggctacggctgcgaggaccacttcctcgagcaggacaccaccgcccacgcatgggagtgcttaaaggacattttaactggggactatacggacaacatcttatgcagcataggaatgccagttattttcaatagtgtgcggtataattgccaggtcttctgcctaaatcgtaagataatcatgatccgaccaaagatgtcccttgcaaatgatggaaattatcgggaattccgttggttttctgcttggacatttaaaggcgagattgttgattttcagctccccgttgaagtctcagaggcaatatcccaggatacggtgccttttggttatggatacatgcggtttatagatgtgtctttggctgctgaaacctgtgaagagctctttacagcaaacgctcctcggattgacttagcattgaatggtgttgaggttttcatgaatgcaagtggaagccaccatcagttaaggaagctcaatcttcgtattgattccataaggagtgcaacccaaacatgtggcggtgtttacatgtatgctaatcagcagggttgcgatggtggccgcctttattacgatggttgttgctgcattgcggtaaacggtgatttggtaggccagggatctcaattctcgttgaaggatgtagaagttctggatgctctggtagatcttgatgctgtatcgagttatcgagcatctgtttctagtttcagagagcaagcaagccacaaaacaaatgtaccttttgtgaaggtaccatataaactttgccaaccatttcggagtggaatggttccgacttctccagttgagattatgtatcactgtcctgaagaagagattgcatttggacctagttgttggctatgggattatttgaggcggagtcaagcatcaggatttttgcttccactttctggtggtgcggatagttcatctgttgcggcaatagtcgggtgcatgtgccaacttgtcataaaagatatagagaaaggagacgagcaagttaaggcagatgctcttcggattgggcagtataaagatggggcaattcccatggatagcagggaactggctaaacgtttgttttatactgtttacatgggaactgaaaatagttctgaagatacccgatcacgtgccaaaaggctagctgaggagattggttcattccacttgaatgtacccattgatagtatagtatctgcttttctttccttgtttgaaacattgactgggaagcgaccacgctacaaggttgatggggggtcaaatactgagaatctgggattgcaaaatattcaagcccgaatcaggatggtgttagcctttatgatggcttctctaatgccatgggtccacaacaaatctgggttttatcttgttcttggaagctccaacgtcgatgaagggttacgtggttatttgacaaagtatgactgcagttcagctgatgtaaaccccattggaagtgtaagtaagcaagatctgagagcttttttacgatgggcagcaattcatcttaagtattcttccttggccgaggttgaagctgcaccacctactgccgagcttgagccaatacgagcaaactacaatcagttggatgaaatagacatgggaatgacatatgaggagctgtctatatatggaaggttaaggaaaattttccgatgtggtcctgtttcaatgtttcagaacctgtgccacagttggtgtggaagattatctccgtctgaagtggctgacaaagtaaagcacttcttcaagtactacgccataaaccggcacaagatgactgttttgaccccatcttatcatgctgagagctattcaccagaagataataggttcgaccttcgccagtttctttacaactcaaggtggccctaccagtttcggaagatcaatgagcttgtgcaagagatggacaaagatggcaaatggggaacttctgcagaagggaagctgggagcgcagacaggtgcacagggaactggaatgggagtggtggcagcggggtctgccaatcccagtgccggcttctgactcgagacccagctttcttgtacaaagtggtgataaattggagctctgcagagctttcgttcgtatcatc

SEQ ID NO: 754 - DNA, 967 bp, Zea mays
ttcttgtttgttgattaacccttaattaatccgggcgcgcctgatttatcacaagtttgtacaaaaaagcaggctcctgcaggaccatgcttactctccacaccattcagtcatgcccctcgctgcgcagatcctctctgttccggcgtgctctgctaggcaggaagagatctttcatttctgccagcagttctgaggatgccgaatccggcactcccccgccgcttggtggcgacaaacaccagcaggaggttcttgcacagatcgccatgcttcagacgcagaaggtgcgcatcacagacttcttggacgagcgctctgcttacctgaccaagttcgccaaggacgccgactcggagttcgacctgattgggcagaacgccatgaaagaacttgatgccgttggtgaccagatactggagaggctcgacagcaagatgcaagccttcgaggagacggctgaggtacaacggcaagagatagaaatgaacgataaggtgttagaggacttcgaagactggattgagaaggagaaaaacgaaggaatgttcttcaaaagccttggcaaggtcaaacctcggaacaagatggaaataaaggtgaaagccaaggtggaagcacagaaggtcaaagagattgcagaggagagtgcaggatcaaaaactcgtatgaacatttacctggggctgatggggatactcgggattacaattgcgaatgccatctttgcaacaccagaggtggagtggaggaaggttgctgctctgggtctgattttcattggtctggttgctcaggtcatctacgagcaggatatctcaccgccggaagctgagaagacagagaaaatagaagaataaaaaaggagttgcagacatatcggtagggtgtgatctcctcgagacccagctttcttgtacaaagtggtgataaattggagctctgcagagctttcgttcgtatcatc

SEQ ID NO: 755 - DNA, 2566 bp, Arabidopsis thaliana
ttcttgtttgttgattaacccttaattaatccgggcgcgcctgatttatcacaagtttgtacaaaaaagcaggctcctgcaggacccatctccccaaaaaaaaaacagagcaagaagaagaagaagaagacaaccatggaagaatcagaacaagttcttcctctattaacaaacccaaaagatctgacaaacccatcatatgcgtcatcatcttcatcttcatctgaaccaagagatgaaacagaggatcttcttttaccaatctccgacgagaatgaggaggaagaagaagagaactcaccaatccgacaagtagcactcactgttccgacaacagatgatccttcattacctgtcttaacatttcgcatgtgggtcttaggaactctctcttgcatcctcttgtcgtttctcaatcagttcttctggtatagaacagaacctctcactatctctgccatctccgctcaaatcgccgtcgtaccacttggtcgtctcatggctgctaaaatcaccgatagagtcttcttccaaggatcaaagtggcagtttacgttgaatccaggtccgtttaatgtgaaagagcatgtgttgatcactattttcgctaacgcgggagctggatctgtttacgcaatacacgttgttaccgtggtcaaagcgttttacatgaagaacataacgttctttgtgtctttcatcgttatcgttaccacccaagtgttaggttttggatgggctggaatatttaggaaataccttgttgaaccggcggcgatgtggtggccggcgaatcttgttcaagtctcactatttagagctttgcacgagaaagaagaacggaccaaaggagggctgacacgtacacaattcttcgtgatagcattcgtttgcagtttcgcttattatgtctttccgggctacttatttcagatcatgacgtcgttgtcgtgggtttgttggttctttccatcatcagttatggcccaacagatcgggtctggtcttcacgggttaggtgttggggccataggacttgactggtcaaccatttcctcttacttgggtagtccactcgctagtccatggtttgctacggctaatgtgggtgtgggatttgtgctggtgatatatgtcttggtaccaatatgctattggctcgatgtgtacaaggccaagaccttccccatattttcgagctcacttttttcgagccagggttcaaagtacaacatcacatccattatagactctaatttccaccttgacctcccagcctacgagcgtcaaggccctttgtatctttgcactttcttcgccattagttacggtgttggttttgccgctttaagcgctaccatcatgcatgttgctctcttccacggaagggagatatgggagcagagtaaggagagttttaaagaaaagaaattggatgtacacgcgaggctaatgcaaaggtacaaacaagttccagagtggtggttttggtgcatactcgttaccaacgttggagccacaatctttgcttgtgagtattacaatgaccaacttcaattaccatggtggggtgttctattggcatgtaccgtcgccattatctttacacttcctatcggtatcatcaccgccatcaccaatcaggcgccaggattgaacattattacagaatatatcataggatatatctatccaggatatccagttgcaaatatgtgctttaaagtatatggatacataagcatgcaacaagccatcacgtttcttcaagactttaagcttggtcactacatgaagataccacctagaaccatgttcatggcacagattgttggaacactcatctcatgttttgtttacctcacaacggcttggtggctaatggagaccatccccaacatatgtgattcggttactaactcggtttggacatgtccatcggataaagtcttttatgatgcatcggtgatatggggacttattggacctcgtagaatctttggagatcttggtttatacaaatccgttaattggttcttccttgtgggcgctatagcccctattcttgtatggttagcttcaaggatgtttcctagacaagagtggatcaagcttataaacatgccggttcttataagcgcgacaagctcgatgccgcccgcaacagccgtgaactacacaacatgggttcttgctggattcttatccggatttgttgtgtttaggtacaggccaaatctatggcagaggtataattatgttttgtcaggagcattggatgctggattagcatttatgggtgtgttgctttatatgtgtttgggacttgagaatgtgagtttggattggtggggaaatgagcttgatggttgtcctttggcctcttgtccaaccgcgcctggtattattgttgaaggatgcccgctttatacgtaaaacgcgtttgcgcggcgaaggcatttccaatgctaaagtttggtggttggatttggtaccctcgagacccagctttcttgtacaaagtggtgataaattggagctctgcagagctttcgttcgtatcatc

SEQ ID NO: 756 - DNA, 1830 bp, Arabidopsis thaliana
atggagctttcagaaacctatgcttgtgttccatcgacggagagaggtagaggaattctgatctctggtaactcgaagtccgataccatcctctacactaatggtcgatccgtcgtgactctcgaccttaacaatcctttaaaggtctctatctatggtgagcacgcttacccagctactgtggcgcgatattctccgaacggagagtggatcgcgtctggtgatgtgtcggggactgttagaatctggggagcttacaacgatcatgtgttgaagaatgagtttaaggttttggctggtcggatcgatgatcttcagtggtctgctgatgggatgaggatcgttgcttctggtgatggcaaaggcaaatctcttgttcgtgctttcatgtgggattcaggatcaaatgtgggagagtttgatggtcattctaggagagttcttagctgtgctatcaagccaactaggccgttccgtattgtaacttgtggggaggattttctggtgaatttctatgaaggtcctccttttaagttcaagctctcaagcagagagcattccaactttgtcaactgtgtgaggtttgcaccagatggaagtaagttcattactgtgagttcagataagaagggaatcatatatgatggaaagacttgtgagatactgggagaactgtcttctgatgatgggcataaaggtagcatctatgcagtcagctggagtcctgatggtaaacaggtgctcactgtttccgcagacaagtcagccaaaatatgggatatatcagacaacggtagtggatcattgaatacaacattgaactgtcctggatcatcaggtggagtagacgatatgcttgttgggtgtctgtggcagaacgatcatattgtcactgtttctctaggtggcacaatcagcatattctcagcaagcgatctggataaatccccctttcagttttcgggacacatgaagaacgtctcttccttagctgtgcttaaaggaaacgctgattacatattatccggtagttatgatggactgatatgtaaatggatgctaggccgtggtttttgcggtaaattgcagcggacacaaaactctcaaataaagtgctttgctgcccatgaagaagagatcgtgacctctggatatgacaataagatatccaggatctcctataaagatgatcaatgcacaaatgaagagtctatcgacattggaaatcaaccaaaggatctaagccttgcaccactctcacccgatctccttctggtgacctttgagtcaggagttgtgtttcttcgtgatgggaaagtagtgtcaaccatcaaccttgggttcattgtcactgctttggcagtaacacctgatggaaccgaagctgtcatcggtggccaagacggtaaactccatttgtattctattaatggtgactccctcaccgaggaagcagttctcgagagacacagaggcgccatcagcgtcatacgttactctccagatttgtctatgtttgcatcagctgatttgaacagagaagcagttgtgtgggacagagtctccagagagatgaaactcaagaacatgttgtaccatagcgcccgcataaactgcttagcttggtctccaaacagcactatggttgccacaggatccttggacacgtgtgtgattgtgtatgaagtggacaaacctgcttcgtcacgcatgacaataaaaggagctcacttaggtggagtatatggtctgggttttgctgatgattcccatgtagtgagttctggtgaagatgcttgtatccgcgtctggagctttactcctcaataa

SEQ ID NO: 757 - DNA, 2370 bp, Arabidopsis thaliana
ttcttgtttgttgattaacccttaattaatccgggcgcgcctgatttatcacaagtttgtacaaaaaagcaggctcctgcaggaccatgaggagtgtagtgcttgttgctttagccgctgcgatagggaatatgttgcagggctgggacaatgccaccattgcaggagctgtaatttacattaagaaagaatttcatttggagaaagaaccaaagatagaaggactgatcgtggcaatgtctctcattggagccactttgatcacaactttctctggtcctgtctctgacaaagtaggaaggcgatcaatgcttatactctcctctgttctctattttctgagtagcattgttatgttttggtctcccaatgtctacgttctccttttcgcaaggcttcttgatggttttgggatcggtttagctgtcactctcgtcccaatctacatctctgagaccgcaccttctgagatcagaggattactcaacactttcccgcagttttgtggatccggtgggatgtttttgtcgtattgtcttgtgtttgggatgtcgcttcaagaatcaccaagctggaggctgatgcttggtgttttgtcaattccgtccattgcctactttgtacttgcggctttcttcttgcctgaatctccaaggtggcttgtcagcaaaggccgtatggatgaagctagacaggttctgcagagactccgtggcagagaagatgtttcaggcgagcttgctctgctggttgaagggcttggggtgggaaaagacacgtcgatagaagaatatgtgattggaccagacaacgaggaaaacgagggtggaaatgaactgccgaggaaagatcagataaaactatatggtccagaggatggacagtcatggatggctaagccagtgaaaggacagagttctctcgcattggcttcccgacaaggcagcatgttaccgcgtggcggatccctcatggacccacttgtcactctctttggtagcattcatgagaatctcccttccgagaacatgaacgcatcatcccgcagcatgctcttccccaatatgggaagtatactgggaatgatgggaaggcaggagtcccagtgggatccagagagaaacaatgaagatagttctgaccaagatgaaaacttaaacagtcctctgctttctccacaaaccactgagccggatgactaccaccagcggaccgttggtaccatgcataggcgacagagcagcttgtttatggcaaacgtgggtgagacagcgacggctacaagcataggcggtggatggcaattggcgtggaagtataatgacaaggttggtgcagatggtaagagagtcaatggagggttacagagaatgtatattcacgaggaaaccgccaacaacaacaccaacaacattcctttttcgcgacgtggatcacttctctccttccacccagagggtgatggtcatgatcaggtgaatggatacgttcaggctgctgcacttgtgagccaagcttcgatgatgccaggaggtaaaggcgagaccgcaatgttgccaaaggaggttaaggatggtccaggctggagggagctgaaagaaccaggggttaagagagctttgatggttggagttgggcttcagatactgcaacagtttgcaggaataaatggagtgatgtattatacacctcaaatattggaagaaacaggtgtgtcaagtcttttgacaaaccttggaataagtgcagagtctgcatcgcttctcataagcgccttaaccacactcttgatgcttccctgcattcttgtctccatgaggttaatggatgtaactggcagaaggtctctgatgctttcgactatccccattctaatactgtcgctggtaacactggtgataggaagcttagtgaatcttggaggttcaataaacgcgttgatatcgacagcaagtgttacggtgtacctaagctgtttcgtgatgggttttggggcaattccaaacatcctctgctcagagatattccctacttctgtgcgcggtctctgcatcaccatatgtgccctcactttctggatctgtgacataatcgtcacttacactctcccagtcatgctcaaatccattggcatcgcaggagtctttggcatttatgcaatcgtctgtgctgtcgcgtgggtttttgtgtacctcaaggtaccagagacaaagggaatgccccttgaagttatctctgagttcttctccgtcggtgcaaaacagcaagacgctgcagcttcatttctctctgatggatgactcgagacccagctttcttgtacaaagtggtgataaattggagctctgcagagctttcgttcgtatcatc

SEQ ID NO: 758 - DNA, 2243 bp, Arabidopsis thaliana
aaaacctagccataaccatcttcttcttctttctcttgttcttgaacataattctgcttcatggacaagcatcatcatcaacatcttttattacagcatcatcaacatcttcaccatcatcagaagctctctcttgccaaatcatccagacaaagctgtagtgaatggtatgttctctttcatgagtaatgttaccagttgaaacactttaagtttctctgatcaagaaactggtgtctgcacatggctctgtctcaatcttgctaatgatgttctttcttgcaactttttaggatctttcgagatgttccaagtgatataaccatagaagtaaacggtggaaactttgctctgcataaggtatatgcatacttagaacacaaccatcactgctttctcaagtaaaccattactgaacatgctttgcttctccatttctcagttccctttagtctctagaagtggaagaatccgaagaatagttgcagaacatagagattcagatatctccaaagtggagcttcttaatctcccaggaggagcagagacattcgaactagcagcaaaattctgctatgggattaacttcgagatcacttcttcgaacgttgcacagctcttttgtgtctctgattacctcgagatgacggaagagtactccaaagataacttggcttcaagaacagaggagtatcttgagagcatcgtatgcaagaatcttgagatgtgtgttcaagtcttgaaacaatccgagattcttctccctcttgcagatgaactgaatatcataggtagatgtatcgatgccattgcctcgaaggcttgcgctgagcagatcgcttcaagcttttcgaggttggagtatagtagctcagggaggcttcatatgagcagacaagtgaaaagcagtggtgatggaggagattggtggatcgaagatctttcggttctgaggattgatttgtatcagagagttatgaatgcaatgaagtgtcgtggtgtacgtccagaaagtataggagcttctttggttagttacgctgagagagagctaacaaagagatctgaacatgaacaaaccattgttgagacaattgttacgcttttgccagtcgaaaacctcgtggttccgatcagtttcctattcgggttactgagaagagcagtgattcttgatacttcagtttcctgcaggcttgatcttgagaggaggttaggttctcagctcgatatggcgactcttgacgatctcttgatcccgtcttttcgtcatgcaggagacactttgttcgacattgacacggttcacagaatcttagtgaatttctcacagcaaggaggagatgatagtgaggatgaagagtctgtgtttgaatgcgatagtccacattcgccttcacaaaccgccatgtttaaagttgcaaagcttgtagacagttatcttgctgagatagctcccgatgctaaccttgacctttctaagttcttgcttatcgcagaagccttaccgcctcatgctcgcacccttcacgatggtttataccgcgccattgatctctatcttaaggtatgttgctacaagaaaattttacttactcttgttgtgacttgatacttattaggttttatgctcttaggcacatcaagggttatcagattcagacaagaagaaactatcaaaacttattgacttccagaaactctcacaagaagctggagcacacgctgcacaaaacgagcggcttcctctgcaatccatagttcaagttctctactttgagcaactcaagcttcgaagctccttgtgctcttcttactcagacgaagagccaaagccaaagcagcaacaacagcagtcatggagaatcaatagcggagctctcagtgcaacaatgtcccccaaagacaactatgcgtctctgaggagagaaaaccgagaactgaagctcgagttagctaggttgagaatgagactcaacgacctagagaaagaacatatatgtatgaagagagatatgcagaggtctcattcgcgcaaattcatgagcagtttctcaaagaaaatggggaaacttagcttctttgggcatagctcttcaagaggatcaagctctccatcaaagcagtctttcagaacagattcaaaggtactgatggagagaacttgcgcaagcacagattagctcagtgtttatcattttctcttacctgttgctgctttttaagtgagacttgagactggt

SEQ ID NO: 759 - DNA, 378 bp, Arabidopsis thaliana
atggaatcaaagacgttctggatcgttactcttcttctctgtggaacaattcaattagcgatttgcagatcagaagagaaaagcacagagaagacgatgatgctaggaggcgttcatgatctccgaggaaatcagaacagtggagagatcgagagtctcgctcgatttgccattcaagaacataacaaacaacagaacaaaattcttgagttcaagaagattgtcaaagcaagggagcaggtagttgcaggaacgatgtaccacttaaccctagaagcaaaagaaggtgatcagactaagaattttgaagccaaagtgtgggtgaagccatggatgaacttcaaacagttgcaggagttcaaggaatcatcttcttga

SEQ ID NO: 760 - protein, 288 aa, Arabidopsis thaliana
MSGALNMTLDEIVKRGKTARSGGRGISRGRGRGRGGGGRGAGPARRGPLAVNARPSSFTINKPVRRVRSLPWQSGLFEDGLRAAGASGVEVGTRLHVTNLDQGVTNEDIRELFSEIGEVERYAIHYDKNGRPSGTAEVVYPRRSDAFQALKKYNNVLLDGRPMRLEILGGNNSSEAPLSGRVNVNVTGLNGRLKRTVVIQQGGGGRGRVRGGRGGRGPAPTVSRRLPIHNQQGGGMRGGRGGFRARGRGNGGRGRGGGRGNGKKPVEKSAADLDKDLESYHADAMNTS

SEQ ID NO: 761 - protein, 417 aa, Arabidopsis thaliana
CLVSQPYRESSTSGHKQVCTTRNGWTAFVKRVSMASGAIRRFQERVLGPNRTGLPSTTSDVWLLGVCYKISADENSGETDTGTVLAALQLDFSSKILMTYRKGFEPFRDTTYTSDVNWGCMIRSSQMLFAQALLFHRLGRAWTKKSELPEQEYLETLEPFGDSEPSAFSIHNLIIAGASYGLAAGSWVGPYAICRAWESLACKKRKQTDSKNQTLPMAVHIVSGSEDGERGGAPILCIEDATKSCLEFSKGQSEWTPIILLVPLVLGLDSVNPRYIPSLVATFTFPQSVGILGGKPGASTYIVGVQEDKGFYLDPHEVQQVVTVNKETPDVDTSSYHCNVLRYVPLESLDPSLALGFYCRDKDDFDDFCLRALKLAEESNGAPLFTVTQTHTAINQSNYGFADDDSEDEREDDWQML

SEQ ID NO: 762 - protein, 96 aa, Arabidopsis thaliana
MSLQQRRMGCKYTFSINETSGLRMQRGPLSALETLVFPLNADPGWQSSSAHMVLNASYEYLALSFQPIPQIVASPTWCDRVVISLNPGDHTINLVG

SEQ ID NO: 763 - protein, 216 aa, Arabidopsis thaliana
MNSFSAFSEMFGSDYESSVSSGGDYIPTLASSCPKKPAGRKKFRETRHPIYRGVRRRNSGKWVCEVREPNKKTRIWLGTFQTAEMAARAHDVAALALRGRSACLNFADSAWRLRIPESTCAKDIQKAAAEAALAFQDEMCDATTDHGFDMEETLVEAIYTAEQSENAFYMHDEAMFEMPSLLANMAEGMLLPLPSVQWNHNHEVDGDDDDVSLWSY

SEQ ID NO: 764 - protein, 173 aa, Arabidopsis thaliana
MANQGAKKRKEENAKHMAKLRRIIIASNAVYFVVRMLIFYSSFTWKHWIGLVITSLAYAFPYKQLDQMAKPSVTDDGELIDGGFDMTTGGICGYLHDVIYITCFVQLASIITGKFWYTYLVIPAFGVYKASGLIRGFMSQGSEGGVEDEKSRKKREKMERKASRGQVVKTRTR

SEQ ID NO: 765 - protein, 103 aa, Arabidopsis thaliana
MEVPGSSKKMIATQEEMSAAKIALGSRDMCAHLLIPLNKCRQAEFYLPWKCEDERHVYEKCEYELVMERMLAMKKIREEEALAKQNKLQGNAAVPLIPKTANA

SEQ ID NO: 766 - protein, 581 aa, Arabidopsis thaliana
MAMIGMNIIGLFMVLMLLLISLIILFACKPWRYFSRFRSSSRFSSTFKVGDLQRPLISDDGNLIQGQTSEVTREYDLEGACYQNDGLLHSSLTEGRFYKQRLPSSSPHFSQGESFVLEVISEPSDNALVGQTLKLPAEKGSLAEVQTYDWQNNRNENLQYNLEKDRLINLSPRLVEDQRSWLFLEVIAGPAIGLQHAVNSTSSSKLPVKLGRVSPSDLALKDSEVSGKHAQITWNSTKFKWELVDMGSLNGTLVNSHSISHPDLGSRKWGNPVELASDDIITLGTTTKVYVRISSQNEFQIPFKIGVASDPMAMRRGGRKLPMEDVCHYKWPLPGANKFGLFCVCDGHGGSGAAQSAIKIIPEVLANILSDSLRKEKVLSKRDASDVLRDMFAKTEARLEEHQYEGCTATVLLVWKDNEENFFAQCANLGDSACVIHLGGRYIQMTEDHRVVSLSERKRFQEAGLALRDGETRLFGINLARMLGDKFPKQQDSRFSAEPYISEPLRIDQSSKDVFAVLASDGLWDVVSPKKAVQLVLQMRDKERGRESSAEKIANGLLNEARAMRTKDNTSIIYLDFDTSL

SEQ ID NO: 767 - protein, 268 aa, Arabidopsis thaliana
MGDLYALDFDGVLCDSCGESSLSAVKAAKVRWPDLFEGVDSALEEWIVDQMHIVRPVVETGYENLLLVRLLLETKIPSIRKSSVAEGLTVDGILESWAKFKPVIMEAWDEDRDALVDLFGKVRDDWINKDLTTWIGANRFYPGVSDALKFASSKIYIVTTKQGRFAEALLREIAGVIIPSERIYGLGSGPKVEVLKLLQDKPEHQGLTLHFVEDRLATLKNVIKEPELDKWSLYLGTWGYNTEKERAEAAGIPRIQVIELSTFSNKLK

SEQ ID NO: 768 - protein, 254 aa, Arabidopsis thaliana
MGLIKNTVHYCCVSRDNQILYSYNGGDQTNESLAALCLEKSPPFHTWYFETIGKRRFGFLIGDGFVYFAIVDEVLKRSSVLKFLEHLRDEFKKAARENSRGSFTAMIGSINVEDQLVPVVTRLIASLERVAESSSNNELKSSNLGEQSEGSNSTKAPLLGRLSKQEKKKGKDHVIELEEHRKSNDRGNITDDSAGAGTSLEKECVSSSGRSVTQSFEWKWRRLVQIVLAIDAAICLTLFGIWLAICRGIECTRS

SEQ ID NO: 769 - protein, 194 aa, Arabidopsis thaliana
MCSLSAIMLLPTKLKPAYSDKRSNSSSSSSLFFNNRRSKKKNQSIVPVARLFGPAIFESSKLKVLFLGVDEKKHPSTLPRTYTLTHSDITAKLTLAISQSINNSQLQGWANRLYRDEVVAEWKKVKGKMSLHVHCHISGGHFLLDLFAKFRYFIFCKELPVVLKAFVHGDGNLLNNYPELQEALVWVYFHSNVN

SEQ ID NO: 770 - protein, 85 aa, Arabidopsis thaliana
MANKALIHLLVIFFLALSHIFFFPSHASRLGSLMEKPKIVRPQQDTLMDVKKEVEERMVMELNDYPGSGANNRHLPRQRGCVVDC

SEQ ID NO: 771 - protein, 101 aa, Arabidopsis thaliana
MPPRTGKDKQNPRLPPEVTRLLYICNLPFSITSEDTYDLFGRYSTIRQVRIGCEKGTKGTAFVVYEDIYDAKKAVDHLWLQHSEPVPYRALLPTCEDEQEV

SEQ ID NO: 772 - protein, 156 aa, Arabidopsis thaliana
MGFSDAGIYLSDPNNLCQTELGFFHEPSLGFSDQSDPQNEFHITPPIYQELQDQDLEPKSQETNNCSRKEGATVKKEEEEEDDYCKTPTRSDQILSAMPRICPPAPRKPKRVPSRSLKVRNSYRSKRMIILNVSREIDCLFNPTSLCNKIKKARYI

SEQ ID NO: 773 - protein, 333 aa, Arabidopsis thaliana
MESLGKLQLHQQPNHLSFTHFSSSFPKKPSSFSLRSLPRSTSSFKCISIKASSSKSQDSKLSILKSTCVSFTAAAALFLVNLQLKPSPAIAAPVAATPLMESLKQSNGNVSFEEEERSLEEYLASHPDDVEALRSLMEVRIKSRKLLEAIELIDRLIELEPEEKEWPMLKANIFSYSGDLESAKTGFEEILVKDPLRVEAYHGLVMAYSDSGDDLNAVEKRIEEAMVRCKKEKNRKDLRDFKLLVAQIRVIEGKHNEALKLYEELVKEEPRDFRPYLCQGIIYTVLKKENEAEKQFEKFRRLVPKNHPYREYFMDNMVASKLFAEKVQREMAE

SEQ ID NO: 774 - protein, 182 aa, Arabidopsis thaliana
MGVEKMVCLASRTGRQFQRYNKGRRQVVGCVPYRFKLSNDGKISDEVEVLVISSQKGHALMFPKGGWELDESVEEAASRECLEEAGVLGNVEHQLGKWDFLSKSRGTYYEGLMFPMLVTEQLELWPEQHVRQRIWMNVTEAREACRDWWMKEALDVLVERLSSPMNQPKEEKTMSISIETMC

SEQ ID NO: 775 - protein, 66 aa, Arabidopsis thaliana
MVIKKIELCIEITKITMEFLVVVADAVTIFLRQSSPPPPALLRHGLYSYSASPNPPSSHYIIGFLP

SEQ ID NO: 776 - protein, 266 aa, Arabidopsis thaliana
MENPAKRVLMTSNGDEVSRNIAFHLAKHGCKLVMMGNEGSLRSIVDKIRDSIEGAFPADVIALDMESDSEVAFHAAVQKAWELSGHFDAFLNSYTYQGKVQDILQVSQDEFHRITKINLTAPWFLLKAVATRMKDHGSGGSIVFMATIASGERALYPGADAYASTSAAIHQLVRASAMSLGKHKIRVNMISRGLHLDDEYTASVGRDRAQKLVKDAAPLGQWLNPDTDLYSTVIYLISDGSRFMTGTTVLVDGAQSLTRPRLKSYM

SEQ ID NO: 777 - protein, 334 aa, Arabidopsis thaliana
MDAFDAIPDPVVIDILNRVGDVKTLIRCRSVSKRFNSLATQSESLLLQLDQILGATESDSEIDSPIASFFRSLFKSIHGLLPPIFSKPANSDEILTRSPKTPAQILSGFERIRNLEVELYGGDVKLEKGAAVKWKAEFGKTLKSCVIVAFRSATVNTSAATEAAAVVDGVVESDSEFVCGLKTRVVWTISALMAASTRHYLMRDLVKDHKEMEKLIVRDSDGEGTVVMDAAGMKEYRETEVRGDNKESERVGERTVVPSVRMSMRHAPSLMLKSGICLEAATLVVVRPTGVASDDNDVELVTEAFAGDGDDCMYGEAVTALLKRRRNVLEMNSF

SEQ ID NO: 778 - protein, 206 aa, Arabidopsis thaliana
MASDQSTNPPIMEAKTRHPLHQIADTPTHKLLLKQWLKEEELILSRVSHKESQIDSVRREITQLYIFFFLFHSISLLLLFHASSSSSSSASSSACKRSWIPSLCALLSSLGIIWAVRYKSEVESHLEKLLEREKEDAKLLRKCVEELKKKGIEFDLLKEVDALRRAKSLRVESKPVKKWSARDFVTLFFFSVSCLVLAMIRLILCD

SEQ ID NO: 779 - protein, 585 aa, Arabidopsis thaliana
MGSIEEEARPLIEEGLILQEVKLYAEDGSVDFNGNPPLKEKTGNWKACPFILGNECCERLAYYGIAGNLITYLTTKLHQGNVSAATNVTTWQGTCYLTPLIGAVLADAYWGRYWTIACFSGIYFIGMSALTLSASVPALKPAECIGDFCPSATPAQYAMFFGGLYLIALGTGGIKPCVSSFGADQFDDTDSRERVRKASFFNWFYFSINIGALVSSSLLVWIQENRGWGLGFGIPTVFMGLAIASFFFGTPLYRFQKPGGSPITRISQVVVASFRKSSVKVPEDATLLYETQDKNSAIAGSRKIEHTDDCQYLDKAAVISEEESKSGDYSNSWRLCTVTQVEELKILIRMFPIWASGIIFSAVYAQMSTMFVQQGRAMNCKIGSFQLPPAALGTFDTASVIIWVPLYDRFIVPLARKFTGVDKGFTEIQRMGIGLFVSVLCMAAAAIVEIIRLHMANDLGLVESGAPVPISVLWQIPQYFILGAAEVFYFIGQLEFFYDQSPDAMRSLCSALALLTNALGNYLSSLILTLVTYFTTRNGQEGWISDNLNSGHLDYFFWLLAGLSLVNMAVYFFSAARYKQKKASS

SEQ ID NO: 780 - protein, 259 aa, Arabidopsis thaliana
MARDGGVSCLRRSEMMSVGGIGGIESAPLDLDEVHVLAVDDSLVDRIVIERLLRITSCKVTAVDSGWRALEFLGLDNEKASAEFDRLKVDLIITDYCMPGMTGYELLKKIKESSNFREVPVVIMSSENVLTRIDRCLEEGAQDFLLKPVKLADVKRLRSHLTKDVKLSNGNKRKLPEDSSSVNSSLPPPSPPLTISPESSPPLTVSTESSDSSPPLSPVEIFSTSPLSSPIDDEDDDVLTSSSEESPIRRQKMRSPGLD

SEQ ID NO: 781 - protein, 202 aa, Arabidopsis thaliana
MRPPMRGGGGFRGRGGRDGGGGGRFGGGGGRFGGGGGRFGGGGGRFGGFRDEGPPSEVVEVATFVHACEGDAVTKLSQEKIPHFNAPIYLENKTQIGKVDEIFGPINESLFSIKMMEGIVATSYSPGDKFFIDPYKLLPLARFLPQPKGQSTGGRGGAGRGRGDSRGRGRGGSFSRGRGAPRGGRFPPRGGSRGSFRGRGRF

SEQ ID NO: 782 - protein, 186 aa, Arabidopsis thaliana
MAEVMLPRKMEILNHSSKFGSPDPLHVLAVDDSHVDRKFIERLLRVSSCKVTVVDSATRALQYLGLDVEEKSVGFEDLKVNLIMTDYSMPGMTGYELLKKIKESSAFREVPVVIMSSENILPRIDRCLEEGAEDFLLKPVKLSDVKRLRDSLMKVEDLSFTKSIQKRELETENVYPVHSQLKRAKI

SEQ ID NO: 783 - protein, 801 aa, Arabidopsis thaliana
MLRRLGWLIGLSQRSRQTKSIDAEPYVARVKPVLMIDTVQEIAIYIHRFHNLDLFQQGWYQIKISMRWEDGDNNSCGIPSRVVQYEALDSTSNDSYGVWKIDDKDSSFLTQPFRIKYARQDVRLCMMVSFTMPLERYEGSATSAVILKFELLYSPIMEDIPVTHSDACAAAVHEFRIPPKALSGVHSYCPVHFDTFHAVLIDVSVHVSVMKSAAYKRPAILSSDASNGKNLTSGNIQSSKKAFTQIASADKKLVSFVKALLGARDTLLEEMQRLSKAVGQTVDLSEFVSSMDNALLSDSGSTGKSVEVEGSGQGKLQNNLELNGPFDLASDDWLHNFSKEHLSRTFHLLGTQLHYLWNTFLTLHRDNYTKILEYLRDIWTKDRRAEWSIWMVYSKVEMPHHFISGMEDISNHSSHKRVSTGLKLNDPAQVASTRAELHRRSIAQMRINNRAIQDMHIFGDPMRVPIVIIERVWNAPRRTFSDNSYMRHVDRIDSSLLNGHDDESGTKKHINPQHTGRELKIVVFVHGFQGHHLDLRLIRNQWLLIDPKIEFLMSEANEERTHGDFREMGQRLAQEVVSFFKRKKDKHARYGRLKNIKLSFVGHSIGNVIIRAAIADSLMDPYRKYFHTYISLSGPHLGYLYSSNSLFNSGLWLLKKLKSTQVIHQLTLTDDPDLQNTFFYKLCKQKTLCSFKNIILLSSPQDGYVPYHSARIESCQPASFDNSKRGVAFLEMLNNCMDQIRGPSPETPHHQRVFMRCDVNFDTTLYGRNLNSFIGRAAHIEFLESDVFARFIMWSFQDLFR

SEQ ID NO: 784 - protein, 252 aa, Arabidopsis thaliana
MTEVVLHIYDVTNSGSEKTNNTIVQINRFFKDGIGLGGIFHSAIQVYGNDEWSYGYCELGTGVFSCPSGKNPMYTYREKIVLGKTDCTIFMVNQMLRELSREWPGHTYDLLSKNCNHFCDVLCDRLGVPKIPGWVNRFANAGDTALEVAGNTAMRMKQAKTELVSASKVAYRFLSNVTSNVTNGSNGSPQRPGTLNNSDSGNLRLQGSWLKGLLNTAKPSTSTEIGNKDEDANHAVTNQKKQSRDSDVLLFQ

SEQ ID NO: 785 - protein, 108 aa, Arabidopsis thaliana
MDSSLSQKFTLAYASLLGVGGLMGYLKRGSKISLVAGGGSAALFYYVYTELPGNPVLASSIGIVGSAALTGMMGSRYLRTRKVVPAGLVSVVSLVMTGAYLHGLIRSS

SEQ ID NO: 786 - protein, 242 aa, Arabidopsis thaliana
MLEAPVNKSSILNGGGGGFSQLQSCFGDCSSEEELSVLPRHTKVVVTGNNRTKSVLVGLQGVVKKAVGLGGWHWLVLTNGIEVKLQRNALSVLEHPTGNEEDNDLEVDHSTQWNHPSDMTTEDTLKPHKSKKRGHRSSRLSQKALYREVSCDSHSKISSITPRLNMKVDLTKLDMAALLRYWRHFNLVDALPNPTKEQLIDIIQRHFMSQQMDELQVIVGFVQAATGMKKACQVEDQRSQKH

SEQ ID NO: 787 - protein, 320 aa, Arabidopsis thaliana
MGRKRKHSETEAPAPVKKSDEPAPDRPKRTLLGWKDKSEGEAEKAKALTSSGFKNKEKVLVTCSRRISFRYRSLMLNIVSLLPHCKKDSKVEAKSSKGATLNELIELKNSNSCLFFECRKHKDLYMWMVKSPNGPSVKFLVKAVHAMEEMKLTGNHLKGSRPLLTFSSNFDKDAHWKLLKEMLTQVFGIPKEHRKSKPYHDHVFVFSIVDEHIWFRNYQISVPHNESDKIAKGGLDKMTLIEVGPRFCLNPIKIFAGSFGGPTLYENPLYVSPNQIRALEKRNKAGKFAKKIKAKTRKKMHELSNPLEPDEFADMWKDDE

SEQ ID NO: 788 - protein, 578 aa, Arabidopsis thaliana
MDLPEECWELICKAIDEDDYRFLESVSLVSTLFLSITNRVRSTFVVTDRAVPLLNRHLLRFRNLKRIRFSDFTQDLNSILLQVSRSGLDFESVDVSQTRYFPDFEMKNVKELKCYGVGGFSDSDLVSIGVNFPLLEKLDISYPNSSPSRVSDSGVIELSSNLKGLLKINISGNSFITDKSLIALSQNCLLLREIIFRDCDFISSDCIKFVLRNSRNLESLAINGIGLRPRESLLTDAFLFARCLTELDLSDSFLSDDLLCLIASAKLPLKKLLLSDCHGFTFDGILYLLDKYQSLVHLNLKGANFLSDEMVMKLGMFFRRLTFLNLSFCSKLTGLAFFSIIERCVSLRCMIMVGTNFGVEEYTKDTKDFKSGVKFLYLSRNHNLLDECLEKISRHCPFIESLDVAQCPGITRDGILEVWRNCGKLRSLDISRCTGIKSLGVVDFELPKLESLRACGTWIDDEALDMISKKCRGLLHLDLQGCLNVSSRGVKEVVQSCIRLREINLKYCEADKKMYTWMVFANPSLRKIVPPCGFSPTKALKNFFLRHGCVVSQDSSELLSIAYRANGRDDDTLTRLII

SEQ ID NO: 789 - protein, 813 aa, Arabidopsis thaliana
MNCNVLFLLSVLVSVTAGVTAAYHPTDVFLFNCGDTSNNVDNSGRNWTVESRQILSSNLVNASFTSEASYQKAGVSRIPYMKARIFRSEFTYSFPVTPGSIFLRLYFYPTQYKSGFDAVNSFFSVKVNGFTLLRNFNADSTVQASIPLSNSLIKEFIIPVHQTLNLTFTPSKNLLAFVNGIEIVSMPDRFYSKGGFDNVLRNVSSDVDFQIDNSTAFESVHRLNVGGQIVNEVDDSGMFRRWLSDDSFGNSGSIVNVPGVKINYTEKTPAYVAPYDVYATSRLMGNSSNLMFNLTGMFLTVDAGYNYLVRLHFCETLPQVTKAGQRVFSIFVEDKMAKKETDVIRLSGGPRIPMYLDFSVYVGFESGMIQPELRLDLVPLKDTNQTYYDAILSGVEILKLNDSDGNLARPNPELLVSTDSTPDDSNVTPPIKGKPHVLVIILIVVGSVIGLATFIVIIMLLIRQMKRKKNKKENSVIMFKLLLKQYIYAELKKITKSFSHTVGKGGFGTVYRGNLSNGRTVAVKVLKDLKGNGDDFINEVTSMSQTSHVNIVSLLGFCYEGSKRAIISEFLEHGSLDQFISRNKSLTPNVTTLYGIALGIARGLEYLHYGCKTRIVHFDIKPQNILLDDNFCPKVADFGLAKLCEKRESILSLIDTRGTIGYIAPEVVSRMYGGISHKSDVYSYGMLVLDMIGARNKVETTTCNGSTAYFPDWIYKDLENGDQTWIIGDEINEEDNKIVKKMILVSLWCIRPCPSDRPPMNKVVEMIEGSLDALELPPKPSRHISTELVLESSSLSDGQEAEKQTQTLDSTII

SEQ ID NO: 790 - protein, 472 aa, Arabidopsis thaliana
MSVYDAAFLNTELSKPTSIFGLRLWVVIGILLGSLIVIALFLLSLCLTSRRKNRKPRADFASAAIATPPISKEIKEIVPAQNQSVPAEIQVDIGKIEHRVVFSDRVSSGESRGTASASETASYSGSGNCGPEVSHLGWGRWYTLRELEAATNGLCEENVIGEGGYGIVYRGILTDGTKVAVKNLLNNRGQAEKEFKVEVEVIGRVRHKNLVRLLGYCVEGAYRMLVYDFVDNGNLEQWIHGDVGDVSPLTWDIRMNIILGMAKGLAYLHEGLEPKVVHRDIKSSNILLDRQWNAKVSDFGLAKLLGSESSYVTTRVMGTFGYVAPEYACTGMLNEKSDIYSFGILIMEIITGRNPVDYSRPQGETNLVDWLKSMVGNRRSEEVVDPKIPEPPSSKALKRVLLVALRCVDPDANKRPKMGHIIHMLEAEDLLYRDERRTTRDHGSRERQETAVVAAGSESGESGSRHHQQKQR

SEQ ID NO: 791 - protein, 438 aa, Arabidopsis thaliana
MSCSSSSGSEGEEEGFDAYRKGGYHAVRIGDPFSGGRYIAQRKLGWGQFSTVWLAYDTLTSTYVALKIQKSAQQFAQAALHEIEFLSAAADGDLDKTKCVVRLIDHFKHSGPNGQHLCMVLEFLGDSLLRLIRYNQYKGLKLNKVREICRCILTGLDYLHRELGMIHSDLKPENILLCSTIDPAKDPVRSGLTPLLEKPEGNANGGASTMNLIEKKLKRRAKRAVAKISERRVSMVTGEEASSKTEKSLDGIDMRCKVVDFGNACWADKQFAEEIQTRQYRAPEVILKSGYSFSVDMWSFGCTAFELVTGDMLFAPKDGNGYGEDEDHLALMMELLGKMPRKIAIGGAKSKDYFDRHGDLKRIRRLKYWPLDRLLIDKYKLPEAEAKEFAEFLTPILEFAPEKRPTAQQCLDHPWMNVTTQNDAENVDDQMNNLHIKG

SEQ ID NO: 792 - protein, 138 aa, Arabidopsis thaliana
MAGLQRSTISFRRQGSSGIVWDDRLIAELSQQAANDRKGETLQQDEQAKLITSEVQDQTTKPIAGEGLKPIRTDGGMERSRSNGGGAIRHHRNTGRVSPAVDPPSPRLSAFGCCSAFGKKQPGKKVNQRKRPAKRRSR

SEQ ID NO: 793 - protein, 581 aa, Arabidopsis thaliana
MEKVTNSDLKSSVDGGVVDVYGEDSATIEHNITPWSLSVSSGYSLLRDPRYNKGLAFTEKERDTHYLRGLLPPVVLDQKLQEKRLLNNIRQYQFPLQKYMALTELQERNERLFYKLLIDNVEELLPIVYTPTVGEACQKFGSIFRRPQGLFISLKDKGKILDVLKNWPERNIQVIVVTDGERILGLGDLGCQGMGIPVGKLALYSALGGVRPSACLPVTIDVGTNNEKLLNDEFYIGLRQKRATGQEYSELLNEFMSAVKQNYGEKVLIQFEDFANHNAFELLAKYSDTHLVFNDDIQGTASVVLAGLVSAQKLTNSPLAEHTFLFLGAGEAGTGIAELIALYMSKQMNASVEESRKKIWLVDSKGLIVNSRKDSLQDFKKPWAHEHEPVKDLLGAIKAIKPTVLIGSSGVGRSFTKEVIEAMSSINERPLIMALSNPTTQSECTAEEAYTWSKGRAIFASGSPFDPVEYEGKVFVSTQANNAYIFPGFGLGLVISGAIRVHDDMLLAAAEALAGQVSKENYEKGMIYPSFSSIRKISAQIAANVATKAYELGLAGRLPRPKDIVKCAESSMYSPTYRLYR

SEQ ID NO: 794 - protein, 358 aa, Arabidopsis thaliana
MSSFTSKFADELIANAAYIGTPGKGILAADESTGTIGKRLASINVENVESNRRALRELLFTTPGALPCLSGVILFEETLYQKSSDGTPFVDMLKSAGVLPGIKVDKGTVELAGTNGETTTQGLDGLGDRCKKYYEAGARFAKWRAVLKIGVNEPSQLAIHENAYGLARYAVICQENGLVPIVEPEILVDGSHDIQKCAAVTERVLAACYKALSDHHVLLEGTLLKPNMVTPGSESAKVAPEVIAEHTVRALQRTVPAAVPAIVFLSGGQSEEEATRNLNAMNQLKTKKPWSLSFSFGRALQQSTLKTWGGKEENVKKAQEAFLVRCKANSEATLGAYKGDAKLGEGAAESLHVKDYKY

SEQ ID NO: 795 - protein, 469 aa, Arabidopsis thaliana
MSSRSDLKIKRVSLIIFLLSVLVEFCYGGFTSEYVRGSDLPDDMPLDSDVFEVPPGHNSPQQVHVTQGNHEGNGVIISWVTPVKPGSKTVQYWCENEKSRKQAEATVNTYRFFNYTSGYIHHCLIDDLEFDTKYYYEIGSGKWSRRFWFFIPPKSGPDVPYTFGLIGDLGQTYDSNSTLSHYEMNPGKGQAVLFVGDLSYADRYPNHDNNRWDTWGRFVERSVAYQPWIWTAGNHEIDFVPDIGEIEPFKPFMNRYHTPHKASGSISPLWYSIKRASAYIIVMSCYSSYGIYTPQYKWLEKELQGVNRTETPWLIVLVHSPFYSSYVHHYMEGETLRVMYEQWFVKYKVDVVFAGHVHAYERSERVSNIAYNIVNGLCEPISDESAPIYITIGDGGNSEGLLTDMMQPQPKYSAFREASFGHGLLEIKNRTHAYFSWNRNQDGNAVAADSVWLLNRFWRAQKKTWLDAF

SEQ ID NO: 796 - protein, 518 aa, Arabidopsis thaliana
MESCFPAMKLNQCTFGLNNEIVSERVSAFWGTQVVKPNHLRTTKLRSAPQKKIQTNLIRSVLTPFVDQESHEPLLRTQNADPKNVASIILGGGAGTRLFPLTSKRAKPAVPIGGCYRLIDIPMSNCINSGIRKIFILTQFNSFSLNRHLSRTYNFGNGVNFGDGFVEVLAATQTSGDAGKKWFQGTADAVRQFIWVFEDAKTKNVEHVLILSGDHLYRMDYMNFVQKHIESNADITVSCLPMDESRASDFGLLKIDQSGKIIQFSEKPKGDDLKAMQVDTSILGLPPKEAAESPYIASMGVYVFRKEVLLKLLRSSYPTSNDFGSEIIPLAVGEHNVQAFLFNDYWEDIGTIGSFFDANLALTEQPPKFQFYDQKTPFFTSPRFLPPTKVDKCRILDSIVSHGCFLRECSVQHSIVGIRSRLESGVELQDTMMMGADFYQTEAEIASLLAEGKVPVGVGQNTKIKNCIIDKNAKIGKNVVIANADGVEEGDRPEEGFHIRSGITVVLKNATIRDGLHI

SEQ ID NO: 797 - protein, 428 aa, Arabidopsis thaliana
MATAFAPTKLTATVPLHGSHENRLLLPIRLAPPSSFLGSTRSLSLRRLNHSNATRRSPVVSVQEVVKEKQSTNNTSLLITKEEGLELYEDMILGRSFEDMCAQMYYRGKMFGFVHLYNGQEAVSTGFIKLLTKSDSVVSTYRDHVHALSKGVSARAVMSELFGKVTGCCRGQGGSMHMFSKEHNMLGGFAFIGEGIPVATGAAFSSKYRREVLKQDCDDVTVAFFGDGTCNNGQFFECLNMAALYKLPIIFVVENNLWAIGMSHLRATSDPEIWKKGPAFGMPGVHVDGMDVLKVREVAKEAVTRARRGEGPTLVECETYRFRGHSLADPDELRDAAEKAKYAARDPIAALKKYLIENKLAKEAELKSIEKKIDELVEEAVEFADASPQPGRSQLLENVFADPKGFGIGPDGRYRCEDPKFTEGTAQV

SEQ ID NO: 798 - protein, 709 aa, Arabidopsis thaliana
MVGGGGGSSGRGGGSGSGSSKQQRGFSMNPKDYKLMEEIGHGASAVVYRAIYLPTNEVVAIKCLDLDRCNSNLDDIRRESQTMSLIDHPNVIKSFCSFSVDHSLWVVMPFMAQGSCLHLMKTAYSDGFEESAICCVLKETLKALDYLHRQGHIHRDVKAGNILLDDNGEIKLGDFGVSACLFDNGDRQRARNTFVGTPCWMAPEVLQPGNGYNSKADIWSFGITALELAHGHAPFSKYPPMKVLLMTIQNAPPGLDYDRDKKFSKSFKEMVAMCLVKDQTKRPTAEKLLKHSCFKHTKPPEQTVKILFSDLPPLWTRVKSLQDKDAQQLALKRMATADEEAISQSEYQRGVSAWNFDVRDLKTQASLLIDDDDLEESKEDEEILCAQFNKVNDREQVFDSLQLYENMNGKEKVSNTEVEEPTCKEKFTFVTTTSSLERMSPNSEHDIPEAKVKPLRRQSQSGPLTSRTVLSHSASEKSHIFERSESEPQTAPTVRRAPSFSGPLNLSTRASSNSLSAPIKYSGGFRDSLDDKSKANLVQKGRFSVTSGNVDLAKDVPLSIVPRRSPQATPLRKSASVGNWILEPKMPTAQPQTIKEHSSHPTSSSPIMPQLQHLFQQNSIQQDLIMNLLNSLQPVEATEGSQSGKLPPLPRSDSNGNVEPVASERERLLLSSISDLRARLDDLTEELDIEKSKYSQLQQKLKAFTGREH

SEQ ID NO: 799 - protein, 495 aa, Arabidopsis thaliana
MVFSVSIFASLAPYLISAFLLFLLVEQLSYLFKKRNIPGPFFVPPITGNAVALVRDPTSFWDKQSSTANISGLSANYLIGKFIVYIRDTELSHQIFSNVRPDAFHLIGHPFGKKLFGDHNLIYMFGEDHKSVRRQLAPNFTPKALSTYSALQQLVILRHLRQWEGSTSGGSRPVSLRQLVRELNLETSQTVFVGPYLDKEAKNRFRTDYNLFNLGSMALPIDLPGFAFGEARRAVKRLGETLGICAGKSKARMAAGEEPACLIDFWMQAIVAENPQPPHSGDEEIGGLLFDFLFAAQDASTSSLLWAVTLLDSEPEVLNRVREEVAKIWSPESNALITVDQLAEMKYTRSVAREVIRYRPPATMVPHVAAIDFPLTETYTIPKGTIVFPSVFDSSFQGFTEPDRFDPDRFSETRQEDQVFKRNFLAFGWGPHQCVGQRYALNHLVLFIAMFSSLLDFKRLRSDGCDEIVYCPTISPKDGCTVFLSRRVAKYPNFS

SEQ ID NO: 800 - protein, 508 aa, Arabidopsis thaliana
MGSANNEYEFLSEIGLTSHNLGSYVAGKWQANGPLVSTLNPANNQPIAQVVEASLEDYEQGLKACEEAAKIWMQVTAPKRGDIVRQIGDALRSKLDYLGRLLSLEMGKILAEGIGEVQEVIDMCDFAVGLSRQLNGSVIPSERPNHMMLEMWNPLGIVGVITAFNFPCAVLGWNACIALVCGNCVVWKGAPTTPLITIAMTKLVAEVLEKNNLPGAIFTAMCGGAEIGEAIAKDTRIPLVSFTGSSRVGSMVQQTVNARSGKTLLELSGNNAIIVMDDADIQLAARSVLFAAVGTAGQRCTTCRRLLLHESVYDKVLEQLLTSYKQVKIGNPLEKGTLLGPLHTPESKKNFEKGIEVIKSQGGKILTGGKAVEGEGNFVEPTIIEISADAAVVKEELFAPVLYVLKFKSFGEAVAINNSVPQGLSSSIFTRNPENIFRWIGPLGSDCGIVNVNIPTNGAEIGGAFGGEKATGGGREAGSDSWKQYMRRSTCTINYGNELPLAQGINFG

SEQ ID NO: 801 - protein, 70 aa, Arabidopsis thaliana
MAFVVTSLIFAVVGIIASICTRICFNKGPSTNLLHLTLVITATVCCWMMWAIVYIAQMNPLIVPILSEVE

SEQ ID NO: 802 - protein, 337 aa, Arabidopsis thaliana
MSYSGAGLGKPGSGKRRIRDLLTQSDNRVCADCGAPDPKWASANIGVFICLKCCGVHRSLGSHISKVLSVTLDEWSDEEVDSMIEIGGNASANSIYEAFIPEGSSKPGPDASHDQRMRFIRSKYEHQEFLKPSLRITSVRGSSTKTPAFLSSSLSKKIVDSFRTNSSSQQPQLEGMVEFIGLLKVTIKKGTNMAIRDMMSSDPYVVLTLGQQKAQSTVVKSNLNPVWNEELMLSVPHNYGSVKLQVFDYDTFSADDIMGEAEIDIQPLITSAMAFGDPEMFGDMQIGKWLKSHDNALIEDSIINIADGKVKQEVQIKLQNVESGELELEMEWLPLEQ

SEQ ID NO: 803 - protein, 354 aa, Arabidopsis thaliana
MQSEFLELRQRIKESIRTKMQSGDTIIAPTSQTQLHQSKSNLPYDFGSFFGPSQTVIASRVLQESKPLLENETSAAKMLNSIQNVCLIRSFFFTFLTLQKKSSVLMNDASGTKNANEVKRKAEKLKDGRDYSFLFSDDAQLPVSIKEPPTSRPSSTESQMQPRPGSSNNVQAHTREDSAINSQKRKSMNKKGQPSSKLGHQRPLSSTKPLRHDSKQQRVEQRNVSLELTRSQLPPAKHQLISKPPLKRVKKKPVKMSEDDLALQMVRKMCKTDRFAGRDEDYDDRCMEANFDDIMREEKRSERLAKKEDAEQLRLVEEEERVRRQKKQKLSHLKNCGLGLKNLRVSNFKVTFLL

SEQ ID NO: 804 - protein, 304 aa, Arabidopsis thaliana
MAATLPLSPINHQLCRFGNNSLTTHRFCSPGFLISSPCFIGLTGMGSATQLRARRSLISSAVATNSLLHDVGATVAVLGGAYALVLSFESLTKRNVIQQSLSRKLVHILSGLLFVLAWPIFSGSTEARYFAAFVPLVNGLRLVINGLSISPNSMLIKSVTREGRAEELLKGPLFYVLALLFSAVFFWRESPIGMISLAMMCGGDGIADIMGRKFGSTKIPYNPRKSWAGSISMFIFGFFISIALLYYYSSLGYLHMNWETTLQRVAMVSMVATVVESLPITDQLDDNISVPLATILAAYLSFGY

SEQ ID NO: 805 - protein, 212 aa, Arabidopsis thaliana
MIPRNPTQSSKNLGFSSFLSCAPSMDSRISVSRLSLNHPGSKFGFSLDTRVRNEFIVRAEEGNTEAESEEFVAEIADTEGNVEEVVEAKPTRKPRIKLGDVMGILNQKAIEVAEKVRPVPEIRTGDIVEIKLEVPENKRRLSIYKGIVMSRQNAGIHTTIRIRRIIAGIGVEIVFPIYSPNIKEIKVVSHRKVRRARLYYLRDKLPRLSTFK

SEQ ID NO: 806 - protein, 613 aa, Arabidopsis thaliana
PLINPGAPDLSQVCTKKQAPAGPWHYFSPSYRTLVGLYYIFTLMHTAVSTPPDDPVKCVSGNTNCTVTNSYGAFPDRSTCRAANVAYPKTEAELVSVVAAATQAGRKMRVTTRYSHSITKLVCTDGTEGLFISTKFLNHTVQADATAMTMTVESGMTLRQLIVEAAKVGLALPYAPYWWGLTVGGMMGTGAHGSSLWGKGSAVHDYVTEIRMVSPGSVNEGFAKIRILSETTTPNEFNAAKVSLGVLGVISQVTFELQPMFKRSLTYTMRNDSDFEDQAVTFGKKHEFADFIWLPSQGKVVYRRDDRVAVNTSGNGLFDFLPFRSQLSAAIAIIRTSEETQERFRDANGKCVGATIISSTLFAPSYGLTNNGIIFTGYPVVGSQNRMMSSGSCLDSLQDGLITACAWDSRIKGEFFHQTTLSVPLTQVKSFISDIKSLVKIEQKSLCGLELHYGILMRYVTSSPAYLGKETEALDFDITYYRAKDPLTPRLYEDFIEEIEQIALFKYNALPHWGKNRNLAFDGVIRKYNNAPAFLKVKDSYDPKGLFSSEWTDQILGIKGNASIVKDGCALEGLCICSKDAHCAPAKGYLCRPGKVYKEARVCTRVDGIISVI

SEQ ID NO: 807 - protein, 619 aa, Arabidopsis thaliana
MVMNNPANNNPVAASSASAVALAPPPHPPQPHRPSTSCDRHPDERFTGFCPSCLFDRLSVLDITGKNNNAVASSSKKPPSSSAALKAIFKPSSSSGSFFPELRRTKSFSASKAEAFSLGAFEPQRRSCDVRVRNTLWSLFHEDAEHNSQTKEGLSVNCSEIDLERINSIVKSPVFEEETEIESEQDNEKDIKFETFKEPRSVIDEIVEEEEEEETKKVEDFTMEFNPQTTAKKTNRDFKEIAGSFWSAASVFSKKLQKWRQKQKLKKHRTGNLGAGSSALPVEKAIGRQLRDTQSEIAEYGYGRRSCDTDPRFSIDAGRFSLDAGRVSVDDPRYSFEEPRASWDGYLIGRAAAPMRMPSMLSVVEDSPVRNHVHRSDTHIPVEKSPQVSEAVIDEIVPGGSAQTREYYLDSSSSRRRKSLDRSSSTRKLSASVMAEIDELKLTQDREAKDLVSHSNSLRDDCCSVENNYEMGVRENVGTIECNKKRTKKSRWSWNIFGLLHRKNGNKYEEEERRSGVDRTFSGSWNVEPRNGFDPKMIRSNSSVSWRSSGTTGGGLQRNSVDGYISGKKKVSKAENGMLKFYLTPGKGRRRGSGNSTAPTSRPVPASQPFGSRNVMNFY

SEQ ID NO: 808 - protein, 499 aa, Arabidopsis thaliana
MARKMLVDGEIDKVAADEANATHYDFDLFVIGAGSGGVRAARFSANHGAKVGICELPFHPISSEEIGGVGGTCVIRGCVPKKILVYGATYGGELEDAKNYGWEINEKVDFTWKKLLQKKTDEILRLNNIYKRLLANAAVKLYEGEGRVVGPNEVEVRQIDGTKISYTAKHILIATGSRAQKPNIPGHELAITSDEALSLEEFPKRAIVLGGGYIAVEFASIWRGMGATVDLFFRKELPLRGFDDEMRALVARNLEGRGVNLHPQTSLTQLTKTDQGIKVISSHGEEFVADVVLFATGRSPNTKRLNLEAVGVELDQAGAVKVDEYSRTNIPSIWAVGDATNRINLTPVALMEATCFANTAFGGKPTKAEYSNVACAVFCIPPLAVVGLSEEEAVEQATGDILVFTSGFNPMKNTISGRQEKTLMKLIVDEKSDKVIGASMCGPDAAEIMQGIAIALKCGATKAQFDSTVGIHPSSAEEFVTMRSVTRRIAHKPKPKTNL

SEQ ID NO: 809 - protein, 203 aa, Arabidopsis thaliana
MEFWGIEIKPGKPFKVIQKDGFMVHASQVTLGDVEKVKKDETFAVYVKIGDDENGFMIGNLSQKFPQFSIDLYLGHEFEISHNSTSSVYLIGYRTFDAFDELDEEIDSDSELDEYMEQQIAALPQNEINPEEDDESDSDEMGLDEDDDSSDEEDVEAEAPLKVAPPSKKMPNGAFEIAKGGKKNKSSGGKKRCPFPCGPSCKK

SEQ ID NO: 810 - protein, 224 aa, Arabidopsis thaliana
MDSNWINCPSVFSSSSSSSRRCQSRSDLYLGGGYEDLEGEDDLKAEFICPFCAEDFDIVGLCCHIDEEHPVEAKNGVCPVCTKRVGLDIVGHITTQHANFFKVQRRRRLRRGGYSSTYLALKKELREANLQSLLGGSSSFTSSTNIDSDPLLSSFMFNSPSVNQSANKSATPVTVGNAATKVSIKESLKRDIQEAPLSGEDQEKAKKSEFVRGLLLSTMLEDDF

SEQ ID NO: 811 - protein, 988 aa, Arabidopsis thaliana
MGSVKRKSVEESSDSAPPQKVQREDDSTQIINEELVGCVHDVSFPENYVPLAPSVHNKPPAKDFPFTLDSFQSEAIKCLDNGESVMVSAHTSAGKTVVASYAIAMSLKENQRVIYTSPIKALSNQKYRDFKEEFSDVGLMTGDVTIDPNASCLVMTTEILRSMQYKGSEIMREVAWIIFDEVHYMRDSERGVVWEESIVMAPKNSRFVFLSATVPNAKEFADWVAKVHQQPCHIVYTDYRPTPLQHYVFPAGGNGLYLVVDEKSKFHEDSFQKSLNALVPTNESDKKRDNGKFQKGLVIGKLGEESDIFKLVKMIIQRQYDPVILFSFSKKECEALAMQMSKMVLNSDDEKDAVETIFASAIDMLSDDDKKLPQVSNILPILKRGIGVHHSGLLPILKEVIEILFQEGLIKCLFATETFSIGLNMPAKTVVFTNVRKFDGDKFRWLSSGEYIQMSGRAGRRGIDKRGICILMVDEKMEPAVAKSMLKGSADSLNSAFHLSYNMLLNQLRCEEGDPENLLRNSFFQFQADRAIPDLEKQIKSLEEERDSLVIEEEESLKNYYNLILQYKSLKKDIREIVFTPKYCLPFLLPNRAVCPDCTNDDEEPQSFSIEDQDTWGVIMKFNKVKSLSEDDDSRRPEDANYTVDVLTRCMVSKDGVGKKKVKAVPIKERGEPVVVTVPLSQIKSLSSAIMNIPKDPVPLEARENALKKVSELLSRHPDGIPLDPEVDMKIKSSSYKKTVRRLEALENLFEKHKIAKSPLITEKLKVLQMKEELIAKIKSLKKTVRSSTALAFKDELKARKRVLRRLGYITSDNVVELKGKVACEISSAEELTLTELMFSGIFKDAKVEELVSLLSCFVWRERLPDAAKPRKELDLLFIQLQDTARRVAEVQLDCKVEIDVESFVQSFRPDIMEAVYAWAKGSKFYEVMEIARVFEGSLIRAIRRMEEVLQQLIVAAKSIGETQLEAKLEEAVSKIKRDIVFAASLYL

SEQ ID NO: 812 - protein, 449 aa, Arabidopsis thaliana
MADQTKKRYVTSEDLKKHNKPGDLWISIQGKVYDVSDWVKSHPGGEAAILNLAGQDVTDAFIAYHPGTAWHHLEKLHNGYHVRDHHVSDVSRDYRRLAAEFSKRGLFDKKGHVTLYTLTCVGVMLAAVLYGVLACTSIWAHLISAVLLGLLWIQSAYVGHDSGHYTVTSTKPCNKLIQLLSGNCLTGISIAWWKWTHNAHHIACNSLDHDPDLQHIPIFAVSTKFFNSMTSRFYGRKLTFDPLARFLISYQHWTFYPVMCVGRINLFIQTFLLLFSKRHVPDRALNIAGILVFWTWFPLLVSFLPNWQERFIFVFVSFAVTAIQHVQFCLNHFAADVYTGPPNGNDWFEKQTAGTLDISCRSFMDWFFGGLQFQLEHHLFPRLPRCHLRTVSPVVKELCKKHNLPYRSLSWWEANVWTIRTLKNAAIQARDATNPVLKNLLWEAVNTHG

SEQ ID NO: 813 - protein, 462 aa, Arabidopsis thaliana
MEIFYFVVFGGLAAIVAGLELSKSNKDRINTSSAFNSFKNNYLLVYSLMMAGDWLQGPYVYYLYSTYGFGKGEIGQLFIAGFGSSMLFGTIVGSLADKQGRKRASITYCITYILSCITKHSPQYKVLMVGRVLGGIATSLLFSAFESWLVAEHNKRGFEQQWLSVTFSKAIFLGNGLVAIIAGLFGNYLVDSLSLGPVAPFDAAACFLAIGMAVIISSWSENYGDPSENKDLLTQFKNAASAIASDEKIALLGAIQSLFEGSMYTFVFLWTPALSPNEEDIPHGFIFATFMLASMLGSSIASRLLAHSSPKVESYMQIVFVISSAALMLPVVTSFLVAPSGVKGGSISFSGCIQLMGFCTFEACVGIFWPSIMKMRSQYIPEEARSTIMNFFRIPLNIFVCLVLYNVDAFPMTVMFGMCSVFLFVASILQRRLMNVAEIHKSRSQEWSAEKEMTSEADPLNP

SEQ ID NO: 814 - protein, 305 aa, Arabidopsis thaliana
MTLYIRRESSKLWKRFCSEISTEIGLLAENWKYLLAGLICQYIHGLAAKGVHYIHRPGPTLQDLGFFLLPELGQERSYISETVFTSVFLSFFLWTFHPFILKTKKIYTVLIWCRVLAFLVACQFLRVITFYSTQLPGPNYHCREGSKVSRLPWPKSALEVLEINPHGVMYGCGDLIFSSHMIFTLVFVRTYQKYGTKRFIKLFGWLTAIVQSLLIIASRKHYSVDVVVAWYTVNLVVFCLDKKLPELPDRTAVLLPVISKDRTKEENHKLLNGNGVDPADWRPRAQVNGKIDSNGVHTDNTMNGA

SEQ ID NO: 815 - protein, 395 aa, Arabidopsis thaliana
MAAATTKLARALQQRRTFVNARVKWVSDHYLDEAVQREKNLKQVISLKDRIVSSPSKSLPLSSLSLLKPLVNLHITAAAFFQKYPSVFTTFQPSPSHPLHVRLTPQALTLHKEEETIHLSPPQRNVTVQRLTKFLMLTGAGSLPLYVLDRFRFDLGLPRDYITSLIGDYPEYFEVTEIKDRLTGEKTLALTISSRRNNLPVSEMERREATIDGSRVKKGLRIRYSMNFPKGYELHKRVKNWVEQWQNLPYISPYENAFHLGSYSDQAEKWAVAVLHELLFLLVSKKTETDNVICLGEYLGFGMRFKKALVHHPGIFYMSHKIRTQTVVLREAYHKVFLLEKHPLMGIRHQYIYLMSKSGRGKKRDYVHGVERSNRKKRVIKACEDGEIYAHNSSL

SEQ ID NO: 816 - protein, 346 aa, Arabidopsis thaliana
MGTSSDPIQDGSDEQQKRSEIYTYEAPWHIYAMNWSVRRDKKYRLAITSLLEQYPNRVEIVQLDESNGEIRSDPNLSFEHPYPPTKTIFIPDKECQRPDLLATSSDFLRLWRIADDHSRVELKSCLNSNKNSEFCGPLTSFDWNEAEPRRIGTSSTDTTCTIWDIEREAVDTQLIAHDKEVFDIAWGGVGVFASVSADGSVRVFDLRDKEHSTIIYESSEPDTPLVRLGWNKQDPRYMATIIMDSAKVVVLDIRFPALPVVELQRHQASVNAIAWAPHSSCHICTAGDDSQALIWDISSMGQHVEGGLDPILAYTAGAEIEQLQWSSSQPDWVAIAFSTKLQILRV

SEQ ID NO: 817 - protein, 1147 aa, Arabidopsis thaliana
MDRNRPPHPFQQHAMEPGYVNDSVPQGFTPDQTGLSNANVRPNPADVKPGLHYSIQTGEEFSLEFLRDRVISQRSANPIAAGDINYPTGYNGHAGSEFGSDVSRMSMVGNGIRQYERTNPPVHEFGNKLGHIHSAPEASLCQDRSLGNFHGYASSSASGSLTAKVKVLCSFGGKILPRPGDSKLRYVGGETHIISIRKDISWQELRQKVLEIYYRTHVVKYQLPGEDLDALVSVSCDEDLLNMMEEYNEMENRGGSQKLRMFLFSVSDLDGALLGVNKSDVDSEFQYVVAVNDMDLGSRSNSTLNGLDSSSANNLAELDVRNTEGINGVGPSQLTGIDFQQSSMQYSESAPPTSFAQYPQSIPHNGAFQFQQAVPPNATLQYAPSNPPSSSVHYPQSILPNSTLQYPQSISSSSYGLYPQYYGETEQFPMQYHDHNSSNYSIPIPFPGQPYPHPGITQQNAPVQVEEPNIKPETKVRDYVEPENRHILATNHQNPPQADDTEVKNREPSVATTVPSQDAAHMLPPRRDTRQNTPVKPSTYRDAVITEQVPVSGEDDQLSTSSGTCGLVHTDSESNLIDLDYPEPLQPTRRVYRSERIPREQLEMLNRLSKSDDSLGSQFLMSHPQASTGQQEPAKEAAGISHEDSHIVNDVENISGNVVASNETLDKRTVSGGGIETEARNLSHVDTERSHDIPEKQTSSGVLIDINDRFPQDFLSEIFAKALSDDMPSGANPYQHDGAGVSLNVENHDPKNWSYFRNLADEQFSDRDVAYIDRTPGFPSDMEDGGEIARLHQVAPLTENRVDPQMKVTESEEFDAMVENLRTSDCEQEDEKSETRNAGLPPVGPSLADYDTSGLQIIMNDDLEELKELGSGTFGTVYHGKWRGSDVAIKRIKKSCFAGRSSEQERLTGEFWGEAEILSKLHHPNVVAFYGVVKDGPGATLATVTEYMVDGSLRHVLVRKDRHLDRRKRLIIAMDAAFGMEYLHAKNIVHFDLKCDNLLVNLKDPSRPICKVGDFGLSKIKRNTLVSGGVRGTLPWMAPELLNGSSSKVSEKVDVFSFGIVLWEILTGEEPYANMHYGAIIGGIVNNTLRPTIPSYCDSDWRILMEECWAPNPTARPSFTEIAGRLRVMSTAATSNQSKPPAHKASK

SEQ ID NO: 818 - protein, 584 aa, Arabidopsis thaliana
MDRILKAARTSGSLNLSNRSLKDVPTEVYQCLETTGEGENWWEAVDLQKLILAHNDIEVLREDLKNLACLVVLNVSHNKLSQLPAAIGELTAMKSLDVSFNSISELPEQIGSAISLVKLDCSSNRLKELPDSIGRCLDLSDLKATNNQISSLPEDMVNCSKLSKLDVEGNKLTALSENHIASWTMLAELNACKNMLGVLPQNIGSLSRLIRLDLHQNKISSVPPSIGGCSSLVEFYLGINSLSTLPAEIGDLSRLGTLDLRSNQLKEYPVGACKLKLSYLDLSNNSLTGLHPELGNMTTLRKLVLVGNPLRTLRSSLVNGPTAALLKYLRSRLSNSEETSASTPTKENVIASAARMSISSKELSLEGLNLSDVPSEVWESGEITKVNLSKNSIEELPAQLSTSVSLQTLILSRNKIKDWPGAILKSLPNLMCLKLDNNPLNQIPLDGFQVVSGLQILDLSVNAVSFREHPKFCHLPQLRELYLSRIQLSEVPEDILNLSNLIILDLNQNSLQSIPKGIKNMTSLKHLDISNNNISSLPPELGLLEPTLEVLRLDGNPLRSIRRPILERGTKAVLNYLKDRLPDQ

SEQ ID NO: 819 - protein, 997 aa, Arabidopsis thaliana
MSSNMGTELIDLETVKADSDAFGETNLMELVGSNDPPSLQHISVSEIEQEPMEISVSGPLSFQFEPEAVSFQSSMLVDTQSLMPQLQLPYSVERSVAACSNSVTGKRKSPPESTLSGSATSEKLDASNKRVEPVHHRPWLEQFYSECIQRGHMPPPATLSTKTEHLPTPAKKVRQMEPASQKSGKQVMNKKQAGLSQGSVKTLNDGNESLRSKMKESLAAALALVHEHEESPKEKKNSETEEASVPVADSNEPASACGTSVTVGEDITPAMSTRDESFEQKNGNGRTLSQESSKDTKMNYVNQSDVQKTQFDEVFPCDDVRFSDSIFTGDELLQGNGLSWVLEPVSDFGENETQKSFEDPELLASKIELELFKLFGGVNKKYKEKGRSLLFNLKDKNNPELRESVMSGKISPERLCNMTAEELASKELSQWRQAKAEEMAEMVVLRDTDIDVRNLVRKTHKGEFQVEIDPVDSGTVDVSAEITSNSKPRAKAKSSKSSTKATLKKNDSNDKNIKSNQGTSSAVTLPPTEEIDPMQGLSMDDEMKDVGFLPPIVSLDEFMESLNSEPPFGSPHEHPPGKEDPASEKSDSKDGSHSKSPSRSPKQSPKEPSESVSSKTELEKTNVISPKPDAGDQLDGDVSKPENTSLVDSIKEDRIWDGILQLSSASVVSVTGIFKSGEKAKTSEWPTMVEVKGRVRLSAFGKFVKELPLSRSRVLMVMNVVCKNGISQSQRDSLIEVAKSYVADQRVGYAEPTSGVELYLCPTLGETLDLLSKIISKDYLDEVKCSEDIGLIGVVVWRRAVVASPGSRHKPGFKRQHSSTGTKRSVLAPENQKSRSVSVTNPSVVNVESMRNHGLVGCDDDDEDMPPGFGPVAAKDDDDLPEFNFNSSSGPVTSSPRPPLQSRSLDQVRELILKYGNSTGSGSKRPWDGHDDDDDDDIPEWQPQLPPPPPDLSPQFHSGTMARPPAQRPVAGPPSGWKANQNAPRQQQYSARRNRGF

SEQ ID NO: 820 - protein, 444 aa, Arabidopsis thaliana
MVRRQEEEKKAEKGMRLGKYELGRTLGEGNFGKVKFAKDTVSGHSFAVKIIDKSRIADLNFSLQIKREIRTLKMLKHPHIVRLHEVLASKTKINMVMELVTGGELFDRIVSNGKLTETDGRKMFQQLIDGISYCHSKGVFHRDLKLENVLLDAKGHIKITDFGLSALPQHFRDDGLLHTTCGSPNYVAPEVLANRGYDGAASDIWSCGVILYVILTGCLPFDDRNLAVLYQKICKGDPPIPRWLSPGARTMIKRMLDPNPVTRITVVGIKASEWFKLEYIPSIPDDDDEEEVDTDDDAFSIQELGSEEGKGSDSPTIINAFQLIGMSSFLDLSGFFEQENVSERRIRFTSNSSAKDLLEKIETAVTEMGFSVQKKHAKLRVKQEERNQKGQVGLSVTAEVFEIKPSLNVVELRKSYGDSCLYRQLYERLLKDVGTSSPEQEIVT

SEQ ID NO: 821 - protein, 86 aa, Arabidopsis thaliana
MASKALLLFVMLTFLLVIEMEGRILRVNSKTKDGESNDLLKRLGYNVSELKRIGRELSVQNEVDRFSPGGPDPQHHSYPLSSKPRI

SEQ ID NO: 822 - protein, 306 aa, Arabidopsis thaliana
MAIARTGVYVDDYLEYASTFPAELQRLLNTVRELDERSQSLINQTRQQTKYCLGLASQSSKKGNGNHYNNGGLDEEETIEKMRKEIESSQENALSLCTEKVLLARQAYDLIDSHVKRLDEDLNNFAEDLKQEGKIPPDEPSVLPPLPIVPKAEKRKSFYGTPQPKKIDYRDRDWDRDRDFELMPPPGSNRKDLMPIEEQPIDPNEPTYCVCHQVSFGDMIACDNENVSLLSQHLIIYFLMYSCYDETFCSCFDSAKEVNGFTIHALASHLRPDSKGNGTAPPADSSHSHTNIICTCEKVLLYYHQN

SEQ ID NO: 823 - protein, 409 aa, Arabidopsis thaliana
MTMEVSKKKGGDFQQCHELIPGLPSELALECLVRVPFQFQSAMRSVCRSWRSLLSDSSFIQERRRCGKTELLLCLVQPLTPPIPASKSVDETLMVDEKKSEDESHPRVFCTPRFGLSVYNAAMSTWHRVAFPEEEQIPLFCECVVLQDAGKILLIGGWDPETLQPTRDVYVLEFAGRKWRRGAPMKESRSFFACASVSPTKVYVAGGHDDQKNALRSAEVYDVEKDEWSSVTPMTEGRDECQGFAVGMGLRFCVLSGYGTESQGRFRSDGEIYDPATDSWSRIDNVWRFPDTSPRGRTAGDFRSSSTLWCFTDTDLQSERRWETNDDSRNLKLDLQSIQLPMTGSSVFAGSLGGESVVMIGGKRESEGEGEGGVMMKMTTEKKMGKWSHHVHIPCDFSTLPFSHASIYV

SEQ ID NO: 824 - protein, 427 aa, Arabidopsis thaliana
MKAIQLLWEAIMEATKRERRREDDDGEKASPESLVLPPEIITEILLRLPAKSIGRFRCVSKLFCTLSSDPGFAKIHLDLILRNESVRSLHRKLIVSSHNLYSLDFNSIGDGIRDLAAVEHNYPLKDDPSIFSEMIRNYVGDHLYDDRRVMLKLNAKSYRRNWVEIVGSSNGLVCISPGEGAVFLYNPTTGDSKRLPENFRPKSVEYERDNFQTYGFGFDGLTDDYKLVKLVATSEDILDASVYSLKADSWRRICNLNYEHNDGSYTSGVHFNGAIHWVFTESRHNQRVVVAFDIQTEEFREMPVPDEAEDCSHRFSNFVVGSLNGRLCVVNSCYDVHDDIWVMSEYGEAKSWSRIRINLLYRSMKPLCSTKNDEEVLLELDGDLVLYNFETNASSNLGICGVKLSDGFEANTYVESLISPNSYGIES

SEQ ID NO: 825 - protein, 151 aa, Arabidopsis thaliana
MKRSTTDSDLAGDAHNETNKKMKSTEEEEIGFSNLDENLVYEVLKHVDAKTLAMSSCVSKIWHKTAQDERLWELICTRHWTNIGCGQNQLRSVVLALGGFRRLHSLYLWPLSKPNPRARFGKDELKLTLSLLSIRYYEKMSFTKRPLPESK

SEQ ID NO: 826 - protein, 457 aa, Arabidopsis thaliana
MPSSATSTYLLSLKQVSLTASSPLLLQLKDRFFHQPKLLNMGFSTGKRKSRDEEEDRVSFFASEFPMDDLNDDVLERVLSWLPTSCFFRMSSVCKRWKSSQTSKSFKLACSQIPTRDPWFFMIDNDSNSSSFVFDSTENSWKNLNRRDFLHHHRQDFIPVASSGGLLCYRCSISGDFLLRNPLTGSSRDIPSQDNNNNKPLQAVAMTTTTVTPSSYTLVTISGEIPNLSFKIYESNADSWSKDQELESVKNNDSSLHDDYDTDSGTVYFLSKQGNVVVASNNLQRSPSKQYSSVITVTDEAEIVYFLSSYGTIVACDLTKRCFTELPKLLPPFLEYSIDLVECEGTMYVILLSEFFESASLRIWRLDNNREWVQVGMLPPALSHELYGKKGDINCVGGAGNKILVCFNASPPEVYCRYFVYDLVAEEWNELPKCFKDGEAVDFVSALSFQPRIEATV

SEQ ID NO: 827 - protein, 350 aa, Arabidopsis thaliana
MSSPVKKMKKKTTTSPILSPTPHSTQILSLPVDLLISILARVSRLDYPILSLVSKSFRSLIASPELYETRSLLGRTESCLYLCLGIPSDFNPRWFTLCRKPKPSGHVMAAISIPNSRPVHCSGLVAVGSDIYNIGGSIINEHSSSVSILDCRYHTWRDAPNMLVERNSHAANVIDGKIYVAGGSRDSNSSNWMEVFDIKTQTWEPVLNPIADGCDRRIRKSAVIEEAICLFGYKGVGVAYNPRIDKWEAIGEVNYLDLGWIGCWMKLKGLEGLPEFASYSYVRLADYGGKMAVLWDKLPTTGNNNMVIWCAVITLEKRHNENIWGRVEWFDAVLTVPEPYEFVCARSANV

SEQ ID NO: 828 - protein, 252 aa, Arabidopsis thaliana
MFSEEVLKNVFPLLEGEDLASCMGVCKQWRDIARDDFYWKCQCAKKWPSVCKRHKPPTETYYKMYQTFSKRRLNRALPPPRLSFENLEFFIDIWSEERLVFSGLIPGVALENGIETLPLGISNVLRTHLGRPDYKMVVPAEPRFTIPLNQSVSVSVLVARNDSDKVARIINRSVFDYIDRSSYRALAFEYLDLSPCYPFISGIRAWISLLFMDVEDMNDDGLLDVFGIQLDFNDVADTKEEVLWLLDMLDWK

SEQ ID NO: 829 - protein, 468 aa, Arabidopsis thaliana
MDLSGCRDIISSLPEAISCHILSFLPTKEAASTSVLSKKWRYLFAFVPNLDLDESVYLNPENETEVSSSFMDFVDRVLALQGNSPLHKFSLKIGDGVEPDRIIPWINNVLERGVSDLDLHVYMETEFVFPSEMFLSKTLVRLKLMLYPLLEFEDVYLPKLKTLYIDSCYFEKYGIGLTKLLSGCPILEDLVLDDIPWCTWDFASVSVPTLKRLTFSTQVRDEFPKSVSIDTPNLVYLKFTDTVAGKYPKVNFDSLVEAHIDLRLLQGHQGYGENDMVGNATDFIMRICNVKTLYLSSNTLQVLTYSCDAIPIFNNLTHLTIESNPEVGWQSLPGLLKNSPNLETLIFQGLIHKATDKCGDVCLCKPREEIRSCLASSPVKVIKILKFGEISDDMEKQREQIKYFLETMPNLEKMILYYNTTSVEDVTEVSSRLQRLVSKLASSTCIVQLISDNLSLSSTVSTNGLLCF

SEQ ID NO: 830 - protein, 727 aa, Arabidopsis thaliana
MAPNLRIKKACDAMKLLGISETKTRAFLRKLLKTYENNWDFIEEDAYKVLLDAIFDEADAQSTEKNKKEEEKKKKEEEKKSRSVATSRGRRKAPEPLVQDEEDDMDEDEFPLKRRLRSRRGRASSSSSSSSSYNNEDLKTQPEEEDEDDGVTELPPLKRYVRRNGERGLAMTVYNNASPSSSSRLSMEPEEVPPMVLLPAHPMETKVSEASALVILNDEPNIDHKPVISDTGNCSAPMLEMGKSNIHVQEWDWETKDILNDTTAMDVSPSSAIGESSEHKVAAASVELASSTSGEAKICLSFAPATGETTNLHLPSMEDLRRAMEEKCLKSYKIVHPEFSVLGFMKDMCSCYIDLAKNSTSQLLETETVCDMSKAGDESGAVGISMPLVVVPECEISGDGWKAISNMKDITAGEENVEIPWVNEINEKVPSRFRYMPHSFVFQDAPVIFSLSSFSDEQSCSTSCIEDCLASEMSCNCAIGVDNGFAYTLDGLLKEEFLEARISEARDQRKQVLRFCEECPLERAKKVEILEPCKGHLKRGAIKECWFKCGCTKRCGNRVVQRGMHNKLQVFFTPNGKGWGLRTLEKLPKGAFICEYIGEILTIPELYQRSFEDKPTLPVILDAHWGSEERLEGDKALCLDGMFYGNISRFLNHRCLDANLIEIPVQVETPDQHYYHLAFFTTRDIEAMEELAWDYGIDFNDNDSLMKPFDCLCGSRFCRNKKRSTSE

SEQ ID NO: 831 - protein, 432 aa, Arabidopsis thaliana
MTRVNQLPCDCVSTAEESLTSGTCITPTHVTSLSSPLDRSGDVDPLPVSDESGGSKADESMTDADETKKRKRILSGDCEADENNKSDGEIASLNDGVDAFTAICEDLNCSLCNQLPDRPVTILCGHNFCLKCFDKWIDQGNQICATCRSTIPDKMAANPRVNSSLVSVIRYVKVAKTAGVGTANFFPFTSNQDGPENAFRTKRAKIGEENAARIYVTVPFDHFGPIPAEHDPVRNQGVLVGESWENRVECRQWGVHLPHVSCIAGQEDYGAQSVVISGGYKDDEDHGEWFLYTGRRSYKDRYSAYAPKEGVRYDGVYRIEKCWRKARFPDSFKVCRYLFVRCDNEPAPWNSDESGDRPRPLPNIPELETASDLFERKESPSWDFDEAEGRWRWMKPPPANHEQRERMKMAMTCLLLFVLIILVGSSSILYQY

SEQ ID NO: 832 - protein, 452 aa, Arabidopsis thaliana
MASGVFEDEAEGTITINEYIERLDAEELAADLVLGGDEGDECTFPKGYMKRQAIFSCITCTPEGNAGICTACCLSCHDGHELLELWTKRNFRCDCGNSKFGTLACKLLPSKDIENSENSYNHNFKGLYCTCDRPYPDPNVEEQVEMIQCCLCEDWFHEEHLGLTPSDSVGSQIPRDEESEPIYEDFICQNCSPACSFLTLYPENLWVVAKVDSTGSANACSETIELDKNHMDSEPGQPENGTDAEKSVVGKCSETISDSEPGQPENGTEAEKSVVQKCSEKIDESEAGQPENSTEAEKFVVRKCSEKIDGSENVPAAGCVIRTDLNSCPEFEKKPLFLTKNWRNILCRCEKCLEMYKQRKVSYLLDAEDTIVEYEKKAKEKRTEKLEKQEGEALDLLNNLDHVSKVELLHGIKDFQDGLQGLMESAGPSKAITSADIEQMFSKLKNKRKRME

SEQ ID NO: 833 - protein, 543 aa, Arabidopsis thaliana
MSNCLQLNTSCVGCGSQSDLYGSSCRHMTLCLKCGRTMAQNKSKCHECGTVVTRLIREYNVRAAAPTDKNYFIGRFVTGLPNFKKGSENKWSLRKDIPQGRQFTDAQREKLKNKPWILEDETGQFQYQGHLEGSQSATYYLLVMQNKEFVAIPAGSWYNFNKVAQYKQLTLEEAEEKMKNRRKTADGYQRWMMKAANNGPALFGEVDNEKESGGTSGGGGRGRKKSSGGDEEEGNVSDRGDEDEEEEASRKSRLGLNRKSNDDDDEEGPRGGDLDMDDDDIEKGDDWEHEEIFTDDDEAVGNDPEEREDLLAPEIPAPPEIKQDEDDEENEEEEGGLSKSGKELKKLLGKANGLDESDEDDDDDSDDEEETNYGTVTNSKQKEAAKEEPVDNAPAKPAPSGPPRGTPPAKPSKGKRKLNDGDSKKPSSSVQKKVKTENDPKSSLKEERANTVSKSNTPTKAVKAEPASAPASSSSAATGPVTEDEIRAVLMEKKQVTTQDLVSRFKARLKTKEDKNAFANILRKISKIQKNAGSQNFVVLREK

SEQ ID NO: 834 - protein, 293 aa, Arabidopsis thaliana
MQYEKVEKIGEGTYGVVYKARDKVTNETIALKKIRLEQEDEGVPSTAIREISLLKEMQHSNIVKYDDVVHSEKRLYLVFEYLDLDLKKHMDSTPDFSKDLHMIKTYLYQILRGIAYCHSHRVLHRDLKPQNLLIDRRTNSLKLADFGLARAFGIPVRTFTHEVVTLWYRAPEILLGSHHYSTPVDIWSVGCIFAEMISQKPLFPGDSEIDQLFKIFRIMGTPYEDTWRGVTSLPDYKSAFPKWKPTDLETFVPNLDPDGVDLLSKMLLMDPTKRINARAALEHEYFKDLGGMP

SEQ ID NO: 835 - protein, 867 aa, Arabidopsis thaliana
MSRVSFEVSGGYHSDAEAGNSGPMSGGQLPPIYKKPGNSRFTAENSQRTRTAPYVDLTVDVQDDTVSVHSLKMEGGSSVEESPELTLLKRNRLEKKTTVVKRLASVSHELKRLTSVSGGIGGRKPPRPAKLDRTKSAASQALKGLKFISKTDGGAGWSAVEKRFNQITATTGGLLLRTKFGECIGMTSKDFALELFDALARRRNITGEVIDGDQLKEFWEQINDQSFDSRLKTFFDMVDKDADGRLTEDEVRELESLETLLLQAATQSVITSTGERKNLSHMMSQRLKPTFNRNPLKRWYRGLRFFLLDNWQRCWVIVLWFIVMAILFTYKYIQYRRSPVYPVMGDCVCMAKGAAETVKLNMALILLPVCRNTITWLRNKTRLGRVVPFDDNLNFHKVIAVGIIVGVTMHAGAHLACDFPRLLHATPEAYRPLRQFFGDEQPKSYWHFVNSVEGITGLVMVLLMAIAFTLATPWFRRGKLNYLPGPLKKLASFNAFWYTHHLFVIVYILLVAHGYYLYLTRDWHNKTTWMYLVVPVVLYACERLIRAFRSSIKAVTIRKVAVYPGNVLAIHLSRPQNFKYKSGQYMFVNCAAVSPFEWHPFSITSAPQDDYLSVHIRVLGDWTRALKGVFSEVCKPPPAGVSGLLRADMLHGANNPDFPKVLIDGPYGAPAQDYKKYEVVLLVGLGIGATPMISIVKDIVNNIKAKEQAQLNRMENGTSEPQRSKKESFRTRRAYFYWVTREQGSFDWFKNIMNEVAERDANRVIEMHNYCTSVYEEGDARSALIHMLQSLNHAKNGVDIVSGTRVMSHFAKPNWRNVYKRIAMDHPNTKVGVFYCGAPALTKELRHLALDFTHKTSTRFSFHKENF

SEQ ID NO: 836 - protein, 269 aa, Arabidopsis thaliana
MKMKKKGKVYPSPPPPPQSSSSSSSSNHLNEEDDDSLSVLKLLPATILVLVSVLSSEEREVLAYLITRGTTISDRGNSSSKNKTKKKSNKSSKNHKPPVFDCECFDCYTNYWFRWDSSPNRELIHEIIEAFENHHGEENSASRSKSKRGKKKEKPGRRVTDSDSKPALRVTDNGDKDSKPVVEPMNETTVSESSHVSSPVRLSEAEVAEGEPEDEIVVEEDGQEEESTVVVFPAAASNVTGHKGLARKVLPDVLGLFHSNFWRLWNPNA

SEQ ID NO: 837 - protein, 590 aa, Arabidopsis thaliana
MSLPETKSDDILLDAWDFQGRPADRSKTGGWASAAMILCIEAVERLTTLGIGVNLVTYLTGTMHLGNATAANTVTNFLGTSFMLCLLGGFIADTFLGRYLTIAIFAAIQATGVSILTLSTIIPGLRPPRCNPTTSSHCEQASGIQLTVLYLALYLTALGTGGVKASVSGFGSDQFDETEPKERSKMTYFFNRFFFCINVGSLLAVTVLVYVQDDVGRKWGYGICAFAIVLALSVFLAGTNRYRFKKLIGSPMTQVAAVIVAAWRNRKLELPADPSYLYDVDDIIAAEGSMKGKQKLPHTEQFRSLDKAAIRDQEAGVTSNVFNKWTLSTLTDVEEVKQIVRMLPIWATCILFWTVHAQLTTLSVAQSETLDRSIGSFEIPPASMAVFYVGGLLLTTAVYDRVAIRLCKKLFNYPHGLRPLQRIGLGLFFGSMAMAVAALVELKRLRTAHAHGPTVKTLPLGFYLLIPQYLIVGIGEALIYTGQLDFFLRECPKGMKGMSTGLLLSTLALGFFFSSVLVTIVEKFTGKAHPWIADDLNKGRLYNFYWLVAVLVALNFLIFLVFSKWYVYKEKRLAEVGIELDDEPSIPMGH

SEQ ID NO: 838 - protein, 405 aa, Arabidopsis thaliana
MKNGIAECPACHSKLVSPGSKTISRAYDDHKIRVSSKQRVLNVLLVVGDCMLVGLQPVLVYMSKVDGKFNFSPISVNFLTEIAKVIFAIVMLLIQARHQKVGEKPLLSVSTFVQAARNNVLLAVPALLYAINNYLKFTMQLYFNPATVKMLSNLKVLVIAVLLKMVMKRRFSIIQWEALALLLIGISVNQLRSLPEGATAIGIPLATGAYVCTVIFVTVPSMASVFNEYALKSQYDTSIYLQNLFLYGYGAIFNFLGILGTVIYKGPGSFDILQGHSRATMFLILNNAAQGILSSFFFKYADTILKKYSSTVATIFTGIASAALFGHVITMNFLLGISIVFISMHQFFSPLAKARDEQQQNGNLELGNTKDTHRANESFINMAAGANEEASHRGESDDRTPLLPR

SEQ ID NO: 839 - protein, 612 aa, Arabidopsis thaliana
MDFFTSSKAKKDSKKSSGLFGKKTVSKSTPGSPAHPPGARSPPPSYLSNKRAETEYDFPMSNEQRPYWKQPASERVPNSHPRPPVYGYGTPDHRRDHGRERMEAMSYEPETNAPSSPYHPAGNRTPERPRKSTEYRREHQDRMYEADTRSNASPFHPFRSPSPSPFHTPDRRRDHYDMYEPEANTMLQNSAPGSPFHPAGSRSPPPYRTPDRRSNYDKEQFEDLYEQDGDVTPRNSSPPSPFHPAAYKTSDQRSNHGKEQIEDFYEQDDDVTPRNSSPPSPLHPAASHSPPPPQPYRTPDHRRSHQDNEDFEAMYELDGDLIHQKSAPPSPVHGPYYSSSDDDNHSTYLYPEIRSPLRSRIVSENSTPVHHNYQIVAAETYEQDKQFEPPELPDESQSFTMQEITKMRGLKNYESGKEESQSMISEAYVSVANYRVRQSVSETLQAIIDKHGDIAASSKLQAMATRSYYLESLAAVVMELKKTVLRDLTKTRVAEIAAVVKDMESVKINVSWLKTAVTELAEAVEYFGQYDTAKVEKEVCERDLTAKKGEMEEMTAELVKREKEIKECREKVTVVAGRLGQLEMKGSKLNKNLDLFQSKVHKFQGEAVLLHL

SEQ ID NO: 840 - protein, 157 aa, Arabidopsis thaliana
MVVTSFSSAPPIFFLPGADAQFSSSNGRFAIPSSSLVKGLRRHQDAKLVGNRARVGVVRVLANPNVSPPPPPGKAKVKKEVIMVDPLEAKRLASKQMEEIKGREKQQRRREIEAINGAWAIIGLMIGLVIEAQTGKGILAQLAGYWSAVVHLFTPST

SEQ ID NO: 841 - protein, 302 aa, Arabidopsis thaliana
MAFPPPIHGSDAPPPPQPPSVVNGIETSRRQQQQIAAASSSPVKSHPLHNFPLSDLRWAMNHANTHRLRKASSRSPLREANTGKGNLVIEEVNEASGSSFELRPEKKKGNASGVSDSAADRSATKSTTPDGRSKIFIRIRTKNNEETAVSTDIATSVAASVQVTDDSAGPAIDAEGERISDGGGQEADEFGPKTWNLRPRRPPPTKKRSIGHGGGVLKSCNGALPENKSLGTVRTESIRSRNGVDAKMATTERKEKKPRLSISLSKLEIDEDIYALTGSKPSRRPKKRAKNVQKQLDVRFSR

SEQ ID NO: 842 - protein, 355 aa, Arabidopsis thaliana
MGEEEKKPEAAEEKKMEEKKPEEKKEGEDKKVDAEKKGEDSDKKPQEGESNKDSKEDSAPAAPEAPAPPPPPQEVVLKVYMHCEGCARKVRRCLKGFEGVEDVMTDCKTGKVVVKGEKADPLKVLARVQRKTHRQVQLLSPIPPPPPPPEKKAEEDKPIVEEKKVEPPVVVTVVLKVHMHCEACATEIKKRIMRMKGVESAESDLKSSQVTVKGVFEPQKLVEYVYKRTGKHAAIMKIDPPPPPPPEEAAAAAEGEKKEEEKGEGESKGEEGKDDKAKTDEEKKEGDGGKGEGEAADNGGGEEEGKVVEVRKIENPYYYYYYQPPRVAIPPMEMPPHAYPPQLFSDENPNACTVM

SEQ ID NO: 843 - protein, 69 aa, Arabidopsis thaliana
MASNEAGRALPKFGEWDVNDPATADGFTVIFSKAGEDKKTGRSSTKTNSQRKQDGDKPAVKKWLCFTFA

SEQ ID NO: 844 - protein, 152 aa, Arabidopsis thaliana
MAEKVKSGQVFNLLCIFSIFFFLFVLSVNVSADVDSERAVPSEDKTTTVWLTKIKRSGKNYWAKVRETLDRGQSHFFPPNTYFTGKNDAPMGAGENMKEAATRSFEHSKATVEEAARSAAEVVSDTAEAVKEKVKRSVSGGVTQPSEGSEEL

SEQ ID NO: 845 - protein, 396 aa, Arabidopsis thaliana
MYSEEKKSRNYGSIFVYCFFCFVLIVEVARFAKPYINLQNLIETEAVVEEGFMAVGNSGNLPCGSSKPSSASVRAHDEQKLSQAVTTDTRTRPPNSYCVKFQSFVTMAKQVKENGGKYESRPFSVGGYNWTLLIYPVIYIPTDSGGYVSIYVRVDNSSLITNPKDVYAEITFLAYKSSTDKYQISQETEAQRFHLFKQQWGLLQFLPIYYFENPAYGYFFEGESVVFGVDINIVKPFENWEVFSNEQNIRDPIFEWRLTKFSTRFLDSYTSDSFSSGGRNWALKVYPNGVGNATGNSLSLYLLSDQSNDKGYVEAKLRVIDQIQSNNFEKKVAAWPNATENGWGFDRFLSFADIKNTSKGFLVNDTLKLEVQILSFSKTDYYSHQSSLNVLTGDST

SEQ ID NO: 846 - protein, 41 aa, Arabidopsis thaliana
NSYSLTHSCSLIHSYSCRTPCCSSSRNCKSHHICRRSHIHS

SEQ ID NO: 847 - protein, 392 aa, Arabidopsis thaliana
MASFTKTVLIPIAHGTEPLEAVAMITVLRRGGADVTVASVETQVGVDACHGIKMVADTLLSDITDSVFDLIVLPGGLPGGETLKNCKSLENMVKKQDSDGRLNAAICCAPALALGTWGLLEGKKATGYPVFMEKLAATCATAVESRVQIDGRIVTSRGPGTTIEFSITLIEQLFGKEKADEVSSILLLRPNPGEEFTFTELNQTNWSFEDTPQILVPIAEESEEIEAIALVDILRRAKANVVIAAVGNSLEVEGSRKAKLVAEVLLDEVAEKSFDLIVLPGGLNGAQRFASCEKLVNMLRKQAEANKPYGGICASPAYVFEPNGLLKGKKATTHPVVSDKLSDKSHIEHRVVVDGNVITSRAPGTAMEFSLAIVEKFYGREKALQLGKATLV

SEQ ID NO: 848 - protein, 349 aa, Arabidopsis thaliana
MARPQDPPRGFFPFGNPFKNLSSKNSVLSSKLLPLLNNFETNLASSISKLVPKEKSDILTVSWMKQAMESLCETHNGIKTLITDLELPVSDWEDKWVDVYLDISVKLLDLCNAFSSELTRLNQGHLLLQFALHNLEANSPQNLSKAQSSLDSWKQHIVSKNPRIENCRAILSSLVQTLNLPKVKNSAKGKVLMRALYGVKVKTLYISGVFAAAFSGSSQNLMYLTVSNELPWAQSFMEVQNTMNAEIKNIFLSDGLTVLKELEAVASGVKKLYPAIQQGSIDPISLQPLKDSVTELSNGIDLVSKEVDCFFKILLSGRDTLLENLRSMGASTLQATSPKKAAGKNYRGF

SEQ ID NO: 849 - protein, 391 aa, Arabidopsis thaliana
MFSHGSLPFLSMTGMSRNMHPPRRGSRFTVRADADYYSVLGVSKNATKAEIKSAYRKLARNYHPDVNKDPGAEEKFKEISNAYEVLSDDEKKSLYDRYGEAGLKGAAGFGNGDFSNPFDLFDSLFEGFGGGMGRGSRSRAVDGQDEYYTLILNFKEAVFGMEKEIEISRLESCGTCEGSGAKPGTKPTKCTTCGGQGQVVSAARTPLGVFQQVMTCSSCNGTGEISTPCGTCSGDGRVRKTKRISLKVPAGVDSGSRLRVRGEGNAGKRGGSPGDLFVVIEVIPDPILKRDDTNILYTCKISYIDAILGTTLKVPTVDGTVDLKVPAGTQPSTTLVMAKKGVPVLNKSNMRGDQLVRVQVEIPKRLSKEEKKLIEELADMSKNKTANSTSR

SEQ ID NO: 850 - protein, 442 aa, Arabidopsis thaliana
MEGEEKNDYRNEEEDFNTPQQLQKKQRKGKKIATETEDENEEDKRVTLKVTQVAERPDRISPIVAYFSTGYDPCKVDPKTGKRVHETPKVTVYKHKDDSKKRIQVVVSPPGARVEFVGTNYTGEQAAMQTNTYRVGVFNREAKTLRILPVAHNKIIRLEPRVKAQETNEEEASGSAVVKELEELKTGERDRYNTKKAVTRDKKKRALYMGDDAATQKVLDGKLSELGVNTAALEGTSSTVARNIPPYNTAATTANEAYPLEKIIEKGDWSFLEDIYWLLQQETEAATEAYPVFVRNRLYRLRDIKDDMKKQTVCGAATLLTHLVKFKDRNSMNGYDSAKDHKMPDIFRQKFNSMFKDSESDRIPVDKINLLISYVLVLSLHVDNFMTDPEDIAKDLRISTVELRKHFLQLGCKFLKQNSTTVATLPTPLNFPEVNRRRRARK

SEQ ID NO: 851 - protein, 519 aa, Arabidopsis thaliana
MAKERDQNTKDKNLLICFLWNFSAELKLALMALLVLCTLATLLPFLPSSFSISASELRFCISRIAVNSTSVNFTTVVEKPVLDNAVKLTEKPVLDNGVTKQPLTEEKVLNNGVIKRTFTGYGWAAYNFVLMNAYRGGVNTFAVIGLSSKPLHVYSHPTYRCEWIPLNQSDNRILTDGTKILTDWGYGRVYTTVVVNCTFPSNTVINPKNTGGTLLLHATTGDTDRNITDSIPVLTETPNTVDFALYESNLRRREKYDYLYCGSSLYGNLSPQRIREWIAYHVRFFGERSHFVLHDAGGITEEVFEVLKPWIELGRVTVHDIREQERFDGYYHNQFMVVNDCLHRYRFMAKWMFFFDVDEFIYVPAKSSISSVMVSLEEYSQFTIEQMPMSSQLCYDGDGPARTYRKWGFEKLAYRDVKKVPRRDRKYAVQPRNVFATGVHMSQHLQGKTYHRAEGKIRYFHYHGSISQRREPCRHLYNGTRIVHENNPYVLDTTMRDIGLAVKTFEIRTIGDRLLRTRQ

SEQ ID NO: 852 - protein, 515 aa, Arabidopsis thaliana
MSDTKISAVAVAAAVVVVTTVTVWIWKGLNVAWLRPKKNEAYLKRQGLSGTPFTFLVGDIKREASMVEQEKSRPINLTDDYTHRVMPLIQQTVKDHGKTSYMWMGPIASVIVTKPEHIKDVLNRVYDFPKPPVHPIVELFATGVALYEGEKWSKHRKIINPSFHLEKLKIMIPAFYESCSEMISKWEKLVTEQGSSNEIDVWPYLGDLTSDVISRTAFGSSYEEGKRIFELQEEQGRRVLKALELAFIPGMRFLPTKNNLRMRQINKEVKSRLREIIMKRQRGMDTGEAPKNDLLGILLESNSGDHGMSIEDVVEECRLFHFAGQETTAVLLVWTMIMLSHHQKWQDQAREEILKVIGKNNKPNFDALSRLKTMSMILNEVLRLYPPGILLGRTVEKETKLGEDMTLPGGAQVVIPVLMVHRDPELWGEDVHEFNPERFADGISKATKNQVSFLPFGWGPRFCPGQNFALMEAKMALVLILQRFSFELSPSYTHAPHTVLTLHPQFGAPLIFHML

SEQ ID NO: 853 - protein, 891 aa, Arabidopsis thaliana
MAPTQDPNSVGGGAKKDEATLKVPSKDPKKKDEKKDEDLSEEDLELKQNLELYVERVQDPNPELQKAALESMRQEIRASTSSMTSVPKPLKFLRPHYGTLKAFHETMADSDLKKYLSDILSVLALTMSADGERESLRFRLIGTEGDIGSWGHEYVRNLAGEIAQEYTKRQSEEASIDDLMELVQQIVAFHMKHNAETEAVDLLMDVEDLDLLLEHVDKTNFKRTCNYLTSAARYLPGPDDMLVLDISYMIYMKFEEYPNALQIALFLDNTQYVKQVFTSCTDLLKKKQFCYMIARHGITFELDDEMVADDDDREALQDIVNNTKLSEGYLTLARDIEVMEAKTPEDIYKAHLLDGRASSGASVDSARQNLAATFVNAFVNAGFGQDKLMTVPSDSTTGSSGNWLFKNKEHGKTSAAASLGMIQLWDVDSGLSQLDKYFHSNDNPIIAGALLGVGIVNCGIKNDCDPALALLGDYIDKEDSSVRIGAIMGLGISYAGSQNDQIRNKLSPILNDAKAPLDVIAFASLSLGMIYVGSCNEEVAQSIIFALMDRSEAELGDALTRFLPLGLGLLYLGKQESVEATAEVSKTFNEKIRKYCDMTLLSCAYAGTGNVLKVQDLLAQCGEHLEKGDIHQGPAVLGLAMVAMSEELGVDMEIRSLERMLQYGEQNIRRAVPLALGLLCISNPKVTVMDTLSRLSHDTDSEVAMSAIISLGLIGAGTNNARIAGMLRNLSSYYYKDMSLLFCVRIAQGLVHMGKGLLTLSPFHSERFLLSPTALAGIVTLLHACLDMKPIILGKYHYVLYFLVLAMQPRMMLTVDENLKPLSVPVRVGQAVDVVGQAGRPKTITGFQTHSTPVLLAAGERAELATDKYIPLSPILEGFIILKENPDYREE

SEQ ID NO: 854 - protein, 309 aa, Arabidopsis thaliana
MASFVMGYFLLFAVAFMCLDARTDKTQDYTSFQYHKGALLTGDVSINLIWYGKFKPSQRAIVTDFVASLSSSRRSTMAQNPSVATWWKTVEKYYQFRKMTTTRGLSLSLGEQILDQGYSMGKSLTEKNLKDLAAKGGQSYAVNVVLTSADVTVQGFCMNRCGSHGTGSGSGKKGSRFAYIWVGNSETQCPGQCAWPFHAPVYGPQSPPLVAPNNDVGLDGMVINLASLMAATATNPFGDGYYQGPKTAPLEAGSACTGVYGKGSYPGYAGELLVDATTGGSYNVKGLNGRKYLLPALFDPKTDSCSTLF

SEQ ID NO: 855 - protein, 456 aa, Arabidopsis thaliana
MAVAISGSSLISSTLQHYNNRIYIRDYPIPCHSSNPICNSFNFKRRSFSPSSPKFNDHVVNPSSSYLSSKLSPIRTHSSFAACGCSWIQDNSMVHDYATTTNGTSKRCSALPTTNTVDVSSVSDLFEFICSGPLVNKIGITPQRVGQSIDKWLLYGSQLCRLFQLNELKLTIPQKARLYHYYIPVFIWCEDQIALHNSKFKDGDDVPPLVIGFSAPQGCGKTTLVFALDYLFKTTKKKSATISVDDFYLTAEGQAELRKKNPGNALLEYRGNAGSHDLKLSVETLEALSKLTKEGLKMKVPRYNKSAYSGRGDRADSSTWPEVEGPLSVILFEGWMLGFKPLPADVVKAVDPQLEVVNKNLEAYYDAWDKYIDAWVVIKIQDPSYVYRWRLQAEIAMRQDGQAGMSDEEVNDFVSRYLPAYKAYLPTLYAEGPSGSDPDRVLAIDIDEERNPILAN

SEQ ID NO: 856 - protein, 619 aa, Arabidopsis thaliana
MKQFMSVVRFKFGFTSVRMRDWSVGVSIMVLTLIFIIRYEQSDHTHTVDDSSIEGESVHEPAKKPHFMTLEDLDYLFSNKSFFGEEEVSNGMLVWSRMRPFLERPDALPETAQGIEEATLAMKGLVLEINREKRAYSSGMVSKEIRRICPDFVTAFDKDLSGLSHVLLELPCGLIEDSSITLVGIPDEHSSSFQIQLVGSGLSGETRRPIILRYNVNFSKPSIVQNTWTEKLGWGNEERCQYHGSLKNHLVDELPLCNKQTGRIISEKSSNDDATMELSLSNANFPFLKGSPFTAALWFGLEGFHMTINGRHETSFAYREKLEPWLVSAVKVSGGLKILSVLATRLPIPDDHASLIIEEKLKAPSLSGTRIELLVGVFSTGNNFKRRMALRRSWMQYEAVRSGKVAVRFLIGLHTNEKVNLEMWRESKAYGDIQFMPFVDYYGLLSLKTVALCILGTKVIPAKYIMKTDDDAFVRIDELLSSLEERPSSALLYGLISFDSSPDREQGSKWFIPKEEWPLDSYPPWAHGPGYIISHDIAKFVVKGHRQRDLGLFKLEDVAMGIWIQQFNQTIKRVKYINDKRFHNSDCKSNYILVHYQTPRLILCLWEKLQKENQSICCE

SEQ ID NO: 857 - protein, 471 aa, Arabidopsis thaliana
MGKKGSGGWFSTVKKKVFKSSPKDSKRENNIGSNNADIWQQQHDTQEVVSFEHFPAESSPEISHDVESTASTPATNVGDRKHAMAVAIATAAAAEAAVAAAQAAAKVVRLAGYNRQTEEDSAAVLIQSHYRGYLARRALRALKGLVRLQALVRGNHVRKQAQMTMKCMQALVRVQGRVRARRLQVAHDRFKKQFEEEEKRSGMEKPNKGFANLKTEREKPKKLHEVNRTSLYQTQGKEKERSEGMMKRERALAYAYTYQRQMQHTNSEEGIGLSSNGPDRNQWAWNWLDHWMSSQPYTGRQTGPGPGPGQYNPPPYPPFPTAAATTTSDDVSEKTVEMDVTTPTSLKGNIIGLIDREYIDLGSYRQGHKQRKSPTHIPSYMAPTASAKAKVRDQGPTVKLQGTSFMPYWNSSTKNGSVNGSGCDSSSSGGAITTGYPGPRSPNPKSDIRRKPVSPSQSPTGFGKRGWRHDH

SEQ ID NO: 858 - protein, 540 aa, Arabidopsis thaliana
MAVSAFRGTRLPLFHHSQFPVARTVSGTSKKMIGARNFKGFVLTAQYSQTQDLFTSRLQSQIEKLPKLVEDIVQTSINTGPRGVTRLVQGVQAFVGVGGEWLNDLSKSTSASGGLPSELQLGLLSPLYLRKLFERMGATYIKLGQFIASAPTLFPPEYVKEFQNCFDKAPPVPFEEIRKILQEELGRPIESVYEYVDPTPIASASIAQVHGARLRGSQEDVVIKVLKPGIEDFLVADLNFIYVVSRIFEFLSPEFSRTSLVGIVKDIRESMLEEVDFNKEAQNIESFKRYLETMGLTGQATAPRVYKYCSSRRVLTMERLYGVPLTDLDSIRSLVSSPENSLITALNVWFGSLLACESFHADVHAGNLWLLRDGRIGFLDFGIVGRISPKTWAAMEVFLASIATEEYESMASALIQMGATNRDVDGKAFAKDLEKMFSSIQELDTEIVVATARGTNSDTTAVAANVVMDERQMNALFLDLVRVSESYGLKFPREFALLLKQLLYFDRYTRLLAPNLNMLQDQRISIASNKRTNGYKDSFN

SEQ ID NO: 859 - protein, 624 aa, Saccharomyces cerevisiae
MVVQKKLRAILTDEGVLIKSQSHHMFNKHGQLRSGDSLSLLSCLSCLDDGTLSSDGGSFDEDDSLELLPLNTTIPFNRILNAKYVNVGQKGFNNGKISSNPFQTENLSSSSENDDVENHSLSNDKAPVSESQSFPKKDKWDTKTNTVKVSPDDSQDNSPSLGIKDNQQLIELTFAVPKGHDVIPQKLTLLIDHVSRKSRANTGEENISSGTVEEILEKSYENSKRNRSILVIINPHGGKGTAKNLFLTKARPILVESGCKIEIAYTKYARHAIDIAKDLDISKYDTIACASGDGIPYEVINGLYRRPDRVDAFNKLAVTQLPCGSGNAMSISCHWTNNPSYAALCLVKSIETRIDLMCCSQPSYMNEWPRLSFLSQTYGVIAESDINTEFIRWMGPVRFNLGVAFNIIQGKKYPCEVFVKYAAKSKKELKVHFLENKDKNKGCLTFEPNPSPNSSPDLLSKNNINNSTKDELSPNFLNEDNFKLKYPMTEPVPRDWEKMDSELTDNLTIFYTGKMPYIAKDTKFFPAALPADGTIDLVITDARIPVTRMTPILLSLDKGSHVLEPEVIHSKILAYKIIPKVESGLFSVDGEKFPLEPLQVEIMPMLCKTLLRNGRYIDTEFESM

SEQ ID NO: 860 - protein, 303 aa, Saccharomyces cerevisiae
MSVILVSAGYDHTIRFWEALTGVCSRTIQHSDSQVNRLEITNDKKLLATAGHQNVRLYDIRTTNPNPVASFEGHRGNVTSVSFQQDNRWMVTSSEDGTIKVWDVRSPSIPRNYKHNAPVNEVVIHPNQGELISCDRDGNIRIWDLGENQCTHQLTPEDDTSLQSLSMASDGSMLAAANTKGNCYVWEMPNHTDASHLKPVTKFRAHSTYITRILLSSDVKHLATCSADHTARVWSIDDDFKLETTLDGHQRWVWDCAFSADSAYLVTASSDHYVRLWDLSTREIVRQYGGHHKGAVCVALNDV

SEQ ID NO: 861 - protein, 531 aa, Arabidopsis thaliana
MEALSSLTFKGSLPEAIFEAKGKKKLFVVYISGEDEESDKLNRLTWTDASVADSLSKYCILVHIQAGSVDATNFSAIYPYSSVPCIAAIGFSGTQVWRTEGFITAEDLASSLEKAWLGLHIQETTASIFSAALASQNSETPVSSASSVVLPPGSVPLDAAVASPSTASSVQPSETKSTVTSASTTENNDGTVAVKGKESAEPSNLCDTTKNQPAPSVDGTKANVEHEATETPLRVQAEKEPIRPTAPGTNDNTSRVRSSVDRKRKQGTVINEEDSGVGVSGRDINLTKSVDTKETMKPKDEGGEEEDGEKSKKASDVHLNIRLPDGSSLQEKFSVTSILRMVKDYVNSNQTIGLGAYDLAVPYPRKVYTDQDLDKSLSELRLFDRQALVVVPRKRATVYQRGTSYSESNNNTDPNSGGYFAYVRRVLSYANPFSYFGGGTANASSSVPERQTRPNTEVRNNLGQVGTSFQDPSEGRSNVRNRRPTTSRIGSNIHTLNHNEDEAPFGDGNAFWNGNSTQYGGGSGGDSNDRR

SEQ ID NO: 862 - protein, 584 aa, Arabidopsis thaliana
MEAQYRNHDGDTSFSSLRVYLNSLSDTPSRFSRRAVSVSTSYDEMSRVRAVSGEQMRRTLRWYDLIGLGIGGMIGAGVFVTTGRASRLYAGPSIVVSYAIAGLCALLSAFCYTEFAVHLPVAGGAFSYIRITFGEFPAFITGANLIMDYVLSNAAVSRGFTAYLGSAFGISTSEWRFIVSGLPNGFNEIDPIAVIVVLAVTFVICYSTRESSKVNMVLTALHIAFIVFVIVMGFSKGDVKNLTRPDNPENPSGFFPFGVSGVFNGAAMVYLSYIGYDAVSTMAEEVKDPVKDIPMGISGSVAIVIVLYCLMAISMSMLLPYDLIDAEAPYSAAFSKSEGWEWVTRVVGIGASFGILTSLIVAMLGQARYMCVIGRSRVVPIWFAKVHPKTSTPVNASAFLGIFTAVLALFTDLNVLLNLVSIGTLFVFYMVANAVIFRRYVTVGYTEPWPTLSFLCLFSITSILFTLVWQLAPSGPPKWFILGASTVTAIAIVQIFHCVVPQARIPEFWGVPLMPWTPCVSIFLNIFLLGSLDAPSYIRFGFFSGLVVLVYVFYSVHASYDAEGDGSLDFKDVESLERINRVLS

SEQ ID NO: 863 - protein, 244 aa, Arabidopsis thaliana
MNGFSDLNPSESKPSLSQLAPLEAILFDVDGTLCDSDPIHLIAFQELLQEIGFNNGVPIDEKFFVENIAGKHNSEIALLLFPDDVSRGLKFCDEKEALYRKIVAEKIKPLDGLIKLTKWIEDRGLKRAAVTNAPKENAELMISKLGLTDFFQAVILGSECEFPKPHPGPYLKALEVLNVSKEHTLVFEDSISGIKAGVAAGMPVIGLTTGNPASLLMQAKPAFLIENYADPKLWAVLEELDNKS

SEQ ID NO: 864 - protein, 114 aa, Arabidopsis thaliana
MAALSTTFYYHPLCTNHRTKRQASSRHGVRSMRVMSCRKQKLPEENEGVIQRTLRRMISEAGKIGKNLKPEKKKGDVKDLMLMSLSFAVYVYISQLLVCAYFSWQHLSFPKSSW

SEQ ID NO: 865 - protein, 575 aa, Arabidopsis thaliana
MTEYENGKKRKVRNKQQVKVQFLSQRYLILCFCCFFVLLFFLSSDRISTLSVRSDSLRPSLRVPTLSVLSSSMDSFHRGRFPPLSVEDRVQFPDHLLLILSHGIGKGEKNLVCVYRGVKEETLVLPSISSDEFDEFRSIVRCPNAPLNYSSSVDLQFRGDLVKKKMKKQSRRVHNWEKVGYEAVIDGDTVVVFVKGLTRRPHKESDPSYYKCQFEIENSEEKEVTQAIAAAQEVVRCGLPESLKLNPEMMFRVSVIHIDPRGRTTPALPSVARIYGSDSIEKKEKKSGVKHELCVCTMLWNQAPFLREWIMYHSWLGVERWFIYDNNSDDGIQEEIELLSSENYNVSRHVWPWIKTQEAGFSHCAVRAKEECNWVGFFDVDEFYYFPTHRSQGLPSKNALKSLVSNYTSWDLVGEIRTDCHSYGPSGLTSVPSQGVTVGYTCRQANPERHKSIIRPELLTSSLLNEVHHFQLKEGVGHMSLVESVAVVNHYKYQVWDTFKAKFYRRVATYVVDWQENQNQGSKDRAPGLGTEAIEPPDWKRRFCEVWDTGLKDLVMSNFADQVTGYLPWQRQQQE

SEQ ID NO: 866 - protein, 114 aa, Arabidopsis thaliana
MGCAGSTQSQADGSVKKIRKPKPWKHTQPITKAELMKLREEFWDTAPHYGGRKEIWDALRAAAEADISLAQAIVDSAGVIVQNTDLTVCYDERGAKYELPKYVLSEPTNLEEEN

SEQ ID NO: 867 - protein, 117 aa, Arabidopsis thaliana
MGSLMSGWDSRVRDPKSVRRCKSLTREEIDTFWKTKKKNEEEEHVQAFSKLVTQEGAQSQAKEKKSVDDLFENQSKSSGWWRKTYWAFLNEPREEEGRPNNYVSQFKVAHIAKIAGS

SEQ ID NO: 868 - protein, 390 aa, Arabidopsis thaliana
MRLRFPMKSAVLAFAIFLVFIPLFSVGIRMIPGRLTAVSATVGNGFDLGSFVEAPEYRNGKECVSQSLNRENFVSSCDASLVHVAMTLDSEYLRGSIAAVHSMLRHASCPENVFFHLIAAEFDPASPRVLSQLVRSTFPSLNFKVYIFREDTVINLISSSIRQALENPLNYARNYLGDILDPCVDRVIYLDSDIIVVDDITKLWNTSLTGSRIIGAPEYCHANFTKYFTSGFWSDPALPGFFSGRKPCYFNTGVMVMDLVRWREGNYREKLETWMQIQKKKRIYDLGSLPPFLLVFAGNVEAIDHRWNQHGLGGDNVRGSCRSLHKGPVSLLHWSGKGKPWVRLDEKRPCPLDHLWEPYDLYEHKIERAKDQSLFGFSSLSELTEDSSFF

SEQ ID NO: 869 - protein, 286 aa, Arabidopsis thaliana
MSFNKVPNIPGAPALSALLKVSVIGGLGVYALTNSLYNVDGGHRAVMFNRLTGIKEKVYPEGTHFMVPWFERPIIYDVRARPYLVESTTGSHDLQMVKIGLRVLTRPMGDRLPQIYRTLGENYSERVLPSIIHETLKAVVAQYNASQLITQREAVSREIRKILTERASNFDIALDDVSITTLTFGKEFTAAIEAKQVAAQEAERAKFIVEKAEQDRRSAVIRAQGEAKSAQLIGQAIANNQAFITLRKIEAAREIAQTIAQSANKVYLSSNDLLLNLQEMNLEPKK

SEQ ID NO: 870 - protein, 195 aa, Arabidopsis thaliana
MSSSSPSGSGSDLTERRGIPAAKFIQDVETYLSQSGLDPNSALAFHQERLQQYKVVEMKLLAQQRDLQAKIPDIEKCLEVVATLEAKKGTGEALLADFEVSEGIYSRACIEDTDSVCLWLGANVMLEYSCEEASALLKNNLENAKASLEVLVADLQFLRDQVTVTQVTIARVYNWDVHQRRVKQVTPTAIAVADS

SEQ ID NO: 871 - protein, 588 aa, Arabidopsis thaliana
MAMVDEPLYPIAVLIDELKNDDIQLRLNSIRRLSTIARALGEERTRKELIPFLSENSDDDDEVLLAMAEELGVFIPFVGGIEFAHVLLPPLESLCTVEETCVREKAVESLCKIGSQMKENDLVESFVPLVKRLAGGEWFAARVSACGIFHVAYQGCTDVLKTELRATYSQLCKDDMPMVRRAAASNLGKFATTVESTFLIAEIMTMFDDLTKDDQDSVRLLAVEGCAALGKLLEPQDCVARILPVIVNFSQDKSWRVRYMVANQLYELCEAVGPDCTRTDLVPAYVRLLRDNEAEVRIAAAGKVTKFCRLLNPELAIQHILPCVKELSSDSSQHVRSALASVIMGMAPILGKDSTIEHLLPIFLSLLKDEFPDVRLNIISKLDQVNQVIGIDLLSQSLLPAIVELAEDRHWRVRLAIIEYVPLLASQLGIGFFDDKLGALCMQWLQDKVYSIREAAANNLKRLAEEFGPEWAMQHLVPQVLDMVNNPHYLHRMMVLRAISLMAPVMGSEITCSKFLPVVVEASKDRVPNIKFNVAKLLQSLIPIVDQSVVDKTIRQCLVDLSEDPDVDVRYFANQALNSIDGSTAAQS

SEQ ID NO: 872 - protein, 319 aa, Agrobacterium tumefaciens
MVKEPGGKHVLCVGAAVLDTLFRVADMPKGEGKVLPYEVLQIAEGMASSAAYAVHRMGGRASLWGAVGDDETGTRILRDLSESGIDTSGMTVAPGARSALSTIIIDNRGERLIVPFYDHRLHEKKRACTPEDIALFDAVLVDVRWPELALDVLTVARALGKPAILDGDVAPVETLEGLAPAATHIVFSEPAATRLTGLETVKDMLPVLHARYPQTFIAVTAGPAGCWWTEADDPTVHFQTTMQVEAVDTLAAGDIFHGTFALAMAEGMQSRAAVRLSSVAAALKCTVFGGRIGAPTREETEEAMRQWLERESEPALRAS

SEQ ID NO: 873 - protein, 419 aa, Arabidopsis thaliana
MAEMSYLQIDDANDAVFNHYRHQRRLHDHLRDQSFSQILYPLPHWIQSDDGDLYISETDFSSGDVSVSDLVFTTDDGLDLLDRRSFVMDLFHQRVEQSQVTPLDNDGIDDFENYEMREDNVELDFGLEMESGNGFVDSDLVVNLNEHVDGMRLLGIESGDVIVTVESCFDSDDEDDQEKEESEIWGIDLNEEDEYVNDDDDNDDEEEDASVTIPLCWDSLQLEDLGINNEDCEWEEVDSDDEREVLSVLAEADDNNSVSVSVAATISLEDLAISERRGSSNLGWEVLLNSRSLEFNLDDAESNLELYIGDIDHEEEDYEDYLHTTEYEMLFEAEISSGIGKPPASKSFIKNLKVSPLSNEDVMENDDDAVCCAVCKEEMIVGKEVAELPCRHKYHSECIVPWLGIRNTCPVCRFELPSD

SEQ ID NO: 874 - protein, 407 aa, Arabidopsis thaliana
MSSSSLILLFSTLSLFLNVSLADNHTAVVITTSDTPPPLPPPSPPPRHNFTSSLMPGIAVVIAVLTAFFSLTFLLLLYVKHCKRRNGSVYVNHPQRFAITRYGGGYYNGGGVVGGRKNSGIDRSVIESLPVFRFGALSGHKDGLECAVCLARFEPTEVLRLLPKCKHAFHVECVDTWLDAHSTCPLCRYRVDPEDILLIGDCNSWFELQFSKDESNSVNNNPPGLTRFIPVSRISGRHSSAGERASRLNEIRTSSSYKSNPMSFRRSLDSSLKVNDAGEEKSESVAVNCLDRLQRKDGLLLIPNRESFEGRFEHRIIISGGNRDDQRWSEVRPSDLLYLRSEMILSDCRKLAAAEGGRDVINGRSVSELTGIERRRRWGGEPRQRQATAVISRWLAWSHRASASSIV

SEQ ID NO: 875 - protein, 445 aa, Arabidopsis thaliana
MATRANVPEQVRGAPLVDGLKIQNKNGAVKSRRALGDIGNLVSVPGVQGGKAQPPINRPITRSFRAQLLANAQLERKPINGDNKVPALGPKRQPLAARNPEAQRAVQKKNLVVKQQTKPVEVIETKKEVTKKEVAMSPKNKKVTYSSVLSARSKAACGIVNKPKIIDIDESDKDNHLAAVEYVDDMYSFYKEVEKESQPKMYMHIQTEMNEKMRAILIDWLLEVHIKFELNLETLYLTVNIIDRFLSVKAVPKRELQLVGISALLIASKYEEIWPPQVNDLVYVTDNAYSSRQILVMEKAILGNLEWYLTVPTQYVFLVRFIKASMSDPEMENMVHFLAELGMMHYDTLTFCPSMLAASAVYTARCSLNKSPAWTDTLQFHTGYTESEIMDCSKLLAFLHSRCGESRLRAVYKKYSKAENGGVAMVSPAKSLLSAAADWKKPVSS

SEQ ID NO: 876 - protein, 585 aa, Arabidopsis thaliana
MEVEEEVSRWEGYADWRNRAAVKGRHGGMLAASFVLVVEILENLAYLANASNLVLYLREYMHMSPSKSANDVTNFMGTAFLLALLGGFLSDAFFSTFQIFLISASIEFLGLIILTIQARTPSLMPPSCDSPTCEEVSGSKAAMLFVGLYLVALGVGGIKGSLASHGAEQFDESTPKGRKQRSTFFNYFVFCLACGALVAVTFVVWLEDNKGWEWGFGVSTIAIFVSILIFLSGSRFYRNKIPCGSPLTTILKVLLAASVKCCSSGSSSNAVASMSVSPSNHCVSKGKKEVESQGELEKPRQEEALPPRAQLTNSLKVLNGAADEKPVHRLLECTVQQVEDVKIVLKMLPIFACTIMLNCCLAQLSTFSVQQAASMNTKIGSLKIPPASLPIFPVVFIMILAPIYDHLIIPFARKATKTETGVTHLQRIGVGLVLSILAMAVAALVEIKRKGVAKDSGLLDSKETLPVTFLWIALQYLFLGSADLFTLAGLLEYFFTEAPSSMRSLATSLSWASLAMGYYLSSVIVSIVNSITGSSGNTPWLRGKSINRYKLDYFYWLMCVLSAANFLHYLFWAMRYKYRSTGSRS

SEQ ID NO: 877 - protein, 469 aa, Arabidopsis thaliana
MGRNVKTKAKRKNKKKAEASSSEIPSIPTRVWQPGVDTLEDGEELQCDPSAYNSLHGFHVGWPCLSFDILGDKLGLNRTEFPHTLYMVAGTQAEKAAHNSIGLFKITNVSGKRRDVVPKTFGNGEDEDEDDEDDSDSDDDDGDEASKTPNIQVRRVAHHGCVNRIRAMPQNSHICVSWADSGHVQVWDMSSHLNALAESETEGKDGTSPVLNQAPLVNFSGHKDEGYAIDWSPATAGRLLSGDCKSMIHLWEPASGSWAVDPIPFAGHTASVEDLQWSPAEENVFASCSVDGSVAVWDIRLGKSPALSFKAHNADVNVISWNRLASCMLASGSDDGTFSIRDLRLIKGGDAVVAHFEYHKHPITSIEWSAHEASTLAVTSGDNQLTIWDLSLEKDEEEEAEFNAQTKELVNTPQDLPPQLLFVHQGQKDLKELHWHNQIPGMIISTAGDGFNILMPYNIQNTLPSELPA

SEQ ID NO: 878 - protein, 279 aa, Arabidopsis thaliana
MAGREILHKMKVGLCGSDTGRGKTKVWKNIAHGYDFVKGKAGHPMEDYVVSEFKKVDGHDLGLFAIFDGHLGHDVAKYLQTNLFDNILKEKDFWTDTKNAIRNAYISTDAVILEQSLKLGKGGSTAVTGILIDGKTLVIANVGDSRAVMSKNGVASQLSVDHEPSKEQKEIESRGGFVSNIPGDVPRVDGQLAVARAFGDKSLKIHLSSDPDIRDENIDHETEFILFASDGVWKVMSNQEAVDLIKSIKDPQAAAKELIEEAVSKQSTDDISCIVVRFQ

SEQ ID NO: 879 - protein, 270 aa, Arabidopsis thaliana
MELSSASAILSHSSSAAQLLRPKLGFIDLLPRRAMIVSSPSSSLPRFLRMESQSQLRQSISCSASSSSSMALGRIGEVKRVTKETNVSVKINLDGTGVADSSSGIPFLDHMLDQLASHGLFDVHVRATGDVHIDDHHTNEDIALAIGTALLKALGERKGINRFGDFTAPLDEALIHVSLDLSGRPYLGYNLEIPTQRVGTYDTQLVEHFFQSLVNTSGMTLHIRQLAGENSHHIIEATFKAFARALRQATETDPRRGGTIPSSKGVLSRS

SEQ ID NO: 880 - protein, 473 aa, Arabidopsis thaliana
MSLGYAEKLSFIEDVGQVGMAEFFDPSHLLQCKIEELAKLIQKSKHLVVFTGAGISTSCGIPDFRGPKGIWTLQREGKDLPKASLPFHRAMPSMTHMALVELERAGILKFVISQNVDGLHLRSGIPREKLSELHGDSFMEMCPSCGAEYLRDFEVETIGLKETSRKCSVEKCGAKLKDTVLDWEDALPPKEIDPAEKHCKKADLVLCLGTSLQITPACNLPLKCLKGGGKIVIVNLQKTPKDKKANVVIHGLVDKVVAGVMESLNMKIPPYVRIDLFQIILTQSISGDQRFINWTLRVASVHGLTSQLPFIKSIEVSFSDNHNYKDAVLDKQPFLMKRRTARNETFDIFFKVNYSDGCDCVSTQLSLPFEFKISTEEHVEIIDKEAVLQSLREKAVEESSCGQSGVVERRVVSEPRSEAVVYATVTSLRTYHSQQSLLANGDLKWKLEGSGTSRKRSRTGKRKSKALAEETKA

SEQ ID NO: 881 - protein, 834 aa, Arabidopsis thaliana
MVDNSNNKKRKEFISEADIATLLQRYDTVTILKLLQEMAYYAEAKMNWNELVKKTSTGITSAREYQLLWRHLAYRDSLVPVGNNARVLDDDSDMECELEASPGVSVDVVTEAVAHVKVMAASYVPSESDIPEDSTVEAPLTINIPYSLHRGPQEPSDSYWSSRGMNITFPVFLPKAAEGHNGNGLASSLAPRKRRKKWSAEEDEELIAAVKRHGEGSWALISKEEFEGERTASQLSQRWGAIRRRTDTSNTSTQTGLQRTEAQMAANRALSLAVGNRLPSKKLAVGMTPMLSSGTIKGAQANGASSGSTLQGQQQPQPQIQALSRATTSVPVAKSRVPVKKTTGNSTSRADLMVTANSVAAAACMSGLATAVTVPKIEPGKNAVSALVPKTEPVKTASTVSMPRPSGISSALNTEPVKTAVAASLPRSSGIISAPKVEPVKTAASAASLPRPSGMISAPKVEPVKTTASVASLPRPSGIISAPKAEPVKTAASAASSPRPSGMISAPKVESVKTTASMPRPSGIISAPKAELVKSAASAASLPCTSGIISSPKAELVKSAASAASFPRPSSMLSAPKADPVKIVPAAATNTKSVGPLNLRHAVNGSPNHTIPSSPFTKPLHMAPLSKGSTIQSNSVPPSFASSRLVPTQRAPAATVVTPQKPSVVAAATVVTPQKPSVGAAATVVTPQKPSVGAAANVVTPQKPSVGSAATVVTPQKPSVGAAVTVTSKPVGVQKEQTQGNRASPLVTATLPPNKTIPANSVIGTAKAVAAKVETPPSLMPKKNEVVGSCTDKSSLDKPPEKESTTTVSPLAVAATKSKPKDEATVTGTGLKEL

SEQ ID NO: 882 - protein, 64 aa, Arabidopsis thaliana
MSDPSGQSSTTTVGGIAGGSGCNGGGGGSGSGSGGSFGNQPRRSKVRKQVWAGVLGISSDSTNN

SEQ ID NO: 883 - protein, 426 aa, Arabidopsis thaliana
MTTIRSSPSSSRCSNSSSSSSYSLASTSLSNRLETIFKKASELCTLCDIEACVIYYGPDGELKTWPKEREKVRDIALRFNQLNEALRHKKSVNLHGFLNKKKKNKGLKNPNKKKKTSLKNVNVLKYPLADHYSPDQVSQLTQSLELNVSKFQERLRFLESQKQNETKPDHQSLTSISSLNQSLNPSQFSLFMYNHGYNTLSQIPVSASNFNQDYISALLEQSELKSQIMKQEVCGYEQNMCMSNHGDATLSQIPFSASNFNQDFSANNNFQHSFVSNTQDYYSVQKSVNNNYGLKNQLMKHDLCGYEHNMCMSNHGDATFSQIPLSASNFNQDFSVSIQEESGLMQQELCGYDQNQNMSMGDITNNNFQVTCASVLESVNNFGLNQLMHKEFYGCHQNMSMGNINNNSFQHPWVSNADHTRRYKNL

SEQ ID NO: 884 - protein, 417 aa, Arabidopsis thaliana
MMMSCRNIDLGTSVLDHSCSSSSTSRRFLFGNSSKTVCMIGGRSCVGNLVFLRRDLATCRAVPAKSKENSLVNGIGQDQTVMLNLRQESRKPISLETLFEVVADDLQRLNDNLLSIVGAENPVLISAAEQIFSAGGKRMRPGLVFLVSRATAELAGLKELTVEHRRLGEIIEMIHTASLIHDDVLDESDMRRGRETVHELFGTRVAVLAGDFMFAQASWYLANLENLEVIKLISQVIKDFASGEIKQASSLFDCDVKLDDYMLKSYYKTASLVAASTKGAAIFSKVESKVAEQMYQFGKNLGLSFQVVDDILDFTQSTEQLGKPAANDLAKGNITAPVIFALENEPRLREIIESEFCEPGSLEEAIEIVRNRGGIKKAQELAKEKAELALKNLNCLPRSGFRSALEDMVMFNLERID

SEQ ID NO: 885 - protein, 196 aa, Arabidopsis thaliana
MITGIPNPNARAAYNPGPAETVTTVIVEKKAIEERSRRTRSKHMHFRSDYSDISPVNSDSISPKYQPPKRRKQHRRKRVHNQEPCLMRGVYYKNMKWQAAIKVEKKQIHLGTFSSQEEAARLYDRAAFMCGREPNFELSEEVIRELKQQSWEEFLNCTRRTITNKKPKSRIEHEDTKINASMPHQPEEEEQDSDKM

SEQ ID NO: 886 - protein, 260 aa, Arabidopsis thaliana
MASSSSMQMVHTSRSIAQIGFGVKSQLVSANRTTQSVCFGARSSGIALSSRLHYASPIKQFSGVYATTKHQRTACVKSMAAEEEEVIEPQAKVTNKVYFDVEIGGEVAGRIVMGLFGEVVPKTVENFRALCTGEKKYGYKGSSFHRIIKDFMIQGGDFTEGNGTGGISIYGAKFEDENFTLKHTGPGILSMANAGPNTNGSQFFICTVKTSWLDNKHVVFGQVIEGMKLVRTLESQETRAFDVPKKGCRIYACGELPLDA

SEQ ID NO: 887 - protein, 278 aa, Arabidopsis thaliana
MTQSSSKPPLANCKISVPAWEKDFCAVIGSVPWWKVVEAKRFMHIYDRVVQWDDSAGEDAFKNAKSRFWAEINGLTCDLSLPDPDVYIDDVDWDAEVDNELILDLERGPDPLTEEQEHVVILDALVLSGQYGGLGWGTGWGDAEGINEENVGKGKPENSWGDQKYDGWNEDSWGIKEKTETWDHNNNNTNTDSWDHNNNFKAETWDQKNCNNNSFNYKKVENWNGRDQGRENRGWRKRGEGRHGGERVEDCRWRNGRGRSRGGFQQHSANAWGWTESF

SEQ ID NO: 888 - protein, 205 aa, Arabidopsis thaliana
MFSLMSGLWSYMFSKTEFNVLILGIDKAGKTTFLEKLKTIYSISEGLPHDRIVPTVGLNIGRIEVSNAKIVFWDLGGQPGLRSIWEKYYEEAHALIYLIDAACPTRFEDSKSALEKALRHEDLQGAPLLILANKQDLTNAVSAEELDRYLDLKKLDERVYMFEAVSGYDGRGIKESIEWLVGVMEKSKRTESLRARAGYTPVPNS

SEQ ID NO: 889 - protein, 309 aa, Arabidopsis thaliana
MEKYEKLEKVGEGTYGKVYKAMEKGTGKLVALKKTRLEMDEEGIPPTALREISLLQMLSTSIYVVRLLCVEHVHQPSTKSQSTKSNLYLVFEYLDTDLKKFIDSYRKGPNPKPLEPFLIQKLMFQLCKGVAHCHSHGVLHRDLKPQNLLLVKDKELLKIADLGLGRAFTVPLKSYTHEIVTLWYRAPEVLLGSTHYSTGVDMWSVGCIFAEMVRRQALFPGDSEFQQLLHIFRLLGTPTEQQWPGVSTLRDWHVYPKWEPQDLTLAVPSLSPQGVDLLTKMLKYNPAERISAKTALDHPYFDSLDKSQF

SEQ ID NO: 890 - protein, 269 aa, Arabidopsis thaliana
MAKEGGLGENSRWSLGGMTALVTGGSKGIGEAVVEELAMLGAKVHTCARDETQLQERLREWQAKGFQVTTSVCDVSSRDQRVKLMETVSSLYQGKLNILVNNVGTSIFKPTTEYTAEDFSFVMATNLESAFHLSQLAHPLLKASGSGSIVLISSAAGVVHVNVGSIYGATKGAMNQLARNLACEWASDNIRTNSVCPWYITTPLSNDFFDEEFKKEAVRTTPMGRVGEANEVSPLVAFLCLPSASYITGQTICVDGGATVNGFSFKTMP

SEQ ID NO: 891 - protein, 383 aa, Arabidopsis thaliana
MVAEAEVVFQQSLPAVLEIELFDGVSSAVKSPVSSPKLGFTQSTASVSGSLTTSPVADIFPEGDCDPSVLDYIPTIRSGSFADIGPKRNMEDEHIRIDDLSSQVGSLFELPKPSAFYAVFDGHGGPEAAAYVRENAIRFFFEDEQFPQTSEVSSVYVEEVETSLRNAFLQADLALAEDCSISDSCGTTALTALICGRLLMVANAGDCRAVLCRKGRAIDMSEDHKPINLLERRRVEESGGFITNDGYLNEVLAVTRALGDWDLKLPHGSQSPLISEPEIKQITLTEDDEFLVIGCDGIWDVLTSQEAVSIVRRGLNRHNDPTRCARELVMEALGRNSFDNLTAVVVCFMTMDRGDKPVVPLEKRRCFSLSPEAFCSLRNLLDG

SEQ ID NO: 892 - protein, 127 aa, Arabidopsis thaliana
MASPKSSTRPNQENQEPQFQDFFPTMAGKLGGEGLIEEICKGFELLMDKDKGVITFESLRRNASTVLGLGDLTDDDVRYMINEGDFDRDGALNQMEFCVLMFRLSPELMEASRCVVTEVIEEEFYRH

SEQ ID NO: 893 - protein, 253 aa, Arabidopsis thaliana
  misc_feature (76)..(76): Xaa can be any naturally occurring amino acid
  misc_feature (112)..(113): Xaa can be any naturally occurring amino acid
  misc_feature (141)..(141): Xaa can be any naturally occurring amino acid
  unsure (1)..(253): unsure at all Xaa locations
MASNFWTSTHYKELKDPQEVNVVHPLDAQRGISVEDFRLIKLHMSNYISKLAQHIKIRQRVVATAVTYMRRVYTRXSLTEYEPRLVAPTCLDLACKAKESVVHAKLLVFYMXXLYADEKFPFEIKDFLEMEMKVWEALDLXLVVFHPYRSLPEFLQDSGINDTSMTHLTWGLVNDTYRMDLILIHPPFLITLACIYIASVHKEKDIKTWFEELSVDMNIVKNIAMEILDFYENHRLFTEERVHAAFNKLATNP

SEQ ID NO: 894 - protein, 147 aa, Arabidopsis thaliana
MPHGTLEVVLVSAKGLEDADFLNNMDPYVQLTCRTQDQKSNVAEGMGTTPEWNETFIFTVSEGTTELKAKIFDKDVGTEDDAVGEATIPLEPVFVEGSIPPTAYNVVKDEEYKGEIWVALSFKPSENRSRGMDEESYGGWKNSEASY

SEQ ID NO: 895 - protein, 459 aa, Arabidopsis thaliana
MPGFDRISELPESLITQILLCLPTKDSVKTSVLSTRWKNLWLNVPGLDLTCSDFPFEDEEYEQVFINFIDRFLEFNPESRLQTFEVDYKRREIRGFKDRIGTAINRGIRLLDAVSSTMYWEEECIMYPYLEFMPLNLFTSKTLVTLKLRDSALNDPGLLSMPCLKFMILREVRWSGTMSLEKLVSGCPVLEDLTLVRTLICHIDDDELPVTRVRSRSLKTFYVPLAYGVGCRSRVPDKVLEIDAPGLENMTLKEDHFDGIVVKNLTSLFMIELNIKFAVDYRRSFDPEDLSKRNEIGDFLTGISRARHMIISQKTVKALESYSKVGSIPKFNNLSHLKAVFPSPLLPFLPAFLESFPNLKNLILKIAFAKDDETEELNLINVPRCIVSTLECVEIKGLFEWEEEEMKIARYFLENAAVLKKLTMSFIDYPRYASNSDVYEDLDKLTKRSQQCRIIVDDE

SEQ ID NO: 896 - protein, 359 aa, Arabidopsis thaliana
MEGDVGIGLVCQNTMDGKASNGNGLEKTVPSCCLKAMACVPEDDAKCHSTVVSGWFSEPHPRSGKKGGKAVYFNNPMWPGEAHSLKVEKVLFKDKSDFQEVLVFESATYGKVLVLDGIVQLTEKDECAYQEMIAHLPLCSISSPKNVLVVGGGDGGVLREISRHSSVEVIDICEIDKMVIDVSKKFFPELAVGFDDPRVQLHIGDAAEFLRKSPEGKYDAIIVDSSDPVGPALALVEKPFFETLARALKPGGVLCNMAESMWLHTHLIEDMISICRQTFKSVHYAWSSVPTYPSGVIGFVLCSTEGPAVDFKNPINPIEKLDGAMTHKRELKFYNSDMHRAAFALPTFLRREVASLLAS

SEQ ID NO: 897 - protein, 456 aa, Arabidopsis thaliana
MEEENEVVKTFAELGVREELVKACERLGWKNPSKIQAEALPFALEGKDVIGLAQTGSGKTGAFAIPILQALLEYVYDSEPKKGRRPDPAFFACVLSPTRELAIQIAEQFEALGADISLRCAVLVGGIDRMQQTIALGKRPHVIVATPGRLWDHMSDTKGFSLKSLKYLVLDEADRLLNEDFEKSLNQILEEIPLERKTFLFSATMTKKVRKLQRACLRNPVKIEAASKYSTVDTLKQQYRFVAAKYKDCYLVYILSEMPESTSMIFTRTCDGTRFLALVLRSLGFRAIPISGQMTQSKRLGALNKFKAGECNILVCTDVASRGLDIPSVDVVINYDIPTNSKDYIHRVGRTARAGRSGVGISLVNQYELEWYIQIEKLIGKKLPEYPAEEDEVLSLLERVAEAKKLSAMNMKESGGRKRRGEDDEESERFLGGNKDRGNKERGGNKDKKSSKKFKR

SEQ ID NO: 898 - protein, 612 aa, Arabidopsis thaliana
MSASWADVADSEKAVSQSKPPYVPPHLRNRPSEPVAAPLPQNDHAGYGGQPAGSRWAPPSSGGGGASGGGYRNDGGRTGYGYGAGGGGGGGGGWNNRSGGWDRREREVNPFGDDAELEPVFTEQENTGINFDAYEDIPVETSGGDVPPPVNTFADIDLGDALNLNIRRCKYVRPTPVQRHAIPILLAERDLMACAQTGSGKTAAFCFPIISGIMKDQHVERPRGSRAVYPFAVILSPTRELACQIHDEAKKFSYQTGVKVVVAYGGTPIHQQLRELERGCDILVATPGRLNDLLERARVSMQMIRFLALDEADRMLDMGFEPQIRKIVEQMDMPPRGVRQTMLFSATFPSQIQRLAADFMSNYIFLAVGRVGSSTDLITQRVEFVQESDKRSHLMDLLHAQRETQDKQSLTLVFVETKRGADTLENWLCMNEFPATSIHGDRTQQEREVALRSFKTGRTPILVATDVAARGLDIPHVAHVVNFDLPNDIDDYVHRIGRTGRAGKSGIATAFFNENNAQLARSLAELMQEANQEVPEWLTRYASRASFGGGKKRSGGRFGGRDFRREGSYSRGGGGGGGGGGSDYYGGGGYGGGGYGGAPSGGYGAGVTSAWD

SEQ ID NO: 899 - protein, 563 aa, Arabidopsis thaliana
MMISEKPLGEESIRQDLEVLTVSRRLVKSVSQKLKKKIHKTEVVEDEEVARGAVNCLSISVGCRVADTGEDFEEDLSNKRWSSASEDGKGLMTICGTEEIRLDCFSYGVRERFWKKNNRRYLADSGQDYRKHVYLPDDILEMCLMRLPLTSLLNAHLVCKKWQSMANTQRFLQMRREGSFQTPWLFLFAALKDGCSSGDIHGYDVSQDKWHRIETDLLKGRFMYSVTSIHEEIYIVGGRSMDRNSFKSHRGILVFSPSIKAWRKIASMRHARSLPIVGATEVTSEFSTMQTKQNRQDRRFHLSRVGGESDVYEDPHRLSVRRQNRNSADQNGTKSHRLIRQKLDRLNRNSSKRFVLIAIGGTGIFDEPLDSGEIYDSATNTWSEMQRLPMGFGVVSCGIICNGIFYAYSENDKLSGYDIERGFWITIQTSPIPPRVHEFYPKLVSCNHRLFMLSVSWCDEGDGQIGRRNKAVRKLWELDLVYLTWTEVSVHPDAPMDWNATYVSDQNILMGVEMFKIFGQVLSFFTVCDILTEEASWRHVSRNQRNQKLNLSCMNKTIALLHL

SEQ ID NO: 900 - protein, 118 aa, Arabidopsis thaliana
MARVVKIDSAESWNFYVSQAKNQNCPIVAHFTALWCIPSVFMNSFFEELAFNYKDALFLIVDVDEVKEVASQLEVKAMPTFLFLKDGNAMDKLVGANPDEIKKRVDGFVQSSRVVHIA

SEQ ID NO: 901 - protein, 401 aa, Arabidopsis thaliana
MTMGNFLKRFGSGKSRSSRNMTLGTTSSQSHEPSPSDPSLSLADNTNATKKKYALIPDRFSSLDQVSKALREAGLESSNLILGVDFTKSNEWTGKTSFDGKCLHALGETSNPYEKAIFVIGQTLAPFDEDNLIPCFGFGDSTTHDEEVFGFHSDNSPCHGFEEVLACYKRIAPNLRLSGPTSYGPLIDAAVDIVEKNNGQFHVLVIVADGQVTRGTDMAEGELSQQEKTTIDAIVNASSYALSIVLVGVGDGPWEDMRKFDDKIPKREFDNFQFVNFTEIMTRNSPESAKETAFALAALMEIPFQYQAAIELRLLGKQTGLAKTIVPRPPPIPYTPPTNAELPSTASPASPEQTQSCPICLTNRKDVAFSCGHMTCGDCGSKISNCPICRVRITNRLKLYT

SEQ ID NO: 902 - protein, 415 aa, Arabidopsis thaliana
MGSSMEEKVVAVIMVGGPTKGTRFRPLSLNIPKPLFPIAGQPMVHHPISACKRIPNLAQIYLVGFYEEREFALYVSAISNELKVPVRYLREDKPHGSAGGLYHFRNLIMEDSPSHIFLLNCDVCCSFPLPKMLEAHRGYGGIGTLLVIKVSPESASQFGELVADPVTNELLHYTEKPETFVSDRINCGVYVFTPEIFNAIGDVSTQRKDRATLKRVSSFEALQPATRIPTDFVRLDQDILSPLAGKKRLYTYETMDFWEQIKSPGMSLRCSGLYLSQFRLTSPQLLASGDGTRSAIVIGDVYIHPSAKVHPTAKIGPNVSISANARVGPGVRLMSCIILDDVEIMENAVVTNAIVGWKSSIGRWSRVQAEGVYNSKLGVTILGDSVAVEDEVVVTSSIVLPNKTLNVSVQDEIIL

SEQ ID NO: 903 - protein, 485 aa, Arabidopsis thaliana
MKLELVFIPSPGDGHLRPLVEVAKLHVDRDDHLSITIIIIPQMHGFSSSNSSSYIASLSSDSEERLSYNVLSVPDKPDSDDTKPHFFDYIDNFKPQVKATVEKLTDPGPPDSPSRLAGFVVDMFCMMMIDVANEFGVPSYMFYTSNATFLGLQVHVEYLYDVKNYDVSDLKDSDTTELEVPCLTRPLPVKCFPSVLLTKEWLPVMFRQTRRFRETKGILVNTFAELEPQAMKFFSGVDSPLPTVYTVGPVMNLKINGPNSSDDKQSEILRWLDEQPRKSVVFLCFGSMGGFREGQAKEIAIALERSGHRFVWSLRRAQPKGSIGPPEEFTNLEEILPEGFLERTAEIGKIVGWAPQSAILANPAIGGFVSHCGWNSTLESLWFGVPMATWPLYAEQQVNAFEMVEELGLAVEVRNSFRGDFMAADDELMTAEEIERGIRCLMEQDSDVRSRVKEMSEKSHVALMDGGSSHVALLKFIQDVTKNIS

SEQ ID NO: 904 - protein, 366 aa, Arabidopsis thaliana
MRPIQSPPGVSVPVKSRPRRRPDLTLPLPQRDVSLAVPLPLPPTSGGSGGSSGSAPSSGGSASSTNTNSSIEAKNYSDLVRGNRIGSGAGGTVYKVIHRPSSRLYALKVIYGNHEETVRRQICREIEILRDVNHPNVVKCHEMFDQNGEIQVLLEFMDKGSLEGAHVWKEQQLADLSRQILSGLAYLHSRHIVHRDIKPSNLLINSAKNVKIADFGVSRILAQTMDPCNSSVGTIAYMSPERINTDLNQGKYDGYAGDIWSLGVSILEFYLGRFPFPVSRQGDWASLMCAICMSQPPEAPATASPEFRHFISCCLQREPGKRRSAMQLLQHPFILRASPSQNRSPQNLHQLLPPPRPLSSSSSPTT

SEQ ID NO: 905 - protein, 217 aa, Arabidopsis thaliana
MEGGGGSSGGGAGGVVPESAIEAVNQTLAYLKELKPQLEQMLTLAEPEVLAAMQPLQRAKTMHLLAEATTTLYELRLRCTGVDPDDHRVKSEIERINVYREKFQKCVDQSKGPLRPTTVLNRQAATRFIEHSLPDLTSTQKQSIRDLSKGEKSRIRYSETSARKRKYQSNEKQSVQSAAKDFLEKAAREIIGHNENGLKGPLVAAADGSDDVEVGTA

SEQ ID NO: 906 - protein, 172 aa, Arabidopsis thaliana
MSVASPIQCIRILNPSSSSSSSTASSSFRFSTTTKPCVFIIRCSQTEGPLRRPSAPPTLREPQKPVPPSQPSSSPPPSPPPQKAVAVDGKSVTTVEFQRQKAKELQEYFKQKKLEAAGQGPFFGFQPKNEISNGRWAMFGFAVGMLTEYATGSDLVDQVKILLSNFGILDLE

SEQ ID NO: 907 - protein, 343 aa, Arabidopsis thaliana
MRGLFKSKPRTPADIVRQTRDLLLYADRSNSFPDLRESKREEKMVELSKSIRDLKLILYGNSEAEPVAEACAQLTQEFFKADTLRRLLTSLPNLNLEARKDATQVVANLQRQQVNSRLIAADYLESNIDLMDFLVDGFENTDMALHYGTMFRECIRHQIVAKYVLDSEHVKKFFYYIQLPNFDIAADAAATFKELLTRHKSTVAEFLIKNEDWFFADYNSKLLESTNYITRRQAIKLLGDILLDRSNSAVMTKYVSSMDNLRILMNLLRESSKTIQIEAFHVFKLFVANQNKPSDIANILVANRNKLLRLLADIKPDKEDERFDADKAQVVREIANLKLRELA

SEQ ID NO: 908 - protein, 257 aa, Arabidopsis thaliana
MGRGKVELKRIENKINRQVTFAKRRNGLLKKAYELSVLCDAEIALLIFSNRGKLYEFCSSPSGMARTVDKYRKHSYATMDPNQSAKDLQDKYQDYLKLKSRVEILQHSQRHLLGEELSEMDVNELEHLERQVDASLRQIRSTKARSMLDQLSDLKTKEEMLLETNRDLRRKLEDSDAALTQSFWGSSAAEQQQQHQQQQQGMSSYQSNPPIQEAGFFKPLQGNVALQMSHYNHNPANATNSATTSQNVNGFFPGWMV

SEQ ID NO: 909 - protein, 127 aa, Arabidopsis thaliana
MASKALILLGLFAILLVVSEVSAARQSGMVKPESEATVQPEGYHGGHGGHGGGGHYGGGGHGHGGHNGGGGHGLDGYGGGHGGHYGGGGGHYGGGGGHGGGGHYGGGGHHGGGGHGLNEPVQTKPGV

SEQ ID NO: 910 - protein, 372 aa, Arabidopsis thaliana
MPKERKERSVSLDKYKRSPLCCEASLALKPSEKQVKEWEEARCPVCMEHPHNGILLICSSYENGCRPYMCDTSHRHSNCFDQFRKASKEKPSLSLLREEEESNEPTEMEDVDSDSTAVNLLGEAASEITVVDLSDGERGEEEVEEEEEEVVVEEEEEGIVTTEEDQEKNKPQKLTCPLCRGHIKEWVVVKAARCFMNSKHRSCSCETCDFSGSYSDLRKHARLLHPGVRPSEADPERQRSWRRLERQSDLGDLLSTLQSSFGGDEISNDDGFLFADTRLLTVYFLIRVFRPESSGSRSSSWSGTSRARTHTSGRRRSSRPASLWGESYEGNTGTSPRDEENNQSSDEQVSGTRRRRSRRRTVIDDDDEEEEP

SEQ ID NO: 911 - protein, 334 aa, Arabidopsis thaliana
MAPEMNNKLSYGEKKRAYVTFLAGTGDYVKGVVGLAKGLRKTKSKYPLVVAVLPDVPADHRRQLLDQGCVIKEIQPVYPPDNQTQFAMAYYVLNYSKLRIWKFVEYSKLIYLDGDIQVFENIDHLFDLPDGNFYAVKDCFCEKTWSHTPQYKIGYCQQCPDKVTWPESELGPKPPLYFNAGMFVYEPSLPTYYNLLETLKVVPPTPFAEQDFLNMYFKDIYKPIPPVYNLVLAMLWRHPENIELNEAKVVHYCAAGAKPWRFTGQEGNMEREDIKMLVEKWWDIYNDESLDYKNFNVHCGQKEDVHRKPKTLPQFFTDLSEADVLQCAKAPSAA

SEQ ID NO: 912 - protein, 446 aa, Arabidopsis thaliana
MTLFHRLDLIDPYTCTPLIVRETSIVEPSSLFLGFPSFIDEDIEDLFEFSSPNPLDLFETVTDLVKIKKSPSSCKYKVIRRRLEPEYPLKYLCDRVSDLESKFDRLVSPKSDRKYTLTKEIKGSGERKYKWEAEIQGPLERKYKLEAEIEGSGERKYRWTTEIKGGKKDEEGLKLAALKKEKAKAKAIAAAEAEKKKNKNKKKSYNWTTEVKSERENGEVSHTYIIKATTGGEKKKKHEEKEKKEKIETKSKKKEKTRVVVIEEEEEEDDESSEHGAIVLRKAFSRRNGAVRTKKGKNKEMPPEYAAVMIQRAFKAYLIRRSKSLRALRDLAIAKTKLKELRASFHNFSYRRLIARDGEERQKFSEKIIVLLLTVDAIEGVDVMVRGAKRSMVDELEAMLDVVDPQPQGKSLSMRRRTFDMPDSLIRKEIAEGVTQIVQMLETEEE

SEQ ID NO: 913 - protein, 258 aa, Arabidopsis thaliana
MMNLRVLFLALLLLASPLLQVARCQSDAEDHSSLVDDVVGENTDDAVEEDDHDLDMNLSSFPGVETVCVFPKNSAKLVPAGEETELLVGLKNEGKTRVGVMGIRASVHLPYDHKLLVQNLTMLRLNNASIPTSLQATFPYIFAVSQYLQPGAFDLVGYIIYDVEGKPYQSVFYNGTIEVVESGGLLSGESVFLLTLGIGLLLLLGLWAYSQVQRLTKKTKKVSKVEVGTRSTEASLDEWLEGTTLAKTSSGKTKNKKN

SEQ ID NO: 914 - protein, 119 aa, Arabidopsis thaliana
MEKSRESEFLFCNLCGTMLVLKSTKYAECPHCKTTRNAKDIIDKEIAYTVSAEDIRRELGISLFGEKTQAEAELPKIKKACEKCQHPELVYTTRQTRSADEGQTTYYTCPNCAHRFTEG

SEQ ID NO: 915 - protein, 438 aa, Arabidopsis thaliana
MSTKLWRWVLGLIYLFAVATIWIAASFVVQSVVEAGVSPFLITFICNSLFVVYLPLFEIGRYLEDAYGSLLFWRSKRSHLMELVESEKAVLLGKDVSGVKSDATESSGLVVREQEISEGGNGIESGLENIELEIDASVNVSDGASGVSNKGLDEKGRWTRMRVAKVSLVICPFWFLAQLTFNVSLKYTTVTSNTILSSASSLFTFLVSLIFLGEKFTWLKLFSVLLCMSGTIIVSMGDSESKSNAVAKNPLLGDILSLVSAALYAVYITLIRKKLPDDDERNGRVSMAQFLGFLGLFNFFIFLPPALILNFTKRERFNALTLKQFGLVVGKGLLDNVLSDYLWAKAVLLTTTTVATAGLTIQVPLAAIVDSLSGNKPSFTDYIGAAAVMVGFAGINIPSEMFCKSKETAIELEPGTSFTDPPPIVPDSIRVDSSLTVV

SEQ ID NO: 916 - protein, 731 aa, Arabidopsis thaliana
MMLVFLLIRRQWRSASVRREEVIRLIALATEESYLAEEVRPATVDYGGDSVSDVYRCAVCLYPTTTRCSQCKSVRYCSSKCQILHWRRGHKEECRSPDYDEEKEEYVQSDYDAKESNVDFPSRGTAYESSSNVSVDVACDMSTSRPSIHKVQPRSEAVDFTTSLNIKDNLYETRPLSRKKSRNRTDKVESASNYSKGKTDAKLRKLGNQNSRRSGDSANMSISDQFLSVGFEEEMNALKHERITSEPSSASAAMSSSSTLLLPSKANSKPKVSQASSSGLKTSVQKVVQHFRPPQSSKKSQPSSSIDEMSFSYELFVKLYCDRVELQPFGLVNLGNSCYANAVLQCLAFTRPLISYLIRGLHSKTCRKKSWCFVCEFEHLILKARGGESPLSPIKILSKLQKIGKHLGPGKEEDAHEFLRCAVDTMQSVFLKEAPAAGPFAEETTLVGLTFGGYLHSKIKCMACLHKSERPELMMDLTVEIDGDIGSLEEALAQFTAYEVLDGENRYFCGRCKSYQKAKKKLMILEGPNILTVVLKRFQSDNFGKLSKPIHFPELLDISPYMSDPNHGDHPVYSLYAVVVHLDAMSTLFSGHYVCYIKTLDGDWFKIDDSNVFPVQLETVLLEGAYMLLYARDSPRPVSKNGGRKSKQRRNLAAIPSRKGNKKQRDGDNNSLLPRVDWSSGSLSSMFSSSDTTSSCSTKDSSGIENLSDYLFGGVEPVWKWDRHNKSQTFD

SEQ ID NO: 917 - protein, 225 aa, Arabidopsis thaliana
MGYWNSKVVPKFKKLFEKNSAKKAAAAEATKTFDESKETINKEIEEKKTELQPKVVETYEATSAEVKALVRDPKVAGLKKNSAAVQKYLEELVKIEFPGSKAVSEASSSFGAGYVAGPVTFIFEKVSVFLPEEVKTKEIPVEEVKAEEPAKTEEPAKTEGTSGEKEEIVEETKKGETPETAVVEEKKPEVEEKKEEATPAPAVVETPVKEPETTTTAPVAEPPKP

SEQ ID NO: 918 - protein, 364 aa, Arabidopsis thaliana
MKAFYVFVVALLLTLNYRGEASGSVFFIDGSNNQYLRPRSSSEALPMSPVEISAAVSALLGFAPSATLTADGSSKLNKILKPNPFERPRAAFVLEIAGADDMLLETSPSHSFLGNAIRSSIKSDSYKADTELPDNEVVVVSVNEPSSDVTDKDINDFASWLGGSYVAGAEPSSGLLSIPLAGGANVEFNLEKEAERKFALNLLGLYQNIRQAVSVYDDLSHGIDRTAELTVGRFGGIDALAQEYGQGMAKQGMDVLLSTLSKLFNLLETSHKGQIVGVIVLDERVNQESENLLNFGSSRSSARSMVEVEGIPSAAIIAEVILVRLTLAWLTGIILLIATILGVYFLMNMPLTKDTLLYSNVKLD

SEQ ID NO: 919 - protein, 147 aa, Arabidopsis thaliana
MLLGKRQRPPIKRTTSLSEIKFDLNQPSEQEPSDHQIQLVNVDEHRQVHQRLLDQRLLAMVSPRGTQRRHSSDYSEDFLRSCSLCKRLLVHGRDIYMYRGDRAFCSLECRQQQITVDERKEKKKGSVRSTIVVATGTTTGERVSAAV

SEQ ID NO: 920 - protein, 204 aa, Arabidopsis thaliana
MGSRSGEQGKRMAELSKNLKEGERILEPTRRPDGTLRKPIRIRPGYTPEDEVVKYQSKGSLMKKEMASQGPPGYEPDPAPKPKTKAAKRNERKKEKRLQATAEKANSSEDGSASNGSQSVNVLASEMEALDVSSNNDVCGGAPNPGTTGEDVEKRIRALKKKIRLTEAQQQKTASRDLNPEQLEKFSKLEEWRQELKALEDKAA

SEQ ID NO: 921 - protein, 232 aa, Arabidopsis thaliana
MASSSDSWMRAYNEALKLSEEINGMISERSSSAVTGPDAQRRASAIRRKITIFGNKLDSLQSLLAEIHGKPISEKEMNRRKDMVGNLRSKANQMANALNMSNFANRDSLLGPDIKPDDSMSRVTGMDNQGIVGYQRQVMREQDEGLEQLEGTVMSTKHIALAVSEELDLQTRLIDDLDYHVDVTDSRLRRVQKSLAVMNKNMRSGCSCMSMLLSVLGIVGLAVVIWMLVKYM

SEQ ID NO: 922 - protein, 208 aa, Arabidopsis thaliana
MDQNVPISKKLWNIVRFLLYMIRKGVSKNKLIADFNATLKRGKNLMFHQRRRVHAGSTASAALNATSATASSRQEYEFSCSNTPNYSFPFSNMAFMRKKSHNNLFTCGQTPQTLDDDVAAARAVLELLNGVGEKGNVTPADLTVALSPYFPGFGQTPLVRPLRVTDSPFPLTPENGDVANGHVDKAADDFIKKFYKNLNQQKKMIEFS

SEQ ID NO: 923 - protein, 148 aa, Arabidopsis thaliana
MAFRITGQLRPVGNQFGGSRRFATTVADGAKQTYNKFSIMGEFAPVAIIGGFVGLAVLMAGHSLKQQLMHAPAISTRKNRRAAVAEVDDPENCVSSADKFINKSWLRKVGQIQDKSKAILSDPTRPNPFTTPRNAETLNSVGVAPKGI

SEQ ID NO: 924 - protein, 348 aa, Arabidopsis thaliana
MASLISFSLLPKPKAVRSSISAPQTQTINTEKLEDKFGRKGIKFSESNNIPMVELKVRNGSSLKLSLSDAHVLSYKPKVYWKDEGFEEVLYTVDGDESRGGVGVVIVNGEEPKGGSSVISGCDWSVKDTDSDAIDALQIELSCTAGVLDITYIVSLYPVSMATALVVKNNGRKPVTLKPGIMSYLRFKKRSGAGIQGLKGCSYCPNPPLSSPFELLSPSEAMKAESSGWFGSEEGEKPGIWAVEDSVITLLEKKMSRIYGAPPAERLKAVYNTPPSKFETIDQGRGLFFRMIRIGFEEMYVGSPGSMWDKYGKQHYFVCTGPTSMLVPVDVASGETWRGAMVIEHDNL

SEQ ID NO: 925 - protein, 272 aa, Arabidopsis thaliana
MDIKHHTSTSKPKNKNKLLKMLPKAMSFGHRVPPFSPGRDLHHNNHHNYTAANKMFFSGPMVPLVPNAARVRRNKSDAVWDEPTSPKVSCIGQIKLGKSKCPTGKKNKAPSSLIPKISKTSTSSLTKEDEKGRLSKIKSIFSFSPASGRNTSRKSHPTAVSAADEHPVTVVSTAAVPSLGQMKKFASSRDALGDFDWAVEMKHEEESPADHHRGYYSDDDTRGAYLRYDDDEDEDDIIIPFSAPLGLKPKKEVNLWKRRTMDPPKPLHLQTI

SEQ ID NO: 926 - protein, 465 aa, Arabidopsis thaliana
MKSVIFTEEKNLQRQNPLQKSEQQRRNFEMPSPPTTTSLSVTQTINGSHSFTIKGYSLAKGIGIGKHIASDTFTVGGYQWAIYFYPDGKNPEDNSAYVSVFIALASDGTDVRALFELSLLDQSGKGKHKVHSHFDRALESGPYTLKYRGSMWGYKRFFRRLMLETSDFLKDDCLKINCTVGVVVSEIDCPRLHSIHVPASDIGSHFGMLLENEDGSDITFNVSGEKFRAHRLVLAARSPVFESEFLDVTGEEDRDIEVTDMEPKVFKALLHYIYKDALIEDAESSSSSGSSVGPSASDTLAAKLLGAADKYKLPRLSLMCESVLCKDISVDSVANILALADRYNASALKSVCLKFAAENLIAVMRSDGFDYLREHCPSLQSELLKTVAGCEEELSGGGGKTRSVWGQFSDGGAETNGRQAQTWGDINGGAERSQSVWVEVVNANGSGRNNNDNNNSDDPMAELED

SEQ ID NO: 927 - protein, 355 aa, Xanthomonas campestris
MPLSRLLTCLVASLAAYAVQAKSPMPPPSPIMLSEFIADQAPTPQAHASTLLETRDGTLLAAWFGGAHEGAADVGIWLAQRGPQHWQTPRRIADGAHAGVDGAALPAWNPVLFQSATGPVQLYYKLGPNPRDWWGLRITSSDNGAHWSPPQRLPDGILGPIKNKPVQLPSGRILAPSSGEDRGWRAHLEWSDDDGAHWQRGLPLNDAATIGAIQPSLLLHADGRLQALGRSQQNKLFSAFSDDGGLHWQPMQLLDVENPNSGTDAVMLHDGRALLVYNPGIAGKQWWDGRGTLAVAVSDDGVQWRRVLTLEDSPKDEFSYPAVIQTRDGLVHISYTWKRQRIKHVVIDPAKLKVR

SEQ ID NO: 928 - protein, 476 aa, Saccharomyces cerevisiae
MIASKSSLLVTKSRIPSLCFPLIKRSYVSKTPTHSNTAANLMVETPAANANGNSVMAPPNSINFLQTLPKKELFQLGFIGIATLNSFFLNTIIKLFPYIPIPVIKFFVSSLYCGGENFKEVIECGKRLQKRGISNMMLSLTIENSEGTKSLSSTPVDQIVKETISSVHNILLPNIIGQLESKPINDIAPGYIALKPSALVDNPHEVLYNFSNPAYKAQRDQLIENCSKITKEIFELNQSLLKKYPERKAPFMVSTIDAEKYDLQENGVYELQRILFQKFNPTSSKLISCVGTWQLYLRDSGDHILHELKLAQENGYKLGLKLVRGAYIHSEKNRNQIIFGDKTGTDENYDRIITQVVNDLIINGEDSYFGHLVVASHNYQSQMLVTNLLKSTQDNSYAKSNIVLGQLLGMADNVTYDLITNHGAKNIIKYVPWGPPLETKDYLLRRLQENGDAVRSDNGWPLIKAIAKSIPKRVGL

SEQ ID NO: 929 - protein, 289 aa, Arabidopsis thaliana
MAISQAVLATVFGILGNIISFFVCLAPIPTFVRIYKRKSSEGYQSIPYVISLFSAMLWMYYAMIKKDAMMLITINSFAFVVQIVYISLFFFYAPKKEKTLTVKFVLFVDVLGFGAIFVLTYFIIHANKRVQVLGYICMVFALSVFVAPLGIIRKVIKTKSAEFMPFGLSFFLTLSAVMWFFYGLLLKDMNIALPNVLGFIFGVLQMILFLIYKKPGTKVLEPPGIKLQDISEHVVDVVRLSTMVCNSQMRTLVPQDSADMEATIDIDEKIKGDIEKNKDEKEVFLISKN

SEQ ID NO: 930 - protein, 356 aa, Arabidopsis thaliana
MVSHEENTSIVEWFLGPHPYTYPPYGIEMIHEDDEVAVAHHHHHHQSGEYYREYEDHRSSDVDNDEIIARTLQDDFLQLEIAESNDYSHQNQQQQHQQEGYTNNYSNNNNGYAWNDQSPAVDYSSEWIGNDNDQDGRSDDSVNVFSCSSPSDTDEYVYSWESDQCDADGEFGRRLNQMVPIPYIPKINGEIPPEEEAVSDHERLRNRLEMFDFTEVKVPGDGNCQFRALADQLYKTADRHKHVRRQIVKQLKSRPDSYQGYVPMDFSDYLRKMSRSGEWGDHVTLQAAADAYRVKIVVLTSFKDTCYIEILPTSQESKGVIFLSFWAEVHYNAIYLNRDTSETELQRKRKWWRFGN

SEQ ID NO: 931 - protein, 492 aa, Arabidopsis thaliana
MQFSCDPDQEGDELPQYEHIYQNDFSYRKHKKQKEEDISICECKFDFGDPDSACGERCLNVITNTECTPGYCPCGVYCKNQKFQKCEYAKTKLIKCEGRGWGLVALEEIKAGQFIMEYCGEVISWKEAKKRAQTYETHGVKDAYIISLNASEAIDATKKGSLARFINHSCRPNCETRKWNVLGEVRVGIFAKESISPRTELAYDYNFEWYGGAKVRCLCGAVACSGFLGAKSRGFQEDTYVWEDGDDRYSVDKIPVYDSAEDELTSEPSKNGESNTNEEKEKDISTENHLESTALNIQQQSDSTPTPMEEDVVTETVKTETSEDMKLLSQNSQEDSSPKTAIVSRVHGNISKIKSESLPKKRGRPFSGGKTKNVAQKHVDIANVVQLLATKEAQDEVLKYEEVKKEAAVRLSSLYDEIRPAIEEHERDSQDSVATSVAEKWIQASCNKLKAEFDLYSSVIKNIASTPIKPQDTKTKVAEAGNEDHIKLLEAK

SEQ ID NO: 932 - protein, 377 aa, Arabidopsis thaliana
MFGTPSSSPSFGTPSSTPAFGTSSPAFGTPSATPAFGTPSNPSFSSGGFGSSLFSSPFSSQQPQQQQQQQQQQQPSSLFQQQPSSNFGFQSPFNNTAQQQQQTPFPNAQLTTQMAPVAPIPYSLADRDVQAIIEAYKEDPTNPKYAFQHLLFSVTEPQYRVKPAAVSDIMWAEAMSKLEGMDSTERERLWPQLVQGFKDLSQRLKLQDEVLVSDRDRIKTTQSNVKMLQRHLQASTFPSIERLRQKEQSLQRRMLRVMRIIEGLEGKGFRLPLTKGEAELSEKLTAITRQVKGPGAELSRRVQSLQTISRAQANSIAAGSSLYLPGSTKIDEQSLIDMQEVLQQETEAIGRLGNVLKRDMRDMEIMVAEDTEMALDS

SEQ ID NO: 933 - protein, 245 aa, Arabidopsis thaliana
MAKVSFKDSLKALEADIQHANTVALDYPREKDGARVQMRLSYTPAAQFLLFLVQWTDCHLAGTLGLLRVLIYMTYADGKTTMSVYERKTSIKDFYAVIFPSLLQLERGITDLDDRKQKEVCKIRYRNKDETEKVKLSEIDIEREEECGICMEMNNMVVLPNCTHSLCIKCYRDWHGRSESCPFCRDSLKRVNSGDLWMLMEKSDTVNMYTIERENKKRLFVYIEKLPLVVPDQVFASSPYDCHVK

SEQ ID NO: 934 - protein, 322 aa, Arabidopsis thaliana
MGGVKRKISIELIEKKDSRAVAFSKRSRGLYSKASDLCLLSDAQIAIIATPVSSKSNVSFYTFGHSSVDNVVAAFLTNQRPREGLGLDYWWEDERLSKSEDLEELRDAMDSMSKMLKDLKDLQNQRDCEEDVKKKGVLHGTHQKQTFNPESCSVNFDGFNKNTEEFDLDEIFDYVSTAEALSMNLDMDDVSVVTTNQNPVSASETVEDRELVVHKNMDEDNIHVSDMDDKDTMLMISDKNNVLPENLDEFDQELDLDQLLDFETNYESLLKSCEMEDYASMVTTKQNLCSNPEAVEDGGLMIQKDLPEDNLCFSDYFSDLHC

SEQ ID NO: 935 - protein, 103 aa, Arabidopsis thaliana
MSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 936 - protein, 283 aa, Arabidopsis thaliana
MNGGEKLESIPIDLIIEIHSRLPAESVARFRCVSKLWGSMFRRPYFTELFLTRSRARPRLLFVLQHNRKWSFSVFSSPQNQNIYEKPSFVVADFHMKFSVSTFPDFHSCSGLIHFSMMKGAYTVPVVCNPRTGQYAVLPKLTRTRYENSYSFVGYDPIEKQIKVLFMSDPDSGDDHRILTLGTTEKMLGRKIECSLTHNILSNEGVCINGVLYYKASRIVESSSDDDTSDDDDDDHERSDVIVCFDFRCEKFEFIVICFYGQLINSVQLSLKQKSHQKLDLII

SEQ ID NO: 937 - protein, 254 aa, Arabidopsis thaliana
MVSNIDHKAMEALLRGQGCANNLKILLENGEISSVSTEPLIHTILDSFSLALSFMDSPNHPPYHESSSHNMASHMSRRSSKQVQHRRKLCVAEGLVNYNHDSRTMCPNDGFTWRKYGQKTIKASAHKRCYYRCTYAKDQNCNATKRVQKIKDNPPVYRTTYLGKHVCKAFAVHDDTYSSTMIRFDQVVPEPIMPQLTTIDHQVITVEENSAEHIMNQECDINDYLVDDDPFWASQFPPFPSSDTMFLENISAFD

SEQ ID NO: 938 - protein, 312 aa, Xanthomonas campestris
MSARIPTLDITRFDSDREAFVAELGAAYRQWGFAGIRNHGIAQSDIDAAYEVFKAFFALPDEVKRSYHVPGSGGARGYTAFGVETAKDSKHFDLKEFWHIGREIPDDSPYRAVMAPNLWPTEVPGFRERGYHLYQQLDQLGSRVLSALALHIGLPQDYFADKTDHGNSILRPIHYPPITSDDIPNVRAGAHGDINFITLLVGASAAGLEVRSNEGEWVPFTADADTIVVNIGDMLQRLTNHVYPSTIHRVVNPPGEEARKPRYSVPFFLHPNPDFLIDVLPSCISADNPSRYPEPITAHGFLEERLREIKLK

SEQ ID NO: 939 - protein, 136 aa, Arabidopsis thaliana
MARTKQTARKSTGGKAPRKQLATKAARKSAPTTGGVKKPHRYRPGTVALREIRKYQKSTELLIRKLPFQRLVREIAQDFKTDLRFQSHAVLALQEAAEAYLVGLFEDTNLCAIHAKRVTIMPKDIQLARRIRGERA

SEQ ID NO: 940 - protein, 474 aa, Glycine max
MSLPPPSLVTAATPTELPIRQIPGSYGFPLLGPISDRLDYFWFQKPESFFRKRVEKYKSTVFRTNVPPSFPFFVNVNPNVIAVLDVKSFSHLFDMDLVDKKDVLVGDFVPSVAFTGNMRVGVYQDTTEPQHSKVKNYIMDILKRSSGIWVSELESNLDTLWDNIEASLSKSSSVSYLFPLQQFLFTFLCKVLAGADPARDPKIAESGYSMLNSWLALQLLPTVSVGILQPLEEIFLHSFAYPFFLVGGNYNNLYNFIKQQGKDTINRGAIGFGLTEEEAIHNLLFVLGFNSYGGFSIFLPSLIDAIASNSALQEKLKKEAREKGGSTLTFDSVKEMDLIQSVVYETLRMNPPVPLQYGRARKDFRLSSHDSVFHVKKGELLCGFQKLVMRDSVIFDEPDRFKPDRFTQEKGAQLLNYLYWSNGPQTGSPSVSNKQCAGKDVVTLTAALIVAYLFRRYDSIQGDGSSITALQKTK

SEQ ID NO: 941 - protein, 345 aa, Arabidopsis thaliana
MKTVLVIINCIFLAIGNCGGPLMMRLYFQNGGERIWFPSFLQTVGCPLIFFPLLLSFLRRRRCLEEQETTPFFLMKPPLFIAAIVVGLLVGFDNYLYSYGLAYIPVSTASLIISAQLGFTALFAFFMVKQKFTPFTINAIVLLTGGAVVLALNSDSDKLANETHKEYVVGFIMTLGAALLYGFILPLVELSYKKSGQRITYTLALEFQMVLCFAATCVCLVGMLAAGDFKVIAGEARDFKLGESLYYVVIVFTAIIWQAFFVGAIGLIFCASSLVSGIMVSALLPVTVILAVICFQEKFQAGKGVALALSLWGSVSYFYGQVKSEEKTKAQDTQLSQLPVTDYVA

SEQ ID NO: 942 - protein, 390 aa, Glycine max
MQEATKVIIIGAGTSGIATAGCLTKQSIPYIMLEREDCFASLWQKYTYDRLHLHLRKQVCELPHLPFPKSYPHYVPRKQFIDYLGNYVNHFEIKPLYQRAVELVEYDGWKGIWRVKAQNRRSGELEEYAGKYLVVASGETAEPRLPQIQGLESFNGKVIHSTAYKNGNEFKNKHVLVVGSGNSGMEIALDLSNFGAKPSIIVRSPVHFLSRDMMYYASLMLNYLSLSTVEKVLVMVSKVVYGDLSEYGIPYPSEGPFTMKMKYAKFPIIDVGTVKKIKSREIQVLPAEIKSIRGNEVLFQDGKSYTFDSIVFCTGFKRSTQKWLKGGDDLLNEDGFPKNSFPNHWKGRNGLYCVGLSRRGFFGANMDAQLVANDIASLIPQEEREGICVM

SEQ ID NO: 943 - protein, 309 aa, Arabidopsis thaliana
MAGTGVVAVYGEGAMTETKQKSPFSVKVGLAQMLRGGVIMDVVNAEQARIAEEAGACAVMALERVPADIRAQGGVARMSDPEMIKEIKNAVTIPVMAKARIGHFVEAQILEAIGVDYVDESEVLTLADEDNHINKHNFKIPFVCGCRNLGEALRRIREGAAMIRTKGEAGTGNVVEAVRHVRSVNGAIRLLRSMDDDEVFTYAKKIAAPYDLVVQTKELGRLPVVQFAAGGVATPADAALMMQLGCDGVFVGSGVFKSGDPVKRAKAIVQAVTNYRDAAVLAEVSCGLGEAMVGLNLDDKVERFASRSE

SEQ ID NO: 944 - protein, 425 aa, Glycine max
MVKGLHGQNLPAHVAQLVDQLERHCFAPDGSLISKPLFNDLQLAREEMCRERLRYLEAMAIYSEAIAMVEEYQQAISVSNLGGIRDTGNLYPQLGLKNSPQVYQTLEHQMVVAEAAQRLRLPLISKDGEVHDEDIEKLSVVSRSSLDSTVSGANSSNYNTPSSSVSGANTALAASDPVEVGVGGVANRFLGITPSYLWQTQHQKAPLSVDMTEYRLSVSREVEARLKMKCEKLSEAFVLDDNDSSSSGSHSSSSRLPERVKLLIEEIEREETALRDDLYSADRKFAEYYNVLEQILAVLIKLVKDLKLEHQHKYDEMQKTWLCKRCETMSAKLSVLEHVLLLETYTKDSIPALHKIRKYLVEATEEASIAYNKAVTRLREYQGVDPHFDNIARQYHDIVQKLENMQWTIHQVEMDLKRLPDKPST

SEQ ID NO: 945 - protein, 388 aa, Glycine max
MADSGSASSSRMWCSIPERVQLHAAMLALQFGYAGFHVVSRAALNMGISKLVFPVYRNIIAFLLLLPFAYFLEKKERPAITLNFLLQFFLLALVGITANQGFYLLGLDNTSPTFASAIQNSVPAITFLMAVILRIEQVRLNRKDGIAKVAGTIFCVAGATVITLYKGPTIYSPSPPLQSESSVVVEFGTLSSLGDAKGKNWTLGCLYLIGHCLSWSAWLVLQAPVLKKYPARLSVTSYTCFFGLIQFLVIALIVERDAQAWIFQSGGEVFTILYAGVVASGIAFAVQIWCIDRGGPVFVAVYQPVQTLVVAIMASLALGEEFYLGGIIGAVLIVVGLYFVLWGKSEERKFAKEHAAITSTPEHSGIRSSSHAKTLLTQPLLPSSTENV

SEQ ID NO: 946 - protein, 336 aa, Glycine max
MENSTEESHLRSENSVTYESPYPIYGMSFSPSHPHRLALGSFIEEYNNRVDILSFHPDTLSVTPHPSLSFDHPYPPTKLMFHPRKPSPSSSSDLLATSGDYLRLWEIRDNSVDAVSLFNNSKTSEFCAPLTSFDWNDIDPNRIATSSIDTTCTIWDIERTLVETQLIAHDKEVYDIAWGEARVFASVSADGSVRIFDLRDKEHSTIIYESPHPDTPLLRLAWNKQDLRYMATILMDSNKVVILDIRSPTTPVAELERHRGSVNAIAWAPHSSTHICSAGDDTQALIWELPTLASPTGIDPVCMYSAGCEINQLQWSAAQPDWIAIAFANKMQLLKV

SEQ ID NO: 947 - protein, 271 aa, Glycine max
MAAPRNVTATRDEEKGEDDDSPSAKKPKSERFPLNTWEFAVAVAVFLVFSTGLFCIYLTMPSAAYTNLKLPRTLSDLRLLKEHLSTYASNHPAQFILGYCSTYIFMQTFMIPGTIFMSLLAGALFGVVRGILLVVFNATAGASSCFFLSKLIGRPLVSWLWPEKLRFFQAEIAKRRDRLLNYMLFLRITPTLPNLFINLASPIVDVPFHIFFSATLIGLVPASYITVRAGLALGDLKSIKDLYDFKTLSVLFLIGFVSIAPTLLKRKRVYE

SEQ ID NO: 948 - protein, 394 aa, Glycine max
MLSRLMDFLTACWRRRSFSDGKGGSEVTGRKEGLLWYKDAGQHLFGEYSMAVVQANNLLEDQSQIESGPLSLLDTGPYGTFVGVYDGHGGPETSRYVCDHLFQHLKRFASEQKSMSEEVIRKAYQATEEGFLSVVTKQWPMNPQIAAVGSCCLVGVICGGILYIANLGDSRAVLGRVVRATGEVLAIQLSSEHNVARESVRQEMHSLHPDDSKIVVLKHNVWRVKGLIQISRSIGDVYLKKAEFNKEPLYAKFRVREGFKRPILSSDPSISVHEIQQHDQFLIFASDGLWEHLSNQDAVDIVQNNPHNGIARRLIKAALQEAAKKREMRYSDLKKIDRGVRRHFHDDITVVVVFLDSNLVSRASSVRGPPLSVRGGGIPLPSRTLAPCAAPMET

SEQ ID NO: 949 - protein, 886 aa, Glycine max
MGASRKLQGEIDRVLKKVQEGVEVFDSIWNKVYDTDNANQKEKFEADLKKEIKKLQRYRDQIKTWIQSSEIKDKKVSASYEQALVDARKLIEREMERFKICEKETKTKAFSKEGLGQQPKTDPREKAKSETRDWLNNVVGELENQIDNFEAELEGLSVKKGKNRPPRLTHLETSITRHKAHIKKCEFILRLLDNDELSPEQVNDVKDFLDDYVDRNQDDFEEFSDVDELYSSLPLDKVESLEDIVTIPPGPAKVTPVLSLKPSVAASASASQTSEQADDTASQDSNSDFVARTPPPKSSIVSPTATTPAGNFATPVSMNVPVPNLSSPPAIASVMPGSNSVQSSLEISSLVDASSFVNQSSTMKEEEINSFPGQRPSPSLSDVTLIRNISRNSVSNQATNSIPLASGNMVSSNGPLGSVPSAPEITKRNILVGDDRLGSNGMVQPLVSPLSNRMIMPQVARPNDGTSSVDSSSVNEAATVSGRVFSPSAVPGMQWRSGSPFQNQNDVVQVRGRTEIAPDQRERYLQKLQQVQQQGQSAILNMPSFVAGNPKQFSAQQQNPLLQQFNSQGSSVASQSGVGLGVQSPGLSGIASTSLPQPPNSVHSPSSQQSLLLVVSKDADVGNSKGDEPQQQIFPDDSGTESTASNGIGKNFVNEDELKSTYAVDSPAGVPASLPEPAQTSRDIDLSPGLPLQSNQRTGNLGVIGRSSTDLGALGDNFSASTANSGGVRDQLYYLQMLEAAHLKLPQPKDSERPRTYTPKHPTITPPSFPQVQAPIVNNPAFWERVGIEQYGTDTLFFAFYYQQNTYQQYMAAKELKKQSWRYHRKYNTWFQRHEEPKVATDEYEQGTYVYFDFHIANDDLQHGWCQRIKTDFTFEYNYLEDEPIV

SEQ ID NO: 950 - protein, 416 aa, Glycine max
MLEGGAKFPGIIDLNKNNNNYYDFSQGFYHKLGEGTNMSIDSVGSLQTSNGGGSVAMSIDNSSVGSNDSHTRMLDHQGLRRRANDNYSVAHSANRRGRVTHALSDDALAQALMDNSSPTEGLDNFDEWTIDLRKLNMGEPFAQGAFGKLYRGTYNGEDVAIKILERPENDPAKAQLMEQQFQQEVMMLATLKHPNIVRFIGACRKPMVWCIVTEYAKGGSVRQFLMKRQNRSVPLKLAVKQALDVARGMAYVHGLLLIHRDLKSDNLLIFGDKSIKIADFGVARIEVQTEGMTPETGTYRWMAPEMIQHRPYTQKVDVYSFGIVLWELITGMLPFQNMTAVQAAFAVVNKNVRPIIPNDCLPVLRDIMTRCWDPNPDVRPPFAEIVGMLENAENEIMTTVRKARFRCCMTQPMTAD

SEQ ID NO: 951 - protein, 257 aa, Glycine max
MADSSREENVYMAKLAEQAERYEEMVEFMEKVAKTVEVEELTVEERNLLSVAYKNVIGARRASWRIISSIEQKEESRGNEDHVAIIKEYRGKIEAELSKICDGILNLLESNLIPSAASPESKVFYLKMKGDYHRYLAEFKTGAERKEAAESTLLAYKSAQDIALADLAPTHPIRLGLALNFSVFYYEILNSPDRACNLAKQAFDEAISELDTLGEESYKDSTLIMQLLRDNLTLWTSDITDDAGDEIKETSKQQPGE

SEQ ID NO: 952 - protein, 294 aa, Glycine max
MASNKESKFPAQSQKTQPGKEHVMNPLPQATNPDHKAANKLQGKVALVTGGDSGIGRAVCLCFAKEGATVAFTYVKGHEDRDKDDTLKMLLEAKTSGADNPLAIAADIGFDENCKQVIDLVVKEYGRLDVLVNNAAEQHLTNSVEEITQQQLERVFGTNIFSQFFLVKHALKHMKEGSCIINSTSVNAYNGNPEALDYTATKGAIVAFTRGLSQQLASRGIRVNGVAPGPVWTPIQPASKPAEMIQNLGCEVPMNRVAQPCEIAPCYLFLATCQDSSYFTGQVLHPNGGMVVNA

SEQ ID NO: 953 - protein, 258 aa, Glycine max
MTSMYSGGYTALVTNLSPRATEDDVRNFFTYCGLIEHIEILRSGENAPTAYVTYRDAYALETALLLNGSMILDQCIFISRYEAYVNDYDNWSNHASNPEYSITTSQDVHMDKFVASPGEALTMAQVVVKTMVAKGYVLGKDAFVMAKAFDESHSVSSTAATKVAELSNKIGLTDTINSGIETFKSVDEKYHVTDFTKSAATVTGTTAIVVASVTGKAAVAAGTAIANSSYFAKGALWVSDVLTRAAKAAADLGQNEKK

SEQ ID NO: 954 - protein, 593 aa, Glycine max
MDVRRRPIPPSGDRRQTQKLKNTATTDSQTLLPLYLTNALFFAVFFSVAYFLLHRWREKIRTATPLHAVTPAETAAIVSLVASAVYLLGFFGVASRASLDELSDDEIILKEDSRAPGPCAAALSDSCSLPNNKIQDQFPLPPRAVHSLAKEKQHIPSPPQVDSPVSVSVSVSSSSDDEDEEIVQAVVSGSIPSYSLESRLGDTRRAATIRHEVVQRLTSRSLSGLPLEGFNYDSILGQCCEMPIGFVQIPVGVAGPLLLDGKEFTVPMATTEGCLVASTNRGCKAIYVSGGASSVLLRDGMTRAPVVRFPSAQRAAQLKFFLEDPLNFDSLAVVFNKSSRFARLQNIQCAIAGKNLYMRFRCSTGDAMGMNMVSKGVQNVLDFLQSDFPDMDVIGISGNFCSDKKAAAVNWIEGRGKSVVCEAIIKEDVVKKVLKTSVEAMVKLNMLKNLTGSAMAGALGGFNAHASNIVSAIYIATGQDPAQNVESSHCITMMEAINDGKDLHVSVTMPSIEVGTVGGGTQLASQSACLNLLGVKGANKESPGANSRLLATIVAGSVLAGELSLMSAIAAGQLVKSHMKYNRSSRDISTIVQ

SEQ ID NO: 955 - protein, 345 aa, Glycine max
MGIYLSTPKTEKFSEDGENDCLRYGLSSMQGWRATMEDAHAAYTDLDESTSFFGVYDGHGGKVVAKFCAKFLHQQLFKSETYLTGDIGASLQKAFLRMDEMMRGQRGWRELSILGDKINKFTGMIEGLIWSPRSSDGNCHVDDWAFEEGPHSDFAGPTSGGTACVAVIRNNQLVVANAGDSRCVISRKGQAYNLSRDHKPDLEIEKERILKAGGFIHVGRVNGSLNLARAIGDMEFKQNKFLSAEKQIVTANPDINTVELCDEDEFVVLACDGIWDCMSSQQLVDFVHEQLHSETKLSAVCERVLDRCLAPSTASGEGCDNMTMIVVQFKRPAQSSVPAEESSSN

SEQ ID NO: 956 - protein, 572 aa, Glycine max
MGGVEDEEPSMKRMKLSSKGLVGLSNGSSKEPVGGLSSDLMARPLPSKGDEHVGSKGVIKKEEFVRIIAKALYSLGYGKSGAHLEEESGIPLHSPGVNLFMQQILDGNWDDSVATLYKIGLADESMVRSASFLILEQKFFELLNGEKVMEALKTLRTEIAPLCINSSRIRELSSCLVSASSRLDILRVRSRSKLLEELQKLLPPTVMIPEKRLEHLVEQALILQREACPFHNSLDKEMSLYSDHHCGKDQIPSSTLQILEAHDDEVWFVQFSHNGKYLASASKDQTAIIWEVGINGRLSVKHRLSGHQKPVSSVSWSPNDQELLTCGVEEAIRRWDVSTGKCLQIYEKAGAGLVSCSWFPCGKYILCGLSDKSICMWELDGKEVESWKGQKTLKISDLEITDDGEEILSICKANVVLLFNRETKDERFIEEYETITSFSLSNDNKFLLVNLLNQEIHLWNIEGDPKLVGKYKGHKRARFIIRSCFGGLKQAFIASGSEDSQVYIWHRSSGELIEALAGHSGSVNCVSWNPANPHMLASASDDRTIRVWGLNCLHNKYQNVHSNGIHYCNGGT

SEQ ID NO: 957 - protein, 490 aa, Arabidopsis thaliana
MANKPRTRWVLPYKTKNVEDNYFLGQVLGQGQFGTTFLCTHKQTGQKLACKSIPKRKLLCQEDYDDVLREIQIMHHLSEYPNVVRIESAYEDTKNVHLVMELCEGGELFDRIVKRGHYSEREAAKLIKTIVGVVEACHSLGVVHRDLKPENFLFSSSDEDASLKSTDFGLSVFCTPGEAFSELVGSAYYVAPEVLHKHYGPECDVWSAGVILYILLCGFPPFWAESEIGIFRKILQGKLEFEINPWPSISESAKDLIKKMLESNPKKRLTAHQVLCHPWIVDDKVAPDKPLDCAVVSRLKKFSAMNKLKKMALRVIAERLSEEEIGGLKELFKMIDTDKSGTITFEELKDSMRRVGSELMESEIQELLRAADVDESGTIDYGEFLAATIHLNKLEREENLVAAFSFFDKDASGYITIEELQQAWKEFGINDSNLDEMIKDIDQDNDGQIDYGEFVAMMRKGNGTGGGIGRRTMRNSLNFGTTLPDESMNV

SEQ ID NO: 958 - protein, 336 aa, Arabidopsis thaliana
MGNCCSHGRDSADNGDALENGASASNAANSTGPTAEASVPQSKHAPPSPPPATKQGPIGPVLGRPMEDVKASYSLGKELGRGQFGVTHLCTQKATGHQFACKTIAKRKLVNKEDIEDVRREVQIMHHLTGQPNIVELKGAYEDKHSVHLVMELCAGGELFDRIIAKGHYSERAAASLLRTIVQIVHTCHSMGVIHRDLKPENFLLLNKDENSPLKATDFGLSVFYKPGEVFKDIVGSAYYIAPEVLKRKYGPEADIWSIGVMLYILLCGVPPFWAESENGIFNAILRGHVDFSSDPWPSISPQAKDLVKKMLNSDPKQRLTAAQVLNHPWIKEDGE

SEQ ID NO: 959 - protein, 323 aa, Arabidopsis thaliana
MQSSNVTDCTMRKRGTKRKIEIEKRMTKQQRSVACSKRRPTLFSKAADLCLLSGANIAVFVTSPDENSDVVYSFSGYSHASEIVDCYLNNKSPPKTTINPESAKFWWEEPDLYRDCDDLSELRIIEDRLMRTKKHLMDYLEKKEKSHSVSKSDQNPNNDSGSSSSSSQIASDFGQNPSTLSPSSLKIVSFDQNSYSSLEPSSQVTTCFDQNPVFSVGSESSSDQSRYLVNEDSGFVDGLLCETEEENNGMRLPQETQTQPMFTEEDQSFWENLDVDDVFGLFKDDNNLEVPLQDHSSTNEDDELLIDISEYLSEEAMECPCFS

SEQ ID NO: 960 - protein, 317 aa, Arabidopsis thaliana
MEEDCEFRHWDELIPDALGLIFSHLPLQEVLTVVPRVCKAWNRAVTGPYCWQEIDIELWSNRFHQSDHLDRMLEMLIPRSAGSLRKLSVTGLRNDSIFSFIAQHAGSLKTLKVPRSGLTNSGVVNVAEKLSSLTFLDLSYCCKIGPEAIQAIGKHCKSLREFCRNMHPLDVASVVSHDDEAYAIANTMPKLKRLEIAYHRVSTEGVLKILSCCVFLEFLELRGCWDVQLDNKFFKEKFPDMKVLGPRVIGFYDMINDWEDCCSDYFSDGSDYLAWEFFEDGVMGEFYEDEFEHGWDDNFYAENAVLDMEPHIWPPSP

SEQ ID NO: 961 - protein, 388 aa, Arabidopsis thaliana
MALLRPHLHRFHSNTLRHSAYPSADAGGGLVVYPTYGRHRCSAIAIDAPSSLTGVTPIRWGYTSVQGFRDEMEDDIVIRSDAVDSFSYAAVFDGHAGSSSVKFLREELYKECVGALQAGSLLNGGDFAAIKEALIKAFESVDRNLLKWLEANGDEEDESGSTATVMIIRNDVSFIAHIGDSCAVLSRSGQIEELTDYHRPYGSSRAAIQEVKRVKEAGGWIVNGRICGDIAVSRAFGDIRFKTKKNDMLKKGVDEGRWSEKFVSRIEFKGDMVVATPDIFQVPLTSDVEFIILASDGLWDYMKSSDVVSYVRDQLRKHGNVQLACESLAQVALDRRSQDNISIIIADLGRTEWKNLPAQRQNVVVELVQAATTIGLVTVGIWMSSHLS

SEQ ID NO: 962 - protein, 155 aa, Arabidopsis thaliana
MDCSFITTNDLRRMFKTLDKNQDGLVTLDELLWILDKLGWAEHTPDELELIVGKQSLDLDEFLRFYYDAVLDSKGSKKNIDVVADNDEAIARAFNVFDVNGDGYISAEELRDVLERLGFEEEAKAWDCGRMIRVHDKNLDGFVDFEEFKNMILHV

SEQ ID NO: 963 - protein, 276 aa, Arabidopsis thaliana
MEIRWEDLQLGEEVGRGSFAAVHRGVWNGSDVAIKVYFDGDYNAMTLTECKKEINIMKKLRHPNVLLFMGAVCTEEKSAIIMEYMPRGSLFKILHNTNQPLDKKRRLRMALDVARGMNYLHRRNPPIVHRDLKSSNLLVDKNWNVKVGDFGLSKWKNATFLSTKSGKGTPQWMAPEVLRSEPSNEKCDVFSFGVILWELMTTLVPWDRLNSIQVVGVVGFMDRRLDLPEGLNPRIASIIQDCWQTDPAKRPSFEELISQMMSLFRKPGSGAQEEDD

SEQ ID NO: 964 - protein, 441 aa, Arabidopsis thaliana
MAHFLETQEPLVFSGKKRNDRDDEDGDALVAKKSALAVCDADPAAAIANIRHEFGEHGGVNMSIEASATFTVMEPDTMRRMFTGELGPDNDFYVYSRHFNPTVLNLSRQMAALEGTQAAYCTSSGMSAISSVMLQLCSSGGHVVAASTLYGGTHALLSHFLPRTCNITTSFVDITDHGAVANAIVEGRTQVLYFESVANPTLTVADIPELSRMAHEKGVTVVVDNTFAPMVLSPAKLGADVVVHSISKFISGGADIIAGAVCGSENLVKEMMDLRGGSLMLLGPTMNAKVAFELSERIPHLGLRMREHSHRAQVYAERMRDLGMKVIYPGLETHPQHKLFKGMVNRDYGYGGLLSIDMETEEKANKLMAYLQNATQFGFMAVSLGYYETLMSCSGSSTSSELDPSQKEAAGISPGLVRMSVGYVGTLEQKWTQFEKAFLRM

SEQ ID NO: 965 - protein, 185 aa, Arabidopsis thaliana [sequence omitted]

SEQ ID NO: 966 - protein, 158 aa, Arabidopsis thaliana
MGEIGFTEKQEALVKESWEILKQDIPKYSLHFFSQILEIAPAAKGLFSFLRDSDEVPHNNPKLKAHAVKVFKMTCETAIQLREEGKVVVADTTLQYLGSIHLKSGVIDPHFEVVKEALLRTLKEGLGEKYNEEVEGAWSQAYDHLALAIKTEMKQEES

SEQ ID NO: 967 - protein, 493 aa, Arabidopsis thaliana
MGETAAANNHRHHHHHGHQVFDVASHDFVPPQPAFKCFDDDGRLKRTGTVWTASAHIITAVIGSGVLSLAWAIAQLGWIAGPAVMLLFSLVTLYSSTLLSDCYRTGDAVSGKRNYTYMDAVRSILGGFKFKICGLIQYLNLFGIAIGYTIAASISMMAIKRSNCFHKSGGKDPCHMSSNPYMIVFGVAEILLSQVPDFDQIWWISIVAAVMSFTYSAIGLALGIVQVAANGVFKGSLTGISIGTVTQTQKIWRTFQALGDIAFAYSYSVVLIEIQDTVRSPPAESKTMKKATKISIAVTTIFYMLCGSMGYAAFGDAAPGNLLTGFGFYNPFWLLDIANAAIVVHLVGAYQVFAQPIFAFIEKSVAERYPDNDFLSKEFEIRIPGFKSPYKVNVFRMVYRSGFVVTTTVISMLMPFFNDVVGILGALGFWPLTVYFPVEMYIKQRKVEKWSTRWVCLQMLSVACLVISVVAGVGSIAGVMLDLKVYKPFKSTY

SEQ ID NO: 968 - protein, 271 aa, Arabidopsis thaliana
MVSPGSRWKKGRLLGMGSFGHVYLGFNSESGEMCAMKEVTLCSDDPKSRESAQQLGQEISVLSRLRHQNIVQYYGSETVDDKLYIYLEYVSGGSIYKLLQEYGQFGENAIRNYTQQILSGLAYLHAKNTVHRDIKGANILVDPHGRVKVADFGMAKHITAQSGPLSFKGSPYWMAPEVIKNSNGSNLAVDIWSLGCTVLEMATTKPPWSQYEGVPAMFKIGNSKELPDIPDHLSEEGKDFVRKCLQRNPANRPTAAQLLDHAFVRNVMPME

SEQ ID NO: 969 - protein, 296 aa, Arabidopsis thaliana
MVTATASTPFSLSSSVVFTRRRNFKRFPVCASLSPEVSPLLRAAHHTVDNYVKSGMIIGLGSGEASDFAIRYLGQQLGSGSLHNVVGVPMSARSASEAAKYGIPLEYYRDGVQIDFAFHDADAVEENTLIAVIGRRRSSQEDDYILKQKSIVKVADEAVFMIKEEQYKAGLEGSIPVLVQSLNWLAIAEEIDDLYLGDAEVWRRASVENEGPLGGDFPIVTSDGHNILDVIFTTPIRSLADLATSLDKIDGVVDHGLIIKTRCTVVIAEETVVRSVTLQTSALEGGVRTYGQTLQK

SEQ ID NO: 970 - protein, 484 aa, Arabidopsis thaliana
MAAATQFLSQPSSLNPHQLKNQTSQRSRSIPVLSLKSTLKPLKRLSVKAAVVSQNSSKTVTKFDHCFKKSSDGFLYCEGTKVEDIMESVERRPFYLYSKPQITRNLEAYKEALEGVSSVIGYAIKANNNLKILEHLRSLGCGAVLVSGNELRLALRAGFDPTKCIFNGNGKSLEDLVLAAQEGVFVNVDSEFDLNNIVEASRISGKQVNVLLRINPDVDPQVHPYVATGNKNSKFGIRNEKLQWFLDQVKAHPKELKLVGAHCHLGSTITKVDIFRDAAVLMIEYIDEIRRQGFEVSYLNIGGGLGIDYYHAGAVLPTPMDLINTVRELVLSRDLNLIIEPGRSLIANTCCFVNHVTGVKTNGTKNFIVIDGSMAELIRPSLYDAYQHIELVSPPPAEAEVTKFDVVGPVCESADFLGKDRELPTPPQGAGLVVHDAGAYCMSMASTYNLKMRPPEYWVEEDGSITKIRHAETFDDHLRFFEGL

SEQ ID NO: 971 - protein, 487 aa, Arabidopsis thaliana
MMSTTVRLNRFTYLTSTAKLTRYFCSHHLVDRSETALHEVIRIVSSPVGGLDDLEENLNQVSVSPSSNLVTQVIESCKNETSPRRLLRFFSWSCKSLGSSLHDKEFNYVLRVLAEKKDHTAMQILLSDLRKENRAMDKQTFSIVAETLVKVGKEEDAIGIFKILDKFSCPQDGFTVTAIISALCSRGHVKRALGVMHHHKDVISGNELSVYRSLLFGWSVQRNVKEARRVIQDMKSAGITPDLFCFNSLLTCLCERNVNRNPSGLVPEALNIMLEMRSYKIQPTSMSYNILLSCLGRTRRVRESCQILEQMKRSGCDPDTGSYYFVVRVLYLTGRFGKGNQIVDEMIERGFRPERKFYYDLIGVLCGVERVNFALQLFEKMKRSSVGGYGQVYDLLIPKLCKGGNFEKGRELWEEALSIDVTLSCSISLLDPSVTEVFKPMKMKEEAAMVDRRALNLKIHARMNKTKPKLKLKPKRRSKTKKKNLQH

SEQ ID NO: 972 - protein, 377 aa, Arabidopsis thaliana
MGLKMSESAKPYFAMVCLQFGYAGMNLVTKVVLDRGMSHYVLVAYRNAFATAAIAPFALLSERKVRPKMTFPIFMQIFVLALLGPLIDQNLYYAGLKLTSPTFAGAVTNIVPALTFIISIICRMEKVEMRKVRFQAKVVGTLVIVVGAMLMILFKIPLITFLRSHLTGHALSPAGEDYLKATVFLLIASFSWASFFVLQAATLKRYSSHLSLSTMVCFMGTLQSTALTFVMEPNLSAWNIGFDMNLLASAYAGIMSSSIAYYVQGMMTKQKSVIFVTAFNPLVVIIGSIIGFLILNQTLNLGGVLGMAILVVGVCTVLWGKEGDIDEEENIEEKFVEIVKCCNRCDIKVLSMMPRIDEEVDVEMQSAGTAKVAVGFS

SEQ ID NO: 973 - protein, 298 aa, Arabidopsis thaliana
MAEEKKAPISVWTTVKPFVNGGASGMLATCVIQPIDMIKVRIQLGQGSAASITTNMLKNEGVGAFYKGLSAGLLRQATYTTARLGSFKLLTAKAIESNDGKPLPLYQKALCGLTAGAIGACVGSPADLALIRMQADNTLPLAQRRNYTNAFHALTRISADEGVLALWKGCGPTVVRAMALNMGMLASYDQSAEYMRDNLGFGEMSTVVGASAVSGFCAAACSLPFDFVKTQIQKMQPDAQGKYPYTGSLDCAMKTLKEGGPLKFYSGFPVYCVRIAPHVMMTWIFLNQITKFQKKIGM

SEQ ID NO: 974 - protein, 547 aa, Arabidopsis thaliana
MGVILDSWCFCKGVGKSEKMKGSIFTGKAPAMARISVSGPNGVTSGTGFLIHRNLLLTTHLNLPSISATETAEVRLQNGVAAALFPHRFFITSSVIDLTIVGLDLVDGDSSSQSQLQQQPHYLKTCSKPNLDLGSVVYLLGYANQNELKIGEGKLVVATDNLIKLSTDEMIWSPGSAGFDVQGNLAFMICDPRKLSTSPTSTSSSSSSSLKKDNNKTLMMQFGIPIPVICDWLNQHWEGSLDEHTTKPKLPLIRLMSSGQKSERSCTSFTMRRVFKPNDSADVGTPSSSNTRDQTHPSSSIAAEEEKEEETSKTNPQVCGTTTHAQGIPTPEIYESPKLTSGPLRNETAQVHLLDINFPPRIPKAITFHPELNSLQSNHIVEEAEIVSEGSDAQIASTGSVNGALSEVISSSPPAAAHYVYNNHGYSSEEETMYSAETAESRNYPTPPRKSEFHHERVGRSQSCVSSSRWGTPQKSLNGRREMLEKQRSFVHGKKMHSQGAMSQRSNDYYSPTVSSIMKKRINSSEQQIIKPVPRPRAVSSSPRWAF

SEQ ID NO: 975 - protein, 360 aa, Arabidopsis thaliana
MAKFGEGDKRWIVEDRPDGTNVHNWHWSETNCLEWSRNFFTKQFSGVDILSGEGNLFIKVSKIEKVEGEAYVNVRKGKIIPGYELNVSLSWEGEAKDSDGKTLLKADGLVDMPYISDENADEDPEIRFSVKDEGPIGRTLKEAMVKKGKEIILEKVRVYVEAMARGGPCRDELESKKVAPKSVAAGSATVAVEKSGAAPVVSAAAVESKVVKEKKKAKTKEGFKTITMTEKFNCRARDLYEILMDENRWKGFTQSNAKISKDVNGPISVFDGSVTGMNLELEEGKLIVQKWRFGSWPDGLDSTVKIVFEEPQPGVTIVNLTHTDVPEEDRYGNATVVENTERGWRDLIFHRIRAVFGFGI

SEQ ID NO: 976 - protein, 261 aa, Arabidopsis thaliana
MYAETSLAFRFMQSSSSPEIHQFEDLFKSYKLSDEMNNLVEASEYDFGEESDLFKAPEPIIEEPMLAVDPLSQELVELGDLGSLQSDQQLIDKAFYDCEQDLLVKSAMESPLSEVLDIKNISLVAKMDNDVKSTSVVVSDVPIPKSVSSGNLSSMDMVEHKDAVIQGFPDFPPVDYGMRRAFSESDIQTLGTGNTGLVQSQLDRIIISCTSEDRREKLSRYRNKKSKRNFGRKIKYACRKALADSQPRIRGRFAKTEEMQK

SEQ ID NO: 977 - protein, 168 aa, Arabidopsis thaliana
MGAFCKLIDAVLFLYFALMAVIAPLIDGQTSLPGDIFPAFIVDLNRWYIDEFGDYLVKEKPHFLVGLVWHELLLLWPLSIVNVYAILAGKSWFGTTSMVYGASVVTSMAAILGEMIGSGKASEKLLMMYVPFMGVGILALLRGLLSQSNKSGGAVGKRPAILARRKRA

SEQ ID NO: 978 - protein, 384 aa, Arabidopsis thaliana
VAKRLEKFKTTIFTQMSILAVKHGAINLGQGFPNFDGPDFVKEAAIQAIKDGKNQYARGYGIPQLNSAIAARFREDTGLVVDPEKEVTVTSGCTEAIAAAMLGLINPGDEVILFAPFYDSYEATLSMAGAKVKGITLRPPDFSIPLEELKAAVTNKTRAILMNTPHNPTGKMFTREELETIASLCIENDVLVFSDEVYDKLAFEMDHISIASLPGMYERTVTMNSLGKTFSLTGWKIGWAIAPPHLTWGVRQAHSYLTFATSTPAQWAAVAALKAPESYFKELKRDYNVKKETLVKGLKEVGFTVFPSSGTYFVVADHTPFGMENDVAFCEYLIEEVGVVAIPTSVFYLNPEEGKNLVRFAFCKDEETLRGAIERMKQKLKRKV

SEQ ID NO: 979 - protein, 529 aa, Arabidopsis thaliana
MSLTERLYNHLSLFDLLLSLLGLFVFCCLREKLTNKRGPMLWPVFGITLEFFFHINDVYGWVTRSLKKCRGTFLYRGVWLDGSYGAVTCVPANVEYMLKTNFKNFPKGTFFKSRFNDLLEEGIFNADDDSWKEQRRIIITEMHSTGFVEHSFQTTQHLVRKKLLKVMESFAKSQEAFDLQDVFLRLTFDIICLAGLGADPETLAVDLPQVPFAKAFEEATESTLFRFMIPPFIWKPMRFLDTGYEKGLRIAVGVVHGFVDKMIVDRICELKEEETLDNRSDVLSRIIQIESHKRENEIDPSTIRFFRQFCTSFILAGRDTSSVALSWFCWVIQKHPEVENKIICEIREILRQRGDSPTSKNESLFTVKELNNMVYLQAALSETLRLFPPIPMEMKQAIEDDVLPDGTFVRKGSRVYFSIYAMGRMESIWGKDCEIFRPERWIQAGKFVSDDQFKYVVFNAGPRLCIGKTFAYLQMKMIAASVLLRYSIKVVQDHVIAPRVTTNLYMKYGLKVTITPRSLEEKKLESCSM

SEQ ID NO: 980 - protein, 508 aa, Arabidopsis thaliana
MEIVIASLALVVVLWCIWRILEWVWLKPKMLESYLRRQGLVGTRYTPLVGDVRRSFSMLKEARSKPMKPTDDLISLVMPYSFHMLNTYGKTFFTWSGPIPAITIMNPQLIKEVYNKFYDFEKTHTFPLTSLLTDGLANADGDKWVKHRKIINPAFHFEKIKNMVPTFYKSCIEVMCEWEKLVSDKGSSCELDVWPWIVNMTGDVISRTAFGSSYKEGQRIFILQAELAHLIILALGKNYIPAYRHFPTKNNRRMKTIVKEIQVILRGIIGHREKARDAGEAPSDDLLGILLKSNSEQSKGNGLNMEEIMEECKLFYFAGQETTSVLLAWTMVLLSQHQDWQARAREEVMQVFGHNKPDLQGINQLKVMTMIIYEVLRLYPPVIQMNRATHKEIKLGDMTLPGGIQVHMPVLLIHRDTKLWGDDAAEFKPERFKDGIAKATKNQVCFLPFGWGPRICIGQNFALLEAKMALALILQRFSFELSPSYVHSPYRVFTIHPQCGAHLILHKL

SEQ ID NO: 981 - protein, 490 aa, Arabidopsis thaliana
MESMTMIILQSLIIFITILFFKKQKRGKKSNTPRSPPRLPLIGNLHQLGHHPHRSLCSLSHRYGPLMLLHLGRVPVLVVSSADVARDILKTHDRVFASRPRSKLFEKLFYDGRDVAFAPYGEYWRQIKSVCVLRLLSNKMVTSFRNVRQEEISLMMEKIQKSSSLQVNVSELLGSLTNDVISRIALGRKYSGETDSKELMKRLMMLMGEFSVGTYVPWLGWIDWISGLDGQLNKTGNDLDEFLEKVVQDHVDGDGQRTDFVDVLLRIQREKSIGFEIDRLCIKAIVLDVLVAGTDSSYALMDWAMTELLRHPECLRTLQEEVRTICKGNLSVSEEDIQNMSYLKAVIKETTRLHPPLPLLAPHESIQDVILGDYHIPAGTQVMINAWAIGREAATWGPDAEKFRPERHLDSSVDFRGHNFELVPFGAGRRICPAISFAVVLIEVALANFVHRYDWKLPEDSKENQTNVAESTGMVIHRLFPLYAIASSTT

SEQ ID NO: 982 - protein, 536 aa, Arabidopsis thaliana
MELMNLASKETSYWMIALPAGFGSQNLHDVSTLGYLFLAVVFLSIVTWALAGGGGVAWKNGRNRLGRVAIPGPRGIPVFGSLFTLSRGLAHRTLAAMAWSRANTEIMAFSLGSTPVIVASEPNIAREILMSPHFADRPVKQSAKSLMFSRAIGFAPNGTYWRMLRRIASTHLFAPRRILAHEAGRQLDCAEMVKAVSVEQNGAGSVVLRKHLQLAALNNIMGSVFGRRYDPLAQKEDLDELTSMVREGFELLGAFNWSDYLPWLGYFYDSIRLNQRCSDLVPRIRTLVKKIIDEHRVSNSEKKRDIGDFVDVLLSLDGDEKLQEDDMIAVLWEMIFRGTDTTALLTEWTMAELVLNPNVQTKLRDEILTAVGDGADGDVADADLAKLPYLNAVVKETLRLHPPGPLLSWARLSTSDVQLSNGMVIPKGTTAMVNMWAITHDQTVWSDPLKFDPERFTGNADMDIRGGDLRLAPFGAGRRVCPGKNMGLATVTRWVAELVRRFEWGQDQTEPVDLGEVLKLSCEMEHPLRAVVTEIF

SEQ ID NO: 983 - protein, 518 aa, Arabidopsis thaliana
MASISTPFPISLHPKTVRSKPLKFRVLTRPIKASGSETPDLTVATRTGSKDLPIRNIPGNYGLPIVGPIKDRWDYFYDQGAEEFFKSRIRKYNSTVYRVNMPPGAFIAENPQVVALLDGKSFPVLFDVDKVEKKDLFTGTYMPSTELTGGYRILSYLDPSEPKHEKLKNLLFFLLKSSRNRIFPEFQATYSELFDSLEKELSLKGKADFGGSSDGTAFNFLARAFYGTNPADTKLKADAPGLITKWVLFNLHPLLSIGLPRVIEEPLIHTFSLPPALVKSDYQRLYEFFLESAGEILVEADKLGISREEATHNLLFATCFNTWGGMKILFPNMVKRIGRAGHQVHNRLAEEIRSVIKSNGGELTMGAIEKMELTKSVVYECLRFEPPVTAQYGRAKKDLVIESHDAAFKVKAGEMLYGYQPLATRDPKIFDRADEFVPERFVGEEGEKLLRHVLWSNGPETETPTVGNKQCAGKDFVVLVARLFVIEIFRRYDSFDIEVGTSPLGSSVNFSSLRKASF

SEQ ID NO: 984 - protein, 558 aa, Arabidopsis thaliana
  misc_feature (109)..(109): Xaa can be any naturally occurring amino acid
  misc_feature (340)..(340): Xaa can be any naturally occurring amino acid
  unsure (1)..(558): unsure at all Xaa locations
MATIWFLSLLFLCCILLAAFKHKKRRTNQQQPPSPPGFPIIGNLHQLGELPHQSLWSLSKTYGPVMLLKLGSVPTVVVSSSETAKQVLKINDLHCCSRPSLAGTITLTXHIQFSFFLFVPLFIELNKNHDFDHSLGAKELSYNYLDIAFSPFDDYWKELRRICVQELFSAKRVHSIQPIKEEEVRKLIVSATESASQKSPVNLSEKFLDLTVSVICKAAFSLDFHTSVLNNDGFDKLIHDAFLFLGSFSASNFFPNGGWIIDWLTGLQRRREKSVKDLDVFYQQMFDLHKQENKQGVEDFVDLLLKLEKEETVLGYGKLTRNHVKAILMVSTIQICATHXIPYDSKLCFLILSQNVLLGAINTSAMTMTWAMAELIRNPRVMKKVQSEIRNQMINKSVITLDDIDHLPYLKMVIKETWRLHPPVPLLLPREVMSEFEINGYKIQPKTLLYVNVWAIGRDPDSWKDADMFYPERFMDNNIDAKGQNFELLPFGSGRRICPGMYMGTTMVEFGLANMLYQFDWEVPDGMVVEDIDMEESPGLAVGKKNELLLVPVKYLGH

SEQ ID NO: 985 - protein, 859 aa, Arabidopsis thaliana [sequence omitted]

SEQ ID NO: 986 - protein, 501 aa, Arabidopsis thaliana
MDIISGQPMFLLFCFILSCFLFFTAARSRRSPTQVLSKSPPGPPRLPIIGNIHLVGKNPHHSFTDLSKTYGPVMSLKLGYLNSVVITSRDAAREVLKAHDQILSGRYITQATKSNNHHEFSVGWIHPSSPLEEMTFTQLFSPQRIEATKALRMKKVQELVNFLSESSERGEAVDISRASFVTALNIISNILFSVNLGSYDSKNSSAFQEMVIGYMESIGNPDVSNFFPFMRLLDLQGNSKKMKEYSGKLLQVFREFYDARILENSSRIDEKDVSSRDFLDALIDLQQGDESEINIDEIEHLLLDMFLAGTDTNSSTVEWAMTELLGNPKTMTKVQDEINRVIRQNGDVQESHISKLPYLQAVIKETFRLHPAAPFLLPRKAERDVDILGFHVPKDSHVLVNVWAIGRDPNVWENPTQFEPERFLGKDIDVKGTNYELTPFGAGRRICPGLPLALKTVHLMLASLLYTFEWKLPNGVGSEDLDMGETFGLTVHKTNPLLACL

SEQ ID NO: 987 - protein, 397 aa, Arabidopsis thaliana
MTSRTFTRHSSLIHVFLLLSLVFSGNILQTVTSLGINYGQVGNNLPSPDKVINLLRSLRITKTRIYDTNPQILSAFANSNIEIIVTIENQVLPLLQDPQQATQWVDSHIKPYVPATRITGIMVGNELFTDDDSSLIGYMMPAIINIHKALVQLGLDRYIQVSSPSSLAVLGESYPPSAGSFKPEVSSVMQQLLDFLEATKSPFWINAYPYFAYKDNPQEIPVDYVLFNRNIGMTDPNTRLHYDNMMYAQVDAVAFAAAKLGYRNIEVRVAETGWPSKGDVGEIGASPVNAATYNRNLMMRQFAGEGTPARRNARLDVYIFALFNEDMKPGPTSEKNYGIFQPDGSLAYNLGFSTMSTTTANSESVTYSSSATKAKRSLEYWTILILAMVQVVMLRLF

SEQ ID NO: 988 - protein, 550 aa, Arabidopsis thaliana
MELLLPHPSNSTPLTVLGFLDRAASVYGDCPSILHTTNTVHTWSETHNRCLRIASALTSSSLGINRGQVVSVVGPNVPSVYELQFAVPMSGAILNNINPRLDAHALSVLLRHSESKLVFVDPNSISVVLEAVSFMRQNEKPHLVLLDDDQEDGSLSPSAASDFLDTYQGVMERGDSRFKWIRPQTEWQPMILNYTSGTTSSPKGVVLSHRAIFMLTVSSLLDWHFPNRPVYLWTLPMFHANGWGYTWGTAAVGATNVCTRRVDAPTIYDLIDKHHVTHMCAAPMVLNMLTNYPSRKPLKNPVQVMTAGAPPPAAIISRAETLGFNVGHGYGLTETGGPVVSCAWKAEWDHLDPLERARLKSRQGVRTIGFAEVDVRDPRTGKSVEHDGVSVGEIVLKGGSVMLGYYKDPEGTAACMREDGWFYSGDVGVIHEDGYLEVKDRSKDVIICGGENISSAEVETVLYTNPVVKEAAVVAKPDKMWGETPCAFVSLKYDSNGNGLVTEREIREFCKTRLPKYMVPRKVIFQEELPKTSTGKIQKFLLRQMAKSLP

SEQ ID NO: 989 - protein, 536 aa, Arabidopsis thaliana
MKLLGFALAILLVVATCKPEEEITCEENVPFTCSQTDRFNKQDFESDFIFGVASSAYQIEGGRGRGLNVWDGFTHRYPEKGGADLGNGDTTCDSYRTWQKDLDVMEELGVKGYRFSFAWSRILPKGKRSRGINEDGINYYSGLIDGLIARNITPFVTLFHWDLPQSLQDEYEGFLDRTIIDDFKDYADLCFERFGDRVKHWITINQLFTVPTRGYALGTDAPGRCSQWVDKRCYGGDSSTEPYIVAHNQLLAHATVVDLYRTRYKYQGGKIGPVMITRWFLPYDDTLESKQATWRAKEFFLGWFMEPLTKGKYPYIMRKLVGNRLPKFNSTEARLLKGSYDFLGLNYYVTQYAHALDPSPPEKLTAMTDSLANLTSLDANGQPPGPPFSKGSYYHPRGMLNVMEHFKTKYGDPLIYVTENGFSTSGGPIPFTEAFHDYNRIDYLCSHLCFLRKAIKEKRVNVKGYFVWSLGDNYEFCNGYTVRFGLSYVDFNNVTADRDLKASGLWYQSFLRDTTKNQDILRSSLPFKNGDRKSLT

SEQ ID NO: 990 - protein, 318 aa, Arabidopsis thaliana
MSHFGRSGPPDISDTYSLLVLNITFRTTADDLYPLFAKYGKVVDVFIPRDRRTGDSRGFAFVRYKYKDEAHKAVERLDGRVVDGREITVQFAKYGPNAEKISKGRVVEPPPKSRRSRSRSPRRSRSPRRSRSPPRRRSPRRSRSPRRRSRDDYREKDYRKRSRSRSYDRRERHEEKDRDHRRRTRSRSASPDEKRRVRGRYDNESRSHSRSLSASPARRSPRSSSPQKTSPAREVSPDKRSNERSPSPRRSLSPRSPALQKASPSKEMSPERRSNERSPSPGSPAPLRKVDAASRSQSPYAAVGYKNTVFQMCITNET

SEQ ID NO: 991 - protein, 298 aa, Arabidopsis thaliana
MTTNDDDHAAERNTMSMNYELAATLSDEEQRARKGKAKIVCKEEDHVFIKKKEKYEEESEKREFFSHVPRKIRPALRYPQPNFENPNGASSSLNLPFEEDYYMAEYYKKTETINPPNPYHQWSPSSFLTEYTHPRMLEVLHRCGFNRPVVTCYSRTAREMRWWLRQVMKDMRAEDLTLILEKTLSTTDVITTTHGRFSMHFNRLISNDFLKPEERSILEEDTYNDETMGVGAILVDQRSQKWSVILKRWGQNYFLSCGWNDVVKANKLKAGDDICLWAFRCDGVLCFAMRQYSSYFRH

SEQ ID NO: 992 - protein, 147 aa, Arabidopsis thaliana
MSHRVSILSSHFSPASAVMASEKEAALAATPSDSPTIFDKIISKEIPSTVVFEDDKVLAFRDITPQGPVHILLIPKVRDGLTGLSKAEERHIDILGRLLYTAKLVAKQEGLAEGFRIVINDGPQGCQSVYHIHVHLIGGRQMNWPPG

SEQ ID NO: 993 - protein, 888 aa, Glycine max
MLTWWGKSSSKETKKKANKESFFDTLHRKLRISSKGKVSIRSGGSRRHCNDTISEKGDHSPCGSRSPSPSKVARCQSFIDRPHAQPLPLPGLHPSSVGRVDSEISISSKSRLEKVSKPLSFLTLPTPGCIRCRPNPADLDGDMVTASVFSDCSADSDEPADSHNRSPLAIDCETGTRTAAGSPSSLMLKDQPPAVSQLNSTGVKKPGNILSNHMSSTSPKRRPLRNHVPNLQVPPHGAFYSAPDSSLSSPSRSPLRAFGTDQVLNSAFLAGKPYPEINFVGSGHCSSPGSGHNSGHNSMGGDMSGPLLWQPSRGSPEYSPVPSPRMTSPGPSSRIQSGAVTPIHPKAGGTPTESQTHRLPLPPLSVSNSSLFSHSNSAATSPSMPRSPARADNPNSGSRWKKGKLLGSGSFGHVYLGFNSERGEMCAVKEVTLFSDDPKSMESAKQFMQEIHLLSRLQHPNIVQYYGSETVDNKLYIYLEYVSGGSIHKLLREYGQFGELVIRSYTQQILSGLAYLHAKNTLHRDIKGANILVDPTGRVKLADFGMAKHITGQSCPLSFKGTPYWMAPEVIKNSNGCNLAVDIWSLGCTVLEMATTKPPWFQYEGVAAMFKIGNSKELPTIPDHLSNEGKDFVRKCLQRNPHDRPSASELLDHPFVKNAAPLERPIPAPEALDPVSGITQGAKALAIGQGRNLSSLDSDRLSVHSSRFLKTNPHESEIHIPRNISCPVSPIGSPLLRSRSPQHRNGKMSPSPISSPRTASGASTPLAGGSGAIPFGNHSKQSIYFQEGFGSIPKSSNGVYMNGHSHHDSNVDIFRGMQMGSHISPELVSSENDVLVKQFARHPHAEPYDFQSVLADRVGRQLLGEHVKINPSIDLSPNSSLLSRPNGL

SEQ ID NO: 994 - protein, 470 aa, Glycine max
MNMMRRLKSIASGRTSISSDPGGDSNSKRAKFEPETEGKADEKTNTIETICTDQEQPIDTSKETSNVGTSDVSTVARTEKSGFDELPKELNEMKIRDEKSKNNNEKDIEATVVSGNGTETGQIITTAIGGRDGQPKQTISYMAERVVGTGSFGVVFQAKCLETGESVAIKKVLQDRRYKNRELQVMRTVDHPNVVKLKHYFFSTTDKDELYLNLVLEYVPETVYKVSKHYVRMHQHMPIIYVQLYTYQICRALNYLHQVIGVCHRDIKPQNLLVNPQTHQLKICDFGSAKVLVPGEPNISYICSRYYRAPELIFGATEYTIAIDMWSVGCVLAELLLGQPLFPGESGVDQLVEIIKVLGTPTREEIRCMNPNYNEFKFPQIKAHPWHKVFHKRMPPEAVDLVSRLLQYSPNLRCTALAACAHPFFNDLRDPNACLPNGRPLPPLFNFTSQELANAPEELRQRLIPEHARS

SEQ ID NO: 995 - protein, 458 aa, Glycine max
MEFTESYKQTGPCCFSPDARFIAVAVDYRLVIRETVSFKVVQLFSCLDKISYIEWALDSEYILCGLYKKPMIQAWSLTQPEWTCKIDEGPAGIAYARWSPDSRHILTTSDFQLRLIVWSLLNTACVHLQWPKHASKGVSFTRDGKFAAICSRRDCKDYINLLSCHTWEIMGNFAVDTLDLADIEWSPDDSAIVIWDSPLDYKVLIYSPDGRCLFKYQAYESGLGIKSVSWSPCGQFLAVGSYDQMLRVLNHLTWKTFAELMHPSTVRGPCYAAVFKEVDEPLQLDMSELCLSDDFSQGHDDSPEEPFRVRYEVMEVPINLPFQKPPAEKPNPKQGIGILSWSTDSQYICTRNDSMPTVLWIWDIRHLELAAILVHKDPIRVAAWDPTCTRLVLCTGSTHLYMWTPSGAYCVHVPLSQFTITDLKWNSDGSCLLLKDKESFCCAAVPLLPESSEYSSDD

SEQ ID NO: 996 - protein, 222 aa, Arabidopsis thaliana
MASILARRSLNTLRARHLVLSGQALQGSHLSRLQSRGISYGSNKDDEEAEQLSKEISKDWNTVFERSINTLFLTEMVRGLSLTLKYFFDPKVTINYPFEKGPLSPRFRGEHALRRYPTGEERCIACKLCEAVCPAQAITIEAEEREDGSRRTTRYDIDMTKCIYCGFCQEACPVDAIVEGPNFEFATETHEELLYDKEKLLENGDRWETEIAENLRSESLYR

SEQ ID NO: 997 - protein, 250 aa, Arabidopsis thaliana
MVKIEVGSVGDSFSVSSLKAYLSEFIATLLFVFAGVGSAVAFAKLTSDGALDPAGLVAIAIAHAFALFVGVSIAANISGGHLNPAVTLGLAIGGNITLITGFFYWIAQCLGSIVACLLLVFVTNGKSVPTHGVSAGLGAVEGVVMEIVVTFALVYTVYATAADPKKGSLGTIAPIAIGFIVGANILAAGPFSGGSMNPARSFGPAVVSGDLSQIWIYWVGPLVGGALAGLIYGDVFIGSYEAVETREIRV

SEQ ID NO: 998 - protein, 540 aa, Arabidopsis thaliana
MKLLGLVFLLFNLFMFSFSRKLLTESGGGLHDEAALLKLKSSFLDPNGVLSSWVSDSSSNHCSWYGVSCNSDSRVVSLILRGCDELEGSGVLHLPDLSSCSSSKRRLGGVISPVVGDLSEIRVLSLSFNDLRGEIPKEIWGLEKLEILDLKGNNFIGGIRVVDNVVLRKLMSFEDEDEIGPSSADDDSPGKSGLYPIEIASIVSASVIVFVLLVLVILFIYTRKWKRNSQVQVDEIKEIKVFVDIGIPLTYEIIVRATGYFSNSNCIGHGGFGSTYKAEVSPTNVFAVKRLSVGRFQGDQQFHAEISALEMVRHPNLVMLIGYHASETEMFLIYNYLSGGNLQDFIKERSKAAIEWKVLHKIALDVARALSYLHEQCSPKVLHRDIKPSNILLDNNYNAYLSDFGLSKLLGTSQSHVTTGVAGTFGYVAPEYAMTCRVSEKADVYSYGIVLLELISDKRALDPSFSSHENGFNIVSWAHMMLSQGKAKEVFTTGLWETGPPDDLVEVLHLALKCTVDSLSIRPTMKQAVRLLKRIQPSRL

SEQ ID NO: 999 - protein, 419 aa, Arabidopsis thaliana
MVSYRATTETISLALEANSSEAITILYQVLEDPSSSPEAIRIKEQAITNLCDRLTEEKRGEDLRKLLTKLRPFFSLIPKAKTAKIVRGIIDAVAKIPGTTDLQITLCKEMVEWTRAEKRTFLRQRVEARLAALLMENKEYVEALALLSTLVKEVRRLDDKLLLVDIDLLESKLHFSLRNLPKAKAALTAARTAANAIYVPPAQQGTIDLQSGILHAEEKDYKTGYSYFFEAFESFNALGDPRAVFSLKYMLLCKIMVSQADDVAGIISSKAGLQYVGPDLDAMKAVADAHSKRSLKLFENALRDYKAQLEDDPIVHRHLSSLYDTLLEQNLCRLIEPFSRVEIAHIAELIGLPLDHVEKKLSQMILDKKFAGTLDQGAGCLIIFEDPKADAIYSATLETIANMGKVVDSLYVRSAKIMS

SEQ ID NO: 1000 - protein, 388 aa, Arabidopsis thaliana
MLSSIKPSSSSFSTAISGSVRRSIPTKLKFSPLLIIKNCHNQSFNANVVSHQKPLHISSASNFKREVKVEAYEADRSRPLDINIELPDEQSAQKLKIGIYFATWWALNVVFNIYNKKVLNAFPYPWLTSTLSLACGSLMMLVSWATRIADAPKTDLEFWKTLFPVAVAHTIGHVAATVSMSKVAVSFTHIIKSGEPAFSVLVSRFFMGETFPLPVYLSLLPIIGGCALAAITELNFNITGFMGAMISNLAFVFRNIFSKKGMKGKSVSGMNYYACLSMMSLVILTPFSIAVEGPQMWAAGWQNAVSQVGPNFVWWVVAQSVFYHLYNQVSYMSLDQISPLTFSIGNTMKRISVIVASIIIFHTPIQPVNALGAAIAIFGTFLYSQAKQ

SEQ ID NO: 1001 - protein, 355 aa, Arabidopsis thaliana
MSSHARGKELIPLLSFSHQKKQPNLSISSTTKMNKKNPDQKSDMSSSSSSPKKQTLFISSLIILWYTSNIGVLLLNKFLLSNYGFKFPIFLTMCHMSACAILSYVSIVFLKLVPLQYLKSRSQFLKVATLSIVFCASVVGGNISLRYLPVSFNQAVGATTPFFTALFAYIMTFKREAWVTYGALVPVVTGVVIASGGEPGFHWFGFIMCISATAARAFKSVLQGILLSSEGERLNSMNLMLYMSPIAVIALLPVTIFMEPDVMSVTLTLGRQHKYMYILLLVNSVMAYSANLLNFLVTKHTSALTLQVLGNAKGAVAVVISILLFRNPVTVMGIGGYSITVLGVVAYGETKRRFR

SEQ ID NO: 1002 - protein, 1187 aa, Arabidopsis thaliana
MRNHCLELSSNCSSIFASSKSNPRFSPSKLSYSTFFSRSAIYYRSKPKQASSSSSFSTFPPCLNRKSSLTHVLKPVSELADTTTKPFSPEIVGKRTDLKKIMILGAGPIVIGQACEFDYSGTQACKALREEGYEVILINSNPATIMTDPETANRTYIAPMTPELVEQVIEKERPDALLPTMGGQTALNLAVALAESGALEKYGVELIGAKLGAIKKAEDRELFKDAMKNIGLKTPPSGIGTTLDECFDIAEKIGEFPLIIRPAFTLGGTGGGIAYNKEEFESICKSGLAASATSQVLVEKSLLGWKEYELEVMRDLADNVVIICSIENIDPMGVHTGDSITVAPAQTLTDREYQRLRDYSIAIIREIGVECGGSNVQFAVNPVDGEVMIIEMNPRVSRSSALASKATGFPIAKMAAKLSVGYTLDQIPNDITRKTPASFEPSIDYVVTKIPRFAFEKFPGSQPLLTTQMKSVGESMALGRTFQESFQKALRSLECGFSGWGCAKIKELDWDWDQLKYSLRVPNPDRIHAIYAAMKKGMKIDEIYELSMVDKWFLTQLKELVDVEQYLMSGTLSEITKEDLYEVKKRGFSDKQIAFATKTTEEEVRTKRISLGVVPSYKRVDTCAAEFEAHTPYMYSSYDVECESAPNNKKKVLILGGGPNRIGQGIEFDYCCCHTSFALQDAGYETIMLNSNPETVSTDYDTSDRLYFEPLTIEDVLNVIDLEKPDGIIVQFGGQTPLKLALPIKHYLDKHMPMSLSGAGPVRIWGTSPDSIDAAEDRERFNAILDELKIEQPKGGIAKSEADALAIAKEVGYPVVVRPSYVLGGRAMEIVYDDSRLITYLENAVQVDPERPVLVDKYLSDAIEIDVDTLTDSYGNVVIGGIMEHIEQAGVHSGDSACMLPTQTIPASCLQTIRTWTTKLAKKLNVCGLMNCQYAITTSGDVFLLEANPRASRTVPFVSKAIGHPLAKYAALVMSGKSLKDLNFEKEVIPKHVSVKEAVFPFEKFQGCDVILGPEMRSTGEVMSISSEFSSAFAMAQIAAGQKLPLSGTVFLSLNDMTKPHLEKIAVSFLELGFKIVATSGTAHFLELKGIPVERVLKLHEGRPHAADMVANGQIHLMLITSSGDALDQKDGRQLRQMALAYKVPVITTVAGALATAEGIKSLKSSAIKMTALQDFFEVKNVSSLLV

SEQ ID NO: 1003 - protein, 424 aa, Arabidopsis thaliana
MQPSRTRVSFFETGETMKQRKKSYLSIFVIFFSLFFFGIFMYNDNLKSSIADFTSSNPFSSSFVELPPDECDLFTGQWVFDNKTYPLYKEEECEFLTEQVTCLRNGRKDSLFQNWRWQPRDCSLPKFNARVLLEKLRNKRLMFVGDSLNRNQWESMVCLVQSVIPPGRKSLNQTGSLTVFKIQDYNATVEFYWAPFLVESNSDDPEKHSIIDRIIMPESIEKHGVNWIGVDFLVFNSYIWWMNTVSIKVLRGSFDDGDTEYDEIKRPIAYERVLRTLGDWVDHNIDPLSTTVFFMSMSPLHIKSSDWANPEGIRCALETTPILNMSFNVAYGQFSAVGTDYRLFPVAENVTQSLKVPIHFLNITALSEYRKDAHTSVYTIKQGKLLTREQQNDPANFADCIHWCLPGLPDTWNEFLYTHIISRR

SEQ ID NO: 1004 - protein, 603 aa, Arabidopsis thaliana
MAASSTNARLTNPPRLLSKPRLSPTSVANLRFPAADFSTRFFADSSSPRLRSVPFPVVFSDQRRRRSMEPSNVYVASNSTEMEIGSHDIVKNPSLICAPVMADSIDKMVIETSKAHELGADLVEIRLDWLKDFNPLEDLKTIIKKSPLPTLFTYRPKWEGGQYEGDENERRDVLRLAMELGADYIDVELQVASEFIKSIDGKKPGKFKVIVSSHNYQNTPSVEDLDGLVARIQQTGADIVKIATTAVDIADVARMFHITSKAQVPTIGLVMGERGLMSRILCSKFGGYLTFGTLDSSKVSAPGQPTIKDLLDLYNFRRIGPDTKVYGIIGKPVSHSKSPIVHNQAFKSVDFNGVYVHLLVDNLVSFLQAYSSSDFAGFSCTIPHKEAALQCCDEVDPLAKSIGAVNTILRRKSDGKLLGYNTDCIGSISAIEDGLRSSGDPSSVPSSSSPLASKTVVVIGAGGAGKALAYGAKEKGAKVVIANRTYERALELAEAIGGKALSLTDLDNYHPEDGMVLANTTSMGMQPNVEETPISKDALKHYALVFDAVYTPRITRLLREAEESGAITVSGSEMFVRQAYEQFEIFTGLPAPKELYWQIMSKY

SEQ ID NO: 1005 - protein, 150 aa, Arabidopsis thaliana
MTTPAKKRLMWDFKRLQKDPPVGISGAPQDNNIMHWNALIFGPEDTPWDGGTFKLTLHFTEDYPNKPPIVRFVSRMFHPNIYADGSICLDILQNQWSPIYDVAAVLTSIQSLLCDPNPDSPANAEAARLFSENKREYNRKVIEIVEQSYV

SEQ ID NO: 1006 - protein, 527 aa, Arabidopsis thaliana
MPIDKIFKDDASEEKGERARMASFVGAMAISDLVKSTLGPKGMDKILQSTGRGHAVTVTNDGATILKSLHIDNPAAKVLVDISKVQDDEVGDGTTSVVVLAGELLREAEKLVASKIHPMTIIAGYRMASECARNALLKRVIDNKDNAEKFRSDLLKIAMTTLCSKILSQDKEHFAEMAVDAVFRLKGSTNLEAIQIIKKPGGSLKDSFLDEGFILDKKIGIGQPKRIENANILVANTAMDTDKVKIYGARVRVDSMTKVAEIEGAEKEKMKDKVKKIIGHGINCFVNRQLIYNFPEELFADAGILAIEHADFEGIERLGLVTGGEIASTFDNPESVKLGHCKLIEEIMIGEDKLIHFSGCEMGQACSIVLRGASHHVLDEAERSLHDALCVLSQTVNDTRVLLGGGWPEMVMAKEVDELARKTAGKKSHAIEAFSRALVAIPTTIADNAGLDSAELVAQLRAEHHTEGCNAGIDVITGAVGDMEERGIYEAFKVKQAVLLSATEASEMILRVDEIITCAPRRREDRM

SEQ ID NO: 1007 - protein, 136 aa, Arabidopsis thaliana
MRGVGGPLLSIGDLLADLGDETGHSPQNHPNPEVSSKSYSDDTISGPLDLTRLFQENYDKLNDAFAGSDHSWTSLTLELCTSLETANKLVHATTTNARLLSEKVEELEKIVKRGDSAVAAARTVHATVNQKGLPST

SEQ ID NO: 1008 - protein, 353 aa, Arabidopsis thaliana
MKKKMIAIGFEGSANKIGVGIVTLDGTILANPRHTYITPPGHGFLPRETAHHHLDHVLPLVKSALETSQVTPEEIDCICYTKGPGMGAPLQVSAIVVRVLSQLWKKPIVAVNHCVAHIEMGRVVTGADDPVVLYVSGGNTQVIAYSEGRYRIFGETIDIAVGNCLDRFARVLKLSNDPSPGYNIEQLAKKGENFIDLPYAVKGMDVSFSGILSYIETTAEEKLKNNECTPADLCYSLQETVFAMLVEITERAMAHCDKKDVLIVGGVGCNERLQEMMRTMCSERDGKLFATDDRYCIDNGAMIAYTGLLAFVNGIETPIEDSTFTQRFRTDEVHAVWREKEAVLLGDKKVAAN

SEQ ID NO: 1009 - protein, 297 aa, Arabidopsis thaliana
MLSSSPAVTTASHLHPPPSPETYQIPLNLLSSPHITRRDLFKTLSVCIATPSLSVSIAAPANARGLFQMPPLRLSNRYYLVRAGESDYESLGIINTNPVAKTSVDSGLSEKGKKQTLRAALQLKAMGACDRNCWLWPSITQRAYQAAEIIAAINGISRSYIVPEYSFLDARGLGAYEGKKLESISEVYALDSISMKTKPPPISDGTPNESVSDVFVRVTQLMSILETQYSEDTIVIVSPDSDNLSVLQAGIQGLDLRRHSELYFGPGEVRLLDANSIPVYKQPASAVYKCKKPPNCD

SEQ ID NO: 1010 - protein, 350 aa, Arabidopsis thaliana
MGSLPPPSLDFSSIDHNSLKNGGSSHQEISHDNLLNLFKSQQDLLNHFFKHLDLSQTLDFSRILLSTTGTVFFTGVGKSAFVANKVSQTLVSLSFRSSFLSPLDALHGDIGALSPRDVLVFFSKSGATEELLRLVPCARAKGAFLVSLTSVSGNPLAGVCDMNVHLPLQRELCPFNLAPVTSTAIQMVFGDTIAVALMAARNLSKEEYAANHPAGRIGKSLIFKVKDVMKKQEELPVCKEGDLIMDQLVELTSKGCGCLLVVDEHSRLIGTFTDGDLRRTLKASGEAIFKLSVGEMCNRKPRTIGPETMAVEAMKKMESPPSPVQFLPVVNEDNTLIGIVTLHGLVSAGL

SEQ ID NO: 1011 - protein, 353 aa, Arabidopsis thaliana
MDLDDFRSVMDNAGVDVWTFIDTAILVASLDYGQELKRRRDNIVERLYATSMANKCRNCDFGGGGNVTEAAIGRVNNGRVHEETEEEDEEGVTAAAEEEVREKSVNVEDDDDFDPFAGLFDDEQKSIVEIKEKLEDPDLSEESLVELLQNLEDMDITFQALQETDIGRHVNRVRKHPSNNVRRLAKQLVKKWKETVDEWVKFNQPGDLEPPSLIADEDSPVQKALHNGSRQQVPDFGYSPVPQNGYSSSSKNSNITEPERKPRPVAPQPRRESPSPAKPSRPSPSQQTIPRDKEHKEVDFDTARKRLQQNYRQAENAKKQRTIQVMDIHDIPKPKKGGFFPRKGGSSQGGRHW

SEQ ID NO: 1012 - protein, 121 aa, Arabidopsis thaliana
MNPKRCAACKYLRRRCPKDCVFSPYFPPNDPQKFACVHRIYGAGNVSKMLQQLPDQTRAEAVESLCFEAKCRVDDPVYGCVGIIHLLKTQIQKTQNELAKTQAEIAVAQTKLSQTHISDFM

SEQ ID NO: 1013 - protein, 244 aa, Arabidopsis thaliana
MTGSGSPCGACKFLRRRCVKGCVFAPYFCHEQGASHFAAIHQVFGASNASKLLSHLPMEDRREAATTIYYEAQARRQDPIYGCVSHIFSLQQQVVNLQTQLEILKQQATQSMMAIDSPSIENPNYYQDTKPQYLQESHDLHHHHLTTSNCQTEQNSDLKNIMTSCYHQMEIETTPFTGAGGDTMAGSYYYNSSSGCSEELKSVSTNGEFSKYSELDQHLTNTFNQYRHGGNNLISESLGYITYS

SEQ ID NO: 1014 - protein, 312 aa, Arabidopsis thaliana
MFENKPDDSPVYLATASHDQTIRLWQARTGRCYFSFRYPDLHVNRLELTPEKGKLVAACNPHIRLFDLRSYNPHIPVRNFVSHTKNVMAVGFQYTGHMMYSGSEDGSVKIWDLRVRECQREFRSVSPVNTVVLHPNQTELISGDQNGNIRVWDLRADLCSCELVPEVGTPIRSLTVMWDGTMVVAANDRGTCYVWRSLCERQTMTEFEPLHKLQAHNSHILKCLLSPGNKYLATASSDKTVKIWNLDGFKLEKVLTGHERWVWDCDFSMDGEYLVTASSDTTARLWSMRAGKEEMVYQAHRKATVCCTLLRD

SEQ ID NO: 1015 - protein, 433 aa, Arabidopsis thaliana
MDIDGEDVSRRLHVKFVTKLDSPFKVPVNSVAIPSNVTRLGLSSIVNSIIESENPEWKTEPFDFLIDGELIRMSLEEFLLAKGISAERTLEIEYIRAVTPRKEEEPSLHDDWVSAVNGSSPRFILTGCYDGLGRVWSSAGSCSHILEGHSGAISSVALVNSNDAETVTVATASKDRTLRLFKFDPAESVDSTTKVRAYKILRGHKASVQSVSAQKSGNMVCSSSWDCTINLWNTNESTSEGESVSVKKRKGNNQAEESQSEGEAVTSLVGHTQCVSSVVWPEHDVIYSSSWDHSVRRWDVETGKDSLNLFCGKALNTVDVGGESSALIAAGGSDPILRVWDPRKPGTSAPVFQFSSHSSWISACKWHKSSWFHLLSASYDGKIMLWDLRTAWPLSVIDTHNDKVLSADWWKGESVVSGGADSNLRISSGIAIS

SEQ ID NO: 1016 - protein, 499 aa, Arabidopsis thaliana
MSNNWKSVRLRLQNRTLVFLLVILSFGSCYSLKSQGDGFLESVTKDLWSDIDAEDLRAVGFHRKLLGRFRNPYTHLNAFRDRPVARATPPSSSVSTRPDAKRSSTLPPPQKSPPAQHVSAPPPFVHHVTLPSLTSSSKTSSNSTIPIVAGCIAGAVFILLLATGVFFFKSKAGKSVNPWRTGLSGQLQKVFITGVPKLKRSEIEAACEDFSNVIGSCPIGTLFKGTLSSGVEIAVASVATASAKEWTNNIEMQFRKKIEMLSKINHKNFVNLLGYCEEEEPFTRILVFEYASNGTVFEHLHYKESEHLDWVMRLRIAMGIAYCLDHMHGLKPPIVHSNLLSSSVQLTEDYAVKIADFNFGYLKGPSETESSTNALIDTNISETTQEDNVHSFGLLLFELMTGKLPESVQKGDSIDTGLAVFLRGKTLREMVDPTIESFDEKIENIGEVIKSCIRADAKQRPIMKEVTGRLREITGLSPDDTIPKLSPLWWAELEVLSTA

SEQ ID NO: 1017 - protein, 182 aa, Arabidopsis thaliana
TGKVIAIMGVSGAGKSTIGKMLGKALSCDFLDADDFHSLSNRDKMRQGIALSDEDRMPWLEKIQESLRKRLLDGETVVLACSSLRKQYREILRGSDPDYKPGSYTSCKVTFVLLEGNAEVIAARLQKRASEEEHFMPLTLLQSQFDLLQADECEKIFKISVVLSPEVIVNTILEMVANSLNP

SEQ ID NO: 1018 - protein, 775 aa, Arabidopsis thaliana
MDEDGNLQISNSNYNGEEEGEDPENNTLNQPLLKRHRTLSSTPLALVGAKVSHIESLDYEINENDLFKHDWRSRSKAQVFQYIFLKWTLACLVGLFTGLIATLINLAVENIAGYKLLAVGYYIAQDRFWTGLMVFTGANLGLTLVATVLVVYFAPTAAGPGIPEIKAYLNGIDTPNMFGFTTMMVKIVGSIGAVAAGLDLGKEGPLVHIGSCIASLLGQGGPDNHRIKWRWLRYFNNDRDRRDLITCGSASGVCAAFRSPVGGVLFALEEVATWWRSALLWRTFFSTAVVVVVLRAFIEICNSGKCGLFGSGGLIMFDVSHVEVRYHAADIIPVTLIGVFGGILGSLYNHLLHKVLRLYNLINQKGKIHKVLLSLGVSLFTSVCLFGLPFLAECKPCDPSIDEICPTNGRSGNFKQFNCPNGYYNDLSTLLLTTNDDAVRNIFSSNTPNEFGMVSLWIFFGLYCILGLITFGIATPSGLFLPIILMGSAYGRMLGTAMGSYTNIDQGLYAVLGAASLMAGSMRMTVSLCVIFLELTNNLLLLPITMFVLLIAKTVGDSFNLSIYEIILHLKGLPFLEANPEPWMRNLTVGELNDAKPPVVTLNGVEKVANIVDVLRNTTHNAFPVLDGADQNTGTELHGLILRAHLVKVLKKRWFLNEKRRTEEWEVREKFTPVELAEREDNFDDVAITSSEMQLYVDLHPLTNTTPYTVVQSMSVAKALVLFRSVGLRHLLVVPKIQASGMSPVIGILTRQDLRAYNILQAFPHLDKHKSGKAR

SEQ ID NO: 1019 - protein, 312 aa, Arabidopsis thaliana
MQGACISESQPWYLHFVCFIGFLFLLRVLFIPLLKWFTTRFLLTPKRLKRYGSWAMVTGATEGIGRAFAHELAKHGLNLILVSRNLSKLESVSDDFQQEFPHIKIKIIPFDFSSEGGYGAIEEGIKGLEVGILINNVGITYPRAMFFHEVDQLTWTKILRVNLEATTWVTRSLIGPMLHRRRGAIVNISSGAAVVVPSHPLYAIYAATKAYVDALSRSLHVEYKQFGIDVQCQVPLYVSTRMVSEVAAIDKPSLFVPSPEVYAKAAVAQIGIGSRCSPFWAHSLQWFLVGLVPDNLVDTWRLSIGLRRRSLS

SEQ ID NO: 1020 - protein, 346 aa, Arabidopsis thaliana
MVLFWNIALVSSYFQLLKARIFGSKSTSISGSINPQNGSSRPICVITGATSGLGKATAFALAEKGFYVVLVGRSSQLLSETLKEIKNKNKDAQLKSFEADMSSFESIFTFKNSLEQWLSDSALHPSIQVLVNNAGILATSSRPTIDGYDRMIATNYVGPFFLTKLLLPLLKNSNVPSRVVNVTSFTHHSAFIQKLDKDSVTGVCFSTSNQYPCARIYEYSKLCLLLFSYELHRQLRLIDDSSHVSVIAADPGFVKTNIMRELPCYITSMVFLGFKILGLLQSPEDGAESIIDAALSTPETSGAYYFGGKGRTIESSQVSRDPKLAKQLWETSCDLFNDLQLLHHHN

SEQ ID NO: 1021 - protein, 303 aa, Arabidopsis thaliana
MDLNNKIFNILLPIVTVSFLLVFMPFSIFFKLLQFIRGCKESEKVNGKVVIITGSSSGIGEHLAYEYARRGAYLTLVARREDRLQVVADRCRKLGSPDVAVVRGDVSVIKDCKRFVQETISRFGRLDHLVNNAGIAEAKFFEDYSEISDVLPIVNTNFWGPVYATHFAIPHLKKTKGKIIAVASPAGWSGVPRMSIYAASKAAMINFYETLRIELHPEVGVTIVFPGLIENGNTNPDLLAESLLQKQDWSQVVTIESAAECAKAVVNGICRGKTFVAEPSWVRVLFWLSAICPELLISKPKRN

SEQ ID NO: 1022 - protein, 646 aa, Arabidopsis thaliana
MGKSCVVTSSFSLLLLFLQTLKYVHAGFICYGDFFNVNYGVSRTYLFSSLPSNVVSNGGFYNASFGRDSKNNRVHVVALCRRGYEKQACKTCLEHVIEDTKSKCPRQKESFSWVTDEFDDVSCSLRYTNHSTLGKLELLPNTINPNPNSIDSKFNNMAMFSQEWIAMVNRTLEAASTAENSSVLKYYSATRTEFTQISDVYALMQCVPDLSPGNCKRCLRECVNDFQKQFWGRQGGGVSRPSCYFRWDLYPYYRAFDNVVRVPAPPPQASSTIIDYGRDEKSFQGSNIAIIVVPSVINLIIFVVLIFSWKRKQSHTIINDVFDSNNGQSMLRFDLRMIVTATNNFSLENKLGQGGFGSVYKGILPSGQEIAVKRLRKGSGQGGMEFKNEVLLLTRLQHRNLVKLLGFCNEKDEEILVYEFVPNSSLDHFIFDEEKRRVLTWDVRYTIIEGVARGLLYLHEDSQLRIIHRDLKASNILLDAEMNPKVADFGMARLFDMDETRGQTSRVVGTYGYMAPEYATYGQFSTKSDVYSFGVMLLEMISGKSNKKLEKEEEEEEEELPAFVWKRWIEGRFAEIIDPLAAPSNNISINEVMKLIHIGLLCVQEDISKRPSINSILFWLERHATITMPVPTPVAYLTRPSLSLGH

SEQ ID NO: 1023 - protein, 601 aa, Arabidopsis thaliana
MKKIFITLLWLLFISSFLCSSSSAEDDVLCLQGLKNSLIDPSSRLSSWSFPNSSASSICKLTGVSCWNEKENRIISLQLQSMQLAGEIPESLKLCRSLQSLDLSGNDLSGSIPSQICSWLPYLVTLDLSGNKLGGSIPTQIVECKFLNALILSDNKLSGSIPSQLSRLDRLRRLSLAGNDLSGTIPSELARFGGDDFSGNNGLCGKPLSRCGALNGRNLSIIIVAGVLGAVGSLCVGLVIFWWFFIREGSRKKKGYGAGKSKDDSDWIGLLRSHKLVQVTLFQKPIVKIKLGDLMAATNNFSSGNIDVSSRTGVSYKADLPDGSALAVKRLSACGFGEKQFRSEMNKLGELRHPNLVPLLGYCVVEDERLLVYKHMVNGTLFSQLHNGGLCDAVLDWPTRRAIGVGAAKGLAWLHHGCQPPYLHQFISSNVILLDDDFDARITDYGLAKLVGSRDSNDSSFNNGDLGELGYVAPEYSSTMVASLKGDVYGFGIVLLELVTGQKPLSVINGVEGFKGSLVDWVSQYLGTGRSKDAIDRSICDKGHDEEILQFLKIACSCVVSRPKERPTMIQVYESLKNMADKHGVSEHYDEFPLVFNKQEA

SEQ ID NO: 1024 - protein, 587 aa, Arabidopsis thaliana
MQIFLFFFSLILCFVLISSQTLEDDKKALLHFLSSFNSSRLHWNQSSDVCHSWTGVTCNENGDRIVSVRLPAVGFNGLIPPFTISRLSSLKFLSLRKNHFTGDFPSDFTNLKSLTHLYLQHNHLSGPLLAIFSELKNLKVLDLSNNGFNGSIPTSLSGLTSLQVLNLANNSFSGEIPNLHLPKLSQINLSNNKLIGTIPKSLQRFQSSAFSGNNLTERKKQRKTPFGLSQLAFLLILSAACVLCVSGLSFIMITCFGKTRISGKLRKRDSSSPPGNWTSRDDNTEEGGKIIFFGGRNHLFDLDDLLSSSAEVLGKGAFGTTYKVTMEDMSTVVVKRLKEVVVGRREFEQQMEIIGMIRHENVAELKAYYYSKDDKLAVYSYYNHGSLFEILHGNRGRYHRVPLDWDARLRIATGAARGLAKIHEGKFIHGNIKSSNIFLDSQCYGCIGDVGLTTIMRSLPQTTCLTSGYHAPEITDTRRSTQFSDVYSFGVVLLELLTGKSPVSQAELVPTGGENMDLASWIRSVVAKEWTGEVFDMEILSQSGGFEEEMVEMLQIGLACVALKQQERPHIAQVLKLIEDIRSVDAE

SEQ ID NO: 1025 - protein, 325 aa, Arabidopsis thaliana
MMMSRRYGAKLMETAVTHSHLLNPRVPLVTENIRVPAMGVVRVFSKMTFEKKKTTEEKGSSGGKADQGNKGEQLIVSYWGVKPMKITKEDGTEWKWSCFRPWETYKSDLTIDLKKHHVPSTLPDKLAYWTVKSLRWPTDLFFQRRYGCRAMMLETVAAVPGMVGGMLVHCKSLRRFEQSGGWIKALLEEAENERMHLMTFMEVAKPNWYERALVIAVQGIFFNAYFLGYLISPKFAHRMVGYLEEEAIHSYTEFLKELDNGNIENVPAPAIAIDYWRLEADATLRDVVMVVRADEAHHRDVNHYASDIHYQGRELKEAPAPIGYH

SEQ ID NO: 1026 - protein, 108 aa, Arabidopsis thaliana
ARHPAKYRMLVGMVDVIFSDVAQPDQARILALNASFFLKTGGHFVISIKANCIDSTVAAEAVFQSEVKKLQQEQFKPAEQVTLEPFERDHACVVGGYRMPKKQKTPAS

SEQ ID NO: 1027 - protein, 163 aa, Arabidopsis thaliana
MAETKKMIILKSSDGESFEIEEAVAVKSQTIKHMIEDDCADNGIPLPNVTGAILAKVIEYCKKHVEAAAEAGGDKDFYGSAENDELKNWDSEFVKVDQPTLFDLILAANYLNIGGLLDLTCKAVADQMRGKTPEQMRAHFNIKNDYTPEEEAEVRNENKWAFE

SEQ ID NO: 1028 - protein, 170 aa, Arabidopsis thaliana
MSSNKIVLTSSDDESFEVEEAVARKLKVIAHMIDDDCADKAIPLENVTGNILALVIEYCKKHVLDDVDDSDDSTEATSENVNEEAKNELRTWDAEFMKEFDMETVMKLILAVNYLNVQDLLGLTCQTVADHMKDMSPEEVRELFNIENDYTPEEEDAIRKENAWAFEDLK

SEQ ID NO: 1029 - protein, 150 aa, Arabidopsis thaliana
MSSKKIVLTSSDDECFEIDEAVARKMQMVAHMIDDDCADKAIRLQNVTGKILAIIIEYCKKHVDDVEAKNEFVTWDAEFVKNIDMDTLFKLLDAADYLIVIGLKNLIAQAIADYTADKTVNEIRELFNIENDYTPEEEEELRKKNEWAFN

SEQ ID NO: 1030 - protein, 625 aa, Arabidopsis thaliana
MPNSILFLLLSFLYLTNCVAQSPSQTCPLDFSHVLTIPWNTTDCQKSDKSADSKNSCCQSLLTLIGIPLAHRLKQTSNFRLPNLATSISCLNNLQTKLSSLSLSSNLTSLCFDPNQFVINNETCAGIQTTQDWVSRLGPSTALDSACSSGLTDLTRCDACVAAGFRVQKQLITLDGNSSHGVYCYHFVVTYAAGIVNKKGPESDDALSCLFSLSLRSPLNSKKKRHTVALALGITGAIFGALVIAGLICLYFRFGKAVKGGEVGWEDQGSRPKWRPNTGSIWFKIEELEKATNNFSQKNFIGRGGFGFVYKGVLPDGSVIAVKKVIESEFQGDAEFRNEVEIISNLKHRNLVPLRGCSMVDDDSESQRYLVYDYMSNGNLDDHLFPRGETTKMPLSWPQRKSIILDVAKGLAYLHYGVKPAIYHRDIKGTNILLDVDMRARVADFGLAKQSREGESHLTTRVAGTHGYLAPEYALYGQLTEKSDVYSFGVVILEIMCGRKALDLSTSGSPNTFLITDWAWSLVKAGKTEEALEQSLLREEGSGLSNPKGIMERFLQVGILCAHVLVALRPTILDALKMLEGDIEVPPIPDRPVPLAHPSYRMDGNGFTISPALSGLQIHSGDMLR

SEQ ID NO: 1031 - protein, 223 aa, Arabidopsis thaliana
MVLEDEMKKGEASGETSEKMGLSRKNSGSSLSPTEDDEEDEDKKLELGPMIALKEQLERDKDDESLRRWKEQLLGVVDLEDVGETPDPVVKILDLTIRSPDREEMVLTIPEDGLPNPKGPWFTIKEGSKYTLVFNFRVTNNIVSGLRYNNTVWKTGVKVDSTKAMLGTFSPQAESYQHVMPEEMTPSGMFARGSYSARTKFIDDDNKCYLEINYTFDIRKSWQ

SEQ ID NO: 1032 - protein, 654 aa, Arabidopsis thaliana
MAVSVSKQYMTSLVVILLFISLSSLSPTSTSHSCDPVEEEEEASSFGYVCHSNLQKCHTFAILRAKPPFYSLSDLSRHLGLDADDEYVPKGQLLLIPIECRCNGSIYEASLIKNCVKGDTFRSVSQSLQGLTTCLSIREKNPHISEDKLGDNIKLRLAIRCSCPQEGVSNASFLVTYPVGVRDSVSSLAVRFNTTEDAIVSANNKSGVVPLKPALIPLDHKPEKQGSRKRNPSKKKRSKMKLMIAVSSAIAGVCGLVTLMVFGYLHWKKETQIQTQTQKWISNKDPETRQLSLSIRTTSDKKISFEGSQDGSILDSHNTVGTTTPRKPVLEIYAFEELEKATENFSSSNHIKGSVYFGSLKGKDLAIKQVNADEMKRFDFGLLNDQSHYYNHNVIRVLGTCFREIDQDSYLVFEYARNGSLWDWIQNKLAIKNQFIESCYCFLAWKQRIKICHDVAIALKYMHRINYVHGNIKSRNIFLNEDLRGKVGNFGMSKCVTNELATEENLIESSLSPASDIFAYGIIVMEVLSGQTPDMLLGLQEVETTSLGTQETFVSEWSRLRRLLGDKEKLREVMDSTLGESYSVDSAFEIASIARDCTAEEAESRPSAVEIAERVSRLVDDDEDEEDEAVIDRESTLISESSYKPLVKKSSIID

SEQ ID NO: 1033 - protein, 564 aa, Arabidopsis thaliana
MSESFKVCFCCSRSFKEKTRQPPVSIKRLFEAYSRNGKMSFDELLRFVSEVQGERHAGLDYVQDIFHSVKHHNVFHHHGLVHLNAFYRYLFSDTNSPLPMSGQVHHDMKAPLSHYFVYTGHNSYLTGNQVNSRSSVEPIVQALRKGVKVIELDLWPNPSGNAAEVRHGRTLTSHEDLQKCLTAIKDNAFHVSDYPVIITLEDHLPPKLQAQVAKMLTKTYRGMLFRRVSESFKHFPSPEELKGKILISTKPPKEYLESKTVHTTRTPTVKETSWNRVANKILEEYKDMESEAVGYRDLIAIHAANCKDPSKDCLSDDPEKPIRVSMDEQWLDTMVRTRGTDLVRFTQRNLVRIYPKGTRVDSSNYDPHVGWTHGAQMVAFNMQGHGKQLWIMQGMFRGNGGCGYVKKPRILLDEHTLFDPCKRFPIKTTLKVKIYTGEGWDLDFHHTHFDQYSPPDFFVKIGIAGVPRDTVSYRTETAVDQWFPIWGNDEFLFQLSVPELALLWFKVQDYDNDTQNDFAGQTCLPLPELKSGVRAVRLHDRTGKAYKNTRLLVSFALDPPYTFR

SEQ ID NO: 1034 - protein, 295 aa, Arabidopsis thaliana
LNATSLQNYVFDFAGVNYVGDFLPTLKLFDLDGYRKRAKKLASKLDKFMQKLVDEHRKNRGKAELEKTMITRLLSLQESEPECYTDDIIKGLVQVMLLAGTDTTAVTLEWAMANLLNHPEVLRKLKTELNEVSKEGRVFEESDTGKCPYLNNVISETLRLFPAAPLLVPHASSTDCEVAGFDIPRRTWLFINAWAIQRDPNVWDDPETFKPERFESETHRGKFLPFGIGRRACPGMGLAQLVLSLALGSLIQCFDWERDNDVAVDMSEGKGLTMPKSVPLVAKCKSLPILDKLVL

SEQ ID NO: 1035 - protein, 497 aa, Arabidopsis thaliana
MAMLGFYVTFIFFLVCLFTYFFLQKKPQGQPILKNWPFLRMLPGMLHQIPRIYDWTVEVLEATNLTFYFKGPWLSGTDMLFTADPRNIHHILSSNFGNYPKGPEFKKIFDVLGEGILTVDFELWEEMRKSNHALFHNQDFIELSVSSNKSKLKEGLVPFLDNAAQKNIIIELQDVFQRFMFDTSSILMTGYDPMSLSIEMLEVEFGEAADIGEEAIYYRHFKPVILWRLQNWIGIGLERKMRTALATVNRMFAKIISSRRKEEISRAKTEPYSKDALTYYMNVDTSKYKLLKPNKDKFIRDVIFSLVLAGRDTTSSVLTWFFWLLSKHPQVMAKLRHEINTKFDNEDLEKLVYLHAALSESMRLYPPLPFNHKSPAKPDVLPSGHKVDANSKIVICIYALGRMRSVWGEDALDFKPERWISDNGGLRHEPSYKFMAFNSGPRTCLGKNLALLQMKMVALEIIRNYDFKVIEGHKVEPIPSILLRMKHGLKVTVTKKI

SEQ ID NO: 1036 - protein, 524 aa, Arabidopsis thaliana
MSLCLVIACMVTSWIFLHRWGQRNKSGPKTWPLVGAAIEQLTNFDRMHDWLVEYLYNSRTVVVPMPFTTYTYIADPINVEYVLKTNFSNYPKGETYHSYMEVLLGDGIFNSDGELWRKQRKTASFEFASKNLRDFSTVVFKEYSLKLFTILSQASFKEQQVDMQELLMRMTLDSICKVGFGVEIGTLAPELPENHFAKAFDTANIIVTLRFIDPLWKMKKFLNIGSEALLGKSIKVVNDFTYSVIRRRKAELLEAQISPTNNNNNNNNKVKHDILSRFIEISDDPDSKETEKSLRDIVLNFVIAGRDTTATTLTWAIYMIMMNENVAEKLYSELQELEKESAEATNTSLHQYDTEDFNSFNEKVTEFAGLLNYDSLGKLHYLHAVITETLRLYPAVPQDPKGVLEDDMLPNGTKVKAGGMVTYVPYSMGRMEYNWGSDAALFKPERWLKDGVFQNASPFKFTAFQAGPRICLGKDSAYLQMKMAMAILCRFYKFHLVPNHPVKYRMMTILSMAHGLKVTVSRRS

SEQ ID NO: 1037 - protein, 709 aa, Arabidopsis thaliana
MVVATTIALYASPPSSVCSTPHQISCDLDLTSRSSSTSSSMASSPQKPIVGGLSSLFSSASVKSSSSSSCSYSTGVDEFSSLRYDRSDDLKDLSFSSSFGYSPAKFVNSFRRDHQSPISVLHGPVSCSCSPPMRMSRDRNLDGSFRLGASGLFNGFVRKALGSCVDYEFGSDSVLVDELTFPMEVDTIKPYARDLLRRAQLRHKIFNDESVIKAFYEAEKAHRGQMRASRDPYLQHCVETAMLLANIGANSTVVVAGLLHDTIDDSFMSYDYILRNFGAGVADLVEGVSKLSQLSKLARENNTACKTVEADRLHTMFLAMADARAVLIKLADRLHNMKTLYALSPVKQQRFAKETLEIFAPLANRLGISTWKVQLENLCFKHLYPNQHNEMSTMLEDSFDEAMITSAIEKLEQALKKAGISYHVLCGRHKSLYSIYSKMLKKKLTVDEIHDIHGLCLIVDNEGDCYKALGVVHSLWSEVPGKLKDYITHPKFNGYQSLHTVVMDNGTVPLEVQIRTQEMHLQAEFGFAAHWRYKEGGCKYSSFVLQMVEWARWVVTWHCEAMSKDRSSISSSDSIKPPCKFPSHSEDCPASYKPNSSQDGPVYVIVIENDKMSVQEFPASSTVSDLLSRAGPGSSRWSMYGIPAKEELRPRLNQIPVSDLKWKLKMGDVVELTPTIPDESLTEYREEIQRMYDRGLAFSRPGTMVGWGS

SEQ ID NO: 1038 - protein, 510 aa, Arabidopsis thaliana
MAYVGLVEVFIALLVFFFFHFLIHKKSHQITPRNWPVLGMLPGVLVMLHRINDYVAEILEVSNLTFAFKGPWFSGMNMLITADPSNIQHVFSSNFSNYDKGPEFKEMFDFLGNGIFTADSKLWEDMRKSALVVLSHQGFQSFSLRTITCKIKNGLVPVLDHFAEANTVFDLQDVFQRLAFDVTLTLVTGCDSSSLSIEMPKNEYAKAMDDAEEVVVYRHVKPVVLWKLQNWIGLGEEKKMKEANAAFDRSCAKYISAKREEIISHHSNIGGEAHAEDLLSVYMNLDISKYELLNPNDDNFLKDIIKSFMLAGRDAIATTLTWFFWLLSKNPEAVTKIRQEINTNLPGSGMSLDADKLNKMVYLHGALCESLRLYAPIPFERKTPIKQDVLPSGHMVDKNWKILFSVYALGRMRSVWGQDASEFKPERWISERNGGLKHEPSFKFFVFNSGPRNCLGKNLSFLQMKTVAVEIIRNYDIKVVEGHKIEPASSIILHMKHGLKVTVSKRGLVS

SEQ ID NO: 1039 - protein, 178 aa, Arabidopsis thaliana
MPLSLRLSPSPTALSPTTGGFGPSRKQCRIPYSGVPTTKIGFCSLDSRKRGDSSVVRCSLETVNVSVGQVTEVDKDTFWPIVKAAGEKLVVLDMYTQWCGPCKVIAPKYKALSEKYDDVVFLKLDCNPDNRPLAKELGIRVVPTFKILKDNKVVKEVTGAKYDDLVAAIETARSAASG

SEQ ID NO: 1040 - protein, 311 aa, Arabidopsis thaliana
MVMYEEDFVLNSRGMKLFTCVWKPVKQEPKALLFLCHGYAMESSITMNSAATRLANAGFAVYGMDYEGHGKSEGLNGYISNFDDLVDDVSNHYSTICEREENKGKMRFLLGESMGGAVVLLLARKKPDFWDGAVLVAPMCKLADEIKPHPVVISILIKLAKFIPTWKIVPGNDIIDIAIKEPHIRNQVRENKYCYKGRPRLNTAYQLLLVSLDLEKNLHQVSIPFIVLHGEDDKVTDKSISKMLYEVASSSDKTFKLYPKMWHALLYGETNENSEIVFGDIINWLEDRATDSNGGLESQLKHKHDGFLKHK

SEQ ID NO: 1041 - protein, 126 aa, Arabidopsis thaliana
MNRIGLIRGSSSKDVVRRTFAAAASKAKKGGKGGGASDAPKGSSLTKEIKSTTVVGANTLKDGSDPKILPDSDYPDWLWHLLDKRPALSELRRKNVETLPYDDLKRFVKLDTRGKIKENNSIKAKN

SEQ ID NO: 1042 - protein, 303 aa, Arabidopsis thaliana
MVTKTEEIQLNQLENQVENGGGGVWEYLCLVRKLKVRRSEIVLKHGLSILNDSGKRSALGPDEWTLYEQVAIAAMDCQSLGVAQNCIKVLKKKFPESKRVGKLEALLLEAKGMWEEAEKAYTSLLEDNPLDQVIHKRKVAMAKAQGKSSLAIEHLNKYLEVFMADHDAWRELAEIYVSLQMYKQAAFCYEELILTQPTLPLYHLAYADVLYTIGGLENLIAARKYYAATIDLTGGKSTRALLGICLCGSAIAQISKGRNKEDKDMAAPELQSLAATALEREYKQKAPAKLNLLTSALRNLKIA

SEQ ID NO: 1043 - protein, 97 aa, Arabidopsis thaliana
MAINRSLLLILLFISVSLSTARILPGEFVPVIFSGEIPPVSKSAVVGCGGEQETKTEYSSFVPEVVAGKFGSLVLNALPKGSRPGSGPSKKTNDVKT

SEQ ID NO: 1044 - protein, 317 aa, Arabidopsis thaliana
MASETENIKYEESFIKNTRGMKLFTCKWVPAKQEPKALVFICHGYAMECSITMNSTARRLVKAGFAVYGIDYEGHGKSDGLSAYVPNFDHLVDDVSTHYTSICEKEENKGKMRFLLGESMGGAVLLLLHRKKPQFWDGAVLVAPMCKIAEEMKPSPLVISILAKLSGVIPSWKIIPGQDIIETAFKQPEIRKQVRENPYCYKGRPRLKTAYELLRVSTDLEKRLNEVSLPFIVLHGEDDKVTDKAVSRQLYEVASSSDKTFKLYPGMWHGLLYGETPENIETVFADIIGWLDKKVADESGGFESELKRKNDGIPLKG

SEQ ID NO: 1045 - protein, 407 aa, Arabidopsis thaliana
MAETLEPSLVGEIDTSAPFESVREAATRFGGFGFWKPSSLNISEASQNEVGMVLKASELEKELIEKEGETLKVLKSLESTKAIVEELKSKIQNKEDKENCDMNVFKELNQAKMNLCKTTKDLAAIRVSVGLLNKRLEEERAALEKTRERLNSENAAEMSMEIQRLSYEAKEFSRTGENVRYAVNKAVAEIEQTRNKIEAAEMRLIAARKMKEAARAAEAVAIAEIKAVTRRGRRRRRGGNGEETMQEEILETIDETAREIRSSRRTLEEGLAKMEAEEGNWWWTEQRRRSSCSAKFKNPPYMMDVKGLNMMMNGDGTSSSVAVLKPTMSIGQILSRKLLLADESAMMMNGRVSLGQILGKTNFGDREKEKRFNGKRKRFGFANLSVMLNKESKKKNKKKKIALNLSC

SEQ ID NO: 1046 - protein, 209 aa, Arabidopsis thaliana
MGLTPTATLLVAVFAFCLVAVTAQFAYVLWWKRRFRRRSIAGSERDAFSSRGGDLTATPPPSKELLYFFLFCLENKQFRIGSATAPPLPAAAPPVNDVASKWSINGENLLCGPSETLFTIAEDYTSESDHRTGEIDPRGSIFTEDHVKDDEVEEEVVATDISDDEVDFSHYNQTTPFSTPCASPPFYTPSPSPIRDDLSKTVREESVYG

SEQ ID NO: 1047 - protein, 282 aa, Arabidopsis thaliana
MVRKMKLPFLNKNTSSSSFSSNSSSSSSSWPWPSSHQQNLKTISSKASFIVNKPKDVYEPEPPPRSFSSSPSSSSYSSFSSTSHAIENPPEIESIENVIKGLKSSKRLIFERRGTSNSILEEATKRDDHEEEEDGLMLLSLESNDPYTDFKNSMEKMVEVHVLHHDWISLEKLLFWFLKVNVKASHRYIFAAFVDLVLNLAVGPSKDVAGEPNSDVVVEDSLSSSWPVSLYSSSDENSSTSVRFLPETSIGEKGRDVCCLSSLFELEEKIKDNIDPNDYVSS

SEQ ID NO: 1048 - protein, 307 aa, Arabidopsis thaliana
MSVTSTVEENHQKNPSTPAAVEEKKKRRWVFWDRRWRRLDYVKFSASFTVHSLALLAPFYFTWSALWVTFLFYTIGGLGITVSYHRNLAHRSFKVPKWLEYLLAYCALLAIQGDPIDWVSTHRYHHQFTDSERDPHSPKEGFWFSHLLWIYDSAYLVSKCGRRANVEDLKRQWFYRFLQKTVLFHILGLGFFLFYLGGMSFVTWGMGVGAALEVHVTCLINSLCHIWGTRTWKTNDTSRNVWWLSVFSFGESWHNNHHAFESSARQGLEWWQIDISWYIVRFFEIIGLATDVKVPTEAQRRRMAIVR

SEQ ID NO: 1049 - protein, 623 aa, Arabidopsis thaliana
MTSTYTRFDTVFLFSRFAGAKYSPLLPSPSFTLSTSGIHIRTKPNSRFHSIIASSSSSSVVAGTDSIEIKSLPTKPIEGQKTGTSGLRKKVKVFMEDNYLANWIQALFNSLPLEDYKNATLVLGGDGRYFNKEASQIIIKIAAGNGVGQILVGKEGILSTPAVSAVIRKRKANGGFIMSASHNPGGPEYDWGIKFNYSSGQPAPETITDKIYGNTLSISEIKVAEIPDIDLSQVGVTKYGNFSVEVIDPVSDYLELMEDVFDFDLIRGLLSRSDFGFMFDAMHAVTGAYAKPIFVDNLGAKPDSISNGVPLEDFGHGHPDPNLTYAKDLVDVMYRDNGPDFGAASDGDGDRNMVLGNKFFVTPSDSVAIIAANAQEAIPYFRAGPKGLARSMPTSGALDRVAEKLKLPFFEVPTGWKFFGNLMDAGKLSICGEESFGTGSDHIREKDGIWAVLAWLSILAHRNKDTKPGDKLVSVADVVKEYWATYGRNFFSRYDYEECESEGANKMIEYLREILSKSKAGDVYGNYVLQFADDFSYTDPVDGSVASKQGVRFVFTDGSRIIFRLSGTGSAGATVRIYIEQFEPDVSKHDVDAQIALKPLIDLALSVSKLKDFTGREKPTVIT

SEQ ID NO: 1050 - protein, 526 aa, Arabidopsis thaliana
MDSKEMVVEEIMRIHRSLPLRPEIDDVETATSLIQNVEKEDRNRLEAIDKLVKTSSSEVPLELFNVFKEMKKSLVRFQSTEQTREATKILDLESVHVVFDELIQRASFCIASPNSTTALPRSVPVPAPVVSSDEIPFKSKEIISRDDTFVKKAKSSFYSDGLLAPSKPQVLDSTLHQAKNVAGNDGEKLSLIKLASLIEVSAKKATQELNLQHRLMDQLEWLPDSLGKLSSLVRLDLSENCIMVLPATIGGLISLTRLDLHSNRIGQLPESIGDLLNLVNLNLSGNQLSSLPSSFNRLIHLEELDLSSNSLSILPESIGSLVSLKKLDVETNNIEEIPHSISGCSSMEELRADYNRLKALPEAVGKLSTLEILTVRYNNIRQLPTTMSSMANLKELDVSFNELESVPESLCYAKTLVKLNIGNNFANLRSLPGLIGNLEKLEELDMSNNQIRFLPYSFKTLSNLRVLQTEQNPLEELPRDITEKGAQAVVQYMNDLVEARNTKSQRTKPKKSWVNSICFFCKSSTN

SEQ ID NO: 1051 - protein, 457 aa, Arabidopsis thaliana
MDISALFLTLFAGSLFLYFLRCLISQRRFGSSKLPLPPGTMGWPYVGETFQLYSQDPNVFFQSKQKRYGSVFKTHVLGCPCVMISSPEAAKFVLVTKSHLFKPTFPASKERMLGKQAIFFHQGDYHAKLRKLVLRAFMPESIRNMVPDIESIAQDSLRSWEGTMINTYQEMKTYTFNVALLSIFGKDEVLYREDLKRCYYILEKGYNSMPVNLPGTLFHKSMKARKELSQILARILSERRQNGSSHNDLLGSFMGDKEELTDEQIADNIIGVIFAARDTTASVMSWILKYLAENPNVLEAVTEEQMAIRKDKEEGESLTWGDTKKMPLTSRVIQETLRVASILSFTFREAVEDVEYEGYLIPKGWKVLPLFRNIHHSADIFSNPGKFDPSRFEVAPKPNTFMPFGNGTHSCPGNELAKLEMSIMIHHLTTKYRCVCVYYLLITFSFTHFVLFFQIYV

SEQ ID NO: 1052 - protein, 283 aa, Arabidopsis thaliana
MAPAMKIVFGLLTFVTVGMVIGSLLQLAFINRLEDSYGTGFPSLRGLRGQNTRYLRDVSRWANDKDAELLRIGNVKPEVVSWSPRIIVLHDFLSPEECEYLKAIARPRLQVSTVVDVKTGKGVKSDVRTSSGMFLTHVERSYPIIQAIEKRIAVFSQVPAENGELIQVLRYEPQQFYKPHHDYFADTFNLKRGGQRVATMLMYLTDDVEGGETYFPLAGDGDCTCGGKIMKGISVKPTKGDAVLFWSMGLDGQSDPRSIHGGCEVLSGEKWSATKWMRQKATS

SEQ ID NO: 1053 - protein, 374 aa, Saccharomyces cerevisiae
MFANVGFRTLRVSRGPLYGMFIVLFIGVLIAKFAGQMLIDSETNFSHIIGSCSQIISFSKRTFYSSAKSGYQSNNSHGDAYSSGSQSGPFTYKTAVAFQPKDRDDLIYQKLKDSIRSPTGEDNYFVTSNNVHDIFAGVADGVGGWAEHGYDSSAISRELCKKMDEISTALAENSSKETLLTPKKIIGAAYAKIRDEKVVKVGGTTAIVAHFPSNGKLEVANLGDSWCGVFRDSKLVFQTKFQTVGFNAPYQLSIIPEEMLKEAERRGSKYILNTPRDADEYSFQLKKKDIIILATDGVTDNIATDDIELFLKDNAARTNDELQLLSQKFVDNVVSLSKDPNYPSVFAQEISKLTGKNYSGGKEDDITVVVVRVD

SEQ ID NO: 1054 - protein, 367 aa, Saccharomyces cerevisiae
MSISSKIRPTPRKPSRMATDHSFKMKNFYADPFAISSISLAIVSWVIAIGGSISSASTNESFPRFTWWGIVYQFLIICSLMLFYCFDLVDHYRIFITTSIAVAFVYNTNSATNLVYADGPKKAAASAGVILLSIINLIWILYYGGDNASPTNRWIDSFSIKGIRPSPLENSLHRARRRGNRNTTPYQNNVYNDAIRDSGYATQFDGYPQQQPSHTNYVSSTALAGFENTQPNTSEAVNLHLNTLQQRINSASNAKETNDNSNNQTNTNIGNTFDTDFSNGNTETTMGDTLGLYSDIGDDNFIYKAKALYPYDADDDDAYEISFEQNEILQVSDIEGRWWKARRANGETGIIPSNYVQLIDGPEEMHR

SEQ ID NO: 1055 - protein, 126 aa, Saccharomyces cerevisiae
MLMHFIPRRSSKAVQFNWLEIGVWRGGVYVKKGIVNARTNNSNFYKMPVVFGIVKGMGALCVHAWGMGYGGIIDCSPVTEHGNISVLQLEYMPWICLSKIMSCSVASRHSNVWIMDETIAPLVGCL

SEQ ID NO: 1056 - protein, 348 aa, Glycine max
MSCRKRQKTSPDKTSDDFFDSLPDDLVLSILCKLSSTATSPSDFISVLITCKRLNSLGLHSLVLSKASHKTFSVKAKNWCDSLHRFLKHCADAGNIEACYTLGMIRFYCLQNRGSGASLMAKAAMNSHAPALYSLAVIQFNGSGGTKNDKDLRAGVALCARAAFLGHIDALRELGHCLQDGYGVKLNVTEGRRFLVQANARELAAVLSAGNTKRPWLTWSHHPVTHPRLRSGCPLMSDYGCNVPAPDAHPASQFMSEWFDIRGGFPGPDMRLCSHSGCGRPETRRHEFRRCSVCGLVNYCSRACQALDWKFRHKAECATVERWLDDDGEGVAGENDGGGDDGVMMVNS

SEQ ID NO: 1057 - protein, 202 aa, Glycine max
MSNTSNNVAGVDNTFRRKFDREEYLERARERERQEEEGRAKPKAKGPPVQRKPLKHRDYEVDLESRLGKTQVVTPVAPLSQQAGYYCSVCECVVKDSANYLDHINGKKHQRALGMSMRVERASLQQVQERFEVLKKRKDVGSFTEQDLDERILKQQQEEEERKRLRREKKKEKKEKAVEEPEIDPDVAAMMGFGGFRSSNKK

SEQ ID NO: 1058 - protein, 352 aa, Arabidopsis thaliana
MAALLGRSCRKLSFPSLSHGARRVSTETGKPLNLYSAINQALHIALDTDPRSYVFGEDVGFGGVFRCTTGLAERFGKNRVFNTPLCEQGIVGFGIGLAAMGNRAIVEIQFADYIYPAFDQIVNEAAKFRYRSGNQFNCGGLTIRAPYGAVGHGGHYHSQSPEAFFCHVPGIKVVIPRSPREAKGLLLSCIRDPNPVVFFEPKWLYRQAVEEVPEHDYMIPLSEAEVIREGNDITLVGWGAQLTVMEQACLDAEKEGISCELIDLKTLLPWDKETVEASVKKTGRLLISHEAPVTGGFGAEISATILERCFLKLEAPVSRVCGLDTPFPLVFEPFYMPTKNKILDAIKSTVNY

SEQ ID NO: 1059 - protein, 269 aa, Glycine max
MAAEANFDSKSSRWSLQGMTALVTGGSKGIGYAIVEELAQLGATVHTCARNEAELNKSLNEWNTKGYRVTGSVRDVASRAERQDLIARVSNEFNGKLNILVNNVGTNIQKETLDFTEEDFTFLVNTNLESCFHLSQLAHPLLKASEAANIILISSIAGVVASNIVSVVYGATKGAMNQMTKHLACEWAKDNIRTNCVAPGPIRTPLGDKHFKEEKLNNSLIARTPLGRIGEAEEVSSLVAFLCLPAASYITGQTICVDGGFTVNGLYIS

SEQ ID NO: 1060 - protein, 413 aa, Arabidopsis thaliana
MERAAILPSVNQNYLLCPSRAFSTRLHSSTRNLSPPSFASIKLQHSSSSVSSNGGISLTRCNAVSSNSSSTLVTELADIDWDTVGFGLKPADYMYVMKCNIDGEFSKGELQRFGNIEISPSAGVLNYGQGLFEGLKAYRKKDGNNILLFRPEENAKRMRNGAERMCMPAPTVEQFVEAVTETVLANKRWVPPPGKGSLYVRPLLMGTGAVLGLAPAPEYTFIIYVSPVGNYFKEGVAPINLIVENEFHRATPGGTGGVKTIGNYAAVLKAQSIAKAKGYSDVLYLDCIYKRYLEEVSSCNIFIVKDNVISTPEIKGTILPGITRKSMIDVARTQGFQVEERNVTVDELLEADEVFCTGTAVVVSPVGSVTYKGKRVSYGEGTFGTVSKQLYTVLTSLQMGLIEDNMKWTVNLS

SEQ ID NO: 1061 - protein, 222 aa, Arabidopsis thaliana
MNMSRVEQQVIRYPAAKATPVGYLPDPASFNKFRVPASSKKSEQSNVKSILKRKKTDGFTNGVRDQSKIRPKLTETVKRKLSLGARILQVGGLEKIFKRLFRVSEGEKLFKMYQCYLSTTAGPIAGLLFISSKKMAFCSERSIKVDSPQGDIIRVHYKVSIPLCKIDRVNQSQNTKKPSQKYLEVVTVDGFDFWFMGFLSYQKAFNCLEKALSLSFEDNKEQ

SEQ ID NO: 1062 - protein, 424 aa, Arabidopsis thaliana
MAVEYVCCSPNFFIHIAVIVFLVLFAGLMSGLTLGLMSLSLVDLEVLAKSGTPEHRKYAAKILPVVKNQHLLLVTLLICNAAAMETLPIFLDGLVTAWGAILISVTLILLFGEIIPQSICSRYGLAIGATVAPFVRVLVFICLPVAWPISKLLDFLLGHRRAALFRRAELKTLVDFHGNEAGKGGELTHDETTIIAGALELSEKMVKDAMTPISDIFVIDINAKLDRDLMNLILEKGHSRVPVYYEQPTNIIGLVLVKNLLTINPDEEIPVKNVTIRRIPRVPEILPLYDILNEFQKGLSHMAVVVRQCDKIHPLPSKNGSVKEARVDVDSEGTPTPQERMLRTKRSLQKWKSFPNRASSFKGGSKSKKWSKDNDADILQLNGNPLPKLAEEEEAVGIITMEDVIEELLQEEIFDETDHHFEDS

SEQ ID NO: 1063 - protein, 236 aa, Arabidopsis thaliana
MDAVLYSVPLSFTPLRASSSPSSPYLLLPRFLSVQPCHKFTFSRSFPSKSRIPSASSAAGSTLMTNSSSPRSGVYTVGEFMTKKEDLHVVKPTTTVDEALELLVENRITGFPVIDEDWKLVGLVSDYDLLALDSISGSGRTENSMFPEVDSTWKTFNAVQKLLSKTNGKLVGDLMTPAPLVVEEKTNLEDAAKILLETKYRRLPVVDSDGKLVGIITRGNVVRAALQIKRSGDRNA

SEQ ID NO: 1064 - protein, 417 aa, Arabidopsis thaliana
MWKQILSKLPNKKSSKHEHRGREHGGHSSSSSHTSGASTSKSTDNGAAKSHAKNASPAGKSAASDSGFKDGNLKSSGNNNNNNNNGVFTPYEALPSFKDVPNTEKQNLFIKKLNLCRVVFDFTDPTKNIKEKDIKRQTLLELVDYVNSPNGKFSEVGIQEVVRMVSANIFRTLNPQPRENKVIDALDLEEEEPSMDLAWPHLQLVYELFLRFVASPETDTKLAKRYIDQSFVLRLLDLFDSEDPRERDCLKTILHRIYGKFMVHRPFIRKSINNIFYRFVFETEKHNGIAEFLEILGSIINGFALPLKDEHKVFLVRVLIPLHKPKCLQMYHQQLSYCITQFVEKDCKLADTVIRGLLKYWPVTNSSKEVMFLNELEEVLEATQPPEFQRCMVPLFRQIARCLNSLHFQVPVILHSF

SEQ ID NO: 1065 - protein, 544 aa, Arabidopsis thaliana
MDSFSYSSMKSMLIQARGSLNSRLSEFEPLVLLLVPLVSLFLAQIIGSVFGVVHEKGLKACLIGFIMGLLKMIPGVQNYIDAEKQKVVDQLQSGSSSKKKNKTEVLPVKGLGVEVLEKMENEKRNDAIWQGKCSGTVYIGGAESEGHFSLINQACSMFAHTNPLHIDVFQSVVRFESEVVAMTAALLGSKETASGGQICGNMTSGGTESIVLAVKSSRDYMKYKKGITRPEMIIPESGHSAYDKAAQYFKIKLWRVPVDKDFRADVKATRRHINRNTIMIVGSAPGFPHGIIDPIEELGQLALSYGICFHVDLCLGGFVLPFARKLGYQIPPFDFSVQGVTSISVDVHKYGLAPKGTSTVLYRNHEIRKHQFVAVTEWSGGLYVSPTIAGSRPGSLVAGAWAAMMSLGEEGYLQNTSKIMEASKRLEEGVREIHELFVIGKPDMTIVAFGSKALDIFEVNDIMSSKGWHLNALQRPNSIHICITLQHVPVVDDFLRDLREAVETVKANPGPITGGLAPIYGAAGKMPDRGMVNELLVSFMDSQY

SEQ ID NO: 1066 - protein, 473 aa, Arabidopsis thaliana
MVFFRSVSAFTRLRSRVGQQSSLSNSVRWIQMQSSTDLDLKSQLQELIPEQQDRLKKLKSEHGKVQLGNITVDMVIGGMRGMTGLLWETSLLDPEEGIRFRGLSIPECQKVLPTAQSGAEPLPEGLLWLLLTGKVPSKEQVEALSKDLANRAAVPDYVYNAIDALPSTAHPMTQFASGVMALQVQSEFQKAYENGIHKSKFWEPTYEDCLNLIARVPVVAAYVYRRMYKNGDSIPSDKSLDYGANFSHMLGFDDEKVKELMRLYITIHSDHEGGNVSAHTGHLVGSALSDPYLSFAAALNGLAGPLHGLANQEVLLWIKSVVEECGEDISKEQLKEYVWKTLNSGKVIPGYGHGVLRNTDPRYVCQREFALKHLPDDPLFQLVSKLYEVVPPVLTELGKVKNPWPNVDAHSGVLLNHYGLTEARYYTVLFGVSRSLGICSQLIWDRALGLALERPKSVTMDWLEAHCKKASSA

SEQ ID NO: 1067 - protein, 461 aa, Arabidopsis thaliana
MGKKAKWFSSVKKAFSPDSKKSKQKLAEGQNGVISNPPVVDNVRQSSSSPPPALAPREVRVAEVIVERNRDLSPPSTADAVNVTATDVPVVPSSSAPGVVRRATPTRFAGKSNEEAAAILIQTIFRGYLARRALRAMRGLVRLKLLMEGSVVKRQAANTLKCMQTLSRVQSQIRARRIRMSEENQARQKQLLQKHAKELAGLKNGDNWNDSIQSKEKVEANLLSKYEATMRRERALAYSYSHQQNWKNNSKSGNPMFMDPSNPTWGWSWLERWMAGRPLESSEKEQSNSNNDNAASVKGSINRNEAAKSLTRNGSTQPNTPSSARGTPRNKNSFFSPPTPSRLNQSSRKSNDDDSKSTISVLSERNRRHSIAGSSVRDDESLAGSPALPSYMVPTKSARARLKPQSPLGGTTQENEGFTDKASAKKRLSYPTSPALPKPRRFSAPPKVESGGVTVTNGAGS

SEQ ID NO: 1068 - protein, 365 aa, Arabidopsis thaliana
MSALKNYGLISIDSALHFPRSNQLQSYKRRNAKWVSPIAAVVPNFHLPMRSLEDKNRTNTDDIRSLRVITAIKTPYLPDGRFDLQAYDDLVNTQIENGAEGVIVGGTTGEGQLMSWDEHIMLIGHTVNCFGGRIKVIGNTGSNSTREAIHATEQGFAMGMHGALHINPYYGKTSIEGMNAHFQTVLHMGPTIIYNVPGRTCQDIPPQVIFKLSQNPNMAGVKECVGNNRVEEYTEKGIVVWSGNDDQCHDSRWDHGATGVISVTSNLVPGLMRKLMFEGRNSALNAKLLPLMDWLFQEPNPIGVNTALAQLGVARPVFRLPYVPLPLSKRIEFVKLVKEIGREHFVGDRDVQVLDDDDFILIGRY

SEQ ID NO: 1069 - protein, 524 aa, Arabidopsis thaliana
MDLVKPEEISHPPMDQLQGLEYCIDSNPPWGEAIALGFEHYILALGTAVMIPSILVPMMGGDDGDKVRVVQTLLFLQGVNTLLQTLFGTRLPTVIGGSYAFMVPIISIIHDSSLTRIEDPQLRFLSTMRAVQGAIIVASSVQIILGFSQMWAICSRFFSPIGMVPVIALTGFGLFNRGFPVVGNCVEIGLPMLILFVIFSQYLKNFQFRQFPVVERFALIIALIIVWAYAHVLTASGAYKHRPHQTQLNCRTDMSNLISSAPWIKIPYPLQWGAPSFDAGHAFAMMAAVLVSLIESTGAFKAAARLASATPPPPHVLSRGIGWQGIGILLNGLFGTLSGSSVSVENIGLLGSTRVGSRRVIQISAGFMIFFSMLGKFGALFASIPFTIFAAVYCVLFGLVASVGLSFLQFTNMNSLRNLFIVGVSLFLGLSIPEYFRDFSMKALHGPAHTNAGWFNDFLNTIFLSSPMVALMVAVFLDNTLDYKETARDRGLPWWAKFRTFKGDSRNEEFYTLPFNLNRFFPPS

SEQ ID NO: 1070 - protein, 734 aa, Arabidopsis thaliana
MKGATLVALAATIGNFLQGWDNATIAGAMVYINKDLNLPTSVQGLVVAMSLIGATVITTCSGPISDWLGRRPMLILSSVMYFVCGLIMLWSPNVYVLCFARLLNGFGAGLAVTLVPVYISETAPPEIRGQLNTLPQFLGSGGMFLSYCMVFTMSLSDSPSWRAMLGVLSIPSLLYLFLTVFYLPESPRWLVSKGRMDEAKRVLQQLCGREDVTDEMALLVEGLDIGGEKTMGDRLVTLEDHEGDDTLETVDEDGQMRLYGTHENQSYLARPAPEQNSSLGLRSRHGSLANQSMILKDPLVNLFGSLHEKMPEAGGNTRSGIFPHFGSMFSTTADAPHGKPAHWEKDIESHYNKDNDDYATDDGAGDDDDSDNDLRSPLMSRQTTSMDKDMIPHPTSGSTLSMRRHSTLMQGNGESSMGIGGGWHMGYRYENDEYKRYYLKEDGAESRRGSIISIPGGPDGGGSYIHASALVSRSVLGPKSVHGSAMVPPEKIAASGPLWSALLEPGVKRALVVGVGIQILQQFSGINGVLYYTPQILERAGVDILLSSLGLSSISASFLISGLTTLLMLPAIVVAMRLMDVSGRRSLLLWTIPVLIVSLVVLVISELIHISKVVNAALSTGCVVLYFCFFVMGYGPIPNILCSEIFPTRVRGLCIAICAMVFWIGDIIVTYSLPVLLSSIGLVGVFSIYAAVCVISWIFVYMKVPETKGMPLEVITDYFAFGAQAQASAPSKDI

SEQ ID NO: 1071 - protein, 1064 aa, Arabidopsis thaliana
MNSNGHEEEKKLGNGVVGILAETVNKWERRTPLTPSHCARLLHGGKDRTGISRIVVQPSAKRIHHDALYEDVGCEISDDLSDCGLILGIKQPELEMILPERAYAFFSHTHKAQKENMPLLDKILSERVTLCDYELIVGDHGKRLLAFGKYAGRAGLVDFLHGLGQRYLSLGYSTPFLSLGASYMYSSLAAAKAAVISVGEEIASQGLPLGICPLVFVFTGTGNVSLGAQEIFKLLPHTFVEPSKLPELFVKDKGISQNGISTKRVYQVYGCIITSQDMVEHKDPSKSFDKADYYAHPEHYNPVFHEKISPYTSVLVNCMYWEKRFPCLLSTKQLQDLTKKGLPLVGICDITCDIGGSIEFVNRATLIDSPFFRFNPSNNSYYDDMDGDGVLCMAVDILPTEFAKEASQHFGDILSGFVGSLASMTEISDLPAHLKRACISYRGELTSLYEYIPRMRKSNPEEAQDNIIANGVSSQRTFNILVSLSGHLFDKFLINEALDMIEAAGGSFHLAKCELGQSADAESYSELEVGADDKRVLDQIIDSLTRLANPNEDYISPHREANKISLKIGKVQQENEIKEKPEMTKKSGVLILGAGRVCRPAADFLASVRTISSQQWYKTYFGADSEEKTDVHVIVASLYLKDAKETVEGISDVEAVRLDVSDSESLLKYVSQVDVVLSLLPASCHAVVAKTCIELKKHLVTASYVDDETSMLHEKAKSAGITILGEMGLDPGIDHMMAMKMINDAHIKKGKVKSFTSYCGGLPSPAAANNPLAYKFSWNPAGAIRAGQNPAKYKSNGDIIHVDGKNLYDSAARFRVPNLPAFALECFPNRDSLVYGEHYGIESEATTIFRGTLRYEGFSMIMATLSKLGFFDSEANQVLSTGKRITFGALLSNILNKDADNESEPLAGEEEISKRIIKLGHSKETAAKAAKTIVFLGFNEEREVPSLCKSVFDATCYLMEEKLAYSGNEQDMVLLHHEVEVEFLESKRIEKHTATLLEFGDIKNGQTTTAMAKTVGIPAAIGALLLIEDKIKTRGVLRPLEAEVYLPALDILQAYGIKLMEKAE

SEQ ID NO: 1072 - protein, 284 aa, Saccharomyces cerevisiae
MTPSTPPRSRGTRYLAQPSGNTSSSVLMQGQKTPQKPSQNLVPVTPSTTKSFKNAPLLAPPNSNMGMTSPFNGLTSPQRSPFPKSSVKRTLFQFESHDNGTVREEQEPLGRVNRILFPTQQNVDIDAAEEEEEGEVLLPPSRPTSARQLHLSLERDEFDQTHRKKIIKDVPGTPSDKVITFELAKNWNNNSPRNDAKSQESEDEEDIIINPVRVGKNPFASDELVTQEIRNERKRAMLRENPDIEDVITYVNKKGEVVEKRRLTDEEKRRFKPKALFQSRDQEH

SEQ ID NO: 1073 - protein, 435 aa, Saccharomyces cerevisiae
MGENHDHEQSIKRNSMIYNENERQLCNSNLKILQNKRALSKNDSSSKQQVQDSKPRRALTDVPVNNNPLSQNKRIVAGSKAAKVRREENIRSIVSAVQKRQIYNDRTAAEQEEEEEEEGEDDDAASIVNKKRRIDAEGVSEIVGWQDLDYVEKDDTAMVAEYSAEIFAFLYRRELETLPSHNYLLDKTSKYYLRPSMRTILVDWLVEVHEKFQCYPETLFLSINLMDRFLAKNKVTMNKLQLLAVTSLFIAAKFEEVNLPKLAEYAYITDGAASKNDIKNAEMFMLTSLEFNIGWPNPLNFLRRISKAEDYDPVNRNIGKFILEYAYCCHQFIHLPPSTVSAMAMYIARRITNRNKNELWNGTLQHYSGGIDPIHDEAFQSLCIDLVKDIASSKTHLDSLILKYKKPRYGSVYFQTFKWCTSEMHSNFQNLFNLK

SEQ ID NO: 1074 - protein, 603 aa, Saccharomyces cerevisiae
MTGMNDNNAAIPQQTPRKHALSSKVMQLFRSGSRSSRQGKASSNIQPPSNINTNVPSASKSAKFGLHTPTTATPRVVSNPSNTAGVSKPGMYMPEYYQSASPSHSSSSASLNNHIDINTSKSSSAASLTSSVSALSLSPTSAINISSKSLSPKFSHHSNSNTAITPAPTPTASNINNVNKITNTSAPICGRFLVHKDGTHEHHLKNAKRQEKLSTMIKNMVGASKLRGEAKSAVPDIIMDPKTTLKSNKNPPTLFAGFMKQVVDMDDKYPEGAPTSGALNCPERDIYRSDQKDSKNNTHNITTTKKDRQCFAEKYGRCQEVLGKGAFGVVRICQKKNVSSQDGNKSEKLYAVKEFKRRTSESAEKYSKRLTSEFCISSSLHHTNIVTTLDLFQDAKGEYCEVMEYCAGGDLFTLVVAAGKLEYMEADCFFKQLIRGVVYMHEMGVCHRDLKPENLLLTHDGVLKITDFGNSECFKMAWEKNIHLSGGVCGSSPYIAPEEYIKEEFDPRPVDIWACGVIYMAMRTGRQLWSSAEKDDPFYMNYLKGRKEKGGYEPIESLKRARCRNVIYSMLDPVPYRRINGKQILNSEWGREIKCCHNGRALK

SEQ ID NO: 1075 - protein, 285 aa, Saccharomyces cerevisiae
MELSSPSKKTTTSPINIPGGNRDNLIIGPHSHSFKTDPFSSNNSSLLSKISTNPSLESPFSSKSLLDCSPVQAVKKSLESEAKTHSLDEETNEQTDVKILNIADFPTDELILMISALLNRIITANDETTDVSQQVSEETEDELLTPILAFYGKNVPEIAVVQYLERIQKYCPTTNDIFLSLLVYFDRISKNYGHSSERNGCAKQLFVMDSGNIHRLLITGVTICTKFLSDFFYSNSRYAKVGGISLQELNHLELQFLILCDFKLLVSVEEMQKYANLLYKFWNDQ

SEQ ID NO: 1076 - protein, 138 aa, Saccharomyces cerevisiae
MGAWLFILAVVVNCINLFGQVHFTILYADLEADYINPIELCSKVNKLITPEAALHGALSLLFLLNGYWFVFLLNLPVLAYNLNKIYNKVQLLDATEIFRTLGKHKRESFLKLGFHLLMFFFYLYRMIMALIAESGDDF

SEQ ID NO: 1077 - protein, 274 aa, Saccharomyces cerevisiae
MPSLAELTKSLSIAFENGDYAACEKLLPPIKIELIKNNLLIPDLSIQNDIYLNDLMITKRILEVGALASIQTFNFDSFENYFNQLKPYYFSNNHKLSESDKKSKLISLYLLNLLSQNNTTKFHSELQYLDKHIKNLEDDSLLSYPIKLDRWLMEGSYQKAWDLLQSGSQNISEFDSFTDILKSAIRDEIAKNTELSYDFLPLSNIKALLFFNNEKETEKFALERNWPIVNSKVYFNNQSKEKADYEDEMMHEEDQKTNIIEKAMDYAISIENIV

SEQ ID NO: 1078 - protein, 212 aa, Arabidopsis thaliana
MKIRLSITIILLSYTVATVAGQQCGRQGGGRTCPGNICCSQYGYCGTTADYCSPTNNCQSNCWGSGPSGPGESASNVRATYHFYNPAQNNWDLRAVSAYCSTWDADKPYAWRSKYGWTAFCGPAGPRGQASCGKCLRVKNTRTNAAVTVRIVDQCSNGGLDLDVAMFNQIDTDGFGYQQGHLIVDYQFVDCGNELIGQPDSRNMLVSAIDAF

SEQ ID NO: 1079 - protein, 983 aa, Arabidopsis thaliana
MASPHKPWRAEYAKSSRSSCKTCKSVINKENFRLGKLVQSTHFDGIMPMWNHASCILKKTKQIKSVDDVEGIESLRWEDQQKIRKYVESGAGSNTSTSTGTSTSSTANNAKLEYGIEVSQTSRAGCRKCSEKILKGEVRIFSKPEGPGNKGLMWHHAKCFLEMSSSTELESLSGWRSIPDSDQEALLPLVKKALPAAKTETAEARQTNSRAGTKRKNDSVDNEKSKLAKSSFDMSTSGALQPCSKEKEMEAQTKELWDLKDDLKKYVTSAELREMLEVNEQSTRGSELDLRDKCADGMMFGPLALCPMCSGHLSFSGGLYRCHGYISEWSKCSHSTLDPDRIKGKWKIPDETENQFLLKWNKSQKSVKPKRILRPVLSGETSQGQGSKDATDSSRSERLADLKVSIAGNTKERQPWKKRIEEAGAEFHANVKKGTSCLVVCGLTDIRDAEMRKARRMKVAIVREDYLVDCFKKQRKLPFDKYKIEDTSESLVTVKVKGRSAVHEASGLQEHCHILEDGNSIYNTTLSMSDLSTGINSYYILQIIQEDKGSDCYVFRKWGRVGNEKIGGNKVEEMSKSDAVHEFKRLFLEKTGNTWESWEQKTNFQKQPGKFLPLDIDYGVNKQVAKKEPFQTSSNLAPSLIELMKMLFDVETYRSAMMEFEINMSEMPLGKLSKHNIQKGFEALTEIQRLLTESDPQPTMKESLLVDASNRFFTMIPSIHPHIIRDEDDFKSKVKMLEALQDIEIASRIVGFDVDSTESLDDKYKKLHCDISPLPHDSEDYRLIEKYLNTTHAPTHTEWSLELEEVFALEREGEFDKYAPHREKLGNKMLLWHGSRLTNFVGILNQGLRIAPPEAPATGYMFGKGIYFADLVSKSAQYCYTCKKNPVGLMLLSEVALGEIHELTKAKYMDKPPRGKHSTKGLGKKVPQDSEFAKWRGDVTVPCGKPVSSKVKASELMYNEYIVYDTAQVKLQFLLKVRFKHKR

SEQ ID NO: 1080 - protein, 234 aa, Arabidopsis thaliana
MGMAAESQFHVLAVDDSLFDRKLIERLLQKSSCQVTTVDSGSKALEFLGLRQSTDSNDPNAFSKAPVNHQVVEVNLIITDYCMPGMTGYDLLKKVKESSAFRDIPVVIMSSENVPARISRCLEEGAEEFFLKPVRLADLNKLKPHMMKTKLKNQKLEEIETTSKVENGVPTAVADPEIKDSTNIEIEILPLQQDLLLVQQEEQTLSINNKRKSVEEGISTDRARPRFDGIATAV

SEQ ID NO: 1081 - protein, 631 aa, Arabidopsis thaliana
MVEGKGFLVSSVTELHRKEKQKKKGKSGGFESLNLGPNVFNAIKKKGYKVPTPIQRKTMPLILSGVDVVAMARTGSGKTAAFLIPMLEKLKQHVPQGGVRALILSPTRDLAEQTLKFTKELGKFTDLRVSLLVGGDSMEDQFEELTKGPDVIIATPGRLMHLLSEVDDMTLRTVEYVVFDEADSLFGMGFAEQLHQILTQLSENRQTLLFSATLPSALAEFAKAGLREPQLVRLDVENKISPDLKLSFLTVRPEEKYSALLYLVREHISSDQQTLIFVSTKHHVEFVNSLFKLENIEPSVCYGDMDQDARKIHVSRFRARKTMLLIVTDIAARGIDIPLLDNVINWDFPPRPKIFVHRVGRAARAGRTGCAYSFVTPEDMPYMLDLHLFLSKPVRPAPTEDEVLKNMEEVMTKTSQAIDSGVTVYGRFPQKTIDLIFNRTREMIDSSAELDSLERTSTKAFRLYSKTKPSPSKESIRRAKDLPREGLHPIFRSIIETGELEAMSFFQKIKNFRPKQTILEAEGEVAKSKHVKGPAGQWVDVMKKKRAIHEEIINTRHQQNQKTSNNHLEMEAEPTTSFVDGTVEGSKVSGKKRKAQETFKDDEFFISSIPVNHHSEAGLSLRGNEGFGSNR

SEQ ID NO: 1082 - protein, 999 aa, Arabidopsis thaliana
MLYCLILLLCLSSTYLPSLSLNQDATILRQAKLGLSDPAQSLSSWSDNNDVTPCKWLGVSCDATSNVVSVDLSSFMLVGPFPSILCHLPSLHSLSLYNNSINGSLSADDFDTCHNLISLDLSENLLVGSIPKSLPFNLPNLKFLEISGNNLSDTIPSSFGEFRKLESLNLAGNFLSGTIPASLGNVTTLKELKLAYNLFSPSQIPSQLGNLTELQVLWLAGCNLVGPIPPSLSRLTSLVNLDLTFNQLTGSIPSWITQLKTVEQIELFNNSFSGELPESMGNMTTLKRFDASMNKLTGKIPDNLNLLNLESLNLFENMLEGPLPESITRSKTLSELKLFNNRLTGVLPSQLGANSPLQYVDLSYNRFSGEIPANVCGEGKLEYLILIDNSFSGEISNNLGKCKSLTRVRLSNNKLSGQIPHGFWGLPRLSLLELSDNSFTGSIPKTIIGAKNLSNLRISKNRFSGSIPNEIGSLNGIIEISGAENDFSGEIPESLVKLKQLSRLDLSKNQLSGEIPRELRGWKNLNELNLANNHLSGEIPKEVGILPVLNYLDLSSNQFSGEIPLELQNLKLNVLNLSYNHLSGKIPPLYANKIYAHDFIGNPGLCVDLDGLCRKITRSKNIGYVWILLTIFLLAGLVFVVGIVMFIAKCRKLRALKSSTLAASKWRSFHKLHFSEHEIADCLDEKNVIGFGSSGKVYKVELRGGEVVAVKKLNKSVKGGDDEYSSDSLNRDVFAAEVETLGTIRHKSIVRLWCCCSSGDCKLLVYEYMPNGSLADVLHGDRKGGVVLGWPERLRIALDAAEGLSYLHHDCVPPIVHRDVKSSNILLDSDYGAKVADFGIAKVGQMSGSKTPEAMSGIAGSCGYIAPEYVYTLRVNEKSDIYSFGVVLLELVTGKQPTDSELGDKDMAKWVCTALDKCGLEPVIDPKLDLKFKEEISKVIHIGLLCTSPLPLNRPSMRKVVIMLQEVSGAVPCSSPNTSKRSKTGGKLSPYYTEDLNSV

SEQ ID NO: 1083 - protein, 558 aa, Arabidopsis thaliana
MDQNSYRRRSSPIRTTTGGSKSVNFSELLQMKYLSSGTMKLTRTFTTCLIVFSVLVAFSMIFHQHPSDSNRIMGFAEARVLDAGVFPNVTNINSDKLLGGLLASGFDEDSCLSRYQSVHYRKPSPYKPSSYLISKLRNYEKLHKRCGPGTESYKKALKQLDQEHIDGDGECKYVVWISFSGLGNRILSLASVFLYALLTDRVLLVDRGKDMDDLFCEPFLGMSWLLPLDFPMTDQFDGLNQESSRCYGYMVKNQVIDTEGTLSHLYLHLVHDYGDHDKMFFCEGDQTFIGKVPWLIVKTDNYFVPSLWLIPGFDDELNKLFPQKATVFHHLGRYLFHPTNQVWGLVTRYYEAYLSHADEKIGIQVRVFDEDPGPFQHVMDQISSCTQKEKLLPEVDTLVERSRHVNTPKHKAVLVTSLNAGYAENLKSMYWEYPTSTGEIIGVHQPSQEGYQQTEKKMHNGKALAEMYLLSLTDNLVTSAWSTFGYVAQGLGGLKPWILYRPENRTTPDPSCGRAMSMEPCFHSPPFYDCKAKTGIDTGTLVPHVRHCEDISWGLKLV

SEQ ID NO: 1084 - protein, 715 aa, Arabidopsis thaliana
MSLFLSFFISILLCFFNGATTTQFDFSTLAISNLKLLGDARLSNGIVGLTRDLSVPNSGAGKVLYSNPIRFRQPGTHFPTSFSSFFSFSITNVNPSSIGGGLAFVISPDANSIGIAGGSLGLTGPNGSGSKFVAVEFDTLMDVDFKDINSNHVGFDVNGVVSSVSGDLGTVNIDLKSGNTINSWIEYDGLTRVFNVSVSYSNLKPKVPILSFPLDLDRYVNDFMFVGFSGSTQGSTEIHSIEWWSFSSSFGSSLGSGSGSPPPRANLMNPKANSVKSPPPLASQPSSSAIPISSNTQLKTSSSSSCHSRFCKENPGTIAGVVTAGAFFLALFAGALFWVYSKKFKRVERSDSFASEIIKAPKEFSYKELKAGTKNFNESRIIGHGAFGVVYRGILPETGDIVAVKRCSHSSQDKKNEFLSELSIIGSLRHRNLVRLQGWCHEKGEILLVYDLMPNGSLDKALFESRFTLPWDHRKKILLGVASALAYLHRECENQVIHRDVKSSNIMLDESFNAKLGDFGLARQIEHDKSPEATVAAGTMGYLAPEYLLTGRASEKTDVFSYGAVVLEVVSGRRPIEKDLNVQRHNVGVNPNLVEWVWGLYKEGKVSAAADSRLEGKFDEGEMWRVLVVGLACSHPDPAFRPTMRSVVQMLIGEADVPVVPKSRPTMSFSTSHLLLSLQDTLSDCNTVALNSSRSSSWSVPEHNVIIRSDDDHLV

SEQ ID NO: 1085 - protein, 481 aa, Bacillus halodurans
MALQTEQFNANILRNGEWVESRTGERISISAPASGVALGSIPALSQEEVNDAIQGAKDAQKIWKIRPIHERVDLLYAWADLLEERKEIIGELIMHEVAKPKKSAIGEVSRTADIIRHTADEALRLNGETLKGDQFKGGSSKKIALVEREPLGVVLAISPFNYPVNLAAAKIAPALVTGNTVVFKPATQGSLSGIKMVEALADAGAPEGIIQVVTGRGSVIGDHLVEHPGIDMITFTGGTTTGERISEKAKMIPVVLELGGKDPAIVLDDADLKLTASQIVSGAFSYSGQRCTAIKRVFVQDSVADQLVANIKELVEQLTVGSPEDDADITPVIDEKSAAFIQGLIDDALENGATLLSGNKRQGNLLSPTLLDDVTPAMRVAWEEPFGPVLPIIRVKDANEAISLSNQSDYGLQASIFTKDTDRAINIGKHLEVGTVHINAKTERGPDHFPFLGVKKSGLGVQGIKPSLLSMTRERVTVLNL

SEQ ID NO: 1086 - protein, 430 aa, Bacillus halodurans
MAILKEPQRTQVDEIKEITELSLLQSTQSVIKEALDLLGYSEATYELLKEPIRMLTVRIPVRMDDGNVNIFTGYRAQHNDAVGPTKGGVRFHPDVNENEVKALSLWMSLKCGIADLPYGGGKGGIICDPRTMSFGELERLSRGYVRAISQIVGPTKDIPAPDVFTNSQVMAWMMDEYSRIREFDSPGFITGKPIVLGGSLGRESATAKGVIICIEEAAKRNQLDLKGARVIIQGFGNAGSFLAKFLHDAGALIVGISDAYGALYDQAGLDIEYLLDKRDSFGTVTNLFKKTISNQELLISDCDILVPAAISNQITKENAHDIKAKVVVEAANGPTTLEATRILTERGIFLVPDVLASSGGVTVSYFEWVQNNQGYYWNEEEIDQKFRNMIVGSFEKVCTFSNQHQVDMRLAAYTVGVKRMAEASHFRGWV

SEQ ID NO: 1087 - protein, 515 aa, Bacillus halodurans
MVTPYKHEPFTDFSVEENRSAFEAALKNVEGELGKDYPLVINGERVTTDDKIVSVNPAMKEQVIGVVSKASREIVDDAFKSAETAFHTWKNVNPEERANILIRAAAIIRRRKHEFSAWLVKEAGKPWKEADADTAEAIDFLEYYARQMITLKDGKPVNSREGEHNRYFYTPIGVCVTISPWNFALAIMAGTTVAPIVTGNTVLLKPASTTPVVAAKFVEVLEEAGLPKGVVNFVPGSGTDIGDYLIDHPKTSLITFTGSRDVGVRLYERAAVVHPGQQHLKRVIVEMGGKDTVVVDKDADLDLAAQSIVTSAFGFSGQKCSAGSRAVIHQDVYDVVLEKAVALTKQLSVGEPTAPDVYMGPVVDQGAFSKIMSYIEVGKEEGRLMVGGEGDDSKGFFIQPTIFADVDPHARIMQEEIFGPVVAFSKARDFDHALEIANNTEYGLTGAVITTNRHHIEKAKRDFHVGNLYFNRNCTGAIVGYHPFGGFKMSGTDSKAGGPDYLALHMQAKTVSEMY

SEQ ID NO: 1088 - protein, 309 aa, Bacillus subtilis subsp. subtilis str. 168
MVCQHNDELEALVKKAKKVTDKGEVASYIPALAKADKHDLSVAIYYSNNVCLSAGDVEKTFTLQSISKVLSLALVLMEYGKDKVFSYVGQEPTGDPFNSIIKLETVNPSKPLNPMINAGALVVTSLIRGRTVKERLDYLLSFIRRLTNNQEITYCREVAESEYSTSMINRAMCYYMKQYGIFEDDVEAVMDLYTKQCAIEMNSLDLAKIGSVFALNGRHPETGEQVISKDVARICKTFMVTCGMYNASGEFAIKVGIPAKSGVSGGIMGISPYDFGIGIFGPALDEKGNSIAGVKLLEIMSEMYRLSIF

SEQ ID NO: 1089 - protein, 310 aa, Escherichia coli K12
MVDANKLQQAVDQAYTQFHSLNGGQNADYIPFLANVPGQLAAVAIVTCDGNVYSAGDSDYRFALESISKVCTLALALEDVGPQAVQDKIGADPTGLPFNSVIALELHGGKPLSPLVNAGAIATTSLINAENVEQRWQRILHIQQQLAGEQVALSDEVNQSEQTTNFHNRAIAWLLYSAGYLYCDAMEACDVYTRQCSTLLNTIELATLGATLAAGGVNPLTHKRVLQADNVPYILAEMMMEGLYGRSGDWAYRVGLPGKSGVGGGILAVVPGVMGIAAFSPPLDEDGNSVRGQKMVASVAKQLGYNVFKG

SEQ ID NO: 1090 - protein, 439 aa, Nostoc punctiforme PCC 73102
MVSIPINLNLPRIPHLITSLPGPLAQAIVQRDRAVTSPSYTRDYPLVVSRGQGCMVEDVDGNVFLDMTAGIAVTATGHAHPEVVKAIQEQSERLLHMSGTDFYYEPMVELAEQLAIRAPFPQPQGNSAFPAKVFFTNSGAESNEGALKLAKYYTKRSLIVAFLGAFHGRTYGAMSLTGSKAVQRANFGPLVPGVTHIPYGTHASLDYLEQQLFGTILPPQEVAAIVVEPIQGEGGYIVPEDGFLKRIRDICDRHGILMVVDEVQAGMGRTGRLFAIEHWGVMPDIITTAKGIASGLPLGAILAKPELMTWPPGSHATTFGGNPVACAAGIATLRLLESGLMANATQMGELLQASLSELHQRFPRVSPPRGKGLMVAVDLLDEQGNLDRELRDRIIQEAFLRGLLLLGCGKAAIRFCPPLVIDSDQIQIALQIISNILTS

SEQ ID NO: 1091 - protein, 634 aa, Arabidopsis thaliana
MSSSTRKLEVVSPVPADIDIANSVEPLHISEIAKDLNINPLHYDLYGKYKAKVLLSAFDELQGQEDGYYVVVGGITPTPLGEGKSTTTVGLCQALGAYLDKKVVTCLRQPSQGPTFGIKGGAAGGGYSQVIPMDEFNLHLTGDIHAITASNNLLAAAIDTRIFHETSQSDKALFNRLCPPNKEGKRSFSDIMFRRLTKLGISKTSPEELTPEEIKKFARLDIDPASITWRRVMDVNDRFLRKITIGQGPEEKGMTRETGFDISVASEIMAVLALTTSLGDMRERLGKMVIGNSKAGDPITADDLGVGGALTVLMKDAINPTLMQTLEGTPVLVHAGPFANIAHGNSSIVADKIALKLVGPGGFVVTEAGFGSDIGTEKFMNIKCRYSGLTPQCAIVVATVRALKMHGGGPDVVAGRPLDRAYVSENVSLVEAGCVNLAKHISNTKAYGVNVIVAVNMFATDTEAELNAVRKFSMDAGAFDAVVCSHHAHSGKGAVDLGIAVEKACQNITQPLRFLYPLDIGIKDKIEAIAKSYGASGVEYSDQAEKQIEMYTQQGFSNLPICMSKTQYSFSHDASKKGAPSGFVLPIRDVRGSIGAGFIYPLVGTMSTMPGLPTRPCFYEIDIDTETGKVRGLS

SEQ ID NO: 1092 - protein, 445 aa, Sinorhizobium meliloti
MNAHNKPNAPVLDSYWMPFTANRQFKAAPRLLAAAEGMHYTSVDGRTVLDGTAGLWCVNAGHGRRQIAAAVERQLSTMDFAPSFQMGHPIAFDFAERLAEIAPGPAGAKLDRVFFTGSGSESVDTALKMALAYQRSIGQGTRTRLIGRERGYHGVGFGGISVGGIVNNRRVFPQLPGSDHLRHTHDPAKNAFVKGQPEHGAELADDLERLVALHGAETIAACIVEPVAGSTGVLIPPKGYLERLRAICDKHGILLIFDEVITGFGRLGAAFATDYFGVTPDIVTTAKGLTNGAIPMGAVFASRKVHDALMHGPEGQIELFHGYTYSGHPAACAAGIATLDIYRDEGLMTRAAEIEGDWHEAMHSMKGLPHVIDIRTIGLIAGIELQSRDGAPGARAYDVFVDCFERGLLIRVTGDIIAFSPPLIAEKQHFGEIVSILADALKRVK

SEQ ID NO: 1093 - protein, 483 aa, Xenorhabdus nematophila
FITSLYKKAGSCRTMAVEHVLSMIEEHQVKFIDLRFTDTKGKEQHITIPAHQIDEDFFEDGKMFDGSSIGGWKGINESDMVLMPDPTTAMRDPFFNDATLILRCDILEPGTMQGYSRDPRSIAKRAEDFLRASDIADTVLFGPEPEFFLFDDIRFGSSISGSYYHIDDVEAAWNSGTRYEGGNKGHRPGIKGGYFPVPPVDSSQDLRSAMCLTMEKMGLVVEAHHHEVATAGQNEIATRFNTMTKKADETQIYKYVVHNVAHSFGKTATFMPKPLVGDNGSGMHCHMSLSKNGTNLFAGDKYGGLSELALYYIGGVIKHARALNAFTNPTTNSYKRLVPGFEAPVMLAYSARNRSASIRIPVVASAKARRIEVRFPDPAANPYLSFSALLMAGLDGIINKIHPGDAMDKNLYDLPAEEAQEIPTVASSLDDALAALDADREFLTRGGVFTDDAIDAYIKLLHGEIERVRMTPHPLEFELYYSV

SEQ ID NO: 1094 - protein, 174 aa, Nitrosomonas europaea
MSIKSRIRTIPHYPHEGIMFRDITTLLKDPAGLRSTIDGIVQRYQTEKIDKVVGIESRGFIIAAPVAYALSAGFVPVRKQGKLPAETIGCDYQLEYGYDKVEIHVDAIDKGDRVLLIDDLIATGGTMEAAIKLVQEAGGEVIECCFVIDLPDIGGSRRLRQQGHRLFSLCSFED

SEQ ID NO: 1095 - protein, 235 aa, Nostoc punctiforme PCC 73102
MTGTDPVKLMKQEVGKAAAALVKSGSIVGLGTGSTTAYTIQFLGDRLKSGELKDIIGIPTSFQSEVLAKQYGVPLATLDSIDHIDIAIDGADEVDPQKNLIKGGGAAHTREKVVDYLAEQFIVVVDSGKLVDRLGSSFAVPVEVIPMAITPVTNAIKKLGGKPELRMGVKKAGPVITDQGNFVLDVRFDSIEDPVSLEKTLNNIPGVLENGIFVNCVDLVLIGEVKDGQPLVRQL

SEQ ID NO: 1096 - protein, 182 aa, Pseudomonas syringae pv. tomato str. DC3000
MTFDQSNFKSLIRPVVDFPKPGVVFRDITPLFQSPKATRQVIDSFVQRYIDADFSHIGVMDARGFLIGSVVAYQLNKPLVLFRKQGKLPADVLSEAYQTEYGEAYLEVHADSLCEGNSVIMFDDLIATGGTLIAAANLIRRMGAQVHEAAAIIDLPELGGSKRLNDLNIPTFCLTEFALDEQ

SEQ ID NO: 1097 - protein, 142 aa, Xenorhabdus nematophila
MTIERTFSIIKPNAVKKDAIGSIYARFESAGFKIIAAKMLYLTREQAEGFYAEHKGRPFFDGLVEFMTSGPIVVQVLEGENAVQRHRDLMGATNPDNALAGTLRADYADSFTENAVHGSDSIESANREIAYFFSDDEIFPRH

SEQ ID NO: 1098 - protein, 460 aa, Saccharomyces cerevisiae
MMLEGYTVQPPQSTLIGDIEIQDENANQEVKNVLYQGVQKGIKRLEKRQRRVALGDVTSQKANKIHNAIHNKFHQTKNNFEIENIRSSALVKEQQRDVRHEDSDYFLIDSSEGSSTDDEQVNEDAIDDLLSRRVNDQQIQADEVYEDFDGEMQDVIEEDVDSQIEPLSPINNDEIQTELDRAFEKYFRSVPNPLDDDTHDVVMVVEYASDIFYYLRELEVKYRPNPYYMQNQVELTWPFRRTMIDWLVQLHFRFQLLPETLYLTINIVDRFLSKKTVTLNRFQLVGVSALFIAAKFEEINCPTLDDLVYMLENTYTRDDIIRAEQYMIDTLEFEIGWPGPMPFLRRISKADDYDFEPRTLAKYLLETTIVEPKLVAAAPSWLAAGAYFLSRTILGSNDWSLKHVFYSGYTSSQIIPLASLILENCKNASRRHHSIWKKYFDQKHYRCSQIVEEWIVSTEA

SEQ ID NO: 1099 - protein, 532 aa, Saccharomyces cerevisiae
MDRTWLLLTWLLLLCGVVQGNQESINQKYHDVCSGMYSKEDFNGKVDPYISFTLEELSLADEDDDGEGVSVAVFDFQDYEHIGVRLPNGEIQYICDDYALDLGLCEDSSEGQFIIQETAIDPFTSKEHKLTSQILTFTQQELGTNDKVYSINKTGYYCVTTSSFISSSSKFKATVNFRNAYGQLDASEAYKMPIYAFLAVAYAVCTLVYSWLCWKHRHELLPLQRYILVFCIFLTADTIFVWMYYIIENQKGNSSVALHVYMVFISIFSAGKMTFTLLLALLISLGYGIVYPKLDRTLLRRCQIFAIFTFAVCVAFLVQKYSQNSESLSNLILITAIPLVLCLFAFYYLTLSSMNKTMTYLREQNQVVKLNMYRKLIILCYISLFILFLGLLVSTFAYVGMDTVDMIEQYWKTEFLITDTWPSFVYFLVFVIFAFFWRPTSTSYLLACSHQLPTDMENVSEFDLDDINSLSDEALPNREPRNDYQEHDHNMDIDLASDFEEVPSVNANTNANNDVLFDVDYDRDAKNDRSTT

SEQ ID NO: 1100 - protein, 121 aa, Saccharomyces cerevisiae
MSNEVDRMDVDEDESQNIAQSSNQSAPVETKKKRFEIKKWTAVAFWSWDIAVDNCAICRNHIMEPCIECQPKAMTDTDNECVAAWGVCNHAFHLHCINKWIKTRDACPLDNQPWQLARCGR

SEQ ID NO: 1101 - protein, 476 aa, Saccharomyces cerevisiae
MLSILRNSVRLNSRALRVVPSAANTLTSVQASRRLLTSYSSFLQKETKDDKPKSILTDDMLFKAGVDVDEKGQGKNEETSGEGGEDKNEPSSKSEKSRRKRQTSTDIKREKYANWFYIFSLSALTGTAIYMARDWEPQESEELKKDIDNGYTLSLMYKRFKARFNSMFTYFQEPPFPDLLPPPPPPPYQRPLTLVITLEDFLVHSEWSQKHGWRTAKRPGADYFLGYLSQYYEIVLFSSNYMMYSDKIAEKLDPIHAFVSYNLFKEHCVYKDGVHIKDLSKLNRDLSKVIIIDTDPNSYKLQPENAIPMEPWNGEADDKLVRLIPFLEYLATQQTKDVRPILNSFEDKKNLAEEFDHRVKKLKDKFYGDHKSGGNWAMTALGLGNSLGGSTKFPLDLIHEEGQKNYLMFMKMIEEEKEKIRIQQEQMGGQTFTLKDYVEGNLPSPEEQMKIQLEKQKEVDALFEEEKKKKKIAESK

SEQ ID NO: 1102 - protein, 433 aa, Saccharomyces cerevisiae
MQSMNVQPRVLAVGGEQFFSQRQASEQHQQQNMGPQVYSPKVNRARMFPQGMPVNTINGSVNQEMNNAYLLKQKNEPLLTQQQQQQQQQQQPFNIGTPVSVASLPPGLNVLQQQQQQQQQQQQQQQGVGLNRPLASQLPKHLTNQSMPPIFLPPPNYLFVRDVWKSNLYSEFAVIRQLVSQYNHVSISTEFVGTLARPIGTFRSKVDYHYQTMRANVDFLNPIQLGLSLSDANGNKPDNGPSTWQFNFEFDPKKEIMSTESLELLRKSGINFEKHENLGIDVFEFSQLLMDSGLMMDDSVTWITYHAAYDLGFLINILMNDSMPNNKEDFEWWVHQYMPNFYDLNLVYKIIQEFKNPQLQQSSQQQQQQQYSLTTLADELGLPRFSIFTTTGGQSLLMLLSFCQLSKLSMHKFPNGTDFAKYQGVIYGIDGDQ

SEQ ID NO: 1103 - protein, 396 aa, Saccharomyces cerevisiae
MKHSQKYRRYGIYEKTGNPFIKGLQRLLIACLFISGSLSIVVFQICLQVLLPWSKIRFQNGINQSKKAFIVLLCMILNMVAPSSLNVTFETSRPLKNSSNAKPCFRFKDRAIIIANHQMYADWIYLWWLSFVSNLGGNVYIILKKALQYIPLLGFGMRNFKFIFLSRNWQKDEKALTNSLVSMDLNARCKGPLTNYKSCYSKTNESIAAYNLIMFPEGTNLSLKTREKSEAFCQRAHLDHVQLRHLLLPHSKGLKFAVEKLAPSLDAIYDVTIGYSPALRTEYVGTKFTLKKIFLMGVYPEKVDFYIREFRVNEIPLQDDEVFFNWLLGVWKEKDQLLEDYYNTGQFKSNAKNDNQSIVVTTQTTGFQHETLTPRILSYYGFFAFLILVFVMKKNH

SEQ ID NO: 1104 - protein, 509 aa, Saccharomyces cerevisiae
MRNYLVKFLYIFYSMTSLIHYFHRQKKEINTVARTNSKIKWKRKVSSFLNMPSNVRSGVLTLLHTACGAGVLAMPFAFKPFGLMPGLITLTFCGICSLCGLLLQTRIAKYVPKSENASFAKLTQLINPSISVVFDFAIAVKCFGVGVSYLIIVGDLVPQIVQSIFYRNDDNMSGSQEHHMFLDRRLYITLIIVFVISPLCFKRSLNSLRYASMIAIVSVAYLSGLIIYHFVNRHQLERGQVYFMVPHGDSQSHSPLTTLPIFVFAYTCHHNMFSVINEQVDKSFKVIRRIPIFAIVLAYFLYIIIGGTGYMTFGENIVGNILTLYPNSISTTIGRLAMLLLVMLAFPLQCHPCRSSVKNIIIFIENFRKGKLYDNRASFIPLDNFNSEDPQEAPTQQNNEEPNLRSESLRHINIITLCILLFSYLLAISITSLAKVLAIVGATGSTSISFILPGLFGYKLIGSEFTGTNERVPTSIKIFKYLSLSLFIWGIAVMVASLSAIVFLGTSSH

SEQ ID NO: 1105 - protein, 567 aa, Saccharomyces cerevisiae
MNSTPDLISPQKSSENSNADLPSNSSQVMNMPEEKGVQDDFQAEADQVLTNPNTGKGAYVTVSICCVMVAFGGFVFGWDTGTISGFVAQTDFLRRFGMKHKDGSYYLSKVRTGLIVSIFNIGCAIGGIILAKLGDMYGRKMGLIVVVVIYIIGIIIQIASINKWYQYFIGRIISGLGVGGIAVLSPMLISEVAPKEMRGTLVSCYQLMITLGIFLGYCTNFGTKNYSNSVQWRVPLGLCFAWALFMIGGMTFVPESPRYLVEAGQIDEARASLSKVNKVAPDHPFIQQELEVIEASVEEARAAGSASWGELFTGKPAMFKRTMMGIMIQSLQQLTGDNYFFYYGTTVFNAVGMSDSFETSIVFGVVNFFSTCCSLYTVDRFGRRNCLLYGAIGMVCCYVVYASVGVTRLWPNGEGNGSSKGAGNCMIVFACFYIFCFATTWAPIAYVVISETFPLRVKSKAMSIATAANWLWGFLIGFFTPFITGAINFYYGYVFMGCMVFAYFYVFFFVPETKGLTLEEVNDMYAEGVLPWKSASWVPTSQRGANYDADALMHDDQPFYKKMFGKK

SEQ ID NO: 1106 - protein, 569 aa, Saccharomyces cerevisiae
MTDRKTNLPEEPIFEEAEDDGCPSIENSSHLSVPTVEENKDFSEYNGEEAEEVVVPEKPASAYATVSIMCLCMAFGGFMSGWDTGTISGFVNQTDFLRRFGNYSHSKNTYYLSNVRTGLIVSIFNVGSAIGCLFLSKLGDIYGRCMGLIIVIVVYMVGIVIQIASIDKWYQYFIGRIIAGIGAGSISVLAPMLISETAPKHIRGTLLACWQLMVTFAIFLGYCTNYGTKTYSNSVQWRVPLGLCFAWAIIMIGGMTFVPESPRFLVQVGKIEQAKASFAKSNKLSVDDPAVVAEIDLLVAGVEAEEAMGTASWKELFSRKTKVFQRLTMTVMINSLQQLTGDNYFFYYGTTIFKSVGMNDSFETSIVLGIVNFASCFFSLYSVDKLGRRRCLLLGAATMTACMVIYASVGVTRLYPNGKSEPSSKGAGNCTIVFTCFYIFCFSCTWGPVCYVIISETFPLRVRSKCMSVATAANLLWGFLIGFFTPFITSAINFYYGYVFMGCLAFSYFYVFFFVPETKGLTLEEVDEMWMDGVLPWKSESWVPASRRDGDYDNEKLQHDEKPFYKRMF

SEQ ID NO: 1107 - protein, 604 aa, Saccharomyces cerevisiae
MSDPIVTSSKMEKSAEFEVTDSALYNNFNTSTTASLTPEIKEHSEESRNGLVHRFVDSFRRAESQRLEEDNDLEDGTKSMKSNNHLKKSMKSRHVVMMSLGTGIGTGLLVANAKGLSLAGPGSLVIGYVMVSFVTYFMVQAAGEMGVTYPTLPGNFNAYNSIFISKSFGFATTWLFCIQWLTVLPLELITSSMTVKYWNDTINADVFIVIFYVFLLFIHFFGVKAYGETEFIFNSCKILMVAGFIILSVVINCGGAGVDGYIGGKYWRDPGSFAEGSGATRFKGICYILVSAYFSFGGIELFVLSINEQSNPRKSTPVAAKRSVYRILIIYLLTMILIGFNVPHNNDQLMGSGGSATHASPYVLAASIHKVRVIPHIINAVILISVISVANSALYAAPRLMCSLAQQGYAPKFLNYIDREGRPLRALVVCSLVGVVGFVACSPQEEQAFTWLAAIAGLSELFTWSGIMLSHIRFRKAMKVQGRSLDEVGYKANTGIWGSYYGVFFNMLVFMAQFWVALSPIGNGGKCDAQAFFESYLAAPLWIFMYVGYMVYKRDFTFLNPLDKIDLDFHRRVYDPEIMRQEDEENKERLKNSSIFVRVYKFWC

SEQ ID NO: 1108 - protein, 533 aa, Arabidopsis thaliana
MQNPSTVTQESAAPVFDFFPRLRGLTSRNRSPCSNSDGYALSSSNALYFNGFRTLPSRRMGKTLASLSFNTKSSAGSSLRRFISDFNSFIRFHCDKVVPESFASVGGVGLSSDENGIRENGTGGVLGEEGLPLNGVEADRPKKVLILMSDTGGGHRASAEAIRAAFNQEFGDEYQVFITDLWTDHTPWPFNQLPRSYNFLVKHGTLWKMTYYGTSPRIVHQSNFAATSTFIAREIAQGLMKYQPDIIISVHPLMQHVPLRVLRSKGLLKKIVFTTVITDLSTCHPTWFHKLVTRCYCPSTEVAKRAQKAGLETSQIKVYGLPVRPSFVKPVRPKVELRRELGMDENLPAVLLMGGGEGMGPIEATARALADALYDKNLGEAVGQVLIICGRNKKLQSKLSSLDWKIPVQVKGFITKMEECMGACDCIITKAGPGTIAEAMIRGLPIILNGYIAGQEAGNVPYVVENGCGKFSKSPKEISKIVADWFGPASKELEIMSQNALRLAKPEAVFKIVHDMHELVRKKNSLPQLSCTA

SEQ ID NO: 1109 - protein, 558 aa, Saccharomyces cerevisiae
MAVLNLKRETVDIEETAKKDIKPYFASNVEAVDIDEDPDVSRYDPQTGVKRALKNRHISLLALGGVIGPGCLVGAGNALNKGGPLALLLGFSIIGIIAFSVMESIGEMITLYPSGGGFTTLARRFHSDALPAVCGYAYVVVFFAVLANEYNTLSSILQFWGPQVPLYGYILIFWFAFEIFQLVGVGLFGETEYWLAWLKIVGLVAYYIFSIVYISGDIRNRPAFGFHYWNSPGALSHGFKGIAIVFVFCSTFYSGTESVALAATESKNPGKAVPLAVRQTLWRILVVYIGIAVFYGATVPFDDPNLSASTKVLKSPIAIAISRAGWAGGAHLVNAFILITCISAINGSLYIGSRTLTHLAHEGLAPKILAWTDRRGVPIPAITVFNALGLISLMNVSVGAANAYSYIVNLSGVGVFIVWGVISYTHLRIRKAWVAQGRSIEELPYEALFYPWTPVLSLAANIFLALIQGWSYFVPFDAGNFVDAYILLPVGILLYIGICVFKSNHFRTVDLRSINLDEGRRKDMEADLSDQESSLASSETMKDYKSATFFRYLSNIFT

SEQ ID NO: 1110 - protein, 489 aa, Arabidopsis thaliana
MANVVGQLKRGISRQFSTGSLRRTLSRQFTRQASHDPRRNNMRFSFGRQSSLDPIRRSPDGSNGPQLAVPDNLDATMQLLFVACRGDVEGVQDLLDEGIDVNSIDLDGRTALHIAACEGHVDVVKLLLTRKANIDARDRWGSTAAADAKYYGNMDVFNILKARGAKVPKTKRTPMVVANPREVPEYELNPQELQGIYQVAKWNGTKVSVKILDKDLYKDSDTINAFKHELTLFEKVRHPNVVQFVGAVTQNVPMMIVSEYHPKGDLGSYLQKKGRLSPAKVLRFALDIARHVTFLARLGMNYLHECKPEPVIHCDLKPKNIMLDSGGHLKVAGFGLISFAKLSSDKSKILNHGAHIDPSNYCMAPEVYKDEIFDRSVDSYSFGVVLYEVVPYGFIRFGVILYPMIEGVQPFHPKPPEEAVKLMCLEGRRPSFKAKSKSCPQEMRELIEECWDTETFVRPTFSEIIVRLDKIFVHCSKQGWWKDTFKFPW

SEQ ID NO: 1111 - protein, 662 aa, Arabidopsis thaliana
MGCVNSKQTVSVTPAIDHSGVFRDNVCSGSGRIVVEDLPPVTETKLLSWWSKSGKKSSSKKSGSELGSDFGELSESGRASSNCRSESVSFRLGNLSKYLEAEQVAAGWPAWLSNVAGEAIHGWVPFRSDAFEKLEKIGQGTYSSVFRARETETGRIVALKKVRFDNFEPESVRFMAREILILRKLNHPNIIKLEGIVTSKLSCSIHLVFEYMEHDLTGLLSSPDIDFTTPQIKCYMKQLLSGLDHCHARGVMHRDIKGSNLLVNNEGILKVADFGLANFCNASGNKQPLTSRVVTLWYRPPELLLGATEYGASVDLWSVGCVFAELLIGKPVLQGRTEVEQLHKIFKLCGSPPEDYWKKSKLPHAMLFKPQQHYDGCLRETLKLKGLSDADINLIETLLSIQPHKRGTASTALVSQYFTSKPFACDPSSLPVYSPSKEIDAKHREDTTRKKISGNGRRGTESRKPTRKPPAFAKLAPAEDVRHHSQKFQKRNGHSVHNSIDSDSTLFEKMQKPSNHEKDEASHVKNASQGDVPFSGPLQVSVSSGFAWAKRRKDDICVRSHNRSLSRGHIPNLLGPSPAFSENTDVDSKNNEKEKEEKHGERTDSQDREAYEMLKLSMLKKWRQLERPDSFGGSDEYHSQELSLELYQREEKAAKLGHLVRL

SEQ ID NO: 1112 - protein, 315 aa, Arabidopsis thaliana
MRIDLSVPKVGAELELNKVLGKGSSGSVSLIKYKSRLDGQTLYAAVKTSNIIHADSLLKEFQILSEFKGCSRIVQCYGTKVQETINEEGDVEFTIPMEYASGGSLRHFMSRFKDMKLPDALIRRFTRMILEGLAVIHGHGYVHCDLKPENILVFPSFELKISDFGLSKREGDSKWWLPSHPFAGTPVYMSPESISNGETRRGLDLWSLGCVVLEMYTGKRPWWDKNYDLGDLKKGSMPLISKDIPCDAKLFVMTCFASETNKRKNAFTLLRHCFLRGDVNKIIEPLVKSKNSNDIALELENIEHRLSQLRCISGG

SEQ ID NO: 1113 - protein, 426 aa, Arabidopsis thaliana
LVSSKAMKCFYFSKDKTQDDEAKTRKFGSATMARGGSGSEFNSDTSTATSITSSLHVLSETHSNNLKVFVLDDLKTATKNFSRSLMIGEGGFGGVFRGVIQNPQDSRKKIDIAVKQLSRRGLQGHKEWVTEVNVLGVVEHPNLVKLIGYCAEDDERGIQRLLVYEYVQNRSVQDHLSNRFIVTPLPWSTRLKIAQDTARGLAYLHQGMEFQIIFRDFKSSNILLDENWNAKLSDFGLARMGPSDGITHVSTAVVGTIGYAAPEYIQTGHLTAKSDVWSYGIFLYELITGRRPFDRNRPRNEQNILEWIRPHLSDIKKFKMIIDPRLEGNYYLKSALKLAAVANRCLMVKAKARPTMSQVSEMLERIVETSSDGAPSGLPLMKSLTPKDAFEASRRERVKRRFVELLIGENGCPNLPTWSHKLVTSI

SEQ ID NO: 1114 - protein, 440 aa, Arabidopsis thaliana
LSAGSMFSSSARSSGSDSLMSSMATCALSVKTFTLSELEKATDRFSAKRVLGEGGFGRVYQGSMEDGTEVAVKLLTRDNQNRDREFIAEVEMLSRLHHRNLVKLIGICIEGRTRCLIYELVHNGSVESHLHEGTLDWDARLKIALGAARGLAYLHEDSNPRVIHRDFKASNVLLEDDFTPKVSDFGLAREATEGSQHISTRVMGTFGYVAPEYAMTGHLLVKSDVYSYGVVLLELLTGRRPVDMSQPSGEENLVTWARPLLANREGLEQLVDPALAGTYNFDDMAKVAAIASMCVHQEVSHRPFMGEVVQALKLIYNDADETCGDYCSQKDSSVPDSADFKGDLAPSDSSWWNLTPRLRYGQASSFITMDYSSGPLEDMENRPHSASSIPRVGGLILPNRSGPLRPMRSRRNFFRLRGSMSEHGGPSSSRHLWSGNGDWL

SEQ ID NO: 1115 - protein, 217 aa, Arabidopsis thaliana
MAISTLTLTQSLYTRSFRPTIFFSSSSSSSFSCLCSSSSDCEPKLSVKKRVFGVGLGFLASSILSLTPLDADATRIDYYATVGDPLCEYSYAKSGLGFCDLDVGFGDEAPRGVLVNIHYTARFADGTLFDSSYKRARPLTMRIGVGKVIRGLDQGILGGEGVPPMRVGGKRKLQIPPKLAYGPEPAGCFSGDCNIPGNATLLYDINFVEIYPGSNTR

SEQ ID NO: 1116 - protein, 396 aa, Arabidopsis thaliana
MGWLWRKKKKNKKLELERGAKLLEELIECCDGKSNPIKFFSADEIRKATNIFSHSNLVHQEEFYCQWYSGKNENHPMILIRKDSNVRGGDLVCRNIAVSSMVSGHKNFMKLVGCCLELKYPVTVYHGVKKHYGLEIDEKPWKRRMKIAEDIATALAYLHTAFPRPLVYMILSHRNILLDEDGVAKLTDFSHCVSIPEGETFVRVEAEDGFYSYFADNYVNSVVVSEKTDVFAFGIFMGLTLLLGYKSYFEHYRGEEKESEEEDPEDTDELDYFNKKRHARYWLSKLKKDRPMEEIADRKMIKNMGQILEQELFQMKAFRMLSLRCMGPSEEVPTMVEVAKELKKIQKSLNKDSYRGEEEEEESEDEFNDSSSLSSGQTQFDSAQDISSTVVLSNQT

SEQ ID NO: 1117 - protein, 328 aa, Arabidopsis thaliana
MGGCCFSTPLDNNQQPPQQPQIPPGERKNDGFVNWPVTEFFLSDITTATNNFSSDEIISENAEESSNVVYKGCLLENLGFVAVKRFKNTPWDDPDYFTEDAKTAGELKHKRLVKLLGYCCEEDEGLLVAEFMPNDTLAKRLFQEKNMEWSMRLRVAYHIVEALDYCNSVRFDEYDNLSAYTVLFDKDGDACLSSFGLVKEIIRYNRREGGNVRTGNVTYRFGTILVNLLTGLQISPSHAPEMINGKDVTELMDPNLKGKFSTEEATIVLKLASECLQWKGYIENGITKKLVATLKALQAKKEISSSEMHEVTKQHDVASSSSQQQLPP

SEQ ID NO: 1118 - protein, 353 aa, Arabidopsis thaliana
MANICIATTATNNQVILRDYVSGFPKQSDLYIATTTIDLRVPPGSMAVLVKNLYLSCDPHSRTRMGKPDPSSQASMAHAFTIGKPISGFGVAKAIDSGHPNYKTGDLLWGRVGWEEYSVITPTPSSHFKIHHTDVPLSFYTGLLGIPGLTAYVGFYEICSPKKGETVFVSAASGAVGQLVGQFAKMAGCYVVGSASSKEKVDLLKTKFGYDDAFNYKEEKDLSAALKRCFPEGIDIYFENVGGKMLDAVLQNMRTHGRIAACGMISQYNLKEPEGLHNTATIVHKRIRVQDFAAVEFFDRYSKFLDFILPHVREGKITYVEDIAQGLENGPSALIGLFHGKNVGKQLVEVARE

SEQ ID NO: 1119 - protein, 401 aa, Arabidopsis thaliana
LISTRSLQTGASGDDSQSMGGYHVSPGGFMRGAVYREPNKPLTIEEFHIPRPKSNEILIKTKACGVCHSDLHVMKGEIPFASPCVIGHEITGEVVEHGPLTDHKIINRFPIGSRVVGAFIMPCGTCSYCAKGHDDLCEDFFAYNRAKGTLYDGETRLFLRHDDSPVYMYSMGGMAEYCVTPAHGLAPLPESLPYSESAILGCAVFTAYGAMAHAAEIRPGDSIAVIGIGGVGSSCLQIARAFGASDIIAVDVQDDKLQKAKTLGATHIVNAAKEDAVERIREITGGMGVDVAVEALGKPQTFMQCTLSVKDGGKAVMIGLSQAGSVGEIDINRLVRRKIKVIGSYGGRARQDLPKVVKLAESGIFNLTNAVSSKYKFEDAGKAFQDLNEGKIVSRGVVEIL

SEQ ID NO: 1120 - protein, 547 aa, Arabidopsis thaliana
MRALNSRLVLIDINSSWQASRRLISATATAFSSDSSSSFRRTRGARQRIASSKSPASSPSPVRRPSDGFSFDVRSPSSDSSISSRKSPTTAPPTVELDAFLEILPPATRKELVKHEAIEELIEVVMDLGRKPLARFPSGDWVISEQPVTHQDLELAVSKVGDFSDDNRSGIDRSLHRISAIRNRKLQVIGLTCRVGRVVSGSAEIIRDLIEGGGSILVIGSPGVGKTTLIREIARMLADEHRKRVVIVDTSNEIGGDGDVPHSGIGRARRMQVPNVNLQHDVMIEAVENHMPETIIIDEIGTELEALAASTIAQRGVQLVATAHGMTIDNIIKNPSLQILIGGIESVTLGDEEARKRKVQKTILERKGPPTFTCAVEMISRTECRVHQRLDVTVDAILAGKSAPFEIRQIRGEDDVPHKLVTPIPLENLEEEPAPLLNRDFVSELLSDDEDEDFLLIRSNKARSNTYTSPRSSPVHVYTYNVLEADLLQVAEVMGLDDEIEVTDDVGEADVILASSSELKQNSSIRRVAKLHKLPIFVIKVSFFLHG

SEQ ID NO: 1121 - protein, 666 aa, Arabidopsis thaliana
MLSLSLSNHVPPLTLLSHERRILKLQSRSSILFHQLFHTKFLLLSNSSSLSSSHGVVAISASPSSVAVPELEDEDHFDDELRRLLALVPEEIRQTLKEHPEISELIEIVLDLGRKPLARFPSGDFVISDDAVRVKDLEFAVSQVGEFTNDNRAGISRTLHRISAIRNRKGEIIGLTCRVGRSVRGSANLLRDLVQDGNSLLLIGPPGVGKTTMIREVARMLGNDYEKRVMIVDTSNEIGGDGDIPHPGIGNARRMQVPNSDIQHKVLIEAVENHMPQVIVIDEIGTKLEAIAASTIAERGIQLVATAHGATIENLIKNPSLDLLVGGVQSVTLGDEEATRRGGQKTVLERKGPSTFNCGAEIVSKTEVRVHRSLEATVDAILAGRLPNVEIRKIKSHGVEVIMEKEPFIDEKTVDKKHEEETLDVSKLTKEETVSEVLQTKEITEAESSEKDTLMYLYVYGIAESTVLQAIKQLEMETAVELTDDISEAEALLALQAKIRKNPRIKSFATSHGIPVYVTKTNSGIQVAKAIRALLTDYEDGLGEFGSEDRLKLSEKMDALEEARLAIERIVIPKKETTDLLPRPPRIVSLQGKLVRKYNLRSERKWRGDEMYLRILPYSTEEDRDDREDEGEFGEANGEELDELGFATGESNDSPSGIDRLPLLPD

SEQ ID NO: 1122 - protein, 639 aa, Arabidopsis thaliana
MARKMSLEAFVSTMAPLIDMEKEAEISMSLTSGASRNIETAQKKGTTILNLKCVDVQTGLMGKSLIEFQSNKGDVLPAHKFGNHDVVVLKLNKSDLGSSPLAQGVVYRLKDSSITVVFDEVPEEGLNTSLRLEKLANEVTYRRMKDTLIQLSKGVLRGPASDLVPVLFGERQPSVSKKDVKSFTPFNKNLDQSQKDAITKALSSKDVFLLHGPPGTGKTTTVVEIVLQEVKRGSKILACAASNIAVDNIVERLVPHKVKLVRVGHPARLLPQVLDSALDAQVLKGDNSGLANDIRKEMKALNGKLLKAKDKNTRRLIQKELRTLGKEERKRQQLAVSDVIKNADVILTTLTGALTRKLDNRTFDLVIIDEGAQALEVACWIALLKGSRCILAGDHLQLPPTIQSAEAERKGLGRTLFERLADLYGDEIKSMLTVQYRMHELIMNWSSKELYDNKITAHSSVASHMLFDLENVTKSSSTEATLLLVDTAGCDMEEKKDEEESTYNEGEAEVAMAHAKRLMESGVQPSDIGIITPYAAQVMLLRILRGKEEKLKDMEISTVDGFQGREKEAIIISMVRSNSKKEVGFLKDQRRMNVAVTRSRRQCCIVCDTETVSSDAFLKRMIEYFEEHGEYLSASEYTN

SEQ ID NO: 1123 - protein, 507 aa, Arabidopsis thaliana
MGSSFETIDIATSARRIGVDNRISLKFYFRIADNILKQANIFRAEKNVIDLYVMLLRFSSLALETIPSHRDYRTSLKSNKEYLRMRLLDVLTELEKLKPVVQQRIDELYPKLKPRYNVQAHPANGSLGWSSAVKPSFNSYDHAKVRNPPGHNSGYMGSRGQQFLNAAPLEERFRKMSVNFRPNEETLSKHSILGPGGLSAQWQPPKYDTKVQYPSNIDFSPVVIPSFQQLVDSKPMITNGSNDEPEKPIVEPSVASNEKIQKNYTEELSSMISFEEPESVNENNLIRQPSPPPVLAEVQDLVPALCPEVREPECMIENSLPDESLRSESPLELHIATSMMDTFMRLAKSNTKKNLETCGILAGSLKNRKFYITALIIPKQESTSDSCQATNEEEIFEVQDKQSLFPLGWIHTHPTQSCFMSSIDVHTHYSYQIMLPEAVAIVMAPQDSSRNHGIFRLTTPGGMTVIRNCDRRGFHAHSSPEDGGPIYNTCKEVYMNPNLKFDVIDLR

SEQ ID NO: 1124 - protein, 441 aa, Arabidopsis thaliana
MAEEKSYKYVIIGGGVAGGYAAREFSNQGLKPGELAIISKEPVPPFERPELTKVYIDLEVNPTLANIYVCAGTGEAKQYPNWYKEKGIDLIVGTEIVKADLASKTLVSDDGKIYKYQTLLIATGSTNIRLSEIGVQEADVKNIFYLREIEDSDELALAMELYVQRGKAVIIGGGFLGLEISSALRANNHEVTMVFPEPWLVHRFFTAEIASFYESYYANKGIKIIKGTVATGFSTNSDGEVTEVKLEDGRTLEANIVVAGVGARPATSLFKGQLEEEKGGIKTDGFFKTSVPDVYALGDVATFPMKMYGGTRRVEHADNARKSAAQAVKAIKAGEEGKTIPDYDYLPYFYSRFFKLSWEFYGENVGESVLFGDNDPKSPKPKFGTYWVKDGKVVGVFLEGGTQEEHKAIAKVARAQPSVESLDVLSEEGLSFATKFYSTSL

SEQ ID NO: 1125 - protein, 435 aa, Arabidopsis thaliana
MAEEKSFKYVIVGGGVAAGYAAREFFNQGVKPGELAIISREQVPPYERPALSKGYIHLENKATLPNFYVAAGIGGERQFPQWYKEKGIELILGTEIVKADLAAKTLVSGTGQVFKYQTLLAATGSSVIRLSDFGVPGADAKNIFYLRELEDADYLAYAMETKEKGKAVVVGGGYIGLELGAALKANNLDVTMVYPEPWCMPRLFTAGIASFYEGYYANKGINIVKGTVASGFTTNSNGEVTEVKLKDGRTLEADIVIVGVGGRPIISLFKDQVEEEKGGLKTDGFFKTSLPDVYAIGDVATFPMKLYNEMRRVEHVDHARKSAEQAVKAIKAAEEGNSIPEYDYLPYFYSRAFDLSWQFYGDNVGESVLFGDNDPESPKPKFGSYWIKERKVVGAFLEGGSPEENNAIAKLARAQPSVESLEVLSKEGLSFATNI

SEQ ID NO: 1126 - protein, 471 aa, Arabidopsis thaliana
MTIKPKSPARFKLGRQSSLAPESRTPIDTLTEDEDDDLAAAATAGIGDPTIRLMYLANEGDIDGINKMLDSGTNVDYRDIDARTALHVAACQGRTDVVELLLSRGAKVDTKDRWGSTPLADAVYYKNHDVIKLLEKHGAKPTIAPMHVLTDKEVPEYEIHPTELDFSNSVKISKGTFNKASWRGIDVAVKTFGEEMFTDEDKVNAFRDELALLQKIRHPNVVQFLGAVTQSTPMMIVTEYLPKGDLRQYLDRKGPLMPAHAVKFALEIARGMNYLHEHKPEAIIHCDLEPPNILRDDSGHLKVADFGVSKLLVVKKTVKKDRPVVTCLDSSWRYMAPEVYRNEEYDTKVDVFSFALILQEMIEGCEPFHEIEDREVPKAYIEDERPPFNAPTKSYPFGLQELIQDCWDKEASKRPTFRVIISTLELISDRIARKRSWKVMLGRCLPRFRLFTKRDYVNPGGSNRSSGSFNR

SEQ ID NO: 1127 - protein, 532 aa, Arabidopsis thaliana
MAATGSGRSQFISSSGGNRSFSNSPLIENSDSNQIIVSEKKSWKNFFAYLGPGFLVSIAYIDPGNFETDLQAGAHYKYELLWIILVASCAALVIQSLAANLGVVTGKHLAEQCRAEYSKVPNFMLWVVAEIAVVACDIPEVIGTAFALNMLFSIPVWIGVLLTGLSTLILLALQKYGVRKLEFLIAFLVFTIAICFFVELHYSKPDPGEVLHGLFVPQLKGNGATGLAISLLGAMVMPHNLFLHSALVLSRKIPRSASGIKEACRFYLIESGLALMVAFLINVSVISVSGAVCNAPNLSPEDRANCEDLDLNKASFLLRNVVGKWSSKLFAIALLASGQSSTITGTYAGQYVMQGFLDLRLEPWLRNLLTRCLAIIPSLIVALIGGSAGAGKLIIIASMILSFELPFALVPLLKFTSCKTKMGSHVNPMAITALTWVIGGLIMGINIYYLVSSFIKLLIHSHMKLILVVFCGILGFAGIALYLAAIAYLVFRKNRVATSLLISRDSQNVETLPRQDIVNMQLPCRVSTSDVD

SEQ ID NO: 1128 - protein, 376 aa, Arabidopsis thaliana
MAKEIESATDLGDTNIKGVLVHGGRYFQYNVYGNLFEVSNKYVPPIRPIGRGAYGFVCAAVDSETHEEIAIKKIGKAFDNKVDAKRTLREIKLLRHLEHENVVVIKDIIRPPKKEDFVDVYIVFELMDTDLHQIIRSNQSLNDDHCQYFLYQILRGLKYIHSANVLHRDLKPSNLLLNSNCDLKITDFGLARTTSETEYMTEYVVTRWYRAPELLLNSSEYTSAIDVWSVGCIFAEIMTREPLFPGKDYVHQLKLITELIGSPDGASLEFLRSANARKYVKELPKFPRQNFSARFPSMNSTAIDLLEKMLVFDPVKRITVEEALCYPYLSALHDLNDEPVCSNHFSFHFEDPSSTEEEIKELVWLESVKFNPLPSI

SEQ ID NO: 1129 - protein, 479 aa, Arabidopsis thaliana
MTFREKMPTSPKSPLRRRRSSWTGTWLNHQTTSFKQAVSAVIQAQSPRSRFKSLSSDFSDVDRTLSLSDSLLLKILEKLPESQNEDVSLVCKRWLSVQGRRLRSMKVFDWEFLLSGRLVSRFPKLTSVDLVNACFNPSSNSGILLCHTSISFHVSTDSSLNLNFVEESLLDNEMVDKGLRVLGRGSFDLIKLVVINATELGLLSLAEDCSDLQELELHKCSDNLLRGIAACENLRGLRLVGSVDGLYSSSVSDIGLTILAQGCKRLVKLELSGCEGSFDGIKAIGQCCEVLEELSICDHRMDDGWIAALSYFESLKTLLISSCRKIDSSPGPGKLLGSCPALESLQLRRCCLNDKEGMRALFKVCDGVTKVNIQDCWGLDDDSFSLAKAFRRVRFLSLEGCSILTTSGLESVILHWEELESMRVVSCKNIKDSEISAALSSLFSLLKELTWRPDTRSHLSSSLEGTGIGKRGSKFFKKR

SEQ ID NO: 1130 - protein, 282 aa, Arabidopsis thaliana
MYRFSNTVIGVLNLLTLLASIPIIGTALYKARSSTTCENFLQTPLLVIGFIILIVSLAGFIGACFNVAWALWVYLVVMIFLIATLMGLTLFGLVVTSQGGGVEVPGRIYKEYRLGDYHPWLRERVRDPEYWNSIRSCILSSKTCTKIESWTTLDYFQRDMTSVQSGCCKPPTACTYEAGVVDGGGDCFRWNNGVEMLCYECDACKAGVLEEIRLDWRKLSVVNILVLVLLIAVYAAGCCAFHNTRHAAHPYHPSDDNRMTRVRPRWDYYWWRWWHEKKEQLY

SEQ ID NO: 1131 - protein, 431 aa, Arabidopsis thaliana
MEMESCKLFIGGISWETSEDRLRDYFHSFGEVLEAVIMKDRATGRARGFGFVVFADPNVAERVVLLKHIIDGKIVEAKKAVPRDDHVVFNKSNSSLQGSPGPSNSKKIFVGGLASSVTEAEFKKYFAQFGMITDVVVMYDHRTQRPRGFGFISYDSEEAVDKVLQKTFHELNGKMVEVKLAVPKDMALNTMRNQMNVNSFGTSRISSLLNEYTQGFSPSPISGYGVKPEVRYSPAVGNRGGFSPFGHGYGIELNFEPNQTQNYGSGSSGGFGRPFSPGYAASLGRFGSQMESGGASVGNGSVLNAAPKNHLWGNGGLGYMSNSPISRSSFSGNSGMSSLGSIGDNWGTVARARSSYHGERGGVGLEAMRGVHVGGYSSGSSILEADSLYSDSMWLSLPAKAEEGLGMGPLDFMSRGPAGYINRQPNGGIAA

SEQ ID NO: 1132 - protein, 309 aa, Arabidopsis thaliana
MAFLSKFGNILKQTTNKQLNAQVSLSSPSLFQAIRCMSSSKLFIGGMAYSMDEDSLREAFTKYGEVVDTRVILDRETGRSRGFGFVTFTSSEAASSAIQALDGRDLHGRVVKVNYANDRTSGGGFGGGGYGGGGGGYGGSGGYGGGAGGYGGSGGYGGGAGGYGGNSGGGYGGNAAGGYGGSGAGGYGGDATGHGGAGGGYGSSGGFGSSGNTYGEGSSASAGAVGDYNGSSGYGSANTYGSSNGGFAGDSQFGGSPVGNSSQFGGDNTQFTAGGQFGGEDQFGSMEKSETKMEDGPIGGEFEDVAKRA

SEQ ID NO: 1133 - protein, 571 aa, Arabidopsis thaliana
MTLLSSLGRASRSAPLASKLLLLGTLSGGSIVAYADANEEANKKEEHKKKKVVVLGTGWAGISFLKDLDITSYDVQVVSPQNYFAFTPLLPSVTCGTVEARSIVESVRNITKKKNGEIELWEADCFKIDHVNQKVHCRPVFKDDPEASQEFSLGYDYLIVAVGAQVNTFGTPGVLENCHFLKEVEDAQRIRRGVIDCFEKAILPGLTEEQRRRKLHFVIVGGGPTGVEFAAELHDFIIEDITKIYPSVKELVKITLIQSGDHILNTFDERISSFAEQKFTRDGIDVQTGMRVMSVTDKDITVKVKSSGELVSIPHGLILWSTGVGTRPVISDFMEQVGQGGRRAVATNEWLQVTGCENVYAVGDCASIAQRKILGDIANIFKAADADNSGTLTMEELEGVVDDIIVRYPQVELYLKSKHMRHINDLLADSEGNARKEVDIEAFKLALSEADSQMKTLPATAQVAAQQGAYLAKCFNRMEQCKELPEGPKRFRTGGHHQFRPFQYKHFGQFAPLGGDQAAAELPGDWVSAGKSAQWLWYSVYASKQVSWRTRALVVSDWTRRYIFGRDSSRI

SEQ ID NO: 1134 - protein, 145 aa, Arabidopsis thaliana
MASFATIAAVQPSAAVKGLGGSSLAGAKLFIKPSRQSFKTKSTRAGAVVAKYGDKSVYFDLEDLGNTTGQWDVYGSDAPSPYNPLQSKFFETFAAPFTKRGLLLKFLILGGGSLLTYVSANSTGDVLPIKRGPQEPPKLGPRGKL

SEQ ID NO: 1135 - protein, 194 aa, Arabidopsis thaliana
MEKKLLDITRTDSAEKKRVRDESFDEAVLDSPEVKRLRDDLFDVLDDSDPEPVSQDLDSVMKSFEDELSTVTTTTAQGSSTAGETQPDLGYLLEASDDELGLPPPPSISPVPVAKEEVTTETVTDLVRASSDSSGIDEIWGFEDHVSNYGGLDFGSGVGDGGDYVAVEGLFEFSDDCFDSGDLFSWRSESLPAE

SEQ ID NO: 1136 - protein, 485 aa, Arabidopsis thaliana
MAMASLYRRSLPSPPAIDFSSAEGKLIFNEALQKGTMEGFFRLISYFQTQSEPAYCGLASLSVVLNALSIDPGRKWKGPWRWFDESMLDCCEPLEVVKEKGISFGKVVCLAHCSGAKVEAFRTSQSTIDDFRKFVVKCTSSENCHMISTYHRGVFKQTGTGHFSPIGGYNAERDMALILDVARFKYPPHWVPLKLLWEAMDSIDQSTGKRRGFMLISRPHREPGLLYTLSCKDESWIEIAKYLKEDVPRLVSSQHVDSVEKIISVVFKSLPSNFNQFIRWVAEIRITEDSNQNLSAEEKSRLKLKQLVLKEVHETELFKHINKFLSTVGYEDSLTYAAAKACCQGAEILSGSPSKEFCCRETCVKCIKGPDDSEGTVVTGVVVRDGNEQKVDLLVPSTQTECECGPEATYPAGNDVFTALLLALPPQTWSGIKDQALMHEMKQLISMASLPTLLQEEVLHLRRQLQLLKRCQENKEEDDLAAPAY

SEQ ID NO: 1137 - protein, 385 aa, Arabidopsis thaliana
MGTNEVTRIVTDEEKREAKNFNIFDLPDVPTGLPPHLELQRTRVVCKKDSNIHPTAITFSGAYSSMGVDNSVRLENFSEDFKVDVISLTETDMVFDMIGVHAGIANAFRRILLAELPSMAIEKVYVANNTSVIQDEVLAHRLGLIPIAADPRLFEYLSENDQPNEKNTIVFKLHVKCLKGDPRRKVLTSELKWLPNGSELIKESGGSTTTPKTYTSFNHSQDSFPEFAENPIRPTLKDILIAKLGPGQEIELEAHAVKGIGKTHAKWSPVATAWYRMLPEVVLLKEFEGKHAEELVKVCPKKVFDIEDMGQGRKRATVARPRDCSLCRECIRDGVEWEDQVDLRRVKNHFIFTIESTGSQPPEVLFNEAVKILEDKCERVISELS

SEQ ID NO: 1138 - protein, 184 aa, Arabidopsis thaliana
MPSNSGDDNVLQVLIKNFDVLALPLVTLVYPLYASVKAIETRSLPEDEQWLTYWVLYALISLFELTFSKPLEWFPIWPYMKLFGICWLVLPQFNGAEHIYKHFIRPFYRDPQRATTKIWYVPHKKFNFFPKRDDDDILTAAEKYMEQHGTEAFERMIVKKDSYERGRSSRGINNHMIFDDDYRY

SEQ ID NO: 1139 - protein, 325 aa, Arabidopsis thaliana
MASFVFVISLLLLSFSSAVFSDDASFQKLPVPDKRSGPESFAFDSTGGFYTGVSGGKILKYVPGKGYVDFAQITDSSNSAWCNGALGTAFAGKCGRPAGIALNSKTGDLYVADAPLGLHVISPAGGLATKLADSVDGKPFKFLDGLDVDPTTGVVYFTSFSSKFGPREVLIAVGLKDASGKLFKYDPATKAVTELMEGLSGAAGCAVSSDGSFVLVSEFIKSNIKKYWIKGPKAGTIEDFSSLVSNPDNIRRVGSTGNFWVASVVNKVVMPTDPRAVKLDANGKVLQTIFLKNEFGNTLLSEVNEFNGHLYIGTLTGPFAGVMKL

SEQ ID NO: 1140 - protein, 196 aa, Arabidopsis thaliana
MSASRFIKCVTVGDGAVGKTCMLISYTSNTFPTDYVPTVFDNFSANVVVDGNTVNLGLWDTAGQEDYNRLRPLSYRGADVFILAFSLISKASYENVAKKWIPELRHYAPGVPIILVGTKLDLRDDKQFFIDHPGAVPITTNQGEELKKLIGSPIYIECSSKTQQNVKAVFDAAIKVVLQPPKQKKKKKNKNRCVFL

SEQ ID NO: 1141 - protein, 372 aa, Arabidopsis thaliana
MDRLLQPPSSHSIAPSKFQSRPSPLLLHRLHSTNLSTFPSSRRLESRRISSISCFFRQNPSPDTSPGLNQSSNFLIASSQTDASKPNPGFIQRIVSSFEQRKTISAGMVILVSAIAALLLNPILVPPAFASFQTATNSGGAAVVGGKLLRTEVLTSAWTGFFAGCLHTLSGPDHLAALAPLSIGRTRMESAAVGALWGCGHDAGQLIFGLLFLLLKDRLHIEVIRTWGTRVVGLTLLVIGAMGIKEASEMPEPCVVTLENGETDEKSLKKKKIGFATFATGIVHGLQPDALMMVLPALALPSRIAGASFLIMFLIGTVIAMGSYTVFIGSCSEALKEKVPRITEKLTWASSLVAIGLGLAIIVSQFFGFSLY

SEQ ID NO: 1142 - protein, 141 aa, Arabidopsis thaliana
MAYSTKLYLPLKTPCFVPKTVRAKTLMLQQSQVHVKVKKATVSQPQPIRYSTKNIVFEDPIQGIICYTDDNGEVICEGYDEGPRCPTQSPMVASYSREVEILDLLQRSYQELSDSNKDGQRPIIASEQEFMMIKWSSFDFL

SEQ ID NO: 1143 - protein, 200 aa, Arabidopsis thaliana
MGDSVSSSSRVSVHQSLGAGSVADLLLWRNRTGAVILLISSTGFWFLFERAGYNLLSFVSNVLLLLVAIFFLWAKSATVLNRPLPPVPNMEIPEEFANKAADDLRVWINYVLSIASDITIARNPIRLLQVSLVLWAISYVGTLINSLTLVYIGVLLSLSFPIVYEKYQDHIDEKVNSTSKFVRNISRKFPLPINKEKKHQ

SEQ ID NO: 1144 - protein, 275 aa, Arabidopsis thaliana
MASHDHHHHHHDHEHDHEKSDGGEGKASWVGKDGKVYHSHDGLAPHSHEPIYSPGYFSRRAPPLHDRNFSERAFTVGIGGPVGTGKTALMLALCRFLRDKYSLAAVTNDIFTKEDGEFLVKNGALPEERIRAVETGGCPHAAIREDISINLGPLEELSNLFKADLLLCESGGDNLAANFSRELADYIIYIIDVSAGDKIPRKGGPGITQADLLVINKTDLAAAVGADLSVMERDSLRMRDGGPFVFAQVKHGLGVEEIVNHVMHSWEHATGKKRQ

SEQ ID NO: 1145 - protein, 173 aa, Arabidopsis thaliana
MALRSVKTPTLITSVAVVSSSVTNKPHSIRFSLKPTSALVVHNHQLSFYGSNLKLKPTKFRCSASALTPQLKDTLEKLVNSEKVVLFMKGTRDFPMCGFSNTVVQILKNLNVPFEDVNILENEMLRQGLKEYSNWPTFPQLYIGGEFFGGCDITLEAFKTGELQEEVEKAMCS

SEQ ID NO: 1146 - protein, 214 aa, Arabidopsis thaliana
MASVSPLAKFKLVFLGDQSVGKTSIITRFMYDKFDTTYQPTIGIDFLSKTMYLEDRTVRLQLWDTAGQERFRSLIPSYIRDSSVAIVVYDVSNRQTFLNTSKWIEDVHRERGQSNVIIVLVGNKTDLVEKRQVSISEGEDKGKEYGVMFIETSAKENFNIKALFRKIAAALPGVDSYSLATKSDDMVDVNLKTTSNSSQGEQQGGAGGGGGCSC

SEQ ID NO: 1147 - protein, 224 aa, Arabidopsis thaliana
MAGGGGYGGASGKVDYVFKVVLIGDSAVGKSQLLARFARDEFSMDSKATIGVEFQTRTLSIEQKSIKAQIWDTAGQERYRAVTSAYYRGAVGAMLVYDMTKRETFEHIPRWLEELRAHADKNIVIILIGNKSDLEDQRAVPTEDAKEFAEKEGLFFLETSALNATNVENSFNTLMTQIYNTVNKKNLASEGDSNNPGSLAGKKILIPGSGQEIPAKTSTCCTSS

SEQ ID NO: 1148 - protein, 210 aa, Arabidopsis thaliana
MGSSSGQSGYDLSFKILLIGDSGVGKSSLLVSFISSSVEDLAPTIGVDFKIKQLTVGGKRLKLTIWDTAGQERFRTLTSSYYRGAQGIILVYDVTRRETFTNLVDVWGKEIELYSTNQECVRMLVGNKVDRESERGVSREEGIALAKELNCMFLECSARTRQNVEQCFEELALKIMEVPSLLEEGSSAVKRNILKQKPEHQTNTQSGCCS

SEQ ID NO: 1149 - protein, 337 aa, Arabidopsis thaliana
MHSLPVNLVLTVLTVFLTSPAQVIGYRPYPPKTNGSDQIFDASKKFEGSSNLVRLRYHMGPVLTNNITVHPIWYGTWQKSQKKIIREFINSISAVGSKHPSVSGWWKTVQLYTDQTGSNITGTVRLGEEKNDRFYSHGKSLTRLSIQSVIKSAVTSRSRPLPVNPKSGLYLLLTADDVYVQDFCGQVCGFHYFTFPSIVGFTLPYAWVGNSAKLCPGVCAYPFAVPAFIPGLKPVKSPNGDVGVDGMISVIAHEIAELATNPLVNAWYAGPDPVAPVEIADLCEGIYGTGGGGSYTGQMLNDHSGATYNVNGIRRRYLIQWLWSHVVSYCTGPNALD

SEQ ID NO: 1150 - protein, 616 aa, Arabidopsis thaliana
MAARINTSLHNALSFLKPFNTPLNTKPFSFRRNSFRFSKKLPYYSQFSSGKRALYCTSSSQESTVDEGETFVLTTPLYYVNAPPHMGSAYTTIAADSIARFQRLLGKKVIFITGTDEHGEKIATSAAANGRNPPEHCDLISQSYRTLWKDLDIAYDKFIRTTDPKHEAIVKEFYARVFANGDIYRADYEGLYCVNCEEYKDEKELLENNCCPVHQMPCVARKEDNYFFALSKYQKPLEDILAQNPRFVQPSYRLNEVQSWIKSGLRDFSISRALVDWGIPVPDDDKQTIYVWFDALLGYISALTEDNKQQNLETAVSFGWPASLHLIGKDILRFHAVYWPAMLMSAGLELPKMVFGHGFLTKDGMKMGKSLGNTLEPFELVQKFGPDAVRYFFLREVEFGNDGDYSEDRFIKIVNAHLANTIGNLLNRTLGLLKKNCESTLVVDSTVAAEGVPLKDTVEKLVEKARTNYENLSLSSACEAVLEIGNAGNTYMDQRAPWFLFKQGGVSAEEAAKDLVIILEVMRVIAVALSPVAPCLSLRIYSQLGYTEDQFNSITWSDTKWGGLKGGQVMEQASPVFARIELNPEKEEDEKKPKVGKKTGKAKVKVVEQTPTVAEA

SEQ ID NO: 1151 - protein, 396 aa, Arabidopsis thaliana
MEAVLLCSKLVPRAASLEGNQKFSFRHLNKHLKCNSLRADSRDTPLLRGFEAIKSPSIWSCAPFPVRKGSWVPPRCSISSSTVSDSDNPFLSQFRTFSFGSMVKKVRELKVKPMDVVKLTLLLSILTVAAKKTLTLVLDPFFWMYFSWTWLFWPWFIAVGLAGYGIYCFRKHWLGEANAFEQLGIVTSVFTWLTLVPPAYFNGYLEGWPYVFFLAYHYFFFFNVSVRKRLYGDFYARTHDPKWDVNTPLWSRILFGVGIMVGHWLAAFEGPELHRLPGGWANVGIWILIVITMLMHYDSTLYLARYSEKVVVPTAVVQFGPYRWVRHPIYASTMLLFAAYCTALRAPLSLLFLLAVCLVYYNKKAKMEEELMVESFGQSYSDYADKVRHKFIPFVY

SEQ ID NO: 1152 - protein, 391 aa, Arabidopsis thaliana
MQFLASLVSNSRKFGRRWDRALSLHHFSSNATPASISNPAFVEFLRDNGFQKPLAIAIAMRYPNLKSLEQPRSVIQMLKSYSFSDTQIQKSIRVHPRMMFYNVEKILEPKLRFFKDIGFTGSGLGKFVSQNSSVVGVSLVKKLIPTVEILKSIVAPKHEDLPVILSRCGWLLLSRDPNLFLLPNISYLETCGIVGSQLASLLRRQPRIFNLSEEKLRGYVSRALDLGFTLNSRMLVHAVISLSSLSEKTFDRKVKLFMANGFSEDEITDIIRRSPGLIRCSEDKLTLGFEFYLKRMGLEREALAKRPCVLSYNLEKRVIPRLKVLQILREKGLLLKEEKKKKNMVGIVEMTEEAFLEKYVVRFGDEIAEELLVAYKCVCLVDETLLDRIKI

SEQ ID NO: 1153 - protein, 399 aa, Arabidopsis thaliana
MSSSGQTQFRYTQTPSKVVHLRNLPWECVEEELIDLCKRFGKIVNTKSNVGANRNQAFVEFADLNQAISMVSYYASSSEPAQIRGKTVYIQYSNRHEIVNNQSPGDVPGNVLLVTFEGVESHEVSIDVIHLVFSAFGFVHKIATFEKAAGFQALVQFTDVETASAARSALDGRSIPRYLLSAHVGSCSLRMSYSAHTDLNIKFQSHRSRDYTNPYLPVNQTAMDGSMQPALGADGKKVESQSNVLLGLIENMQYAVTVDVLHTVFSAYGTVQKIAIFEKNGSTQALIQYSDIPTAAMAKEALEGHCIYDGGYCKLRLSYSRHTDLNVKAFSDKSRDYTLPDLSLLVAQKGPAVSGSAPPAGWQNPQAQSQYSGYGGSPYMYPSSDPNGASPSGQPPYYG

SEQ ID NO: 1154 - protein, 462 aa, Arabidopsis thaliana
MEGENNMEKGLLLAKKEDSANTTPLLIFSTFIIVSASFTFGAAIGYTADTMSSIMSDLDLSLAQFSLFGSLSTFGGMIGAIFSAKAASAFGHKMTLWVADLFCITGWLAISLAKDIIWLDMGRFLVGIGVGLISYVVPVYIAEITPKHVRGAFTFSNQLLQNCGVAVVYYFGNFLSWRTLAIIGSIPCWIQVIGLFFIPESPRWLAKKGRDKECEEVLQKLRGRKYDIVPEACEIKISVEASKKNSNINIRSLFEKRYAHQLTIGIGLMLLQQLCGTAGISSYGSTLFKLAGFPARIGMMVLSLIVVPKSLMGLILVDRWGRRPLLMTSALGLCLSCITLAVAFGVKDVPGIGKITPIFCFIGILSFTMMFAIGMGALPWIIMSEIFPMDIKVLAGSLVTIANWFTGWIANYAFNFMLVWSPSGTFIISAIICGATIVFTWCLVPETRRLTLEEIQLSFVNV

SEQ ID NO: 1155 - protein, 507 aa, Arabidopsis thaliana
MAVVVSNANAPAFEAKMTVYVFICVMIAAVGGLIFGYDIGISGGVSAMDDFLKEFFPAVWERKKHVHENNYCKYDNQFLQLFTSSLYLAALVASFVASATCSKLGRRPTMQFASIFFLIGVGLTAGAVNLVMLIIGRLFLGFGVGFGNQAVPLFLSEIAPAQLRGGLNIVFQLMVTIGILIANIVNYFTATVHPYGWRIALGGAGIPAVILLFGSLLIIETPTSLIERNKNEEGKEALRKIRGVDDINDEYESIVHACDIASQVKDPYRKLLKPASRPPFIIGMLLQLFQQFTGINAIMFYAPVLFQTVGFGSDAALLSAVITGSINVLATFVGIYLVDRTGRRFLLLQSSVHMLICQLIIGIILAKDLGVTGTLGRPQALVVVIFVCVYVMGFAWSWGPLGWLIPSETFPLETRSAGFAVAVSCNMFFTFVIAQAFLSMLCGMRSGIFFFFSGWIIVMGLFAFFFIPETKGIAIDDMRESVWKPHWFWKRYMLPEDDHHDIEKRNA

SEQ ID NO: 1156 - protein, 514 aa, Arabidopsis thaliana
MAGGFVSQTPGVRNYNYKLTPKVFVTCFIGAFGGLIFGYDLGISGGVTSMEPFLEEFFPYVYKKMKSAHENEYCRFDSQLLTLFTSSLYVAALVSSLFASTITRVFGRKWSMFLGGFTFFIGSAFNGFAQNIAMLLIGRILLGFGVGFANQSVPVYLSEMAPPNLRGAFNNGFQVAIIFGIVVATIINYFTAQMKGNIGWRISLGLACVPAVMIMIGALILPDTPNSLIERGYTEEAKEMLQSIRGTNEVDEEFQDLIDASEESKQVKHPWKNIMLPRYRPQLIMTCFIPFFQQLTGINVITFYAPVLFQTLGFGSKASLLSAMVTGIIELLCTFVSVFTVDRFGRRILFLQGGIQMLVSQIAIGAMIGVKFGVAGTGNIGKSDANLIVALICIYVAGFAWSWGPLGWLVPSEISPLEIRSAAQAINVSVNMFFTFLVAQLFLTMLCHMKFGLFFFFAFFVVIMTIFIYLMLPETKNVPIEEMNRVWKAHWFWGKFIPDEAVNMGAAEMQQKSV

SEQ ID NO: 1157 - protein, 560 aa, Arabidopsis thaliana
MADSKSGDTEVAHRSSDPSEKRGGWITLPFMLVTLLGMSITSFGWGMNLIVFLIEEFHIKNIAAAQISNVVNGVVNMLPVVAAILADSFFGNIPVISTSTFISLAGTSLLTLITSLNYLMPRPCETGSILCQSPSKLQLGILYVALALVIIGSAGTRFTLAAAGANQYKKPKEQGRFFNWFFLALYIGAITGTTAIVYTQDNASWKLGFGLCAVANLISFIVFIAGVRFYKHDKPLGSPYTSLIRVLVAATMKRKAVISSKDEDYHQYGLGKEAKTYTTMPSKSFRFLNRAALKNKEDLNTSGDSSNNMWRLCSVQEVEDFKAILRLVPLWAAVMFLSTPVAVQMSMTVLQALVMDRKLSPHFEVSAGSLQVIVLVFGCVFIMLNNWIIYPMYQKLIGKPLTPLQQVGIGHVFTILSMAISAVVEAKRLKTVENGGHPMSVLWLVPALVMVGIGEAFHFPANVAVFYGEFPESLKNTATSLTSVVIGISFYLSTAVIDVIQRTTSWLPNDINHGRVDNVYWVVVIGGVLNLGYFLVCSWFYKYRNLKDDDHEQDPKDVKT

SEQ ID NO: 1158 - protein, 514 aa, Arabidopsis thaliana
MAGGAFIDESGHGGDYEGRVTAFVMITCIVAAMGGLLFGYDIGISGGVISMEDFLTKFFPDVLRQMQNKRGRETEYCKYDNELLTLFTSSLYLAALFASFLASTITRLFGRKVSMVIGSLAFLSGALLNGLAINLEMLIIGRLFLGVGVGFANQSVPLYLSEMAPAKIRGALNIGFQLAITIGILAANIVNYVTPKLQNGIGWRLSLGLAGVPAVMMLVGCFFLPDTPNSILERGNKEKAKEMLQKIRGTMEVEHEFNELCNACEAAKKVKHPWTNIMQARYRPQLTFCTFIPFFQQLTGINVIMFYAPVLFKTIGFGNDASLISAVITGLVNVLSTIVSIYSVDKFGRRALFLQGGFQMIVTQIAVGSMIGWKFGFNGEGNLSGVDADIILALICLYVAGFAWSWGPLGWLVPSEICPLEIRSAGQSLNVSVNMFFTFFIGQFFLTMLCHMKFGLFYFFAGMVLIMTIFIYFLLPETKGVPIEEMGKVWKEHRYWGKYSNNDDGDDVDDDAYF

SEQ ID NO: 1159 - protein, 517 aa, Arabidopsis thaliana
MAGGAFVSEGGGGGNSYEGGVTVFVIMTCIVAAMGGLLFGYDLGISGGVTSMEEFLSKFFPEVDKQMHEARRETAYCKFDNQLLQLFTSSLYLAALASSFVASAVTRKYGRKISMFVGGVAFLIGSLFNAFATNVAMLIVGRLLLGVGVGFANQSTPVYLSEMAPAKIRGALNIGFQMAITIGILIANLINYGTSQMAKNGWRVSLGLAAVPAVIMVIGSFVLPDTPNSMLERGKYEQAREMLQKIRGADNVDEEFQDLCDACEAAKKVDNPWKNIFQQAKYRPALVFCSAIPFFQQITGINVIMFYAPVLFKTLGFADDASLISAVITGAVNVVSTLVSIYAVDRYGRRILFLEGGIQMIVSQIVVGTLIGMKFGTTGSGTLTPATADWILAFICLYVAGFAWSWGPLGWLVPSEICPLEIRPAGQAINVSVNMFFTFLIGQFFLTMLCHMKFGLFYFFGGMVAVMTVFIYFLLPETKGVPIEEMGRVWKQHPFWKRYMPDDAVIGGGEENYVKEV

SEQ ID NO: 1160 - protein, 527 aa, Arabidopsis thaliana
MAEPTQPLLTDSNSSSPRSLDDTIESYIGSFGWAQFLQAALVSFSGVFDAQQTFISVFTDSEPTWHCTDSNSICHESISNICILPKTAWSWDYSPHVSVISEWGLQCAGSFVKGLPESSFFVGCLIGGLVLSTLADSSLGRKNMLFLSCLVMAISTMLTVFSPNIWVYAVLRFVNGFGRATIGTCALVLSTELVGKKWRGRVGIMSFFGFMLGFLSLPLMAYMNRGSSWRILYAWTSIPTIIYCVLVRFFVCESPRWLFVRGRREEAISILKRVASIPSTDVSSGGAISMSFSSLPFEEDEEKPSTNVNIFTTMKVLVEKRWALKRLSAVMAIAFGIGLVYYGMPLALSNLDFNIYLSAAFNALMDLPANLITLFLVDKLSRRNALIGFTALGGVSSVLIFALHNMRIGNHGALQLALELISYFSACSAFNMEMIYTIELFPTCVRNSAIAMARQALVLGGVFSPIMVAAGRKNAFWSFGLFGLAIGLLGLFAVGLPETRGSDLCDTMDEEECKDRRSKVAVNNVIA

SEQ ID NO: 1161 - protein, 508 aa, Arabidopsis thaliana
MVHADGHNFPGSDPNPHMNKFAFGCAIVASIISIIFGYDTGVMSGAQIFIRDDLKINDTQIEVLAGILNLCALVGSLTAGKTSDVIGRRYTIALSAVIFLVGSVLMGYGPNYPVLMVGRCIAGVGVGFALMIAPVYSAEISSASHRGFLTSLPELCISLGILLGYVSNYCFGKLTLKLGWRLMLGIAAFPSLILAFGITRMPESPRWLVMQGRLEEAKKIMVLVSNTEEEAEERFRDILTAAEVDVTEIKEVGGGVKKKNHGKSVWRELVIKPRPAVRLILIAAVGIHFFEHATGIEAVVLYSPRIFKKAGVVSKDKLLLATVGVGLTKAFFIIIATFLLDKVGRRKLLLTSTGGMVFALTSLAVSLTMVQRFGRLAWALSLSIVSTYAFVAFFSIGLGPITWVYSSEIFPLRLRAQGASIGVAVNRIMNATVSMSFLSMTKAITTGGVFFVFAGIAVAAWWFFFFMLPETKGLPLEEMEKLFGGGGPRGDRDGLEIQTKTISIGGFS

SEQ ID NO: 1162 - protein, 470 aa, Arabidopsis thaliana
MGDGSSSRSNSSNSTSEKPEWLQQYNLVGKIGEGTYGLVFLARTKTPPKRPIAIKKFKQSKDGDGVSPTAIREIMLLREISHENVVKLVNVHINFADMSLYLAFDYAEYDLYEIIRHHRDKVGHSLNTYTVKSLLWQLLNGLNYLHSNWIIHRDLKPSNILVMGDAEEHGIVKIADFGLARIYQAPLKPLSDNGVVVTIWYRAPELLLGSKHYTSAVDMWAVGCIFAELLTLKPLFQGAEAKSSQNPFQLDQLDKIFKILGHPTMDKWPTLVNLPHWQNDVQHIQAHKYDSVGLHNVVHLNQKSPAYDLLSKMLEYDPLKRITASQALEHEYFRMDPLPGRNAFVASQPMEKNVNYPTRPVDTNTDFEGTTSINPPQAVAAGNVAGNMAGAHGMGSRSMPRPMVAHNMQRMQQSQGMMAYNFPAQAGLNPSVPLQQQRGMAQPHQQQQLRRKDPGMGMSGYAPPNKSRRL

SEQ ID NO: 1163 - protein, 442 aa, Arabidopsis thaliana
MVDSDPVEFPPENRRGQLFGKYEVGKLVGCGAFAKVYHGRSTATGQSVAIKVVSKQRLQKGGLNGNIQREIAIMHRLRHPSIVRLFEVLATKSKIFFVMEFAKGGELFAKVSKGRFCEDLSRRYFQQLISAVGYCHSRGIFHRDLKPENLLLDEKLDLKISDFGLSALTDQIRPDGLLHTLCGTPAYVAPEVLAKKGYDGAKIDIWSCGIILFVLNAGYLPFNDHNLMVMYRKIYKGEFRIPKWTSPDLRRLLTRLLDTNPQTRITIEEIIHDPWFKQGYDDRMSKFHLEDSDMKLPADETDSEMGARRMNAFDIISGSPGFNLSGLFGDARKYDRVERFVSAWTAERVVERLEEIVSAENLTVAKKETWGMKIEGQKGNFAMVVEINQLTDELVMIEVRKRQRAAASGRDLWTDTLRPFFVELVHESDQTDPEPTQVHTTS

SEQ ID NO: 1164 - protein, 439 aa, Arabidopsis thaliana
MDKNGIVLMRKYELGRLLGQGTFAKVYHARNIKTGESVAIKVIDKQKVAKVGLIDQIKREISVMRLVRHPHVVFLHEVMASKTKIYFAMEYVKGGELFDKVSKGKLKENIARKYFQQLIGAIDYCHSRGVYHRDLKPENLLLDENGDLKISDFGLSALRESKQQDGLLHTTCGTPAYVAPEVIGKKGYDGAKADVWSCGVVLYVLLAGFLPFHEQNLVEMYRKITKGEFKCPNWFPPEVKKLLSRILDPNPNSRIKIEKIMENSWFQKGFKKIETPKSPESHQIDSLISDVHAAFSVKPMSYNAFDLISSLSQGFDLSGLFEKEERSESKFTTKKDAKEIVSKFEEIATSSERFNLTKSDVGVKMEDKREGRKGHLAIDVEIFEVTNSFHMVEFKKSGGDTMEYKQFCDRELRPSLKDIVWKWQGNNNNSNNEKIEVIH

SEQ ID NO: 1165 - protein, 489 aa, Arabidopsis thaliana
MGPRCSKLSLCWWPTHLKSTHNEASDLDNGTDDLPSFTEFSFDQLRAATCGFSTDSIVSEHGVKAPNVVYKGRLEDDRWIAVKRFNRSAWPDTRQFLEEAKAVGQLRNERLANLIGFCCEGDERLLVAEFMPFETLSKHLFHWDSQPMKWSMRLRVALYLAQALEYCSSKGRALYHDLNAYRILFDQDGNPRLSCFGLMKNSRDGKSYSTNLAFTPPEYLRTGRVIPESVVYSFGTLLLDLLSGKHIPPSHALDLIRGKNFLMLMDSCLDGHFSNDDGTDLVRLASRCLQYEARERPNVKSLVSSLAPLQKETDIPSHVLMGIPHGAASPKETTSLTPLGDACSRHDLTAIHEILEKVGYKDDEGVANELSFQVWTDQIQETLNSKKQGDAAFKGKDFVTAVECYTQFIEDGTMVSPTVFARRCLCYLMSNMPQEALGDAMQAQVVSPEWPTAFYLQAAALFSLGMDKDACETLKDGTSLEAKKHNNRN

SEQ ID NO: 1166 - protein, 612 aa, Arabidopsis thaliana
MIIMMNCFPCFTSQKSRNAPCTTNETNDDNVEHDEFRPPVVATTKRTEEREPAEQQPPVKTFNFRELATATKNFRQECLLGEGGFGRVYKGTLQSTGQLVAVKQLDKHGLHGNKEFLAEVLSLAKLEHPNLVKLIGYCADGDQRLLVFEYVSGGSLQDHLYEQKPGQKPMDWITRMKIAFGAAQGLDYLHDKVTPAVIYRDLKASNILLDAEFYPKLCDFGLHNLEPGTGDSLFLSSRVMDTYGYSAPEYTRGDDLTVKSDVYSFGVVLLELITGRRAIDTTKPNDEQNLVAWAQPIFKDPKRYPDMADPLLRKNFSERGLNQAVAITSMCLQEEPTARPLISDVMVALSFLSMSTEDGIPATVPMESFRDKSNKSSSSSDSEDEEEEKEQKAEKEEESTSKKRQEQEETATDSDDESDSNSEKDQEEEQSQLEKARESSSSSSDSGSERRSIDETNATAQSLKISYSNYSSEEEDNEKLSSKSSCKSNEESTFSRYDSGRDHDDSSRNTSMRINSLAHDDKEEDEEENHETRSYSDHDDSPRNTSMRINSLSHDDDEEEEEENHQTRLEHIHSSKSEDQSVYSDDDAGESGESSLHRIEAKEEEHISSDHD

SEQ ID NO: 1167 - protein, 359 aa, Arabidopsis thaliana
MKSMVKKLKQSLRSGSLEKRKEKEKDIQEEKWFLDNGSIFLKELIADCNGKSIPIRNFSSDQILKATSNFGSSCFVTAEGFYVWYKGIIEDRSYMIKRFSEYKVTQYRVAEVYNEIVLSARMSNHNNFLKLIGFCLEFSLPVLVFEYAEHGVLNHRGGVIVNGEEVILPLSLRLKIGKEIANAVTYLHMAFPKILIHRHIKPRNVFLDENWTPKLSDFSISINLPEGKSRIEVECVQGTIGYLDPVYYTTKMVTEYTDVYSFGVFLMVILTGKPALASTSSDGDYKHIASYVKGFHENGQLDGVIDPKVMEDITSAQKVHVEACVVLALRCCELRDENRPKMIQIAKELKQIETLFRRS

SEQ ID NO: 1168 - protein, 513 aa, Arabidopsis thaliana
MSILSFPHTFFNISPSLFYTILISSLVLLILTRRSAKSKIVKLPPGPPGWPVVGNLFQFARSGKQFYEYVDDVRKKYGPIYTLRMGSRTMIIISDSALVHDVLIQRGPMFATRPTENPTRTIFSSNTFTVNASAYGPVWRSLRKNMVQNMLSSIRFREFGSLRQSAMDKLVERIKSEAKDNDGLVWVLRNARFAAFCILLEMCFGIEMDEESILNMDQVMKKVLITLNPRLDDYLPILAPFYSKERARALEVRCEQVDFIVKLIERRRRAIQKPGTDKTASSFSYLDTLFDLKTEGRITTPSNEELVSLCSEFLNGGTDTTGTAIEWGIAQLIVNPEIQSRLYDEIKSTVGDREVEEKDVDKMVFLQAVVKEILRKHPPTYFTLTHSVTEPTTVAGYDVPVGINVEFYLPGINEDPKLWSDPKKFNPDRFISGKEEADITGVTGVKMMPFGIGRRICPGLAMATVHVHLMLAKMVQEFEWSAYPPESEIDFAGKLEFTVVMKKPLRAMVKPRV

SEQ ID NO: 1169 - protein, 344 aa, Arabidopsis thaliana
MGFRSVYQSLTELFPQIDPKILRGVAIEHQHDADEAASVVISEIFPFSSPNSTQPHNKNKTKVSDNPPNLKVKCDDGSLSLSQWLQPSKLPHSYLALLNEDSTPDVKPPLDYVVEKVVLPSRGPATGLGGGIRTMYSSDNIGGSSLVKPSIRVQSRTNNELSGSSSKVPGRRRSSRKSVQPWSPDYSEKLRSWKKRSNNNNRDFSQLFDNDIDVPSTRSNKCYTNERERKQRIADNIKALGKLLPHKVEGDNHELTLNAMVDHVKLLHLQMKELSRSRLGGEPISHPMAFIEGYGHYIHHEQTMAKSLEEVMEDLLTKDFDAAANLLESKGLYLTPLSSVQGSC

SEQ ID NO: 1170 - protein, 557 aa, Arabidopsis thaliana
MTTTSEISLQEEYVTDAVDHRGLAARRSNTGRWRAALFIIGVEVAERFAYYGIGSNLISYLTGPLGESTAVAAANVNAWSGIATLLPVLGAFVADAFLGRYRTIIISSLIYVLGLAFLTLSAFLIPNTTEVTSSTSSFLNVLFFFSLYLVAIGQSGHKPCVQAFGADQFDEKDSQEKSDRSSFFNWWYLSLSAGICFAILVVVYIQEEFSWAFGFGIPCVFMVISLVLFVSGRRIYRYSKRRHEEEINPFTRIGRVFFVALKNQRLSSSDLCKVELEANTSPEKQSFFNKALLVPNDSSQGENASKSSDVEDATALIRLIPVWFTTLAYAIPYAQYMTFFTKQGVTMDRTILPGVKIPPASLQVFIGISIVLFVPIYDRVFVPIARLITKEPCGITTLKRIGTGIVLSTITMVIAALVEFKRLETAKEHGLIDQPEATLPMSIWWLIPQYLLLGLADVYTLVGMQEFFYSQVPTELRSIGLALYLSALGVGSLLSSLLISLIDLATGGDAGNSWFNSNLNRAHLDYFYWLLAIVSAVGFFTFLFISKSYIYRRVDRV

SEQ ID NO: 1171 - protein, 374 aa, Arabidopsis thaliana
MTNQNVIVSDRKPILGLKTITVSVSNSPLFSNSFPTYFNFPRRKLLKLLEAADKNNLVVAPKITSMIDSMRDSSPTRLRSSSYDSVSDNDDKTSWIVRFPSALNMFDEIVNAAKGKQIVMFLDYDGTLSPIVEDPDKAFITHEMREVVKDVASNFPTAIVTGRSIEKVRSFVQVNEIYYAGSHGMDIEGPTNENSNGQSNERVLFQPAREFLPMIEKVVNILEEKTKWIPGAMVENNKFCLSVHFRRVDEKRWPALAEVVKSVLIDYPKLKLTQGRKVLEIRPTIKWDKGQALNFLLKSLGYENSDDVVPVYIGDDRTDEDAFKVLRERGQGFGILVSKVPKDTNASYSLQDPSQVNKFLERLVEWKRKTVGEE

SEQ ID NO: 1172 - protein, 281 aa, Arabidopsis thaliana
MAADNAYLMQFVDETSFYNRIVLSHLLPANLWEPLPHFLQTWLRNYLAGTLLYFISGFLWCFYIYYLKINVYLPKDAIPTIKAMRLQMFVAMKAMPWYTLLPTVSESMIERGWTKCFASIGEFGWILYFVYIAIYLVFVEFGIYWMHRELHDIKPLYKYLHATHHIYNKQNTLSPFAGLAFHPVDGILQAVPHVIALFIVPIHFTTHIGLLFMEAIWTANIHDCIHGNIWPVMGAGYHTIHHTTYKHNYGHYTIWMDWMFGSLRDPLLEEDDNKDSFKKAE

SEQ ID NO: 1173 - protein, 298 aa, Arabidopsis thaliana
MIPYATVEEASIALGRNLTRLETLWFDYSATKSDYYLYCHNILFLFLVFSLVPLPLVFVELARSASGLFNRYKIQPKVNYSLSDMFKCYKDVMTMFILVVGPLQLVSYPSIQMIEIRSGLPLPTITEMLSQLVVYFLIEDYTNYWVHRFFHSKWGYDKIHRVHHEYTAPIGYAAPYAHWAEVLLLGIPTFMGPAIAPGHMITFWLWIALRQMEAIETHSGYDFPWSPTKYIPFYGGAEYHDYHHYVGGQSQSNFASVFTYCDYIYGTDKGYRFQKKLLEQIKESSKKSNKHNGGIKSD

SEQ ID NO: 1174 - protein, 452 aa, Arabidopsis thaliana
MNSLTVEQVLKEKKTNDPDSVKELNLGHKALTDVSCLSKFKNLEKLDLRFNNLTDLQGLKSCVNLKWLSVVENKLQSLNGIEALTKLTVLNAGKNKLKSMNEISSLVNLRALILNDNEISSICKLDLLKDLNSLVLSRNPISEIGDSLSKLKNLSKISLSDCRIKAIGSSLKSCSDLKELRLANNEIKALPAELAVNKRLLNLDVGNNVITQLSGLEVLGTLSCLRNLNIRGNPISDNDKSAKKVRTLLLPSVNVFNAQPLEKSSRNAKHIRLDTDDETFDAYHNKSAEEEQSKEDRKRKKSSKRNKSEEEEVNNEDHKSKKKKSKSNTNVDQVETKKKEEHKEKTIPSNNDDDDDAEKKQKRATPKEELDAIDDAETSFAEIFSRENVPKGSEDGIEKKKKSSVQETGLVKVIDTKANKKKKKSEKKQSKSVVIDLPMEVEIGLGGESKWE

SEQ ID NO: 1175 - protein, 332 aa, Arabidopsis thaliana
MPATAGRVRMPANNRVHSSAALQTHGIWQSAIGYDPYAPTSKEEPKTTQQKTEDPENSYASFQGLLALARITGSNNDEARGSCKKCGRVGHLTFQCRNFLSTKEDKEKDPGAIEAAVLSGLEKIRRGVGKGEVEEVSSEEEEESESSDSDVDSEMERIIAERFGKKKGGSSVKKTSSVRKKKKRVSDESDSDSDSGDRKRRRRSMKKRSSHKRRSLSESEDEEEGRSKRRKERRGRKRDEDDSDESEDEDDRRVKRKSRKEKRRRRSRRNHSDDSDSESSEDDRRQKRRNKVAASSDSEANVSGDDVSRVGRGSSKRSEKKSRKRHHRKERE

SEQ ID NO: 1176 - protein, 313 aa, Arabidopsis thaliana
MAATSLVLTCASPLFSSPRVISATKKLTTELSISTAKFRRRCSGNNDEVLLEGMPPEYYDDEWQARQREKTKELRRMQREEEEEEERKIEEYREIGTRLKEFPEQDLRKARKLVSSFIRAAEEVEERIEEAAEKGELDELVLMIIWNRLDLARRDDEKDAIRSLDLLYRRVETEILKRQASPAMKLLNDLLNMHDGFEDDAWLKDCRKRMAETFPREDPFSILMPPGFDIDMHQGQLRPPIETETDNTLLRVDFVREVDALLQEVRIEEDATTGSKGEGLDPEAIALKFKQQEKQRTIRQIEAILDLALNLKW

SEQ ID NO: 1177 - protein, 335 aa, Bacillus subtilis subsp. subtilis str. 168
MAVKVGINGFGRIGRNVFRAALNNPEVEVVAVNDLTDANMLAHLLQYDSVHGKLDAEVSVDGNNLVVNGKTIEVSAERDPAKLSWGKQGVEIVVESTGFFTKRADAAKHLEAGAKKVIISAPANEEDITIVMGVNEDKYDAANHDVISNASCTTNCLAPFAKVLNDKFGIKRGMMTTVHSYTNDQQILDLPHKDYRRARAAAENIIPTSTGAAKAVSLVLPELKGKLNGGAMRVPTPNVSLVDLVAELNQEVTAEEVNAALKEAAEGDLKGILGYSEEPLVSGDYNGNKNSSTIDALSTMVMEGSMVKVISWYDNESGYSNRVVDLAAYIAKKGL

SEQ ID NO: 1178 - protein, 336 aa, Desulfitobacterium hafniense
MGVRIAINGFGRIGRLSMRAILERKSSLDIVAVNDLGSPDLLGHLFKYDSIHDILPYDVEVKENTLEVLDQKVAFLAEKDPGKLPWRELGVDLVIEATGRFTKREQAALHLQAGAKKVIISAPGKHEDITIVMGVNEHLYNPAEHHILSNASCTTNGLAPLAKVLLEEFGIEQGMMTTTHSVTNDQRILDLEHKDWRRARAAYESMIPTTTGATKAVELVLPDLKGKLKGLAVRVPTPNVSLIDFVANLSRSTTKEEVNQKLREAAEGSLKGYLAYSELPLVSHDFNGNPHSAIVDGLSTLMLGERMVKVLAWYDNEWGYSNRIVDLVEYIAGQGL

SEQ ID NO: 1179 - protein, 402 aa, Pseudomonas fluorescens PfO-1
MAEQGSPRRFARIDRLPPYVFNITAELKMAARRRGEDIIDLSMGNPDGATPPHIVEKLVQVAQREDTHGYSTSKGIPRLRRAISNWYKERYEVEIDPESEAIVTIGSKEGLAHLMLATLDQGDTVLVPNPSYPIHIYGAVIAGAQVRSVPLVPGVDFFAELERAIRGSIPKPKMMILGFPSNPTAQCVELDFFERVIALAKQYDVLVVHDLAYADIVYDGWKAPSIMQVPGAKDMAVEFFTLSKSYNMAGWRIGFMVGNPELVSALARIKSYHDYGTFTPLQVAAIAALEGDQQCVRDIAEQYRQRRNVLVKGLHELGWMVENPKASMYVWAKIPEAYAHLGSLEFAKKLLAEAKVCVSPGVGFGEYGDDHVRFALIENQDRIRQAVRGIRGMFRADALGTK

SEQ ID NO: 1180 - protein, 439 aa, Synechocystis sp. PCC 6803
MCCWQSRGLLVKRVLAIILGGGAGTRLYPLTKLRAKPAVPLAGKYRLIDIPVSNCINSEIVKIYVLTQFNSASLNRHISRAYNFSGFQEGFVEVLAAQQTKDNPDWFQGTADAVRQYLWLFREWDVDEYLILSGDHLYRMDYAQFVKRHRETNADITLSVVPVDDRKAPELGLMKIDAQGRITDFSEKPQGEALRAMQVDTSVLGLSAEKAKLNPYIASMGIYVFKKEVLHNLLEKYEGATDFGKEIIPDSASDHNLQAYLFDDYWEDIGTIEAFYEANLALTKQPSPDFSFYNEKAPIYTRGRYLPPTKMLNSTVTESMIGEGCMIKQCRIHHSVLGIRSRIESDCTIEDTLVMGNDFYESSSERDTLKARGEIAAGIGSGTTIRRAIIDKNARIGKNVMIVNKENVQEANREELGFYIRNGIVVVIKNVTIADGTVI

SEQ ID NO: 1181 - protein, 353 aa, Bacillus subtilis subsp. subtilis str. 168
MTHTVPQNMKAAVMHNTREIKIETLPVPDINHDEVLIKVMAVGICGSDLHYYTNGRIGNYVVEKPFILGHECAGEIAAVGSSVDQFKVGDRVAVEPGVTCGRCEACKEGRYNLCPDVQFLATPPVDGAFVQYIKMRQDFVFLIPDSLSYEEAALIEPFSVGIHAAARTKLQPGSTIAIMGMGPVGLMAVAAAKAFGAGTIIVTDLEPLRLEAAKKMGATHIINIREQDALEEIKTITNDRGVDVAWETAGNPAALQSALASVRRGGKLAIVGLPSQNEIPLNVPFIADNEIDIYGIFRYANTYPKGIEFLASGIVDTKHLVTDQYSLEQTQDAMERALQFKNECLKVMVYPNR

SEQ ID NO: 1182 - protein, 369 aa, Escherichia coli K12
MKSRAAVAFAPGKPLEIVEIDVAPPKKGEVLIKVTHTGVCHTDAFTLSGDDPEGVFPVVLGHEGAGVVVEVGEGVTSVKPGDHVIPLYTAECGECEFCRSGKTNLCVAVRETQGKGLMPDGTTRFSYNGQPLYHYMGCSTFSEYTVVAEVSLAKINPEANHEHVCLLGCGVTTGIGAVHNTAKVQPGDSVAVFGLGAIGLAVVQGARQAKAGRIIAIDTNPKKFDLARRFGATDCINPNDYDKPIKDVLLDINKWGIDHTFECIGNVNVMRAALESAHRGWGQSVIIGVAVAGQEISTRPFQLVTGRVWKGSAFGGVKGRSQLPGMVEDAMKGDIDLEPFVTHTMSLDEINDAFDLMHEGKSIRTVIRY

SEQ ID NO: 1183 - protein, 341 aa, Nostoc punctiforme PCC 73102
MTLLLAGDIGGTKTILQLVETSDSQGLHTIYQESYHSADFPDLVPIVQQFLIKANTPIPEKACFAIAGPIVKNTAKLTNLAWFLDTERLQQELGIPHIYLINDFAAVGYGISGLQKQDLHPLQVGKPQPETPIGIIGAGTGLGQGFLIKQGNNYQVFPSEGGHADFAPRNEIEFQLLKYLLDKHDIQRISVERVVSGMGIVAIYQFLRDRKFAAESPDIAQIVRTWEQEAGQEEKSVDPGAAIGTAALEKRDRLSEQTLQLFIEAYGAEAGNLALKLLPYGGLYIAGGIAPKILPLIQNSGFLLNFTQKGRMRPLLEEIPVYIILNPQVGLIGAALCAARL

SEQ ID NO: 1184 - protein, 370 aa, Pseudomonas syringae pv. tomato str. DC3000
MIKSRAAVAFEAKKPLEIVEVDVAMPKAGEVLLKVVASGVCHTDAYTLSGADPEGIFPSILGHEGGAIVEAIGEGVTSVAVGDHVIPLYTPECRQCKFCRSGKTNLCQAIRSTQGKGLMPDGTTRFSYKGEPIFHYMGTSTFSEYTVLPEISVAKIDKKAPLEKVCLLGCGVTTGIGAVLNTAKVKPGDTVAVFGLGGIGLSAVIGAVKAKAARIIAIDINPAKFEIAKQLGATDCVNPKDFDRPIQEVIVDMTDGGVDFSFECIGNVQLMRSALESCHKGWGESVIIGVAGAGQEISTRPFQLVTGRVWRGSAFGGVRGRTELPSYVDMAQTGEIPLDTFITHTMGLEDINKAFDLMHEGKSIRTVIHF

SEQ ID NO: 1185 - protein, 361 aa, Xenorhabdus nematophila
MKKTFKIAAIPGDGIGHEVLPEGIRVLQAVAEKWDLHLSFEYFEWASCDYYLRHGKMMPDDWFNQLMQFDAIYFGAVGWPETVPDHISLWGSLLKFRRDFQQYVNLRPVRLLPGVPCPLANKKPEDIDFYVVRENTEGEYSAIGGRFNEGTEHEVVIQESVFTRRGVDRILKYAFELAQSRPRKLLTSATKSNGLSISMPYWDERVEKMAKQYPDIKWDKQHIDILCARFVLNPERFDVVVASNLFGDILSDLGPACTGTIGISPSANLNPERNFPSLFEPVHGSAPDIYGKNIANPIAMIWAGAMMLQFLGEGEQRYQDAHDDILAAIEAVIVQGIVTPDMKGKASTQQVGEAIVNHLNA

SEQ ID NO: 1186 - protein, 346 aa, Xenorhabdus nematophila
MKALVYHGTGKKQWETKSPPQLIESTDAIVRIIKTTICGTDLHILKGDVPTVDAGRTLGHEGIGIVESVGESVRNIKVGDKVIISCITVCGRCRYCKRQLYSHCEDGGWILGHKIDGTQSEKVRIPHADNSLHRLPEGIDEEAALMLSDILPTGLEIGVINGKVQPGNTIALIGAGPVGLSALLASQFYSPAHIIMIDTDDNRLHVAQQFGADTVINPTHQNVVEVIQKLTDGIGVDVAIECVGIPATFKICQDIITAGGYIANVGVHGKSVELHLEDLWIKNITITTGLVNTSSTPMLLKSLQSGKISPEKLVTHRYSLSEIKTAYEVFGNAEKEKALKIVLTAE

SEQ ID NO: 1187 - protein, 402 aa, Saccharomyces cerevisiae
MFQQLSASIRHNAHIIFLCISWYFISSLASQVTKQVLTVCPLPLFLGEFQFIYTAVLAWFTCYIAYSFPGFYRIFPNGTFPEYYIDDRETSRAARKESKLSSLIIPPSKPILQTVLPLGLFQFVGKYFGHTATSLVPVSTVASIKTLSPMFILLLQKILKISTLKITLTLIFSLCTLVLGVWIIVQEDNRSPASSNELREFSKYGVICAMISMFIFVLQNIYGKTVFTYRSQTDESQSNSGFSRQESPLPLYEKLDEKLVAKKKPKSYDKLTLMIYISLVGFCLSFGWFITLEFPVLFRYFFQINSSSTVIKAFPVSLFLLNGTFHFIQAMITFHLLGEVSTLTYSIANLMKRFAIIAVSWVFIGRRITWLQVFGLVLNTLGLFLYERCTSQSKIKAKIRPE

SEQ ID NO: 1188 - protein, 515 aa, Bacillus subtilis subsp. subtilis str. 168
MAVTYAHEPFTDFTEAKNKTAFGESLAFVNTQLGKHYPLVINGEKIETDRKIISINPANKEEIIGYASTADQELAEKAMQAALQAFDSWKKQRPEHRANILFKAAAILRRRKHEFSSYLVKEAGKPWKEADADTAEAIDFLEFYARQMLKLKEGAPVKSRAGEVNQYHYEALGVGIVISPFNFPLAIMAGTAVAAIVTGNTILLKPADAAPVVAAKFVEVMEEAGLPNGVLNYIPGDGAEIGDFLVEHPKTRFVSFTGSRAVGCRIYERAAKVQPGQKWLKRVIAEMGGKDTVLVDKDADLDLAASSIVYSAFGYSGQKCSAGSRAVIHQDVYDEVVEKAVALTKTLTVGNPEDPDTYMGPVIHEASYNKVMKYIEIGKSEGKLLAGGEGDDSKGYFIQPTIFADVDENARLMQEEIFGPVVAICKARDFDHMLEIANNTEYGLTGALLTKNRAHIERAREDFHVGNLYFNRGCTGAIVGYQPFGGFNMSGTDSKAGGPDYLILHMQAKTTSEAF

SEQ ID NO: 1189 - protein, 495 aa, Rhodobacter sphaeroides
MVQEIDWHARAKAVALPNRPFIDGQYVDSLSGETFACIYPGDGRPLTDVASCNAADVDVAVRSARKAFEAGVWSRMAPADRRRILLRFSELILANREELALLETLNVGKPIANAYNGDVVSAAACIAWYAEAIDKVYGEVAATAYDMTTLVMREPLGIVAAVVPWNYPMSMAAWKLGPALATGNSVILKPAEQSPFTALKFGELAIEAGMPPGVLNVVPGLGHIAGKALGLHMDVDCVGFTGSTEVGKYFMQYSGQSNIKRIGLELGGKSPQVVLADCDDLDAAAAGIAAGIFANTGQVCNAGSRLIVDEKIHDQLLEKIAAQAKVFAPGDPLDTATRMGSMVSEEQMDRVLGYIDAGRADGARPVIGGGRVKTETGGFYIEPTIFEGVRNDMKIAQEEIFGPVLSAIPVKGFDEAMATANDTVYGLAGAVWTGSVKNAHRAAKSLRAGVVWVNCFDRGSLAVPFGGFKQSGFGRDKSLHAMDKYTDLKAVWFAH

SEQ ID NO: 1190 - protein, 485 aa, Pseudomonas syringae pv. tomato str. DC3000
MLKNQLKDPSLLVDRAYVDGQWISADDGATLAISDPATGEVIAQVPALQGAETRRAIEAADRAWPAWRARPAAERAALLERWHQAMLDNVEDLALIMTLEQGKPLNESRGEIRYGASFVKWFAEEARRSYGETIPTPSADRRLMTLKQPVGVCAAITPWNFPNAMITRKCAPALAAGCTIIVKPSDLTPLSALALAVLAERAGIPVGVFSVVTGMPTAIGEELTGNPVVRKISFTGSTPIGRLLMRQSAEHIKRLSLELGGNAPFIVFDDADLEQAVAGIMLSKFRNAGQTCVCANRILVQSGIYDRFAARLVEEVAKLKVGNGLEEGVTIGPLINPAAVSKIARHIDDALSQGAKLLYGGLPNGDGQFVQPTVLGDTHAGMLLANEETFGPVAPLMRFTDEAEALALANATPYGLAAYYFTQDLRRSWRFGEALEFGMVGLNTGIISMEIAPFGGIKQSGLGREGSSYGLDEYLEVKAFHVGGL

SEQ ID NO: 1191 - protein, 327 aa, Bacillus halodurans
MYRKGVIEMNRGVICLGEALIDFIPMDSTNEIYQKSPGGAPANVAVGLAKLGAKSTFVGKVGDDLLGRFLKETLTKANVNTEHMLFSKEVRTGATFVTLAANGERSFDFYINPSADRFLEKGEIAPTLFEEHGVLHFGSISLISEPARTATRHAVSLAKKNGLMISYDPNLRLNLWEDEEQARLLITSMLGEADVLKISEEELAFITGEQTIEAGLDQLVAYNIPLVFVTLGEKGSIVSYNGIQRKIPAMAVQTVDTTGAGDAFVSAILFKLQEERKQVAELSIKEVEQMARFASVSGGLAAATKGAMTALPTLEKVNDILRNEQME

SEQ ID NO: 1192 - protein, 320 aa, Escherichia coli K12
MIKKIGVLTSGGDAPGMNAAIRGVVRSALTEGLEVMGIYDGYLGLYEDRMVQLDRYSVSDMINRGGTFLGSARFPEFRDENIRAVAIENLKKRGIDALVVIGGDGSYMGAMRLTEMGFPCIGLPGTIDNDIKGTDYTIGFFTALSTVVEAIDRLRDTSSSHQRISVVEVMGRYCGDLTLAAAIAGGCEFVVVPEVEFSREDLVNEIKAGIAKGKKHAIVAITEHMCDVDELAHFIEKETGRETRATVLGHIQRGGSPVPYDRILASRMGAYAIDLLLAGYGGRCVGIQNEQLVHHDIIDAIENMKRPFKGDWLDCAKKLY

SEQ ID NO: 1193 - protein, 514 aa, Escherichia coli K12
MASSMLSSATMVASPAQATMVAPFNGLKSSAAFPATRKANNDITSITSNGGRVNCMQVWPPIGKKKFETLSYLPDLTDSGGRVNCMQAMSKSENLYSAARELIPGGVNSPVRAFTGVGGTPLFIEKADGAYLYDVDGKAYIDYVGSWGPMVLGHNHPAIRNAVIEAAERGLSFGAPTEMEVKMAQLVTELVPTMDMVRMVNSGTEATMSAIRLARGFTGRDKIIKFEGCYHGHADCLLVKAGSGALTLGQPNSPGVPADFAKYTLTCTYNDLASVRAAFEQYPQEIACIIVEPVAGNMNCVPPLPEFLPGLRALCDEFGALLIIDEVMTGFRVALAGAQDYYGVVPDLTCLGKIIGGGMPVGAFGGRRDVMDALAPTGPVYQAGTLSGNPIAMAAGFACLNEVAQPGVHETLDELTTRLAEGLLEAAEEAGIPLVVNHVGGMFGIFFTDAESVTCYQDVMACDVERFKRFFHMMLDEGVYLAPSAFEAGFMSVAHSMEDINNTIDAARRVFAKL

SEQ ID NO: 1194 - protein, 532 aa, Bacillus subtilis subsp. subtilis str. 168
MASSMLSSATMVASPAQATMVAPFNGLKSSAAFPATRKANNDITSITSNGGRVNCMQVWPPIGKKKFETLSYLPDLTDSGGRVNCMQAMTKYTREDIEKLVKEENVKYIRLQFTDILGTIKNVEIPVSQLGKALDNKVMFDGSSIEGFVRIEESDMYLYPDLNTFVIFPWTAEKGKVARFICDIYNPDGTPFEGDPRNNLKRILKEMEDLGFSDFNLGPEPEFFLFKLDEKGEPTLELNDKGGYFDLAPTDLGENCRRDIVLELEEMGFEIEASHHEVAPGQHEIDFKYAGAVRSCDDIQTFKLVVKTIARKHGLHATFMPKPLFGVNGSGMHCNLSLFKNGVNAFFDENADLQLSETAKHFIAGIVKHATSFTAVTNPTVNSYKRLVPGYEAPCYVAWSAQNRSPLIRIPASRGISTRVEVRSVDPAANPYLALSVLLAAGLDGIKNKLEAPAPIDRNIYVMSKEERMENGIVDLPATLAEALEEFKSNEVMVKALGEHLFEHFIEAKEIEWDMFRTQVHPWEREQYMSQY

SEQ ID NO: 1195 - protein, 398 aa, Escherichia coli K12
MASSMLSSATMVASPAQATMVAPFNGLKSSAAFPATRKANNDITSITSNGGRVNCMQVWPPIGKKKFETLSYLPDLTDSGGRVNCMQAMVDANKLQQAVDQAYTQFHSLNGGQNADYIPFLANVPGQLAAVAIVTCDGNVYSAGDSDYRFALESISKVCTLALALEDVGPQAVQDKIGADPTGLPFNSVIALELHGGKPLSPLVNAGAIATTSLINAENVEQRWQRILHIQQQLAGEQVALSDEVNQSEQTTNFHNRAIAWLLYSAGYLYCDAMEACDVYTRQCSTLLNTIELATLGATLAAGGVNPLTHKRVLQADNVPYILAEMMMEGLYGRSGDWAYRVGLPGKSGVGGGILAVVPGVMGIAAFSPPLDEDGNSVRGQKMVASVAKQLGYNVFKG

SEQ ID NO: 1196 - protein, 480 aa, Pseudomonas syringae pv. tomato str. DC3000
MEIFMYPDVQLYIDGQWRASRDGRSIPVIDPATGQSLGSVAHAGIADLDEALSAAERGFATWRATSAYDRYKLMQKAADLVRERADSIARIMTQEQGKPLAEARMETLSAADVIDWLAEEGRRSYGRIVPSRGVSIEQKVIKEPVGPVAAFTPWNFPINQVVRKLSSALAAGCSIIVKAPEETPGSPAELIRAFADAGVPAGVIGLVYGDPAEISGYLIPHPVIRKVTFTGSTPVGKQLAALAGKHMKRATMELGGHAPALVFDDADIDLAARVLATAKFRNAGQVCVSPTRILVQRKVLQAFTEKFVGLTREIKVGNGLESGTTMGPVANDRRIPALVDLIEDAVSAGATVSAGGKAVEGQGYFFEPTVLSGLTPAMRIMNEEPFGPVALLVPFDTVEEAIVESNRVPFGLASYAFTTSMKTAQALSTYIEAGMLSINHQGIGLPEVPFGGIKDSGYGSEGGTEAIEAYLNTKLVTQYS

SEQ ID NO: 1197 - protein, 480 aa, Pseudomonas syringae pv. tomato str. DC3000
MQLKDSTLFRQQAYINGQWLDADGGQSIKVNNPATNEILGTVPKMGAAETRRAIEAADKALPAWRALTAKERGNKLRRWFELMIENQDDLGLLMTLEQGKPLAEAKGEITYAASFIEWFAEEAKRVYGDVIPGHQPDKRLIVLKQPIGVTAAITPWNFPAAMITRKAGPALAAGCTMVLKPASQTPFSALALAELAERAGIPAGVFSVVTGSAGDIGSELTGNPIVRKLSFTGSTEIGRQLMAECAKDIKKVSLELGGNAPFIVFDDADLDKAVEGAMISKYRNNGQTCVCANRIYVQDGVYDAFAEKLKVAVGKLKIGNGLEDGITTGPLIDEKAVAKVKEHIADAVSKGATVLTGGNSLEGSFFEPTILVNVSKDAAVAREETFGPLAPLFRFKDEAEAIALANDTEFGLASYFYAQNMSRVFRVAEALEYGMVGINTGLISNELAPFGGIKSSGLGREGSKYGIEDYLEIKYLCLSV

SEQ ID NO: 1198 - protein, 505 aa, Pseudomonas syringae pv. tomato str. DC3000
MDDLLTADEYAAIAQSISFPSNAFINGAYKPAISGATFSTINPATGEFLSDLAACRAEDVDDAVSKAKKAFDDGRWRLLAPGERKSVLLKFARLLEDNRHELAVLESLDSGKPVRECQLVDVPDTIHTLRWHAELIDKLYDHTAPVGNDALTLVVREPIGVVGCVLPWNFPLLMLAWKIGPALAAGCSVIVKPAEQTSLTTLRVAELAFEAGVPAGVLNIITGTGKDVGEPIGLHKDIDMVSFTGSTVTGRRFLHYSADSNLKRVVLECGGKNPAVVMEDAEDLDLVAEQVVNGAFWNMGENCSATSRLLVHASVKDELLERMGAYIREWKMGDPLDPQTRVGALVSSDHFAKVKSYLDYANADKLDIVYGGDTQEGAFVQLTVVDGVERDSRLFQEEIFGPILSVTTFNSISEAIALANDTVYGLAASVYTGSLRKAIKLSREIRAGIVTVNCFGEGDASTPFGGFKESGFGGRDKSVFAHDQYTEIKTIWIDVSDRSVDETVK

SEQ ID NO: 1199 - protein, 426 aa, Acidithiobacillus ferrooxidans
MSAIVRIQAREVLDSRGNPTVEAEVYLDNGGMGRAIVPSGASTGEREAVELRDGGQRYGGKGVRKAVEHVNGEIQDALLGMEAEEQEHIDAALCALDGTENKARLGANAILSVSLATAHAAAHAAGQPLYRYIGGLGPLQLPVPMMNVINGGAHADNDVDMQEFMLIPAGAESFSEALQMGVEVFHSLKAVLQSRGLATTVGDEGGFAPNLPSNEAALELLMDAINKAGYQPGKDIWLGMDVASSEFYRDGRYHLASERRELDSAQFVDYLAALADRYPLISIEDGMDQNDWEGWITLTDRLGDRLQLVGDDIFVTNTTILREGIERGVANSILIKLNQIGTLSETLAAIEMAKVHSYTAIVSHRSGETEDTTLADVAVATGCGQIKTGSLSRTDRVAKYNRLLRIEEDLGDAARYPGLATFYNLD

SEQ ID NO: 1200 - protein, 567 aa, Escherichia coli K12
MASSMLSSATMVASPAQATMVAPFNGLKSSAAFPATRKANNDITSITSNGGRVNCMQVWPPIGKKKFETLSYLPDLTDSGGRVNCMQAMAVPVQHPMYIDGQFVTWRGDAWIDVVNPATEAVISRIPDGQAEDARKAIDAAERAQPEWEALPAIERASWLRKISAGIRERASEISALIVEEGGKIQQLAEVEVAFTADYIDYMAEWARRYEGEIIQSDRPGENILLFKRALGVTTGILPWNFPFFLIARKMAPALLTGNTIVIKPSEFTPNNAIAFAKIVDEIGLPRGVFNLVLGRGETVGQELAGNPKVAMVSMTGSVSAGEKIMATAAKNITKVCLELGGKAPAIVMDDADLELAVKAIVDSRVINSGQVCNCAERVYVQKGIYDQFVNRLGEAMQAVQFGNPAERNDIAMGPLINAAALERVEQKVARAVEEGARVAFGGKAVEGKGYYYPPTLLLDVRQEMSIMHEETFGPVLPVVAFDTLEDAISMANDSDYGLTSSIYTQNLNVAMKAIKGLKFGETYINRENFEAMQGFHAGWRKSGIGGADGKHGLHEYLQTQVVYLQS

SEQ ID NO: 1201 - protein, 535 aa, Escherichia coli K12
MASSMLSSATMVASPAQATMVAPFNGLKSSAAFPATRKANNDITSITSNGGRVNCMQVWPPIGKKKFETLSYLPDLTDSGGRVNCMQAMDQTYSLESFLNHVQKRDPNQTEFAQAVREVMTTLWPFLEQNPKYRQMSLLERLVEPERVIQFRVVWVDDRNQIQVNRAWRVQFSSAIGPYKGGMRFHPSVNLSILKFLGFEQTFKNALTTLPMGGGKGGSDFDPKGKSEGEVMRFCQALMTELYRHLGADTDVPAGDIGVGGREVGFMAGMMKKLSNNTACVFTGKGLSFGGSLIRPEATGYGLVYFTEAMLKRHGMGFEGMRVSVSGSGNVAQYAIEKAMEFGARVITASDSSGTVVDESGFTKEKLARLIEIKASRDGRVADYAKEFGLVYLEGQQPWSLPVDIALPCATQNELDVDAAHQLIANGVKAVAEGANMPTTIEATELFQQAGVLFAPGKAANAGGVATSGLEMAQNAARLGWKAEKVDARLHHIMLDIHHACVEHGGEGEQTNYVQGANIAGFVKVADAMLAQGVI

SEQ ID NO: 1202 - protein, 487 aa, Bacillus subtilis subsp. subtilis str. 168
MASSMLSSATMVASPAQATMVAPFNGLKSSAAFPATRKANNDITSITSNGGRVNCMQVWPPIGKKKFETLSYLPDLTDSGGRVNCMQAMEITPSDVIKTLPRQEFSLVFQKVKEMEKTGAHIINLGQGNPDLPTPPHIVEALREASLNPSFHGYGPFRGYPFLKEAIAAFYKREYGVTINPETEVALFGGGKAGLYVLTQCLLNPGDIALVPNPGYPEYLSGITMARAELYEMPLYEENGYLPDFEKIDPAVLEKAKLMFLNYPNNPTGAVADAAFYAKAAAFAKEHNIHLIHDFAYGAFEFDQKPASFLEAEDAKTVGAELYSFSKTFNMAGWRMAFAVGNEKIIQAVNEFQDHVFVGMFGGLQQAASAALSGDPEHTESLKRIYKERIDFFTALCEKELGWKMEKPKGTFYVWAEIPNTFETSHQFSDYLLEHAHVVVTPGEIFGSNGKRHVRISMVSKQEDLREFVTRIQKLNLPFGSLQETSR

SEQ ID NO: 1203 - protein, 598 aa, Bacillus halodurans
MASSMLSSATMVASPAQATMVAPFNGLKSSAAFPATRKANNDITSITSNGGRVNCMQVWPPIGKKKFETLSYLPDLTDSGGRVNCMQAMSKKPVALIILDGFAMRDEAKGNAVAQANKPNFDRYWNQYPHALLKADGEAVGLPEGQMGNSEVGHLNIGAGRIVYQSLTRVNLSIREGEFFENETFLNAMNHVKEKGSSLHIYGLVSDGGIHSHINHLYALLELAKREQVERVYIHGFLDGRDVGPTSAESYLVDLEAKMKELGVGELATLHGRYYAMDRDKRWDRVEKSYRAMVYGEGPAYSSALDVIKDSYENSIHDEFVIPSVITNEDGSPVATIEDDDAIIFFNFRPDRAIQMSQVFTNKDFRGFDRGEKLPQNVYYVCLTHFSETVQGDVAFKPTNLDNTLGEVLAQQNYKQLRIAETEKYPHVTFFFSGGREEPFPGEERILIDSPKVATYDLKPEMSAYEVTDALLNEIEADKHDVIILNFANPDMVGHSGMLEPTIKAVEAVDECLGKVVDAILAKGGAAVITADHGNADEVVTLEGKPMTAHTTNKVPVIVTEEGLNLREDGILADLSPTVLDLLGGKQPAEMTGKTLIK

SEQ ID NO: 1204 - protein, 424 aa, Desulfitobacterium hafniense
MASSMLSSATMVASPAQATMVAPFNGLKSSAAFPATRKANNDITSITSNGGRVNCMQVWPPIGKKKFETLSYLPDLTDSGGRVNCMQAMGVRIAINGFGRIGRLSMRAILERKSSLDIVAVNDLGSPDLLGHLFKYDSIHDILPYDVEVKENTLEVLDQKVAFLAEKDPGKLPWRELGVDLVIEATGRFTKREQAALHLQAGAKKVIISAPGKHEDITIVMGVNEHLYNPAEHHILSNASCTTNGLAPLAKVLLEEFGIEQGMMTTTHSVTNDQRILDLEHKDWRRARAAYESMIPTTTGATKAVELVLPDLKGKLKGLAVRVPTPNVSLIDFVANLSRSTTKEEVNQKLREAAEGSLKGYLAYSELPLVSHDFNGNPHSAIVDGLSTLMLGERMVKVLAWYDNEWGYSNRIVDLVEYIAGQGL

SEQ ID NO: 1205 - protein, 602 aa, Escherichia coli K12
MASSMLSSATMVASPAQATMVAPFNGLKSSAAFPATRKANNDITSITSNGGRVNCMQVWPPIGKKKFETLSYLPDLTDSGGRVNCMQAMVVSKKPMVLVILDGYGYREEQQDNAIFSAKTPVMDALWANRPHTLIDASGLEVGLPDRQMGNSEVGHVNLGAGRIVYQDLTRLDVEIKDRAFFANPVLTGAVDKAKNAGKAVHIMGLLSAGGVHSHEDHIMAMVELAAERGAEKIYLHAFLDGRDTPPRSAESSLKKFEEKFAALGKGRVASIIGRYYAMDRDNRWDRVEKAYDLLTLAQGEFQADTAVAGLQAAYARDENDEFVKATVIRAEGQPDAAMEDGDALIFMNFRADRAREITRAFVNADFDGFARKKVVNVDFVMLTEYAADIKTAVAYPPASLVNTFGEWMAKNDKTQLRISETEKYAHVTFFFNGGVEESFKGEDRILINSPKVATYDLQPEMSSAELTEKLVAAIKSGKYDTIICNYPNGDMVGHTGVMEAAVKAVEALDHCVEEVAKAVESVGGQLLITADHGNAEQMRDPATGQAHTAHTNLPVPLIYVGDKNVKAVEGGKLSDIAPTMLSLMGMEIPQEMTGKPLFIVE

SEQ ID NO: 1206 - protein, 556 aa, Sinorhizobium meliloti
MASSMLSSATMVASPAQATMVAPFNGLKSSAAFPATRKANNDITSITSNGGRVNCMQVWPPIGKKKFETLSYLPDLTDSGGRVNCMQAMAYDLIVIGSGPGGYVCAIKAAQLGMKVAVVEKRSTYGGTCLNVGCIPSKALLHASEMFHQAQHGLEALGVEVANPKLNLQKMMAHKDATVKSNVDGVSFLFKKNKIDGFQGTGKVLGQGKVSVTNEKGEEQVLEAKNVVIATGSDVAGIPGVEVAFDEKTIVSSTGALALEKVPASMIVVGGGVIGLELGSVWARLGAKVTVVEFLDTILGGMDGEVAKQLQRMLTKQGIDFKLGAKVTGAVKSGDGAKVTFEPVKGGEATTLDAEVVLIATGRKPSTDGLGLAKAGVVLDSRGRVEIDRHFQTSIAGVYAIGDVVRGPMLAHKAEDEGVAVAEIIAGQAGHVNYDVIPGVVYTQPEVASVGKTEEELKAAGVAYKIGKFPFTANGRARAMLQTDGFVKILADKETDRVLGGHIIGFGAGEMIHEIAVLMEFGGSSEDLGRTCHAHPTMSEAVKEAALSTFFKPIHM

SEQ ID NO: 1207 - protein, 521 aa, Synechocystis sp. PCC 6803
MASSMLSSATMVASPAQATMVAPFNGLKSSAAFPATRKANNDITSITSNGGRVNCMQVWPPIGKKKFETLSYLPDLTDSGGRVNCMQAMIYDIFMPALSSTMTEGKIVSWTKSPGDKVEKGETVLVVESDKADMDVESFNEGYLAAILVPAGEEAPVGATLGLVVETEAEIAEAQAKAGSGGGSSAAPTATPAPQQPEPVAIASATAIETTPAPSSNGNGKGSGRIIASPRAKKLAKELKVDLATIAGTGPHGRIVAADIESAAGKPVTASIAAPSAPAPKTSPAPTPRVTSTPSVPVGQTVPLTTFQKALVQNMVAAMAAPTFRVGYTITTDGLDQLYKQIKGKGVTMTALLAKAVALALKKHPIVNASYTDQGIIYHKDVNIALAVAMPDGGLITPVLQNADQVDIYSLSRRWKELVERARAKQLQPEEYSTGTFTISNLGMFGVDRFDAILPPGQGGILAVGASRPQVVANEEGLIGTKRQMAVNVTCDHRVIYGAHAAAFLKDLAVIIEENAQSLTM

SEQ ID NO: 1208 - protein, 975 aa, Xenorhabdus nematophila
MASSMLSSATMVASPAQATMVAPFNGLKSSAAFPATRKANNDITSITSNGGRVNCMQVWPPIGKKKFETLSYLPDLTDSGGRVNCMQAMADILKNDVDPIETRDWLQAIESVIREEGVERAQFLIDQVLNGARKGGVSVAAGVASRDYINTIPVEDEPAYPGNLDLERRIRSAIRWNAVMTVLRASKKDLDLGGHMASFQSSATFYDVCFNHFFRARNENDGGDLVYFQGHISPGVYARAFLEGRLTEEQMNNFRQEIGGNGLSSYPHPKLMPDFWQFPTVSMGLGPISAIYQAKFLKYLEHRGLKNTSQQTVYAFLGDGEMDEPESKGAITIATREKLDNLVFVINCNLQRLDGPVTGNGKIVNELEGIFAGAGWKVLKVLWGERWDELLRKDTSGKLVQLMNETLDGDYQTFKSKDGTYVREHFFGRYPETAALVKDMTDDEIWALNRGGHDPKKVYAALNQAQNTTGQPTVILAQTIKGYGMGDTAEGKNIAHQVKKMNMEGVRHFRDRFNVPVSDEQIEKLPYVTFDKDSEESKYLHEHRNALGGYLPSRRVNFDEKLEIPALEDFSSLLEEQSKEISTTIAFVRALNVMLKNKSIKDRLVPIIADEARTFGMEGLFRQIGIYSPNGQQYTPQDREQVAYYKEDAKGQILQEGINELGAASSWLAAATSYSTNNLPMIPFYIYYSMFGFQRIGDLCWAAGDQQARGFLVGGTSGRTTLNGEGLQHEDGHSHIQSLTIPNCISYDPAFAYEVAVIMHDGLERMYGEKQENIYYYITTLNENYHMPAMPAGAEEGIRKGIYKLEAFDSAKGKVQLLGSGSILRHVREAAKILSDEYGIGSDVYSVTSFTELARDGQDCERWNMLHPSEEPRVPYIAQIMNEAPAVASTDYMKLFAEQVRNFVPASEFRVLGTDGFGRSDSRENLRHHFEVDASYVVVAALGELAKRGEVDVKVVEEAIKKYNINPEKVNPRLA

SEQ ID NO: 1209 - protein, 763 aa, Nostoc punctiforme PCC 73102
MASSMLSSATMVASPAQATMVAPFNGLKSSAAFPATRKANNDITSITSNGGRVNCMQVWPPIGKKKFETLSYLPDLTDSGGRVNCMQAMAVATQSAKELSVEELAINSIRFLAIDAVEKAKSGHPGLPMGAAPMAFVLWDRFLKFNPKNPKWFNRDRFVLSAGHGSMLQYALLYLTGYDSVTIEDIKQFRQWGSKTPGHPENFETPGVEVTTGPLGQGIANGVGLAIAEAHLAAKFNKPDTKIVDHYTYVIVGDGCNMEGISGEACSFAGHLGLGKLIALYDDNHISIDGSTDVAFTEDVSKRFEAYGWHVQHVEDGNTDLAAIAKAIEAAKAVTDKPSFIKVTTIIGYGSPNKANTAGVHGAALGADEIALTRKNLGWEYEPFDVPQEALNHTRKAVERGASYEAEWNKTFADYKAKYAQEAAEFERYLSGKLPDGWDNVLPTYTPEDKGLPTRKHSETCLNKLAAVLPELIGGSADLTHSNLTEIKGKGDFQKGHYENPNIHFGVREHAMGAICNGIALHTSGLIPYGATFLIFTDYMRAAIRLSALSQAGVIWVMTHDSIGQGEDGPTHQPIETLASLRAIPNLLVFRPADGNETSGAYKIAIEKAKQNAPSLLAFTRQNVPNLAGTSVEGVAKGGYTVVDSEGTPDIILIGTGSELSLAVSAAEKLKAEGKKVRVVSLPSWELFEAQDAAYKESILPKAVTKRLSVEAAASFGWHKYVGTEGDTVSIDRFGASAPGNVCLEKFGFSVDNVLAKAKQLLG

SEQ ID NO: 1210 - protein, 391 aa, Saccharomyces cerevisiae
MASSMLSSATMVASPAQATMVAPFNGLKSSAAFPATRKANNDITSITSNGGRVNCMQVWPPIGKKKFETLSYLPDLTDSGGRVNCMQAMTVTDTFKLFILRHGQSELNSENIFCGWIDAQLTEKGKSQARHSAKLIKQFCDSNNISLPQIGYTSRLIRTQQTMDVILEELGLKHTNYVITTNTNIKEELQDTRFEGSMPVLQTWRLNERHYGAWQGQRKPDILKEYGKEKYMYIRRDYNGKPPKVNLNLEMVQEENDQGSSTGYDFKEPNRHLKYGPEEKANERLPESESLCEVVVRLKPFLNNVVLSTANKISQESCVIVGHGSSVRSLLKVLEGISDEDIKDVDIPNGIPLVIELDRDNYSFVRKFYLDPESAKVNAQMVRDEGFEKNP

SEQ ID NO: 1211 - protein, 266 aa, Synechocystis sp.
MASSMLSSATMVASPAQATMVAPFNGLKSSAAFPATRKANNDITSITSNGGRVNCMQVWPPIGKKKFETLSYLPDLTDSGGRVNCMQAMIRLLMVFPQRFSPSHLLSRHWGWLAVAMASLGSLSSLPVNVNSSVVAQTAPSSPMTVRSDIQEANSQTGVVTARGNVQVYYPARNLQATAAQAQYFSQERRLVLSGNVYVLQDGNSMRAETMTYLVDEGRFVANPQANQQVESIYLVEESQSPAGPAPTGPNPLPGDTLPDLPPLGS

SEQ ID NO: 1212 - protein, 336 aa, Arabidopsis thaliana
MSTAPLSGFFLTSLSPSQSSLQKLSLRTSSTVACLPPASSSSSSSSSSSSRSVPTLIRNEPVFAAPAPIIAPYWSEEMGTEAYDEAIEALKKLLIEKEELKTVAAAKVEQITAALQTGTSSDKKAFDPVETIKQGFIKFKKEKYETNPALYGELAKGQSPKYMVFACSDSRVCPSHVLDFQPGDAFVVRNIANMVPPFDKVKYGGVGAAIEYAVLHLKVENIVVIGHSACGGIKGLMSFPLDGNNSTDFIEDWVKICLPAKSKVISELGDSAFEDQCGRCEREAVNVSLANLLTYPFVREGLVKGTLALKGGYYDFVKGAFELWGLEFGLSETSSV

SEQ ID NO: 1213 - protein, 208 aa, Synechocystis sp.
MASSMLSSATMVASPAQATMVAPFNGLKSSAAFPATRKANNDITSITSNGGRVNCMQVWPPIGKKKFETLSYLPDLTDSGGRVNCMQAMIKLFNQASRIFFGIALPCLIFLGGIFSLGNTALAADLAHGKAIFAGNCAACHNGGLNAINPSKTLKMADLEANGKNSVAAIVAQITNGNGAMPGFKGRISDSDMEDVAAYVLDQAEKGW

SEQ ID NO: 1214 - protein, 184 aa, Synechocystis sp.
MASSMLSSATMVASPAQATMVAPFNGLKSSAAFPATRKANNDITSITSNGGRVNCMQVWPPIGKKKFETLSYLPDLTDSGGRVNCMQAMTDPLTPAISDRICKHMNEDHASAIALYAQVFGQQTDVTMAQMQAIDPTGMDLVVESEGGSKTIRIEFEQPLKDSEDAHQVLIAMAKQARSVGKNS

SEQ ID NO: 1215 - protein, 376 aa, Synechocystis sp.
MASSMLSSATMVASPAQATMVAPFNGLKSSAAFPATRKANNDITSITSNGGRVNCMQVWPPIGKKKFETLSYLPDLTDSGGRVNCMQAMINSAVRSLAIVGGVHGNERTGVEVVRRWQQKDFARYFPALKCHYFLANPRAIAANRRYINQDLNRCFRPQDRKNPYLMGYEQLRARQLAHQISLAGIDFIVDLHTTTAAMGTTLILNCPHPLLLNLAAYLSAQDEEIRVLQYSPQKDLPYIRGLCELGLTIELGPVPQGVYDPTAIAKTQRTLARILAYLQASTSGNVPAADNCTVYQQIDTIDYPRDEQGQIVAEIAPHIRDYQAIKPGTPLFYHRRGNVTPYQGAATVYPVFIGEAAYVEKGIAMALTQRKTIAI

SEQ ID NO: 1216 - protein, 454 aa, Saccharomyces cerevisiae
MASSMLSSATMVASPAQATMVAPFNGLKSSAAFPATRKANNDITSITSNGGRVNCMQVWPPIGKKKFETLSYLPDLTDSGGRVNCMQAMISRLPTSLARNVARRAPTSFVRPSAAAAALRFSSTKTMTVREALNSAMAEELDRDDDVFLIGEEVAQYNGAYKVSKGLLDRFGERRVVDTPITEYGFTGLAVGAALKGLKPIVEFMSFNFSMQAIDHVVNSAAKTHYMSGGTQKCQMVFRGPNGAAVGVGAQHSQDFSPWYGSIPGLKVLVPYSAEDARGLLKAAIRDPNPVVFLENELLYGESFEISEEALSPEFTLPYKAKIEREGTDISIVTYTRNVQFSLEAAEILQKKYGVSAEVINLRSIRPLDTEAIIKTVKKTNHLITVESTFPSFGVGAEIVAQVMESEAFDYLDAPIQRVTGADVPTPYAKELEDFAFPDTPTIVKAVKEVLSIE

SEQ ID NO: 1217 - protein, 344 aa, Sinorhizobium meliloti
MASSMLSSATMVASPAQATMVAPFNGLKSSAAFPATRKANNDITSITSNGGRVNCMQVWPPIGKKKFETLSYLPDLTDSGGRVNCMQAMAPDIRPLVAGNWKMNGTRASLDQIKAMAEGVKGDLSARVDALICPPATLLYVATALCDDSPLMIGAQDCHQKQSGAHTGEVSAEMVADCFGTHVIVGHSERRTDHGEGDALVRAKTEAAHGADLVAIVCVGETEEERKAGRTLDILKRQLSESLPDQATAENTVIAYEPVWAIGTGLTPTVSDVEEAHAFMRRELVSRFGAEGGKMRILYGGSVKPSNAKELMGVANVDGALIGGASLKADDFLAIYRAYEELTA

SEQ ID NO: 1218 - protein, 230 aa, Xanthomonas campestris
MASSMLSSATMVASPAQATMVAPFNGLKSSAAFPATRKANNDITSITSNGGRVNCMQVWPPIGKKKFETLSYLPDLTDSGGRVNCMQAMETVRQLLGMKQVEVFSVAADAAVIEAIRLMADKSIGAVLVMEGERLVGIVSERDYARKVVLRDRSSSSTSVAEIMSHAVVTVSPADSVEHCMQLMTDGRFRHLPVVDNGRVQGVISIGDLVKAVIEAQQHDIDQLQRYIAS

SEQ ID NO: 1219 - protein, 508 aa, Agrobacterium tumefaciens
MASSMLSSATMVASPAQATMVAPFNGLKSSAAFPATRKANNDITSITSNGGRVNCMQVWPPIGKKKFETLSYLPDLTDSGGRVNCMQAMTEKRVQPLARDAMAYVLAGGRGSRLKELTDRRAKPAVYFGGKARIIDFALSNALNSGIRRIGVATQYKAHSLIRHLQRGWDFFRPERNESFDILPASQRVSETQWYEGTADAVYQNIDIIEPYAPEYMVILAGDHIYKMDYEYMLQQHVDSGADVTIGCLEVPRMEATGFGVMHVNEKDEIIDFIEKPADPPGIPGNEGFALASMGIYVFHTKFLMEALRRDAADPTSSRDFGKDIIPYIVEHGKAVAHRFADSCVRSDFEHEPYWRDVGTIDAYWQANIDLTDVVPDLDIYDKSWPIWTYAEITPPAKFVHDDEDRRGSAVSSVVSGDCIISGAALNRSLLFTGVRANSYSRLENAVVLPSVKIGRHAQLSNVVIDHGVVIPEGLIVGEDPELDAKRFRRTESGICLITQSMIDKLDL

SEQ ID NO: 1220 - protein, 404 aa, Escherichia coli K12
MASSMLSSATMVASPAQATMVAPFNGLKSSAAFPATRKANNDITSITSNGGRVNCMQVWPPIGKKKFETLSYLPDLTDSGGRVNCMQAMDELDGIKQFTTVVADSGDIESIRHYHPQDATTNPSLLLKAAGLSQYEHLIDDAIAWGKKNGKTQEQQVVAACDKLAVNFGAEILKIVPGRVSTEVDARLSFDKEKSIEKARHLVDLYQQQGVEKSRILIKLASTWEGIRAAEELEKEGINCNLTLLFSFAQARACAEAGVFLISPFVGRIYDWYQARKPMDPYVVEEDPGVKSVRNIYDYYKQHHYETIVMGASFRRTEQILALTGCDRLTIAPNLLKELQEKVSPVVRKLIPPSQTFPRPAPMSEAEFRWEHNQDAMAVEKLSEGIRLFAVDQRKLEDLLAAKL

SEQ ID NO: 1221 - protein, 599 aa, Bacillus subtilis subsp. subtilis str. 168
MASSMLSSATMVASPAQATMVAPFNGLKSSAAFPATRKANNDITSITSNGGRVNCMQVWPPIGKKKFETLSYLPDLTDSGGRVNCMQAMSKKPAALIILDGFGLRNETVGNAVALAKKPNFDRYWNQYPHQTLTASGEAVGLPEGQMGNSEVGHLNIGAGRIVYQSLTRVNVAIREGEFERNQTFLDAISNAKENNKALHLFGLLSDGGVHSHINHLFALLKLAKKEGLTKVYIHGFLDGRDVGPQTAKTYINQLNDQIKEIGVGEIASISGRYYSMDRDKRWDRVEKAYRAMAYGEGPSYRSALDVVDDSYANGIYDEFVIPSVITKENGEPVAKIQDGDSVIFYNFRPDRAIQISNTFTNKDFRDFDRGENYPKNLYFVCLTHFSETVDGYVAFKPINLDNTVGEVLSQHGLKQLRIAETEKYPHVTFFMSGGREAEFPGEERILINSPKVATYDLKPEMSAYEVKDALVKEIEADKHDAIILNFANPDMVGHSGMVEPTIKAIEAVDECLGEVVDAILAKGGHAIITADHGNADILITESGEPHTAHTTNPVPVIVTKEGITLREGGILGDLAPTLLDLLGVEKPKEMTGTSLIQK

SEQ ID NO: 1222 - protein, 490 aa, Pseudomonas fluorescens PfO-1
MASSMLSSATMVASPAQATMVAPFNGLKSSAAFPATRKANNDITSITSNGGRVNCMQVWPPIGKKKFETLSYLPDLTDSGGRVNCMQAMAEQGSPRRFARIDRLPPYVFNITAELKMAARRRGEDIIDLSMGNPDGATPPHIVEKLVQVAQREDTHGYSTSKGIPRLRRAISNWYKERYEVEIDPESEAIVTIGSKEGLAHLMLATLDQGDTVLVPNPSYPIHIYGAVIAGAQVRSVPLVPGVDFFAELERAIRGSIPKPKMMILGFPSNPTAQCVELDFFERVIALAKQYDVLVVHDLAYADIVYDGWKAPSIMQVPGAKDMAVEFFTLSKSYNMAGWRIGFMVGNPELVSALARIKSYHDYGTFTPLQVAAIAALEGDQQCVRDIAEQYRQRRNVLVKGLHELGWMVENPKASMYVWAKIPEAYAHLGSLEFAKKLLAEAKVCVSPGVGFGEYGDDHVRFALIENQDRIRQAVRGIRGMFRADALGTK

SEQ ID NO: 1223 - protein, 556 aa, Pseudomonas syringae pv. tomato str. DC3000
MASSMLSSATMVASPAQATMVAPFNGLKSSAAFPATRKANNDITSITSNGGRVNCMQVWPPIGKKKFETLSYLPDLTDSGGRVNCMQAMAKSVQLIKDHDVKWIDLRFTDTKGTQHHVTMPARDALEDDFFEVGKMFDGSSISGWKGIEASDMILLPDDETAVLDPFTEEPTLILVCDIIEPSTMQGYDRDPRAIARRAEEYLKSTGIGDTVFAGPEPEFFIFDEVKFKSDISGSMFKIYSEQGSWMSDQDVEGGNKGHRPGIKGGYFPVPPFDHDHEIRTAMCNALEEMGQTVEVHHHEVATAGQNEIGVKFNTLVKKADEVQTLKYVVHNVADAYGRTATFMPKPLYGDNGSGMHVHMSIAKDGKNTFAGEGYAGLSDIALYFIGGIIKHGKALNGFTNPATNSYKRLVPGFEAPVMLAYSARNRSASIRIPYVNSPRGRRIEARFPDPAANPYLAFAALLMAGLDGIQNKIHPGDAADKNLYDLPPEEAKEIPQVCGSLKEALEELDKGRAFLTKGGVFSDDFIDAYIALKSEEEIRVRTFVHPLEYELYYSC

SEQ ID NO: 1224 - protein, 478 aa, Sinorhizobium meliloti
MASSMLSSATMVASPAQATMVAPFNGLKSSAAFPATRKANNDITSITSNGGRVNCMQVWPPIGKKKFETLSYLPDLTDSGGRVNCMQAMRTSHLAQMSKRSAVEPFHAMDVLAEATRRRDSGHPVISMAVGQPAHPAPKAALDAARRALDHGRLGYTDALGTHSLKRAIAAHYHSRHGITLDPQRIAVTTGSSAGFNLAFLALFDPGDRVAIARPGYPAYRNIMAALGLEVVEIEANAEAGFTLTPDSLEGAAARAGKPLKGVLLASPANPTGTVTGKAQLKALADYCRDHSIAFISDEIYHGLTFAGEETTALEVADDAVVINSFSKYYCMTGWRIGWMVLPEARVRAFERIAQSLYISPPELSQIAAEAALGAHEELDGYKRAYAANRALLLERLPQIGFSIASPMDGAFYAYADVSRFTNDSMAFARRMLAEIDVAATPGFDFDPLEGHRTMRFSYAGAATEMEEAMNRIARWLA

SEQ ID NO: 1225 - protein, 569 aa, Sinorhizobium meliloti
MASSMLSSATMVASPAQATMVAPFNGLKSSAAFPATRKANNDITSITSNGGRVNCMQVWPPIGKKKFETLSYLPDLTDSGGRVNCMQAMEERMLDKRKFYIDGKWVEPATQNDLLVLNPATEKPIAVISLGTAVDVDRAVAAAKKAFASYSRTSVEERLALLEKLLAIYKRRYDEMADTITAELGAPRTMSHEQQADVGVGHLQGFIDALKRLKLREKLPNGDTLLREPIGVCGLITPWNWPVNQIALKVVPALATGCTCVLKPSEFTPLNAMLYAEMIEEAGFPAGVFNLVNGDGIHAGAALSKHKDIDMMSFTGSTRAGIAVSKDAADTVKRVTLELGGKSPNIVFADADIEERVTASILECFNNSGQSCDAPTRMLVERSAYDEVVEIARRVGMEARVGDPTKVGSHIGPLVSHIQFERVQALIEAGVAEGATLLAGGPGKPEGFETGYFVQPTIFADVDNSMRIAREEVFGPVLSIIPFDTEEEAIAIANDTNYGLAAYVQTRDRERAERVASRLRAGMVHINGGPHRYGSPFGGYKQSGNGREGGMFGLEDFLEVKTVHLPDAA

SEQ ID NO: 1226 - protein, 343 aa, Xenorhabdus nematophila
MASSMLSSATMVASPAQATMVAPFNGLKSSAAFPATRKANNDITSITSNGGRVNCMQVWPPIGKKKFETLSYLPDLTDSGGRVNCMQAMGHPLVMGNWKLNGSTHMVNDLIAGLRKELSNVDGCGVAIAPPTVYVSLAKNALAGSRIALGAQDVDVNLSGAFTGETSAEMLKDVGAKYIIIGHSERRTYHKESDELIAKKFTILKEQGLIPVLCIGETEQENEAGQTEAVCARQIDAVLNTLGAEAFKDTVIAYEPVWAIGTGKSATPAQAQAVHKFIRDHIAKQDAAIAGQVIIQYGGSVNAGNAAELFTQPDIDGALVGGASLKADAFAVIVKAAAEAKKA

SEQ ID NO: 1227 - protein, 615 aa, Bacillus halodurans
MCGITGWVDWRRNLQNETETIKQMAETQTHRGPDDLNVWTEKHAALGHSRLIVVDPEGGCQPMMRERNGKRYTIVYNGELYNTEDLRKELIVKGYQFQGHSDTEVLLVSYIEWGYQCVEKFNGIFAFAIWNDKDQSLFMARDRLGVKPLFYTVRHGFLLFATEIKALLAHPEIEPVLTEEGLSEVLGLGPSRSPGNGVFDDIQELRPAHLLTYDRNGAKVSRYWRLKSMAHSEDAMETAAHLRDLLEDTVERQLFADVPVGMFLSGGVDSSALTAIAALIYEREGKGLIRTYSIDYDENDKYFKANDFQPNADGPWVEKVSTTFRTNHHNAVISIEELANQLKRAVELRDLPGMADVDSSLYWFCKQIKKDVTVGLSGECADEIFGGYPWFHKPEVMNFNGFPWMRSADERQELLHERWRQKLNLPKYVHDRYKETIAETPRFEEDTPEEARRREISYLNMVWFMTTLLDRKDRMSMGASLEVRVPFSDHRIVEYAWNIPWEIKQFGGREKGILRKALEGILPDEVLYRKKSPYPKTHHPKYTKMVQQEMERILGQSDSPLFDVVNRKKLKELTETGGKALTTPYFGQLMTGPQLLAHFIQMEHWLKHYNIKLIG

SEQ ID NO: 1228 - protein, 554 aa, Pseudomonas fluorescens PfO-1
MAYYRTPHDVTALPAWQALKDHRQAMQDFSMREAFNADPQRFNQFTLSSCGLFLDYSKNLINAETRNLLVGLANEVDLKGAIKALFDGEIVNSSEGRPALHTALRRPVGDKLSVNGVNVMPEVHKVLNQITDLVGRIHDGLWRGYTEKPITDVVNIGIGGSFLGPELVSEALLSYAQKGVRCHYLANIDGSEFHELTQKLRAETTLFIVSSKSFNTLETLKNAQAARAWYLAQGGSEAELYRHFIAVSSNNAAAVAFGIREENIFPMWDWVGGRYSLWSAIGLPIALAIGMSNFKELLSGAYTMDQHFQSAPFEQNMPVLLALLGVWYGNFWGAQSHAILPYDHYLRNITKHLQQLDMESNGKSVRQDGTPVSTDTGPVIWGGVGCNGQHAYHQLLHQGTQLIPADFIVPIVSFNPVSDHHQWLYANCLSQSQALMLGKTLPEAEAELRDKGMSEDQVQKLAPHKVIPGNRPSNTLVVERISPRRLGALVAMYEHKVFVQSVVWGINAFDQWGVELGKELGKGVYNRLVGSEETAAEDASTQGLINYFRGRHRG

SEQ ID NO: 1229 - protein, 718 aa, Bacillus subtilis subsp. subtilis str. 168
MVSIRRSFEAYVDDMNIITVLIPAEQKEIMTPPFRLETEITDFPLAVREEYSLEAKYKYVCVSDHPVTFGKIHCVRASSGHKTDLQIGAVIRTAAFDDEFYYDGELGAVYTADHTVFKVWAPAATSAAVKLSHPNKSGRTFQMTRLEKGVYAVTVTGDLHGYEYLFCICNNSEWMETVDQYAKAVTVNGEKGVVLRPDQMKWTAPLKPFSHPVDAVIYETHLRDFSIHENSGMINKGKYLALTETDTQTANGSSSGLAYVKELGVTHVELLPVNDFAGVDEEKPLDAYNWGYNPLHFFAPEGSYASNPHDPQTRKTELKQMINTLHQHGLRVILDVVFNHVYKRENSPFEKTVPGYFFRHDECGMPSNGTGVGNDIASERRMARKFIADCVVYWLEEYNVDGFRFDLLGILDIDTVLYMKEKATKAKPGILLFGEGWDLATPLPHEQKAALANAPRMPGIGFFNDMFRDAVKGNTFHLKATGFALGNGESAQAVMHGIAGSSGWKALAPIVPEPSQSINYVESHDNHTFWDKMSFALPQENDSRKRSRQRLAAAIILLAQGVPFIHSGQEFFRTKQGVENSYQSSDSINQLDWDRRETFKEDVHYIRRLISLRKAHPAFRLRSAADIQRHLECLTLKEHLIAYRLYDLDEVDEWKDIIVIHHASPDSVEWRLPNDIPYRLLCDPSGFQEDPTEIKKTVAVNGIGTVILYLASDLKSFA

SEQ ID NO: 1230 - protein, 1017 aa, Escherichia coli
  misc_feature (197)..(197): Xaa can be any naturally occurring amino acid
  unsure (1)..(1017): unsure at all Xaa locations
MMQVSRRQFFKICAGGMAGTTAAALGFAPSVALAETRQYKLLRTRETRNTCTYCSVGCGLLMYSLGDGAKNAKASIFHIEGDPDHPVNRGALCPKGAGLVDFIHSESRLKFPEYRAPGSDKWQQISWEEAFDRIAKLMKEDRDANYIAQNAEGVTVNRWLSTGMLCASASSNETGYLTQKFSRALGMLAVDNQARVXHGPTVASLAPTFGRGAMTNHWVDIKNANLVVVMGGNAAEAHPVGFRWAMEAKIHNGAKLIVIDPRFTRTAAVADYYAPIRSGTDIAFLSGVLLYLLNNEKFNREYTEAYTNASLIVREDYGFEDGLFTGYDAEKRKYDKSSWTYELDENGFAKRDTTLQHPRCVWNLLKQHVSRYTPDVVENICGTPKDAFLKVCEYIAETSAHDKTASFLYALGWTQHSVGAQNIRTMAMIQLLLGNMGMAGGGVNALRGHSNIQGLTDLGLLSQSLPGYMTLPSEKQTDLQTYLTANTPKPLLEGQVNYWGNYPKFFVSMMKAFFGDKATAENSWGFDWLPKWDKGYDVLQYFEMMKEGKVNGYICQGFNPVASFPNKNKVIGCLSKLKFLVTIDPLNTETSNFWQNHGELNEVDSSKIQTEVFRLPSTCFAEENGSIVNSGRWLQWHWKGADAPGIALTDGEILSGIFLRLRKMYAEQGGANPDQVLNMTWNYAIPHEPSSEEVAMESNGKALADITDPATGAVIVKKGQQLSSFAQLRDDGTTSCGCWIFAGSWTPEGNQMARRDNADPSGLGNTLGWAWAWPLNRRILYNRASADPQGNPWDPKRQLLKWDGTKWTGWDIPDYSAAPPGSGVGPFIMQQEGMGRLFALDKMAEGPFPEHYEPFETPLGTNPLHPNVISNPAARIFKDDAEALGKADKFPYVGTTYRLTEHFHYWTKHALLNAILQPEQFVEIGESLANKLGIAQGDTVKVSSNRGYIKAKAVVTKRIRTLKANGKDIDTIGIPIHWGYEGVAKKGFIANTLTPFVGDANTQTPEFKSFLVNVEKV

SEQ ID NO: 1231 - protein, 548 aa, Xenorhabdus nematophila
MKNINPSQTEAWKALQQHFEQIKDTHLRDLFEQDKARFATFSATFDDQMLVDYSKNRITAETLEKLQALAKETDLSGAIHSMFSGEKINRTEDRAVLHIALRNRSNSPIKVDEEDVMPQVNAVLAKMKSFSERIISGEWKGYTGKAITDVVNIGIGGSDLGPYMVTEALKAYKNHLNMHFVSNVDGTHIAETLKSLDPETTLFLIASKTFTTQETMTNAHSARDWFLQSAVDEVHVAKHFAALSTNEQEVSKFGIDPQNMFEFWDWVGGRYSLWSAIGLSIVLSIGYDNFEQLLNGAHAMDKHFAQTAPEQNIPVILALIGIWYNNFFGAETEAILPYDQYMHRFAAYFQQGNMESNGKYIDRNGSPVDYQTGPIIWGEPGTNGQHAFYQLIHQGTKLIPCDFIAPAISHNPIGDHHSKLLSNFFAQTEALAFGKTQAQVEAEFVAAGKNVQDVANVVPFKVFEGNRPTNSILLREITPFSMGALIAMYEHKIFAQGAILNIFSFDQWGVELGKQLANRILPELHDSESVNSHDSSTNGLINRFKEWR

SEQ ID NO: 1232 - protein, 245 aa, Arabidopsis thaliana
MSEDPEYRCFIGGLAWTTSDRGLRDAFEKYGHLVEAKVVLDKFSGRSRGFGFITFDEKKAMDEAIAAMNGMDLDGRTITVDKAQPHQGGAGRDNDGDRGRDRGYDRDRSRPSGGRGGGDCFKCGKPGHFARECPSESSRDGGGRFSSKDDRYSSKDDRYGAKDDRYGAKEDRYGAKDDRYSSKDDRYSSKDDRYGSRDGGGSRYGPDRSGERAGGRSRDGGSRGAPGGERHSRAPYDRPRAGGFH

SEQ ID NO: 1233 - protein, 186 aa, Arabidopsis thaliana
MGSRDQKVKWSWSSALIGAASATAAASLLSAKPKDPTFHLISIDLTSLKLNLPVLDAELMLTVHVTNPNIAAIHYSSTKMTILYDGTVLGSAEVKAGSQPARSCQLLRLPARLDGMELAQHARQFFSDVANREMKLEAKLTIEGAAKVLWWDHSFRVHVDSFVTVDPVFLDVIGQENKSQMDLFLT

SEQ ID NO: 1234 - protein, 379 aa, Arabidopsis thaliana
MEIDSEISDSSSSNNSMIPPLPQNPILTVKLSPIILHVRRCSKNIKKKKRTRTPLKKKKKSISSSVESIIGVSFKSASQKHSTTVTRDGGVKKISSWVKSRLLGEGAYGCVYLATSKDDIYKTERAIKSADVLKAWSLMHEGRILRSLQSPFVIRCYGHEIAREGTGHQYNLILEYCSGQCLADMIEDNQGGIPEFDVKQFAIDVLSGLSYIHRRNIIHCEIKPDNLLLSPVDHRFRSNGFLTKIADFGLSMEKGSKEYGNGRGHMRGTTRYMAPELIGGGLLDFAVDICAFGCSVLEMLTGKRVWGEYGDLAHDDWVDLIGHSDLTPQISIRLSAEAQDFLMRCLVKEPGSRWTIGELVDHPFLCSDEEFSHNGFVYD

SEQ ID NO: 1235 - protein, 115 aa, Arabidopsis thaliana
MASLNSDVIMGESSSISVPSSSSKNSKRFELKKWSAVALWAWDIVVDNCAICRNHIMDLCIECLANQASATSEECTVAWGVCNHAFHFHCISRWLKTRQVCPLDVCEWEFQKYGH

SEQ ID NO: 1236 - protein, 128 aa, Arabidopsis thaliana
MESYQNQSGAQQTHQQLDQFGNPFPATTGAYGTAGGAPAVAEGGGLSGMLHRSGSSSSSSSEDDGLGGRRRKKKGITEKIKEKLPGHHDSNKTSSLGSTTTAYDTGTVHHEKKGMMEKIKEKLPGGHH

SEQ ID NO: 1237 - protein, 442 aa, Arabidopsis thaliana
MSELKERLLPPRPASAMNLRDASVTRPSASGRPPLLGVDVLGLKKRGQGLRSWIRVDTSGNTQVMEVDKFTMMRRCDLPARDLRLLDPLFVYPSTILGREKAIVVNLEQIRCIITADEVLLLNSLDNYVLRYVVELQQRLKTSSVGEMWQQENSQLSRRRSRSFDNAFENSSPDYLPFEFRALEIALEAACTFLDSQASELEIEAYPLLDELTSKISTLNLERVRRLKSRLVALTRRVQKVRDEIEQLMDDDGDMAEMYLTEKKRRMEGSMYGDQSLLGYRSNDGLSVSAPVSPVSSPPDSRRLDKSLSIARSRHDSARSSEGAENIEELEMLLEAYFVVIDSTLNKLTSLKEYIDDTEDFINIQLDNVRNQLIQFELLLTTATFVVAIFGVVAGIFGMNFEIDFFNQPGAFRWVLIITGVCGFVIFSAFVWFFKYRRLMPL

SEQ ID NO: 1238 - protein, 512 aa, Arabidopsis thaliana
MTRRKSTVVLPQPIRRSARLISLQNRDSQVKPRKDLGFGSEPTKKTRREVLRGLSKRLVYSSDSPIEDSRSKKLNISKDGFPSLRRSLRLSSRECPEVNKEKPKTASTSSSRTKSSTTVSSSCALRRSPRFSSGGGESVDQSSSSIGKKSGNSVLSSCSTKSISSEKVKGGDGLKSKDRSRSRVRPKTKKMFSGCDDNEEEEEEVSVCLTERKRMRIAKPNEEENAEAKADEVKRKGKEEEEEEDEEEGLKAKNKLEKGGWTEELELALQGAYLTVKPSPNFWKKVAKMVPGKSAQECFDRVNSALITPRQAQPRRATKTILSTIPQFSLSASKLLKPNSPKTKIRQRRNNLSKKVVRHLLEKQNHMDQGLGFDLFSVLEPNTTSNFLSTPMEKGRSLPKILESPVPCSSKDPTTLVSPPVLKQVKNKALHEKYIDHLHIRDAKRKAESTRLAGKENIRPIEIQKKDSVRAAKDALFFDVQDAIQKLKGLEAENSSSSSEFCYDHVETDEED

SEQ ID NO: 1239 - protein, 406 aa, Arabidopsis thaliana
MGPIKTIKKKKRAEKKVDRNVLLAATAAATSASAAAALNNNDDDDDSSSQSLDWWDGFSRRIYGGSTDPKTFESVFKISRKTFDYICSLVKADFTAKPANFSDSNGNPLSLNDRVAVALRRLGSGESLSVIGETFGMNQSTVSQITWRFVESMEERAIHHLSWPSKLDEIKSKFEKISGLPNCCGAIDITHIVMNLPAVEPSNKVWLDGEKNFSMTLQAVVDPDMRFLDVIAGWPGSLNDDVVLKNSGFYKLVEKGKRLNGEKLPLSERTELREYIVGDSGFPLLPWLLTPYQGKPTSLPQTEFNKRHSEATKAAQMALSKLKDRWRIINGVMWMPDRNRLPRIIFVCCLLHNIIIDMEDQTLDDQPLSQQHDMNYRQRSCKLADEASSVLRDELSDQLCGKNSSA

SEQ ID NO: 1240 - protein, 122 aa, Arabidopsis thaliana
MNPRREPRGGRSSLFDGIEEGGIRAASSYSHEINEHENERALEGLQDRVILLKRLSGDINEEVDTHNRMLDRMGNDMDSSRGFLSGTMDRFKTVFETKSSRRMLTLVASFVGLFLVIYYLTR

SEQ ID NO: 1241 - protein, 343 aa, Arabidopsis thaliana
MGKEVDNKFTWVIKNFSSQQSRKNYSDEFFVDGCKWRLLAFPKGNGVEKLSLYLAVAGSEFLPDGWRRHAYFHFSVVNQLSDELSQARETKNWFDASTSDWGFTSMLSLKKLHDKDGGFLVNGELKIVVDVSVLEVIGKLDVPVESEETTTKALSELEENDVPEESEETTKALSKVDENDGAESNDSLKEASSVKESMDVNGFRVLPSQVETVSCIFERHPDIASEFGPKNQHLRSAYMNVLLSLIKTMCQSTQELSKDDLSDADAALAYLTDAGLNLNWLEEKLEEVSEKKENEEAGETRVHEIEEELKELKLKCSNLEAQLEKEKADVSVARAPFSFDDIV

SEQ ID NO: 1242 - protein, 416 aa, Arabidopsis thaliana
MKKILERSMEGSGTWQGLVLVGIVTWICASSYLKFTHKFRSLLQPWVARQVVGGVPLILRIQKCQNGVLDAFFSGLSCVVSVPFYTAFLPLLFWSGHGRLARQMTLLIAFCDYLGNCIKDVVSAPRPSCPPVRRITATKDEEDNAMEYGLPSSHTLNTVCLSGYLLHYVLSSLEYESVSIQYYGFALACLLVALIAFGRVYLGMHSVVDIVSGLAIGVLILGLWLTVNEKLDDFITSKQNVSSFWTALSFLLLFAYPTPEHPTPSYEYHTAFNGVTLGIVTGVQQTYSQFHHEAAPRIFSPELPISSYLGRVMVGIPTILLVKFCSKSLAKWTLPMVSNALGIPIRSSMYIPKLKGYASGKKTDEPKNSVGYLQKLCEFLSHDSFDIDTGIRFFQYAGLAWSVVDLVPSLFSYVNL

SEQ ID NO: 1243 - protein, 154 aa, Arabidopsis thaliana
MSLDANTCSIVFFLFFTVSFAVSGQKPTAYDAVKLYNLPPGILPKGVVDYELNPKTGNFKVYFNDTCEFTIQSYQLKYKSTISGVISPGHVKNLKGVSVKVLFFWVNIAEVSLDGADLDFSVGIASASFPAANFEESPQCGCGFDCNNGLLFSS

SEQ ID NO: 1244 - protein, 422 aa, Arabidopsis thaliana
MTMNSLPRRFGKNHGYLDRDYRNGRRSGSDSDEELKGLSHEEYRRQKRLKMRKSAKFCFWENTPSPPRDQNEDSDENADEIQDKNGGERDDNSKGKERKGKSDSESESDGLRSRKRKSKSSRSKRRRKRSYDSDSESEGSESDSEEEDRRRRRKSSSKRKKSRSSRSFRKKRSHRRKTKYSDSDESSDEDSKAEISASSSGEEEDTKSKSKRRKKSSDSSSKRSKGEKTKSGSDSDGTEEDSKMQVDETVKNTELELDEEELKKFKEMIELKKKSSAVDEEEEEGDVGPMPLPKAEGHISYGGALRPGEGDAIAQYVQQGKRIPRRGEVGLNAEEIQKFEDLGYVMSGSRHQRMNAIRIRKENQVYSAEDKRALAMFNYEEKAKREAKVMSDLQRLVQRHMGEEVGPNHDPFGAGKTEEDDD

SEQ ID NO: 1245 - protein, 181 aa, Arabidopsis thaliana
MEEVKKDVYSVWALPDEESEPRFKKLMEALRSEFTGPRFVPHVTVAVSAYLTADEAKKMFESACDGLKAYTATVDRVSTGTFFFQCVFLLLQTTPEVMEAGEHCKNHFNCSTTTPYMPHLSLLYAELTEEEKKNAQEKAYTLDSSLDGLSFRLNRLALCKTDTEDKTLETWETVAVCNLNP

SEQ ID NO: 1246 - protein, 202 aa, Arabidopsis thaliana
  misc_feature (114)..(114): Xaa can be any naturally occurring amino acid
  unsure (1)..(202): unsure at all Xaa locations
SSRTIDEHLPLSRATPSSLSNAYSSPLSPPIPLAITNINLQTSPPKLPRTQGNSSEASPGLTQVVPEKKTWHVDDLTDFELKKQYREAIDECPICLEGILFIIQSYMLNITFWXISSSCLFAEYEIDNPKLLTKCGHDFHLACILAWMERSEACPVCDKVCVRLKSAIFTIHFELLESLESVLTIESTFWVFFSQELVLTES

SEQ ID NO: 1247 - protein, 176 aa, Arabidopsis thaliana
MSITIPYDGSISREPSPSPPPPKANTKNLPTKILSNFLIGLIMIPVAITAFIFILTSLGFTFFFAFYWFLQRNYRHRLRRHRRHEYSDGLSPRCVKRLPQFKYCEPSSEYGGDDCVVCIDGFRQGQWCRKLPRCGHVFHRKCVDLWLIKVSTCPICRDRVYRFEEGRRWRPQGEIF

SEQ ID NO: 1248 - protein, 571 aa, Arabidopsis thaliana
MSSFNLSVDVNQNGNIKNVDSLSTLDDIDDIDFAKLLEKPRPLNIDRLRSLDERSLTELTGSPQLRNADNASRAPDHADYVISPSFGRRSGFNTPRSQPGFESHPMVGEAWDALRRSMVYFRGQPVGTIAAVDNSEEKLNYDQVFVRDFVPSALAFLMNGEPDIVKNFLLKTLRLQSWEKKIDRFQLGEGVMPASFKVFHDPVRNHETLIADFGESAIGRVAPVDSGFWWIILLRAYTKSTGDSSLADMPECQKGIRLILSLCLSEGFDTFPTLLCADGCCMIDRRMGVYGYPIEIQALFFMALRCALLLLKHDGEGKEMVEQIVKRLHALSYHMRSYFWLDLKQLNDIYRYKTEEYSHTAVNKFNVIPDSLPEWVFDFMPPHGGFFIGNVSPARMDFRWFALGNCIAILSSLATPEQSTAIMDLIESRWEELVGEMPLKVCYPAIESHEWRIVTGCDPKNTRWSYHNGGSWPVLLWLLTAACIKTGRPQIARRAIEVAEARLHKDHWPEYYDGKVGRYVGKQSRKNQTWSVAGYLVAKMMLEDPSHVGMVCLEEDKQMKPVMRRSNSWTC

SEQ ID NO: 1249 - protein, 354 aa, Arabidopsis thaliana
MGKLLCDSTATFQSPSPTVPWREPSTVAVSLEDVDLVDQSAAAAAVDAVEKTMAAATTTAWDEVFGLEEAQRRHLSRLHARGVLWKHPGKDESSASVVFRLSHGGEVSSDGNCLFTASQKAMEARGIDARDLRRRTVRRFLEDFRSASEEEKEVITDAIRHMYSPDLKSGWGIHIVQEEKLLAKKDERESLDSAIEELLQIGMHRETAAESIYRERCLPVNDGLSWSKYMSISGSTEDEYDIITLQYTEDGLLSVDENREGRAAAFGDDIAIECLATEFKREIYVVQAHGSDGMVEEENCVFFLPHKPRSEVLEVPVFLFMKGTGWCGGGADHYEPLIANPSPLISHEKVALVL

SEQ ID NO: 1250 - protein, 76 aa, Arabidopsis thaliana
MCPMRFLLVFFSAVLAGYFAWKTVSSSPEFDSPDELNEKQELNLKKKMENGFWVFVDMASGRYLWRNLKEMREKSQ

SEQ ID NO: 1251 - protein, 361 aa, Arabidopsis thaliana
MSLSLPSSSAAAAAASTSGSSSSPAAASSSSTTTSWFSGIVRGRGDKSGTAKLSKSSSMAGGGSGSGDYGGPIKGKNQFRGVLFKYGPKSIQVAFKTGEYKQQVIFIGGLTDGLLATDYLEPLAIALDKEKWSLVQLLMSSSYSGFGTSSLKQDAQEIDQLINHLINKENSEGVVLLGHSTGCQDIVYYMGTNAACSRAVRAAILQAPVSDREYKATLPETPAMIDLAANMIKEGRGEELMPREADPCAPISAYRYHSLCAYMGDDDMFSSDLSDDQLKTRLGHMANTPCQVIFSMGDEYVPDYVDKKALVNRLSKAMGGAEKVEIEHGNHSLSNRVHEAVQAIIGFVKREGPSGWDDPWS

SEQ ID NO: 1252 - protein, 135 aa, Arabidopsis thaliana
MTMFRSISMVMLLVALVTFISMVSSAASSPEADFVKKTISSHKIVIFSKSYCPYCKKAKSVFRELDQVPYVVELDEREDGWSIQTALGEIVGRRTVPQVFINGKHLGGSDDTVDAYESGELAKLLGVSGNKEAEL

SEQ ID NO: 1253 - protein, 422 aa, Arabidopsis thaliana
MADLIPFYLNIVAFLCTVGAIALAIFHIYRHLLNYTEPTYQRYIVRIIFMVPVYAFMSFLSLVLPKSSIYFDSIREVYEAWVIYNFLSLCLAWVGGPGSVVLSLSGRSLKPSWSLMTCCFPPLTLDGRFIRRCKQGCLQFVILKPILVAVTLVLYAKGKYKDGNFNPDQAYLYLTIIYTISYTVALYALVLFYMACRDLLQPFNPVPKFVIIKSVVFLTYWQGVLVFLAAKSGFIKSAEAAAHFQNFIICVEMLIAAACHFYAFPYKEYAGANVGGSGSFSGSLSHAVKLNDFYHDTVHQFAPTYHDYVLYNHQDGGDEGTKKYRSRTFVPTGQEMDAMRKNKPVYANKIDGVSVSSSLSSEASSPKSSSVTSDPARSDAVKSSLLVDASDSLETMYDMSLIDIDLSSFPSNVPSASESGPR

SEQ ID NO: 1254 - protein, 344 aa, Arabidopsis thaliana
MAGSEEVNLIESKTVVPLNTWVLISNFKLAYNLLRRPDGTFNRHLAEFLDRKVPANANPVNGVFSFDVIIDRQTNLLSRVYRPADAGTSPSITDLQNPVDGEIVPVIVFFHGGSFAHSSANSAIYDTLCRRLVGLCGAVVVSVNYRRAPENRYPCAYDDGWAVLKWVNSSSWLRSKKDSKVRIFLAGDSSGGNIVHNVAVRAVESRIDVLGNILLNPMFGGTERTESEKRLDGKYFVTVRDRDWYWRAFLPEGEDREHPACSPFGPRSKSLEGLSFPKSLVVVAGLDLIQDWQLKYAEGLKKAGQEVKLLYLEQATIGFYLLPNNNHFHTVMDEIAAFVNAECQ

SEQ ID NO: 1255 - protein, 454 aa, Arabidopsis thaliana
MNPTQKPEPVYDMVILGASGFTGKYVVREALKFLQTPSSSPLKSLALAGRNPTRLTQSLEWAARPNPPPSSVAILTADTSDPDSLRRLCTQTKLILNCVGPFRIHGDPVVSACADSGCDYLDISGEPEFMERMEANYHDRAEETGSLIVSACGFDSIPAELGLLFNAKQWVSPSVPNQIEAYLSLESDKKIAGNFGTYESAVLGVANAEKLKELRRSRPRRPRPTICGPPAKGPTLENQKTIGLWALKLPSADAVVVRRTLTTLTEKPHGLPGINESPEQIQKREAFWSSIKPAHFGVKITSKSLFGIFRYVTLGVSLGLLSKFSFGRWLLLKFPSVFSLGWFQKKGPSEEEVESATFKMWFIGRGYSEESLASQGETKPDLEIITRISGPEIGYITTPITLVQCGLIVLGQRESLVKGGVYTPGIVFGSTDIQQRLEDNGISFELISKIKTQG

SEQ ID NO: 1256 - protein, 395 aa, Arabidopsis thaliana
MAVIIPRSDPPSRIHPEPPQTLEIDHFDHLPDSILLLVFNKIGDVKALGRCCVVSRRFHSLVPQVDNVVVRVDCVISDDDSSSLSSIKSRSGSSAGSFSAIFRLVVGGIVKPLQALGQFLGTKRSSSSCGGSGSSSSSLSISGDDDGGEIEQGGVTHHSPTQVLKNFDEIRYLRIELPSGELGIDDGVLLKWRAEFGSTLDNCVILGASSVIPPNPMRVSQACDTTTVVEAPGSGSDDNGSIPESFYTNGGLKLRVVWTISSLIAASARHYLLQPIIAEHKTLDSLVLTDSDGQGVLCMNRDQLEELRVKPLAASSASKRTLVPALNMRLWYAPTLELPDGTVLKGATLVAIRPSESKKEVSDISWVSSAFEEPYETAAKMLVKRRTYCLEMNSF

SEQ ID NO: 1257 - protein, 346 aa, Arabidopsis thaliana
MDSLTGFRMEPKWQIDPQLLFVGPKIGEGAHAKVYEGKYKNQTVAIKIVHRGETPEEIAKRDSRFLREVEMLSRVQHKNLVKFIGACKEPVMVIVTELLQGGTLRKYLLNLRPACLETRVAIGFALDIARGMECLHSHGIIHRDLKPENLLLTADHKTVKLADFGLAREESLTEMMTAETGTYRWMAPELYSTVTLRLGEKKHYNHKVDAYSFAIVLWELLHNKLPFEGMSNLQAAYAAAFKNVRPSAESLPEELGDIVTSCWNEDPNARPNFTHIIELLLNYLSKVGSPISAIPQRILASKNTLLPPDSPGTSSLMAKLDECGETPKAKSEDKRKGLFFCFNQCY

SEQ ID NO: 1258 - protein, 416 aa, Arabidopsis thaliana
MIYTAIDNFYLSDEQLKASPSRKDGIDETTEISLRIYGCDLIQEGGILLKLPQAVMATGQVLFQRFYCKKSLAKFDVKIVAASCVWLASKLEENPKKARQVIIVFHRMECRRENLPLEHLDMYAKKFSELKVELSRTERHILKEMGFVCHVEHPHKFISNYLATLETPPELRQEAWNLANDSLRTTLCVRFRSEVVACGVVYAAARRFQVPLPENPPWWKAFDADKSSIDEVCRVLAHLYSLPKAQYISVCKDGKPFTFSSRSGNSQGQSATKDLLPGAGEAVDTKCTAGSANNDLKDGMVTTPHEKATDSKKSGTESNSQPIVGDSSYERSKVGDRERESDREKERGRERDRGRSHRGRDSDRDSDRERDKLKDRSHHRSRDRLKDSGGHSDKSRHHSSRDRDYRDSSKDRRRHH

SEQ ID NO: 1259 - protein, 304 aa, Arabidopsis thaliana
MAIISEVEEESSSSRPMIFPFRATLSSANPLGFLEKVFDFLGEQSDFLKKPSAEDEIVVAVRAAKEKLKKAEKKKAEKESVKPVEKKAEKEIVKLVEKKVEKESVKPTIAASSAEPIEVEKPKEEEEKKESGPIVPNKGNGTDLENYSWIQNLQEVTVNIPVPTGTKARTVVCEIKKNRLKVGLKGQDPIVDGELYRSVKPDDCYWNIEDQKVISILLTKSDQMEWWKCCVKGEPEIDTQKVEPETSKLGDLDPETRSTVEKMMFDQRQKQMGLPTSEELQKQEILKKFMSEHPEMDFSNAKFN

SEQ ID NO: 1260 - protein, 311 aa, Arabidopsis thaliana
MAMEIGEDEWKVCCGSSEFAKQMSTSGPLTSQEAIYTARDIWFNQVNVTDWLEAFSAHPQIGNTPSPSINSDFARRSVSEQSTAFATTSASALQELAEWNVLYKKKFGFIFIICASGRTHAEMLHALKERYENRPIVELEIAAMEQMKITELRMAKLFSDKAKVISETDSSSSPVSTKPQAEAKAPKRSRPPITTHVLDVSRGAPAAGVEVHLEVWSGTTGPSFVHGGGGVWSSVGTSATDRDGRSGPLMDLVDALNPGTYRISFDTAKYSPGCFFPYVSIVFQVTESQKWEHFHVPLLLAPFSFSTYRGS

SEQ ID NO: 1261 - protein, 464 aa, Arabidopsis thaliana
MVGGRGGVGGGGGNRVEADQWLVTSEKLLASSDLQGAKTFAIRACEADPTRAEAADYILAICDILLAGETRLGDSNLPDWYAVLRLGRLAQNPEHVATQYRRLALLLNPSVNRLPFADRALKIVSDAWFVLSDPFKKSFYDRELQLSQLGQSGFHPQTQSHQNFQWEPSSSTAVYPPPRSQSQAGTSADPMATSFWTACPYCFVLFEYPKAYEECTLKCQECRRAFQAVTIPKPPVDKKDDEDVYFCSWALFPLGFSGEFQAPSWSPISPLFACPLQKLDGEPKKRKEPGPPRIYYDDDDIYVAISDGDDAGDDGDWQDVVQVNKKTNVGKGKETYVRSNKKHGVEEVQNVESISSASNHAVSIASNAAAVGSSTGVMSKPGSYITRKRMGTGAKNLGRLDLNVEFSNEVEEPGVAGGGNAGNGIGSNREVDNMEGIGFFEGLDEFLNSLPILSVVGDDKIKAT

SEQ ID NO: 1262 - protein, 444 aa, Arabidopsis thaliana
MAKKRDRIVNTQPFISDDASVASSRKRSKVPKTHQKQEKLIEAGMSEKIMKQALAQQKEVADEENAERNPSSAAFAVAGAATAGEEQKILEEEEDDIDDFDGTFENQSQFDKQEEINEDDEKLFESFLNKNAPPQRTLTDIIIKKLKDKDADLAEEERPDPKMDPAITKLYKGVGKFMSEYTVGKLPKAFKLVTSMEHWEDVLYLTEPEKWSPNALYQATRIFASNLKDRQVQRFYNYVLLPRVREDIRKHKKLHFALYQALKKSLYKPSAFNQGILFPLCKSGTCNLREAVIIGSILEKCSIPMLHSCVALNRLAEMDYCGTTSYFIKVLLEKKYCMPYRVLDALVAHFMRFVDDIRVMPVIWHQSLLTFVQRYKYEILKEDKEHLQTLLQRQKHHLVTPEILRELKDSRNRGEKEDPMVDNFAPVPAKEDRFDIPEVPMEED

SEQ ID NO: 1263 - protein, 220 aa, Arabidopsis thaliana
MATVKGLLKGLRYITQIFDEEKDKDMQIGFPTDVKHVAHIGSDGPATNVPSWMGDFKPQENENGQVVSRADANNNQIGEGVGLQELLPPTDKPKHKKTRRKSETVSQNGSPPRRNSSASASDMQPKNTRRHHRSRHGSIDSSNDPSVRRRRVVSVTTNDMEGSYPLSDSSTHSRKSTSRHRKPKGSGGGELSMKKTKGKTENPIVESVDTCNDNNISDKE

SEQ ID NO: 1264 - protein, 645 aa, Arabidopsis thaliana
MLKTLLVQWLVFFFFFLIGSVVTAAEDDGSLSLCNCDDEDSLFSYETILNSQKVGDFLIAIAYFSIPIELVYFVSRTNVPSPYNWVVCEFIAFIVLCGMTHLLAGFTYGPHWPWVMTAVTVFKMLTGIVSFLTALSLVTLLPLLLKAKVREFMLSKKTRELDREVGIIMKQTETSLHVRMLTTKIRTSLDRHTILYTTLVELSKTLGLKNCAVWIPNEIKTEMNLTHELRPRIDDENENEHFGGYAGFSIPISESDVVRIKRSEEVNMLSPGSVLASVTSRGKSGPTVGIRVPMLRVCNFKGGTPEAIHMCYAILVCVLPLRQPQAWTYQELEIVKVVADQVAVAISHAVILEESQLMREKLAEQNRALQVARENALRANQAKAAFEQMMSDAMRCPVRSILGLLPLILQDGKLPENQTVIVDAMRRTSELLVQLVNNAGDINNGTIRAAETHYFSLHSVVKESACVARCLCMANGFGFSAEVYRALPDYVVGDDRKVFQAILHMLGVLMNRKIKGNVTFWVFPESGNSDVSERKDIQEAVWRHCYSKEYMEVRFGFEVTAEGEESSSSSSGSNLEEEEENPSLNACQNIVKYMQGNIRVVEDGLGLVKSVSVVFRFQLRRSMMSRGGGYSGETFRTSTPPSTSH

SEQ ID NO: 1265 - protein, 348 aa, Arabidopsis thaliana
MEKPKFKTVQEVVAAGQGLPERYLHAPTGEGESQPLNGAVPEMDIPAIDLSLLFSSSVDGQEEMKKLHSALSTWGVVQVMNHGITEAFLDKIYKLTKQFFALPTEEKHKCARETGNIQGYGNDMILSDNQVLDWIDRLFLTTYPEDKRQLKFWPQVPVGFSETLDEYTMKQRVLIEKFFKAMARSLELEENCFLEMYGENAVMNSRFNFFPPCPRPDKVIGIKPHADGSAITLLLPDKDVEGLQFLKDGKWYKAPIVPDTILITLGDQMEIMSNGIYKSPVHRVVTNREKERISVATFCVPGLDKEIHPADGLVTEARPRLYKTVTKYVDLHYKYYQQGRRTIEAALI

SEQ ID NO: 1266 - protein, 252 aa, Arabidopsis thaliana
MTEYKQEQEMEIEALEAILMDEFKEIHSSESGLNTSNRCFQITVTPQDDELEELAIPPVQLALVFSHTENYPDEAPLLDVKSIRGIHVSDLTILKEKLEQEASENLGMAMIYTLVSSAKDWLSEHYGQDDAAEFAEVEAAKEDEVIVPHGEPVTLETFLAWRERYEAELALERAKLMPESALTAPKEKKLTGRQWFESGRGRGTVVIADEEDEEEDEEDIDFEDEDFEDDEEDMLEHYLAEKSDSSAPPTRT

SEQ ID NO: 1267 - protein, 537 aa, Arabidopsis thaliana
MELSLLRPTTQSLLPSFSKPNLRLNVYKPLRLRCSVAGGPTVGSSKIEGGGGTTITTDCVIVGGGISGLCIAQALATKHPDAAPNLIVTEAKDRVGGNIITREENGFLWEEGPNSFQPSDPMLTMVVDSGLKDDLVLGDPTAPRFVLWNGKLRPVPSKLTDLPFFDLMSIGGKIRAGFGALGIRPSPPGREESVEEFVRRNLGDEVFERLIEPFCSGVYAGDPSKLSMKAAFGKVWKLEQNGGSIIGGTFKAIQERKNAPKAERDPRLPKPQGQTVGSFRKGLRMLPEAISARLGSKVKLSWKLSGITKLESGGYNLTYETPDGLVSVQSKSVVMTVPSHVASGLLRPLSESAANALSKLYYPPVAAVSISYPKEAIRTECLIDGELKGFGQLHPRTQGVETLGTIYSSSLFPNRAPPGRILLLNYIGGSTNTGILSKSEGELVEAVDRDLRKMLIKPNSTDPLKLGVRVWPQAIPQFLVGHFDILDTAKSSLTSSGYEGLFLGGNYVAGVALGRCVEGAYETAIEVNNFMSRYAYK

SEQ ID NO: 1268 - protein, 598 aa, Arabidopsis thaliana
MPTISVGRDRLFAALGESYTQEKFEELCFSFGIELDDVTTEKAIIRKEKHIDEEADDDEEIIYKIEIPANRPDLLCLEGLAQSLRVFIEKQEIPTYTLADISKDKILQMNVKPETSKIRPFVVCAVLRGVTFDEARYNSFIDLQDKLHQNICRRRSLVAIGTHDLDTLQGPFTYEALPPTDINFVPLKQTKSFRADELIEFYKSDMKLKKFLHIIENSPVFPVLYDSKRTVLSLPPIINGAHSAITLQTKNVFIECTATDLTKAKIVLNTMVTTFSEFCARKFEIEPVEVTYDDGKSYIYPDLAVYDMEVPLSFITDSIGVSLKVEQVTSLLTRMQLQAEQAKSSDNQCAIKVHVPPSRSDVLHPCDVMEDVAIAYGFNNIPTRKPASIKPLTLNELTDLLRIEIAMCVYTEVVTWLLCSHKENFAMLNREDVNSAVIVGNPRSADFEAMRRALMPGLLKTVGHNNKYPKPIKIFEISDVVMLDESKDVGASNRRHLAALYCGATSGFELIHGLVDRIMEVMAIPFLTIHENNVPINEKDGYYVKLSQEPEFLPGRQASIIVRGKHIGNFGIVHPEVLNNFDIPDPCSYLELDIEAIL

SEQ ID NO: 1269 - protein, 352 aa, Arabidopsis thaliana
MWRFCFFLSLLFFDVSAVKSAESIFLPSQIGVEDSRVFESLSLSPVCSAADPNLNYKPVIGILTHPGEGRWDARLHSLKNYAYATNISYIAASYVKLAETGGARVIPLIYNEPEEILFQKLELVNGVIFTGGWAKTGLYYDVVEKIFNKVMEKNDAGEHFPVYAMCLGFEILSMIISQNRDILERFNSVNYASSLQFFKNVNIEATVFQRFPPELLKKLSADCLVMQNHYFGISPDNFQGNPYLSSFFNIVTTSADKDSKTFVSTIRSKRYPVTAFQWHPEKNAFEWGSSEIPHSEDAIQVTQHAANYLVSEARKSMNRPSSEKVLSNLIYNYKPTYSGYKGSGDDEVYIFT

SEQ ID NO: 1270 - protein, 128 aa, Arabidopsis thaliana
MSATGIKRSNLNTRPVQRDASAKQTAIKGPYGKSPGCTTSCGLRLPRKTEVTAAKLIKHLGCKFAKGLRLVVMRKKKRSPPSKVSSFSGRSQPPIIPINNDSHRSEAIEDCIQFINSSSSFTRSNSTS

SEQ ID NO: 1271 - protein, 131 aa, Arabidopsis thaliana
MAYEERRSSILDSFSLSPLPYPVLLILAVASVFLLSSWYFSLEEAAESAEEQINFALLLIPLFLIVLVRWLSSMENPDALLGMFSSSRRTTYVSPGAGGDGGSSPWGVAALIVLLLVLLQYQSSFLEMWSG

SEQ ID NO: 1272 - protein, 300 aa, Arabidopsis thaliana
MSSSEAFPVMQEIMLEFRAGKMSLQGTRVVPDARKGLVRIARGDEGLIHFQWLDRNQNTVEDDQIVFPDEALFEKVNQSSDRVYILKFNSDDRKLFFWMQEPRAEGDAELCSSVNQYLNQPLEFPGEEGLAAAITEELEDMAEDNTSSRAGNLVVPNLSSEVSDVTSSSGPVKLADLQRILNNLSGGPVGIAGDQDEGLALGDILKPELIMPLLEALPVQERLSSHLPEGHSRAEDILELLQSPPFRQQVDAFTYVLRTGQIDLTQFGIDPSKYKFTVDSFLEALEDSVSTQSRDAMDES

SEQ ID NO: 1273 - protein, 219 aa, Arabidopsis thaliana
MDMIPQLMEGSSAYGGVTNLNIISNNSSSVTGATGGEATQPLSSSSSPSANSSRYENQKRRDWNTFGQYLRNHRPPLSLSRCSGAHVLEFLRYLDQFGKTKVHTNICHFYGHPNPPAPCPCPLRQAWGSLDALIGRLRAAFEENGGKPETNPFGARAVRLYLREVRDMQSKARGVSYEKKKRKRPLPSSSTSSSSAVASHQQFQMLPGTSSTTQLKFEK

SEQ ID NO: 1274 - protein, 171 aa, Arabidopsis thaliana
MNRGRRNLKQAASDQDFTLEECQSIAQVVSLRGSNQIEIMDAKGENSLALFPAKFRESMWIRRGSFVVIDHTGKEKAQESGSKVTSIVCKVLFFEQVRLLQKSPEWPEIFKDTRPIPAEKSSPIEQHEDDGEVDSSDDDDGMPPLQANTNRLRPFGVKCDAETDSGSDSDS

SEQ ID NO: 1275 - protein, 494 aa, Xenorhabdus nematophila
MTNHLETLLLRQQAYINGQWVDAHNKTTFAVINPANGEVIANVSDMGCAETQQAIEAAQTALPAWRALTAKQRSQKLKQWFHLIMDNQKSLAELLSAEQGKPHAEAMGEIAYGASFIEWFAEEGKRIYGETIPSPMPGRRLATIKQPIGVVAAITPWNFPNAMITRKVGPALAAGCTVVLKPAAETPLSALALAVLAEQAGIPAGVLNIVTGIDAKAIGETLTSSPIVRKLSFTGSTRVGKLLMAQSADTVKKLSLELGGNAPFIVFDDADLDAAVEGAMATKFRNSGQTCVSANRILVQEGVYDAFAERLVHAVKQLRVGPTHSDSSQPVPQQGPLINQAAVEKIQAHISDAVSHGARILAGGKSHTLGGLFFEPTVLADVDDSMRVSHEETFGPLAPLIKFRDEAEAIRLANDTEFGLAAYFYSRDIGRIYRVAEALESGMVGINEGLISNEVVPFGGIKQSGLGREGSRYGIEDYLEVKYLCFGGLGTKGA

SEQ ID NO: 1276 - protein, 281 aa, Saccharomyces cerevisiae [sequence omitted]

SEQ ID NO: 1277 - protein, 148 aa, Saccharomyces cerevisiae
  misc_feature (98)..(98): Xaa can be any naturally occurring amino acid
  unsure (1)..(148): unsure at all Xaa locations
MSGVNNTSANDLSTTESNSNSAVGAPSVKTEHGDSKDSLNLDATEAPIDLPQKPLSAYTTVAILCLMIAFGGFIFGWDTGTISGFVNLSDFIRRFGQXKNDKGTYYLSKVRMGLIVSIFNIGCAIARDPAFLYKVVINWSSAELSFVS

SEQ ID NO: 1278 - protein, 477 aa, Saccharomyces cerevisiae
MTLNRKCVVIHNGSHRTVAGFSNVELPQCIIPSSYIKRTDEGGEAEFIFGTYNMIDAAAEKRNGDEVYTLVDSQGLPYNWDALEMQWRYLYDTQLKVSPEELPLVITMPATNGKPDMAILERYYELAFDKLNVPVFQIVIEPLAIALSMGKSSAFVIDIGASGCNVTPIIDGIVVKNAVVRSKFGGDFLDFQVHERLAPLIKEENDMENMADEQKRSTDVWYEASTWIQQFKSTMLQVSEKDLFELERYYKEQADIYAKQQEQLKQMDQQLQYTALTGSPNNPLVQKKNFLFKPLNKTLTLDLKECYQFAEYLFKPQLISDKFSPEDGLGPLMAKSVKKAGASINSMKANTSTNPNGLGTSHINTNVGDNNSTASSSNISPEQVYSLLLTNVIITGSTSLIEGMEQRIIKELSIRFPQYKLTTFANQVMMDRKIQGWLGALTMANLPSWSLGKWYSKEDYETLKRDRKQSQATNATN

SEQ ID NO: 1279 - protein, 197 aa, Zea mays
MRSCSSVRQMLLTRLSSVSCSSTAQQLHAGVGKFAAAACWSWKKKREELPCFRARLAAKPPRASPAKGGIVPASDDDDGVSLGTVKLPGNIDTARLESLLFQWGNSLCQGANLPLPVPLKVDKVEGGIRLGFVAVEDGATRTLVYIDCLVSPAPDGSGPVFRAIRNGPMKDKEPPGEPRIMRSLLQALEKSIQIARV

SEQ ID NO: 1280 - protein, 1133 aa, Zea mays
MTGAREPVAMEIPAEEGPAAARAPPRRIRRRLVEGARGGGAPASVEEIEARLREAELRRQQFREWLACKARKKPRSPSWSSQEEDHGQRLEAKLLAAEQKRLSLLAKAQNRLAKLDELRQAAKNDVEMRFEKEREELETRVESRVRQAEENRMRLLHADMQKRAALKERTARSLVQKAKSESKYMEQVRSAISLKRAAAEKKRLRLLEAEKTKAQARLLRIQKAAMTVCSRRESERRKLKEQLDNKLQRAKRQRAEYLKQRGSPRGSTHADYLKHAYALSRKLARYWRIFVKSRKTTFALAQAYDALGINEKSVKNMPFEKLAMSMESPVVLRSTKALLDRLEKRLVISHSVASSSVENVDHLLKRLGSPPRRRAPPSREGKTRAVVKRPAKSSEASIKLPRYSLRVVLCAYMILAHPSAVLSGQGEREKQLIESAANFIKEFELLIKVILDGPGQSSGVTGQRKFRAQLANLDKAWCSYLYSFVVWKVKDARLLEEDLVRAACKLELSMMQTCKLTADRHSQNNLTHDMKAIQKQVIDDQKLLRDKVQHLSGDAGLERMNSALSDTRSKFFEAKENGSPLTAPVANVSTPLSINSSGKAPLSEVPESSRTNVVGTSSVVRSLFSASSSSVSSSPEKQPTENEKMVNEMLHEDASALAGRSDSASTAEEEFQNKVRETMEKAFWDMVTNSMRGERPDYSQLINLVKEVRDSLHDLAPKEWKEKILENIDLEILSQVLGSGSQDAQYLGQILEYSLDMVRKLSAAAKEDEMKKNHDKLLSELSTNSEVNGDGINSFVIAVIKGLRFILEEIKELKAEVSKARIQMMQQIIKESAGVEYLQKAFADRYGPPETAPASLPLTLQWILTSKNIAEEEWSEHSDCLSVMPAAGQAPALVPVLRSGHGAPVGQPSPSAGDTSGQPECKGEKLDKLIRIGLLQLIGSVEGLQLQSTPESFQINLLRLRAVQSQFQQVIVIATSMLVLRQILMSENSRATPLELENAISELVKALADILDSSPDSGTEEIVQAMVNASASVGSPSEEKVQARMQMITRVFLKSLQPGDVVFKKVSRAVYCAFRGIILGGSGPKGQKLADAALRRIGAIKVVDRVLKAAEVLIKVATVSEKVHGPWYKALIV

SEQ ID NO: 1281 - protein, 469 aa, Zea mays
MGKRSGGRKLPFFTRSSSSSSKRNRSARRLPSLPKQDNATRALLASPSAASPSATPGSAAAGQTAQLPPPLSVTAGGGVAVSGKVNKKKAGTRLWMRLDRWSASEIVELDKASIIRRAGLPPRDLRILGPVFSRSSSILAREKAMVINLEFIRAIVTAEEVLLLDPLMHEVLPFVDQLRQHLPLRSRVGENGECAPDGNGEKQKGSLNEATGAEHELPFEFHVLEVALEVVCSSLDLSVSDLERHATPVLDELTKNVSTRNLERVRNLKSHLTRLLARVQKVRDEIEHLLDDNEDMEHLYLTRKQVQNQQVEALMSSAASNSIVLAGTGVPRLNSSFRRSLSIATSMHLDNDVEDLEMLLEAYFMQLDGIRNRILSVREYIDDTEDYVNIQLDNQRNELIQLQLTLTIASFGIAANTFIAGAFAMNIPGSLFNTDGSLFWPFVGSTSSGCFVITVLLLGYAWWKKLLGP

SEQ ID NO: 1282 - protein, 562 aa, Zea mays
MAAPPEGNVRLGEGWDEDDVLEPQPLEVIAPDVKSKKRNPAPGVRVVGRRIYDPENGKTCHQCRQKTTDFAAACKQVKKKGPCPVKYCLKCLLNRYGESAEEAAGKEDWICPKCRGICNCSFCRKKKGEMPTGIMAHIAKASGCTSVHDLLKKGSDVVSAAQAILKVNGSDKGTKRSRGTDAAAEVATEKDVNIGIDINTVIADEGDENIGVDLNSLPSVDTKKRQKRQKLKHRTKKDPADATSHGVNTEPLQMDGNLDFLNSKTVRPRGTPVTKIAGAELDDEDTGAAIQFIEFCRAFTEIFQIKKGQPEKILQDLVGGRELRFVSSVVAGFHINLLSVIQEGKGKKPLAYTRDGDAWVIDIGKYISESASISKGFPLNHINQGISGYKNLSPSCKLRVLNFLCDETLSTDKLRNWIDMQNDIAAEPVNAAREKARAAKEMVKELKERLKDNMNKIIVSPNEAAASNSEANKYIISQIKEAQEVKRAAINDMATMEKQGGFWTKPLMVEKGAAYWKLDGYCDNSAILLQEYGGDELMANKDKWFMFTEDEEKIIEKHLATR

SEQ ID NO: 1283 - protein, 188 aa, Zea mays
MVLVLALGDLHIPHRVPDLPAKFKSMLVPGKIQHIICSGNLCIKEVHDYLKSLCPDLHITGGEYDEYARYPETKTLTIGQFKLGLCHGHQVVPWGDLDSLAMLQRQLDVDILVTGHSHQFKAYKHEGGVVINPGSATGAYSSITYDVNPSFVLMDIEGLRVVVYVYELIDGEVKVDKIDFKKAATMQA

SEQ ID NO: 1284 - protein, 262 aa, Zea mays
MAGLYEKQSETYAKKRPQYPKEWFSMLASLTAGHQRAWDAGCGTGQAAISMAEHYESVVATDVSEGQLRHATAHPKVRYLHTPEHLSEDELVSLVGGEGSLDLVVVATSIHWFDVPLFYAVVSRALRKPGGMLAVWGYNYEIHPFEDALHGQLYPALRPYLDPRAGLAMERYRSLPFPFEPVGVGAEGAPADVDIEVEMTLEDLVGFLNTGSVVTTARAKGVDLEAVTRAALKRVEEQWGGAPTVPRKLVFKAFMLAGRPKC

SEQ ID NO: 1285 - protein, 93 aa, Zea mays
MGFIMDFAENLILRLMEDPDKRDQVRREHVYKMKERCERTKAAWSLPLRPYGFWTFDRFNSQLSWDPQISQAAGRRDPYDDLIARHSGSPPSS

SEQ ID NO: 1286 - protein, 419 aa, Glycine max
MNQLGGVSVILLVLSVLCFHVRAQTSAPSSGDAVSNFQPSLAVVIGILGVMFLLTFFLLMYAKFCHRRHGGASAVGDSENQLTFVRSRSRFSGIDKTVIESLPFFRFSALKGLKEGLECAVCLSKFEDVEILRLVPKCKHAFHIDCIDHWLEKHSTCPICRHRVNPEDHTTFTYSNSLRMLAGEESNIEILVQREEEEHHGSSRFSVIGSSSFRKTVKEEELLIQKGAEDSDGNQKGYHKHNHRITISDVVFKHRWSNVSSSDLMFLNSEMLNDTSSNRFSSNLESITRGVVVENEQIMNIKEEMERKISFENKVVGALNNIVSDHKEDPPFTSDSAPKYVNPGEKRSMSEITAVSRFGDLGMKMRVLKDSDSLQNNLKEERMRQIWFPIARRTAQWFVNREERRSLQSQNNKQQPLDV

SEQ ID NO: 1287 - protein, 383 aa, Glycine max
MHSQKVVEMEDKTESHMSSAAAFVEGGIQESCDDACSICLEEFGASDPSTVTTCKHEFHLQCILEWCQRSSQCPMCWQPISLKDPTSQELFEVVEQERSLRATPSRNAAIFHHPAFGDFELQHLRMSLNDADFEERIIQHLAAAAAMRRANQLGWREGQRARSSAHGHPQFLVFSNQPIAPSSVAGGENDPTAIPNRSPSTPITSVGNEASQQILHLQTQSSSSASGSPVMATNPRGIYSNERGSTACSSPANQDRAEPSELQSFSDSLRSRLNAVSMRYKESISKGTRGWKERLFSRSSSMSKLGSETRRREINSGIASVSRLMESLETSENNRVVGTSLSNHTEGCSIGGVSNQNNVEARGENSSHDDNTPAACSANSHLN

SEQ ID NO: 1288 - protein, 168 aa, Zea mays
MGDAGADASSSPPPPSGSFSYFAVFRNYPLVAALLGFAVAQSIKFFVTRYKENRWDPKRLIGSGGMPSSHSATVTALAVAIGFQDGFSCSLFATATIFASVVMYDASGIRLHAGKQAEVLNQIVCELPSEHPLSETRPLRELLGHTPTQVVAGALLGCTIATAGQLFL

SEQ ID NO: 1289 - protein, 363 aa, Zea mays
MGYLPALGGKAAHLVNDLATVILNPVSERERQPHHPTHLPEATEGEDTLFVDDDSDQNSDGPDTSSFRAFLMSFVPSSTASKNSMETIPEHNLDVEYPTLTPVGKACSGRKGLFSRGKHSLGRIISKAGLGNLRQKQTHSIDGEIIGQTESVAPRFEVKGSKESTLHDKLPAMSEPSLLLTEMMRAVLYTSLPVLVQGRNWMLVYSTWRHGISLSTLYRRSRLCAGYSLLIVGDRRGAVFGGLVEAPLQPIVKRKYQGTNDCFVFTNVDGCPVICHPTGANNYFTFCSTDYMAMGGGGHFALYLDGDLMTGSSSTSETFNNPCLSHTQEFKIKDVELWGFVNASKFEEMLMICRTEKQGIWNL

SEQ ID NO: 1290 - protein, 180 aa, Triticum aestivum
MVGSGMHAQRGDPLVVGRVIGDVVDPFVRRVALRVGYASRDVANGCELRPSAIADPPRVEVGGPDMRTFYTLVMVDPDAPSPSDPSLREYLHWLVTDIPATTGVSFGTEVVCYEGPRPVLGIHRLVFLLFQQLGRQTVYAPGWRQNFSTRDFAELYNLGLPVAAVYFNCQRETGTGGRRM

SEQ ID NO: 1291 - protein, 153 aa, Gossypium hirsutum
MQALCSCEEAIDIGTMMENKRNPFSVDHTGFTSLASKRQKATKEKKDQVSERIAALQQLVSPYGKTDTASVLLEAMGYIRFLHEQVKVLSAPYLQTIPANSLQDDDQYSLRNRGLCLAPVSCTVGLARSNGADIWAPVKTTSPKFDEVISQFN

SEQ ID NO: 1292 - protein, 313 aa, Zea mays
MLLHHRLLPRLLLVPSTHTSTLLCPSRLPRRLSLSPRFYALPHLAAPQTVDHSDDEGAPQGEGQIKLPLDHLFVPPGATMDAGDQEAVSARVLKGSNIVLGPYARGDAQVVNADFVKSSVRPDDCPRDGLPEFALVGRSNVGKSSLLNSLVRRKRLALTSKKPGKTQCINHFKVNDSWYLVDLPGYGYASAPQEARTNWDEFTRNYFLSRENLVSVFLLIDASIPAKKIDLDYASWLGQNKVPMTLVFTKCDKRKKKKNGGRKPEENVETFQGLIREYFEAAPPWIMTSSVTNQGRDEILLHMSQLRNYWLKH

SEQ ID NO: 1293 - protein, 557 aa, Xenorhabdus nematophila
MASSMLSSATMVASPAQATMVAPFNGLKSSAAFPATRKANNDITSITSNGGRVNCMQVWPPIGKKKFETLSYLPDLTDSGGRVNCMQAMAVEHVLSMIEEHQVKFIDLRFTDTKGKEQHITIPAHQIDEDFFEDGKMFDGSSIGGWKGINESDMVLMPDPTTAMRDPFFNDATLILRCDILEPGTMQGYSRDPRSIAKRAEDFLRASDIADTVLFGPEPEFFLFDDIRFGSSISGSYYHIDDVEAAWNSGTRYEGGNKGHRPGIKGGYFPVPPVDSSQDLRSAMCLTMEKMGLVVEAHHHEVATAGQNEIATRFNTMTKKADETQIYKYVVHNVAHSFGKTATFMPKPLVGDNGSGMHCHMSLSKNGTNLFAGDKYGGLSELALYYIGGVIKHARALNAFTNPTTNSYKRLVPGFEAPVMLAYSARNRSASIRIPVVASAKARRIEVRFPDPAANPYLSFSALLMAGLDGIINKIHPGDAMDKNLYDLPAEEAQEIPTVASSLDDALAALDADREFLTRGGVFTDDAIDAYIKLLHGEIERVRMTPHPLEFELYYSV

SEQ ID NO: 1294 - protein, 424 aa, Pseudomonas fluorescens PfO-1
MASSMLSSATMVASPAQATMVAPFNGLKSSAAFPATRKANNDITSITSNGGRVNCMQVWPPIGKKKFETLSYLPDLTDSGGRVNCMQAMARVTLSRYLIEQTRSNNTPADLRFLIEVVARACKEISHAVSKGALGGVLGSMGTENVQGEVQKKLDVLSNEILLEANEWGGHLAGMASEEMDNAYQIPGKYPKGAYLLVFDPLDGSSNIDINAPVGTIFSVLRCPNEYLSQNEALDEKAFLQPGTQQVAAGYAIYGPQTMLVLTLGHGVKGFTLDREMGSFVLTHEDITIPESTQEFAINMSNQRHWEAPVQRYVSELLAGEEGPLKKNYNMRWVAAMVADVHRILTRGGLFMYPRDSREPSKPGKLRLMYEANPMSFLVEQAGGASTDGHQRILDIKPEGLHQRVAVFLGSKEEVARATAYHKE

SEQ ID NO: 1295 - protein, 243 aa, Synechocystis sp.
MASSMLSSATMVASPAQATMVAPFNGLKSSAAFPATRKANNDITSITSNGGRVNCMQVWPPIGKKKFETLSYLPDLTDSGGRVNCMQAMEPIHRYIRLILSKDQDLLFLSLLRTFEKILSKLLAICLMVVVFVAVFDLFKVLIIELQTEPFGFFNRSLIEIFGLFLNILIALELLENITVYLKDNVIQVELVIVTAMIAVARKIIIFDFGKYEGMDLLALGFAIVCLAASFWMVKKLNVNNKH

SEQ ID NO: 1296 - protein, 292 aa, Synechocystis sp.
MASSMLSSATMVASPAQATMVAPFNGLKSSAAFPATRKANNDITSITSNGGRVNCMQVWPPIGKKKFETLSYLPDLTDSGGRVNCMQAMVQRLVHILALTVCGLAVVSSLTPSVRGQGVTEVEEVIIEGSGPENSREFRPLNQEGSILSVGAGRRLMNEANEAINLNQYTVALEKLQEARKIFNQLSNFHLQLANSFSGINTVIFEEQRIAALETGQLRDEATYRLALVHRANNEPALAVPLLLQIIRSQNPTTDLGRKSYQQLYELGFVASPFEGPTPTGTNAAPTAPVVN

SEQ ID NO: 1297 - protein, 284 aa, Synechocystis sp.
MASSMLSSATMVASPAQATMVAPFNGLKSSAAFPATRKANNDITSITSNGGRVNCMQVWPPIGKKKFETLSYLPDLTDSGGRVNCMQAMAHSTDLSALARWMAADFSNQAQAFENPPFYAHIRVAIRPLDQAKFGDRLLFLEQAYDFMLQRPYRLRVLKLKVVEDHIEIENFKVKDEEKFYGAARDLGKLAQLTPADLEPMHGCDMIVEWTGTSFKGEVQPGRQCRVMRDGKETYLENSFEVSETGLISLDRGYDPETNERVWGSVAGAFHFVRWQSFADEVSF

SEQ ID NO: 1298 - protein, 368 aa, Synechocystis sp.
MASSMLSSATMVASPAQATMVAPFNGLKSSAAFPATRKANNDITSITSNGGRVNCMQVWPPIGKKKFETLSYLPDLTDSGGRVNCMQAMAPSAASHAIDTLIEMAHQGEINPWDVSVIDVIDRFLQDLGILNSLDLNFQQQNLPRSGQAFLWASMLVRYKADSLHNLEQEPEEVLPEAELEEWPDGLIARLPRDLENRLRRRTAVPPLQRRRVTLAELIDQIEAIAVEIEKSEQKPKRVKRARPQSRREALQIITELAHQENLTELASQLEQFLQTRLPEILPDLPHRSWVDLDTLLHCWHHHLDPDKLPDKKDKVGVFWALLLLSSQSKVSLAQEEFYQDLQVQIIDDSEKNIQLTLDPETEVLNSA

SEQ ID NO: 1299 - protein, 230 aa, Synechocystis sp.
MASSMLSSATMVASPAQATMVAPFNGLKSSAAFPATRKANNDITSITSNGGRVNCMQVWPPIGKKKFETLSYLPDLTDSGGRVNCMQAMDTFLASPKALAGYTAHTYNRAQRAFQCCPFYLNLFRAMAQASVPLPTIAGAGGVEQGFCGQALTENRVERELMWLIQVGLLRREVDGQGITDSFRLTPLAKQILAQYPGEQRQFPSPSLLDRLQNRLARWLAPLATLLVRG

SEQ ID NO: 1300 - protein, 230 aa, Synechocystis sp.
MASSMLSSATMVASPAQATMVAPFNGLKSSAAFPATRKANNDITSITSNGGRVNCMQVWPPIGKKKFETLSYLPDLTDSGGRVNCMQAMAESVISPEDAFNQAIARYNGGEGPETLIPVFKDIADSSPKNATVWACLAWLYLLDDKPTLAFKAAQRSVKIDGYHPQARINYALAMLANKKTGVREQVELAAQMMSFDQEIAAGVMESLDDGLERKPDWRDIERIKKWLTE

SEQ ID NO: 1301 - protein, 370 aa, Synechocystis sp.
MASSMLSSATMVASPAQATMVAPFNGLKSSAAFPATRKANNDITSITSNGGRVNCMQVWPPIGKKKFETLSYLPDLTDSGGRVNCMQAMEWREISGSWVLVPPQPIAVVHFLGGAFVGTAPNVAYRWLLTELGKAGYVVVATPFVNTFDHQAIARSVLNRFEIILERLQKQGEITTGLLPVYGLGHSLGCKLHLLIGSLYEVERAGNILVAFNNYPVKQAIPFGEQLAQLQLDKFLTGVQKQLRQLNLQVDLNFEFTPSPEETNLLIAENYRVRRNLLIKFSNDDIDQTLGLRPILNQQTADLVAYCPLPGNHLTPLGQDIQWETGQEFSPLDAVGQWLKNSLSQDLRRLQKEILRWLEPTRFYSGFDNL

SEQ ID NO: 1302 - protein, 551 aa, Zea mays
MAAAPASVGCGGAYSCETAERTREWMQALATFLGRHRPLLEAHVVNFFKDRLWELVDAEWMECLRREPVESLLKLPSGCVQEHWPATLREFVLTARSLVIPREQKAPQSLVSDIHVAPVGTVLAQGMNSKKKHEIENLAAVVHAIAKRCGAKTVVDVGSGQGYLAQALSFEYQLRVVAIDASSHHASVTIARAERIKKHYAAKCVEKQLLMVPRAVTCHVLSSDTLAAVTLDACKDDNGEHVRDTKTSTKKITQIQESTQGTPPLILAGLHACGDLSVNMLRVFVSCEQVKALVSIGCCYNLLSEDTYEDTDTCPGFPMSKAAKHSELVLGKSIRDLACQSAERWRNLTMDIALQNFDVHAFRAAFQMVLEKYFPEVSRLSPSIGRQGKALRRQRLRKVVESQMTTKKNDDFSCSTLKEQNKNTNDVHPVIHEVDTGPDDIHQNAHQKFILFKDFTLSGLGRLGCGSVEDTSLLEIWKDVQPFSEYIGPFWCLRAALGPLVETYILLDRLLYLQERSNLVEALLFPLFDPTISPRNMAVIAWKLCANSSEA

SEQ ID NO: 1303 - protein, 381 aa, Zea mays
MAVSGEKPPPPPPPATASGGTARKLILALLTCLSSALLYRQIQPLPPKIPGTPGGPPVTATRTRLSDGRYLAYLETGVPREKAKHRLVFVHGFDSCRHDALPISTELAQELGVYMLSFDRPGYAESDPHPARTEESIALDIAELADNLQLGRKFYLAGFSMGGEIMWSCLKYIPHRLSGVAILGPVGNYWWPGLPSNVSRDAWYQQLPRDQWAVWVAHHLPWLTYWWNTQKLFPASSVIAYNPALLSQEDEMLMAKFGYRAYMPQIRQQGEHECLHRDMMVGFGKWSWSPLQLENPFADADADDGQGAGKVHLWHGAEDLIVPVSLSRYISQKLPWVVYHELPKSGHLFPIAEGMADIIVKSLLLGDDHLSSSASQPPHSP

SEQ ID NO: 1304 - protein, 673 aa, Zea mays
MAAALLLRSLRPSVSRAHIHLLSHASSPTALGSPLLPRLYSSAAASTAASPVFTPGGVMDPSRIRNVAVIAHVDHGKTTLMDRLLRQCGADIPHERAMDSISLERERGITIASKVTSVSWKENELNMVDTPGHADFGGEVERVVGMVEGAVLVVDAGEGPLAQTKFVLSKALKYGLRPILLLNKVDRPSVSEETCDEVESLVFDLFANLGATEEQLDFPVLYASAKEGWASLTFTKSPPDNAKNMSSLLDSIVRHVPSPKADLEAPFQMLVSMMERDFYLGRILTGRVRSGVVRVGDKVHGLRSTDDGVHKIEDGKVVKLMKKKGTNMVTVEAAGAGDIISMAGLAAPAIGHTVANSEILSALPTIELDPPTISMTFGVNDSPLAGRDGTHLTGAKIGNRLMAEAETNLAINVLPGPLSESYEVQGRGELQLGILIENMRREGFELSVSPPKVMYKTERGERLEPIEEVTVEVGEEHVGFVLETITHRKGEVVDMGPVPGTTGRTRIFMTCPSRGLVGVKGIFSSFTRGTGFMHRAFQAYAKYRGPLGSVRKGVLISVGKGLITSHALMSLEARGILFVSPGMEAYEGMIVGEHSRDSDLEVNPVRTKELTNIRAPGKDENVRLSPPRLMSLEEAIGYVAADELIEVTPKVVRLRKKYLDSTKRKMMKNKPMN

SEQ ID NO: 1305 - protein, 529 aa, Zea mays
KKAGSCRTMPPAQAPSSGGAAWRQLLLLLTVLPLTLAALAFVLQWRGGGGVDDPTTRWPSHAFPGMAEPTPPSLPSSDCADVLVGSSAPSFPYIRGWSFPSDSGAAMGSVEEHLQPKVCVQTSTSAGLEQILPWLFYHKVVGVAQFLLFVEGKAAKPNVAGVLESIPGVKVVYRTKDLEERQARSRIWNETWLSGFFYKPCNYELFVKQSLNMEMAIVMARDGGMDWIIHLDTDELLYPGGAAEYSVRRLLAEVPRDVDMVIFPNYESSVEHDNIKDPFSEVSMFKRNYDHLPKDTYFGMYKEATRGNPNYFLTYGNGKSAARIQDHLRPNGAHRWHNYAKSPNEIKLEEAAVLHYTYTKFSDLTSRRDRCGCKPTKEDVKRCFMLDFDRAAFIIASTASEEEMLRWYNERVVWTDKQLNLKLLRKGVLTRIYTPMTIVQSLRESGVFTSAIAAGQPAVNAKLSPKETNAQSQNVTASGNMTRVVRSTDSKASGRKILQAVDLAFSDTNVTAVPPLSPPSLDEHRHHSE

SEQ ID NO: 1306 - protein, 180 aa, Triticum aestivum
MAAHVDPLVVGRVIGDVVDMFVPTMPVTVRFGTKDLTNGCEIKPSIADAAPSIQIAGRAGDLFTLVMTDPDAPSPSEPTMKEWLHWLVVNIPGGSDPSQGEEVVPYMGPKPPLGIHRYVLVLFQQKARVLAPAPGGDTAASAMRARFSTRAFAERHDLGLPVAAMYFNAQKEPANRRRRY

SEQ ID NO: 1307 - protein, 196 aa, Zea mays
MVVYTQEHVYRHPWDRVTAAAWRKFTDPASCTALSHVADVHTLHRRLDSDTGRLQAARSITVRSPPLPFVLRRLLPSAAASPNGAALCHCVETSLVDAQRRAMDVVVRNVSLRGLIEVEERASYRPHPDRPDDWTQFRQETTIRCRPLAALAAVAEKVETRCAERFLQNSAKGREVVERICRYLEAESAGAAPSVT

SEQ ID NO: 1308 - protein, 195 aa, Zea mays
MTGKKRKAEAARLEETDQALYGAFRGAANSLSQLYTLAMGAQKASFNAGERHAMEKLYEWILRQHENGLRLTVADVASRIQLEIQYGGDNASASPRPQYPSQSTAPTVHIPNTSNQQPSPSLFAPGNPGLTQSKNSMVFSNALSSPIRRSLQPYHLEQDGDTGYFVNGASRDMDPTASNDSSMDMHSDSPVHDSY

SEQ ID NO: 1309 - protein, 242 aa, Zea mays
MLAKGRKVAGRREEMSANYAFGPQDDDAIIKHRLLTRTTTTRGEPPLKKLQKKFMSFATEIEKDADNISDCERLYKAFLHEINTFELPLLKSKAVVDANIREKESFNELQVEIERQILHAKTDIEDLKKQLEQSKIERQHKEECEAIRKLICLQPPRSETEKLIADLEKEITDLKAENVACIRTLELRKKQFALLLHVVEELQISIEDEQKSIADELRAIAGEQKMSMEEGSVGASDSMVVD

SEQ ID NO: 1310 - protein, 470 aa, Zea mays
MAKPEGPTIGVKLFVDKEKKKVLFAESDKEFVDVLFSFLTMPLGTIVRLLDKQSQMGCLDQLYKSVEDLNLEYFQTSACKAMLLKPLNAASGHCCRLKINVDGSFPRVVYVCKDTSCSALSDNAFSSFPGTVCKCGKVMEFVGRCPKYDGDTETAAAACSEDGVFVIGCLKFIVTDDLQVAPASTSLMMSFFEKFGVLDPAVLEQQVLQFSSEKIKCLLKRLLTSKQPLTDHYFEALVPQDDASLEALVQNLHPKQENEDQEMPGNQKIRVLQTKDNSALLYDEVGVDFVDSLFGLLSIPLGSAIKLYCQCSAKGCLGNAYRSIDGSVKEFVREECQSLLLDPKVPPFFGCCASKILQVDELAPRELTMEACFVCFKSLWFSGCNRSHEFAYSLRCNEVFCANKVKSIKLCEANPKRQNGGSGQTNFVVKEIKLKVMELQRAVLVLSRNILSSVLLHPKKTKKLHHYRRM

SEQ ID NO: 1311 - protein, 80 aa, Zea mays
MPATPTIIGALLGLGTQMYSNALRKLPYMRHPWEHVLGMGLGAVFVNQLVKFDEKLKEDLDKMLERARLANEQRYIDDDE

SEQ ID NO: 1312 - protein, 311 aa, Zea mays
MARNEEKAQSMLNRFITMKQEEKRKPRERRPYLASECRDLADAERWRSEILREIGAKVAEIQNEGLGEHRLRDLNDEINKLLRERGHWERRIVELGGRDYSRSSNAPLMTDLDGNIVAVPNPSGRGPGYRYFGAARKLPGVRELFDKPPEMRKRRTRYEIHKRINAGYYGYYDDEDGVLERLEGPAGKRMREEIVSEWHRVERVRREAMKGVMSGEVAAAGGRSGEAAREVLFEGVEEEVEEERKREEEKREREKGEEVGREFVAHVPLPDEKEIERMVLERKKKELLSKYASDSLLVEQEEAKEMLNVRR

SEQ ID NO: 1313 - protein, 321 aa, Zea mays
MFYGGYAYHGNSFEQTYRCYPASFFDKPHLEGGDKVIMPPSALDRLASLHIEYPMLFELHNDATQRISHCGVLEFVAEEGMIIMPYWMMQNMLLQEGDTVHVKNATLPKGTYVKLQPHTTDFLDISNPKAILEKTLRNFSCLTTGDSIMVAYNNKQYYIDIVETKPASAVSIIETDCEVDFAPPLDYKEPEKLRQPTVLASKAPAEDGNTAAEDEPKFKPFTGFGKRLDGKASKLQASEVPSTALSAPSDSNKRANQQISAPAASGASSYSRQKTGKLVFGSSASNNKEPQKAPAKEEQPAKKDDEPRFQAFSGKSYSLKR

SEQ ID NO: 1314 - protein, 292 aa, Zea mays
MAGGSGEAAMSPPSSSASGKRGRDPEEDVYVDNLHSHKRYLSEIMASSLNGLSVGDSLPDNIMESPARSETASCYRDEILSQYSPMSEDSDDYRCYDTQLNPSGNHPDAMISPSTSPMSSPHRHQRPQSSLLPSNPYPLPSCSLSSVVCSHARRGSDNEGRFPSSPNDMCHVADLRRTALLRSVQMRVQGPHSYDLSFGIRQGQDHAHEHEGEHDHEHEHLEDLEGTEGSSCNKSIVNEVTYNQRRDHDFGRSEHEIDYINNSTSDDCVSDLKFKQEDKSHSKFDIPMHKNS

SEQ ID NO: 1315 - protein, 296 aa, Zea mays
MPLILISGFPSAGKTTRARQLEQFFESKIASAPPDARTSRLKVHLINDQTLGVPRSVYRTARAEKDARAEEYSAVKRVLSRDDIVIADGLNYIKGFRYQLYCEAKALQTPSCVLHVGTPPDRCRENNKKLLADEGTDGGYEEDVFENLIFRYEEPNGMTRWDSPLFIVVEEDETPPCDQIWEAMIGSDGKLKTVKPNLATVLKPATEQNYLYELDKTTSDILTQIMVYQKDHAGEGGGQIAVADVEKPIELPATPMTLPQLQRIRRQFITLNRQHSFSKARIKEVFVDYLNAEFLR

SEQ ID NO: 1316 - protein, 154 aa, Zea mays
MATTKDPATIGGEPAIGIPYHPAAEAQGHYYYAPPPNPYAAGMPPPNAIYAGAPKGVPLQQTMFRDTPAPFHCQACGEAAVSSVRSKPSLASVVACMMPFMLGVCFLCPSMDCLWHKYHYCPSCGEKVGEFRKSDPCLVVDATRWSEPSFAVPA

SEQ ID NO: 1317 - protein, 175 aa, Zea mays
MGNASSMLTQYDIEEVQEHCSYLFSQQEIVSLYERFCQLDRSAKGFISEDEFLSIPEFSLNPLSKRLLRMVDGLNFKDFVAFLSTFSAKASLRQKIEFIFKVYDIDGKGKITFKDLLEVLRDLTGSFMSEEQREQVVTEVLEEAGYTRDYAFSLEDFIQIIDHPGLKMEVEVPID

SEQ ID NO: 1318 - protein, 273 aa, Zea mays
MLYIVGLGLGDERDITVRGLDAVRSCSKVYMEAYTSLLSLGLDPAALANLEKLYGKEITVADREMVEERVDQVLSEAADTDVAFLVVGDPFGATTHTDLVVRAKKMGVEVKVIHNASVMNAIGVCGLQLYRYGETISIPFFTDEWRPDSFYEKIQNNRQLGLHTLCLLDIRVKEPTWESLARGKKVYEPPRFMTVNTAISQLFEVEEARGGYAYRRETLCIGVARLGSDDQKIVAGPMEKLLDVDFGPPLHCLIIVGETHPLEEEMLEFYMIK

SEQ ID NO: 1319 - protein, 179 aa, Zea mays
MAWSAAAVSRFAAASPPAAPISVRLGAAASRSSLSFSSGRRRPVAASLSTSATVVKEAVQTEKAPPALGPYSQAIKANNLVFVSGVLGLNPETRKFISENVEEQTEQVMKNMGEILKASGASYSSVVKTTIMLADLQDFNKVNEIYGKYFPAPAPARSTYQVAALPLNARIEIECIAAL

SEQ ID NO: 1320 - protein, 898 aa, Glycine max
MAEEEEDDESFGDFTFASFPSQPTSNDTNPVDDDDDWGDFMNHSNQINGKPFDAFGVPTDPTNKHVNDNNGVAVQAEAAKKPKGAIPLSIFGEEEEEEEEQQEKPASANVFSNGGAVKRGSDSNGSVGISDLISSLYNQQRPQVDSHNNGSVSVSNVDAPNSTNSNGSKLNSDEVDEDDDGWEFKSAEWETGTKSQDVKAETPKHDSGALDVGTVLDSSNGISDKAGGWHMEFEFSPRFASQDHINPQPSPKNESNDIGTGFAMFNQNFGEFSSGSGPGPNQNLEAPKKAGICATNMELLKFNGATPHGTIDSSLTSESHQSDEWNFGFNFNSSYVGEDNHSSDSYFKTKNNQDDNNRNNASPTNIDVDSHVNFFDSESDVTQHEKPLTSPENRREALPLSIFGDETPDTDEHPVSQDLSPYTPSSPIRNSFTSPGSNFSINDIWNLYNQAENQSSSNVTPKASENQIHAPPEVSGSSLVTGNDDLDDDFWDYKDAATETRFTNESAQKTSSPQVNENGLQSSPTFLNSDLTNGDDDFEDDSWEFKEATSGTINQDHTSTLDHRGLPQLSTKLEQVDYAEFYSKVKDELCNYVLFHLQNLKKTQNVAALSGEDAKAKALQEEISEFSKILHQDTMSIPNEYLSEDYCPRNVRFNELLEVLKEPKFQPVESEYQLASRLSMAEKDIKYGMELLKDTVSTLRILKLGSREEQSSYLTIWSKIAFVCSQELKHGAYVWKQAVLQNVHDQILSSQKGVQYILALGEIYRVAEIIEASAKLHKPWMLSGAIDHKSLCALLNECYSIWLASGLEEALLSIANQNNFELDGISRELVESIKYIHELDEHALQSFVISGEQTTCQLSALPAGFIPGLNLVKWNGKHYIVKLANLWINLISSDPPKK

SEQ ID NO: 1321 - protein, 281 aa, Glycine max
MYAETGLLFPYLNNISHGLHQLEEYCKTQKSNASMDDLVQSSVMSEYDLAAEGDLFKAPEPIIEEPIMDMDPMTATISMISCGEDVSSQGLKSTDIDILQNDQFLHEVFYECEKDLLEKAAIEPPFSEILEIKVPLLNIDENTIQENKLLPDMQLAKSVSSGSLSSMDWMRGAAMKPAFIDIPAIDFNADYGMRRSFSEGDIKTLGNGNMNIVQSPLERPLLISNCTSEERFQKLSRYRNKRTKRNFGRKIKYACRKALADSQPRIRGRFARTEESDVKRE

SEQ ID NO: 1322 - protein, 243 aa, Glycine max
MSAALDMTLEDIIKNNKKSSLANTRGRGRASGPGPARRLPNRAANRAAPYAAAKAPETAWKHDMYANQPVAAAYPGGRASSIETGTKLYISNLDYGVSNDDIKELFLEVGDVKRHTVHYDRSGRSKGTAEVVFSRRADAVAAVKRYNNVQLDGKPMKVEIVGTNIATHAAPPAVNGTFGNPTGVPRSGQGRSGSLGRPRGGSRGRGSIQRGRGRGRGGRDEKVSAEDLDADLEKYHAEAMQLN

SEQ ID NO: 1323 - protein, 294 aa, Zea mays
MAASSSCKVIDSHLHVWATPQQAKEEYPYFPGQEPTLRGDADFLLECMSEAGVDGAVIVQPINHMFDHSLVTSVLKKYPSKFVGCCLANPADDGTGIKQLEHLIVQEKYRAVRFNPNLWPSGQKMTNEVGRSLFSKAGELGVPLGIMTMKGVGPYIQEIEELCRDYPATTVILDHMAFCKPPTNDEEEKAFSSFLSLSRFPQVYVKYSALFRITREAYPYEDTAQLLSSVISHYGASRVMWGSDFPYVVPECGYKGGREAISHVASKIPVSQSDLEWILGKTVSQLFQGAWVTP

SEQ ID NO: 1324 - protein, 235 aa, Zea mays
MAAANGAAGAVLFSEEDLREVSGVRWGEDFVEVTCGCTSHRYGDAVGRLRVFASGDLEINCECTPGCREDKMTPAAFEKHSGKETAGKWRNTVWVMVQGEKVPLSKTALLKYYYLAHKSGNGSHKGRNGRPSHRDEFICCAGCGKERRFRLRSKEECRVYHDALAKASWTCADLTTDRVTCDDEEERASRKVLRGCSRAPSCTGCMKCVCFGCETCRFKDCDCQTCVDFYRNSKE

SEQ ID NO: 1325 - protein, 78 aa, Glycine max
MDLSDLNSAEMQKFYSEEQQRAMVNEMVAKLTSECWDKCITGTPGNKFSSSESNCLSNCAHRYLEMSMLIMKRFQSMQ

SEQ ID NO: 1326 - protein, 990 aa, Glycine max
MLEPRESDIPVLFLVLVVLPLVAYILLGKWSETSKKRDRINLLAHLAAEEALRAEEMAVADVIPPVSASKNEHHVCARCSAPARTRCSRCKIVRYCSGNCQIIHWRLIHKQECQQLEPHKSSSFPLAVSVEEFGHGDGSYFYENLNNQFLGPSLKQTLRESAPLDYLVHPLTGTAASTTADFSVFNNFQHSAFERTSHKSNRETLRRDNGSIYESSIESSDYKASSSLSSVVPKEAFMRQKSRKSSDSVLEEEISNVSSGGFGVYINRFDASKNMIHENDSHQSQYGNALVTRHKYGRSNVSSAANNDNGVDEFETDITTKGVSVVKGGNYHSDEAAQYKRPSESTIKGSMKAKKILHTPKTKSSKSPKSTSKTSADFCCSEIEKKGKTADELKVAGNSDTIPLHGNGSNGTANTGIMKMMGLRKSTKPTPLASTESMDVKCKKVKKIKMLFPYDEFVKIFQSDVFGIYPRGLLNCGNSCYANAVLQCLTSTKPLVVYLLYRSHSKACCAKDWCLMCELEKHIMVLRENGDPLSPSRILWHMRSINCHMGEGNQEDAHEFLRLLIASMQSICLEALGGEKKVDPRLQETTFIQHTFGGRLQSKVKCLKCNHESERYENIMDLTLEILGWVESLEDALTQFTSPEDLDGENMYRCGRCTSYVRARKQLSIHEAPNILTIVLKRFQEGRYGKINKCITFPEMLDMIPFMTGTGDIPPLYMLYAVVVHLDTLNASFSGHYVSYVKDLQGNWFRIDDIEVQPVLVNQVMSEGAYILFYMRSCPRPPVEHTVKAVQQSVYDSSKHNPMEMQKPNKPGHSRHGSHQFFVSESSPNARPEISTHIIDTTNGFLRKSTNRNALPVTQTYAKNVRSEFSDTTSSDWSLFTSSDEASFTTESTRDSFSTVDYGDSGNMDPISSIFNYTPEKSYLKFSHSRPVTRVFPEKGHVEQVQRIDHSKRVGHSSNEHPPNGNCGLYVYYGSNPVCGTTRTSSQCEF

SEQ ID NO: 1327 - protein, 145 aa, Glycine max
MPVPLAPYPTPPAPYTPPANGVQSQLVCSGCRNLLVFPVGATSVCCAVCNAVTAVPPPGTEMAQLVCGGCHTLLMYIRGATSVQCSCCHTVNLALEANQVAHVNCGNCRMLLAYQYGARSVKCAVCNFVTSVGATASTTEQKFST

SEQ ID NO: 1328 - protein, 802 aa, Arabidopsis thaliana
MMMDEDVEQASLMSFNDRPRAFPNMRSKTYSPLIFRIIRKLNVRVLSIILLFCFGAIFYMGASTSPIIVFVFTVCIISFLLSIYLTKWVLAKDEGPPEMVEISDAIRDGAEGFFRTQYSTISKMAILLAFVILCIYLFRSLTPQQEAAGLGRAMSAYITVAAFLLGALCSGIAGYVGMWVSVRANVRVSSAARRSAREALQIAVRAGGFSALVVVGMAVIGIAILYSTFYVWLGVGSPGSMNVTDLPLLLVGYGFGASFVALFAQLGGGIYTKGADVGADLVGKVEQGIPEDDPRNPAVIADLVGDNVGDCAARGADLFESIAAEIISAMILGGTMAKKCKIEDPSGFILFPLVVHSFDLIISSIGILSIKGTRDASVKSPVEDPMAVLQKGYSLTIILAVITFGASTRWLLYTEQAPSAWFNFALCGLVGIITAYIFVWISKYYTDYKHEPVRTLALASSTGHGTNIIAGVSLGLESTALPVLTISVAIISAYWLGNTSGLVDENGIPTGGLFGTAVATMGMLSTAAYVLTMDMFGPIADNAGGIVEMSQQPESVREITDLLDAVGNTTKATTKGFAIGSAALASFLLFSAYMDEVSAFANVSFKEVDIAIPEVFVGGLLGAMLIFLFSAWACAAVGRTAQEVVNEVRRQFIERPGIMEYKEKPDYSRCVAIVASAALREMIKPGALAIASPIVVGLVFRILGYYTGQPLLGAKVVASMLMFATVCGILMALFLNTAGGAWDNAKKYIETGALGGKGSEAHKAAVTGDTVGDPFKDTAGPSIHVLIKMLATITLVMAPVFL

SEQ ID NO: 1329 - protein, 449 aa, Zea mays
MASQPPPEPAPAEAGLESMEGLVLDTVISRAGARPAAALACASTRLRTAVADDSLWRRFCGEDLGLDAPVDPEGRPLPSFQVAYKVWSESFGMYPLPMVKRVRQFWTSMKTWLSENFPEAYKTLCEGVSEAQLKSAEDDLGFKLPMPTKLLYRFCNAQLPFSEDHDTNKSISTYGLIGGYAFYDHWVNVHLSPLEQIVEETKDFYREFPDVFHGRKFIVVATSWFHPKTFLLDCSNGELYVGTYNLPIGGMLPCVPKALIKPAGNDLAQDGLLLWLEEHLRRLQSGMIKTRMLMASRYISLYPEAPPSCSSAVTNGIKVRSSAVFVPEHPGRPGEKFMFTYSIRMSVPEACMLGGVYYSSCQLCSRHWTIRSCDRVVSDVSGGGVIGEYPLLLPGEDEFVYESCTPLPQVPGSVEGSFSFVPGKLSRPEGKPFEVMVAPFPLDVPEYIF

SEQ ID NO: 1330 - protein, 224 aa, Zea mays subsp. mexicana
MDTGVQAMFIISLVLWCTTSFALDDAAATRIPNVGTLPLSMKENPQLCQLCEEFASEALFYLNENETQTEIIDTLHQACSKFGSFKLECTRLVDYYVPLFFTKIASLSPEEFCASASFCGEVTFIRLPRHEDTCTLCHVVVDEVVTNLEDPDMELKIIEILLKGCNNAEDYVQKCKRLIIQNAPIIMENIKKFLEKRDFCNSIHVCGGKSVRAGSQVLRSLSSA

SEQ ID NO: 1331 - protein, 688 aa, Arabidopsis thaliana
MVTLCATLLILLSIFLATPSNVRGNAELKALMELKSSLDPENKLLRSWTFNGDPCDGSFEGIACNQHLKVANISLQGKRLVGKLSPAVAELKCLSGLYLHYNSLSGEIPQEITNLTELSDLYLNVNNFSGEIPADIGSMAGLQVMDLCCNSLTGKIPKNIGSLKKLNVLSLQHNKLTGEVPWTLGNLSMLSRLDLSFNNLLGLIPKTLANIPQLDTLDLRNNTLSGFVPPGLKKLNGSFQFENNTGLCGIDFPSLRACSAFDNANNIEQFKQPPGEIDTDKSALHNIPESVYLQKHCNQTHCKKSSSKLPQVALISSVITVTITLIGAGILTFFRYRRRKQKISNTPEFSEGRLSTDQQKEFRASPLVSLAYTKEWDPLGDSRNGAEFSQEPHLFVVNSSFRFNLEDIESATQCFSEANLLSRNSFTSVFKGVLRDGSPVAIRSINISSCKNEEVEFMNGLKLLSSLSHENLVKLRGFCCSRGRGECFLIYDFASKGKLSNFLDLQERETNLVLAWSARISIIKGIAKGIAYLHGSDQQKKPTIVHRNISVEKILLDEQFNPLIADSGLHNLLADDMVFSALKTSAAMGYLAPEYVTTGKFTEKTDIFAFGVIILQILSGKLMLTSSLRNAAENGEHNGFIDEDLREEFDKPEATAMARIGISCTQEIPNNRPNIETLLENINCMKSE

SEQ ID NO: 1332 - protein, 318 aa, Zea mays subsp. mexicana
MSMGRFVNSMDPTSGLEVIRDWNGVAQVVLRSPKGASARVSLCGGQVVSWRNDRGEELLFTSSKATFKPPNAMRGGIQMCFPQFGYSGTLERHGFARNRIWSLDDEQPPLNHNDNGSKVSVDLILKPSEDDLKCWPHCFEFRLRASLSKDGDLSLISRIRNVNGKPFSFSFAYHTYLSVSDISEVRIEGLETLDYLDNLSHKERFTEQGDAITFESEVDRVYVSSRNVVAVIDHEKKHSFVIRKEGLPDVVVWNPWEKKSKTMVDFGDEEYKQMLCVDAAAVERTISLRPGEEWTGKLELSAVLSTNCSDHLDHPVSI

SEQ ID NO: 1333 - protein, 145 aa, Zea mays subsp. mexicana
MAEPTPSQSPAQTPPPPPTQQTPAAGGLEDMLACVAALEAALLPCLPARELQAVDRSLQSSHQIDVERHARDFMEAAKKLQSYFISLQREEPPSAEEMLRKEITTMEEELKSKSELIAKHKKLIEGWQKELKEQLSKHITELERV

SEQ ID NO: 1334 - protein, 876 aa, Arabidopsis thaliana [sequence omitted]

SEQ ID NO: 1335 - protein, 237 aa, Zea mays subsp. mexicana
MSMASRPPLRRRRRLPLVPLLVLLCLSPACAAGRVPVSVYYEALCPFCSAFVVNDLSRVFRDGISSIAELRLVPFGNGRVSADGTVTCQHGEDECQLNAIEACVIRIWPDAEQHFPFIQCVEHLALTRKWDAWPSCFHETGLAYQPAIDCYISGYGRQLVLQYAAETNALQPPHRFVPWVVVNGKPLGDDYMNFEAYICSAYDGNLPKACKGKHLAIAQETKASRGDKVCPASKTIS

SEQ ID NO: 1336 - protein, 742 aa, Arabidopsis thaliana
MQISLQIHLSSFTFLLLIFLLPVLSESQVASSESQTLLEIQKQLQYPQVLQSWTDTTNFCHIRPSPSLRIICLHGHVTELTVTGNRTSKLSGSFHKLFTLLTQLSSLKTLSLTSLGISGSLSPKIITKLSPSLESLNLSSNFISGKIPEEIVSLKNLKSLVLRDNMFWGFVSDDLRGLSNLQELDLGGNKLGPEVPSLPSKLTTVSLKNNSFRSKIPEQIKKLNNLQSLDLSSNEFTGSIPEFLFSIPSLQILSLDQNLLSGSLPNSSCTSSKIITLDVSHNLLTGKLPSCYSSKSFSNQTVLFSFNCLSLIGTPNAKYQRPLSFCQNQASKAIAVEPIPKAKDKDSARIKLGLVILIIIGVIILAAILVLLVLIALKRRRSRSEDDPFEVNNSNNERHASDKVSVCSTTTASSKSLPDSRRVPQTMRSAVIGLPPYRVFSLEELEEATNDFDAASLFCEQLYRGCLREGIPVTVRVIKLKQKSLPQSLAQQMEVLSKLRHMHLVSVLGHSIASNQDHNQHAGHTIFIVQEYISSGSLRDFLTNCRKKEVLKWPQRMAIAIGVARGIQFLHMGVAPGIFGNNLKIENIMLDETLTVKISGYTIPLPSKVGEERPQAKKPRSNEDREKEDVYQFGVILLQIITGKVVAAGSSEMGSLKLQLENGLRDEPSVLSSLADPSVKGSYAYESLRTTVEFAINCLCEDQSKRPSIEDVVWNLQYTIQVQQGWRPSSGNHESSMKAIYE

SEQ ID NO: 1337 - protein, 900 aa, Arabidopsis thaliana
MEFRFENLLGAPYRGGNAVITKNTQLISPVGNRVSVTDLSKNHSVTLPLETSTNICRLASSPDGTFLLAVDEQNRCLFINLPRRVVLHRITFKDKVGALKFSPNGKFIAVGIGKLVEIWRSPGFRRAVLPFERVRTFANSDDKVVSLEWSLDSDYLLVGSRDLAARLFCVRKLKGVLNKPFLFLGHRDSVVGCFFGVDKMTNKVNRAFTIARDGYIFSWGYTEKDVKMDESEDGHSEPPSPVTPDRADEVMVENGGGVGTELKKRKEYDGKGLESDEEGDDDDEEYMHRGKWVLLRKDGCNQASAKVTACDYHQGLDMVVVGFSNGVFGLYQMPDFICIHLLSISRQKLTTAVFNERGNWLTFGCAKLGQLLVWDWRTETYILKQQGHYFDVNCVTYSPDSQLLATGADDNKVKVWNVMSGTCFITFTEHTNAVTALHFMADNHSLLSASLDGTVRAWDFKRYKNYKTYTTPTPRQFVSLTADPSGDVVCAGTLDSFEIFVWSKKTGQIKDILSGHEAPVHGLMFSPLTQLLASSSWDYTVRLWDVFASKGTVETFRHNHDVLTVAFRPDGKQLASSTLDGQINFWDTIEGVLMYTIEGRRDIAGGRVMTDRRSAANSSSGKCFTTLCYSADGGYILAAGTSRYICMYDIADQVLLRRFQISHNLSLDGVLDFLHSKKMTEAGPIDLIDDDNSDEEGGIDKQSRGNLGYDLPGSRPNRGRPIIRTKSLSIAPTGRSFAAATTEGVLIFSIDDTFIFDPTDLDIDVTPEAVEAAIEEDEVSRALALSMRLNEDSLIKKCIFAVAPADIKAVAISVRQKYLERLMEALVDLLENCPHLEFILHWCQEICKAHGSSIQRNYRTLLPALRSLQKAITRAHQDLADMCSSNEYTLRYLCSVPNNH

SEQ ID NO: 1338 - protein, 231 aa, Zea mays
MDRATMSSNQAGKVLKKGKKKQAKDELDRQKQAEKKRRRLEKALANSAAIISELEKKKQQKKEEQQRLDEEGAAIAEAVALHVLIGEDSDEPCHLMLNKHHIRCNHWAPSAAFEFTVDAQPAEVYPSEDGLVCGSHAYAPRAPKGRRADWGIGQALPCWGEVSDLQGPYYQGTFRQSVTCPGFIAAQAVSSLQIREESPEVTSPSHGADAAATVVNRMLGGTSRLNLYRGI

SEQ ID NO: 1339 - protein, 278 aa, Zea mays
MRGLHRCPHQLLLVSPPPRSAPACRQSATASSRGLRSSLAVFSAPGARVAAAAREQKWGHVEGDEDGGEEGLGEALHRTRELVECAMFAAVAGLAYFLSNSLAIENYFSCFFPLPIVISSLRWGLEASRKTVVATVLLLFTLSGPVKASTYLLMHGVVGLIMGTVWRLETNWIVSIILCSIVRALGACGYVLVSSFLIRENILALITVNIHASLTYILTAAGVNTIPSMGTIYLLFGTLLLLNCGFFVFLLHVMYTVFLAKLGIKPSLRSPRWLDRVM

SEQ ID NO: 1340 - protein, 192 aa, Glycine max
MVLWEITLGTAYFLGLKRTYRLALRIQRRIVSPKYPKLLQFLHRRTRAVFDVAIRVHRNIQVRDIEVGRNFGNFILRWLDRMKPSAQIRGPPPSNGITSRESVGKRLSAGRSSNQKGSGTSRRDSDRHLFTSSRIMHFPTVARMMRPPNPAGITIHGRHFSTSTPQTVGSIYRVNWSEGVIRKDIMQWLRHN

SEQ ID NO: 1341 - protein, 309 aa, Glycine max
MHRGKFSLTPKNEVKDLTGSSLTSYKHSSLLDPIDVSSSSDDENDLPNDDVSNQLVLYDPVANGNNAIELAPDPLQCEHPLLPRSKPSHSVPRVLPSVGAFTVQCASCFKWRLIPTKEKYEEIREHILEQPFVCQKAREWRPHVSCDDPEDISQDGSRVWAIDKPNIAQPPAGWERLLRIRAEGSSKFADIYYIAPSGKRLRSMVEIQKFLMEHPEYTRDGVTLSQFSFQIPRPLQENYVRKRPARLTSSYEVSEPVEHEQVSPLAWVDPEGHGRRLGLPAPPFMESHDIDPISISRPSKRQATHKGAL

SEQ ID NO: 1342 - protein, 256 aa, Glycine max
MSSADTVNASSAESVKEPVIGSSLEAKQDDTEIKSQVDAMWEQMNKGVSNKTLNRFTSKPNSAPKKTAKKTSSNWMSYLALAPKATESLGQGASKNGPGILQSSTSDEAKKLAAAALAAVKDDAAMAASSRGKLVITEVRDFAGQEIEVKKLVDSDSKEAMERAKAPPPSAVDTVLEQIKKKQKLSVLDKTKKDWGEFKEEKRLEEELDAYKKSSNQYLDKVSFLQRADYREFERERDARLALQSRKRPDNMQEDD

SEQ ID NO: 1343 - protein, 563 aa, Sinorhizobium meliloti
MASSMLSSATMVASPAQATMVAPFNGLKSSAAFPATRKANNDITSITSNGGRVNCMQVWPPIGKKKFETLSYLPDLTDSGGRVNCMQAMDTQLLIGSRFEAGTEAEEHILNPRTGAGIIDLAEASHAQIDAAVDAAERAFVGWSQTTPAERSNALLKIADAIEKEADEFAALEALNCGKPINAVKNDELPAIIDCWRFFAGAVRNLHAPAAGEYLPGHTSMIRRDPIGIVGSIAPWNYPLMMMAWKLAPAIGGGNTVVFKPSEQTPLTALKLARLIADILPEGVVNVITGRGETVGNALINHPKVGMVSITGDIATGKKVLAAAAKTVKRTHLELGGKAPVIVYGDADLEAVVNGIRTFGYYNAGQDCTAACRIYAEAGIYEKLVADLTSAVSTIRYNLDDDTENEIGPLISRRQRDRVASFVERAADQKHIEITTGGRTGSDEGFFFQPTVVAGATQEDEIVRREVFGPVVSVTRFTGKDDAVAWANDSDYGLASSVWTKDISKAMRAASRLQYGCTWINTHFMLTNEMPHGGIKQSGYGKDMSVYALEDYTAVRHIMINHG

SEQ ID NO: 1344 - protein, 553 aa, Arabidopsis thaliana
MVEEKTGNVTLLDQTVEDLLLQAQELVPIALSKARTVKGFSSRWRVIISRLEKIPTCLSDLSSHPCFSKHTLCKEQLQAVLETLKETIELANVCVSEKQEGKLKMQSDLDSLSAKIDLSLKDCGLLMKTGVLGEVTKPLSSSTQDLETFSVRELLARLQIGHLESKRKALEQLVEVMKEDEKAVITALGRTNVASLVQLLTATSPSVRENAVTVICSLAESGGCENWLISENALPSLIRLLESGSIVAKEKAVISLQRMSISSETSRSIVGHGGVGPLIEICKTGDSVSQSASACTLKNISAVPEVRQNLAEEGIVKVMINILNCGILLGSKEYAAECLQNLTSSNETLRRSVISENGIQTLLAYLDGPLPQESGVAAIRNLVGSVSVETYFKIIPSLVHVLKSGSIGAQQAAASTICRIATSNETKRMIGESGCIPLLIRMLEAKASGAREVAAQAIASLVTVPRNCREVKRDEKSVTSLVMLLEPSPGNSAKKYAVSGLAALCSSRKCKKLMVSHGAVGYLKKLSELEVPGSKKLLERIEKGKLKSFFSRK

SEQ ID NO: 1345 - protein, 296 aa, Arabidopsis thaliana
MAYHQPYDPFYVYQLHSHPHHLPPQLPLLADEPGAINTLFVSGLPNDVKAREIHNLFRRRHGFESCQLKYTGRGDQVCKNLQFLFFFIPIFRKAVVAFATFTSHRFALAAMNELNGVKFDPQTGSNLHIELARSNSRRKERPGSGPYVVIDNRNKEISKSQDDQSDEGDSDPDEVQEPGNSDSPKENDTTKSEADSEPDSKAPSANGHLEKASEGGSGARACSTLFIANLGPNCTEDELKQLLSRYPGFHILKIRARGGMPVAFADFEEIEQATDAMNHLQGNLLSSSDRGGMHIE

SEQ ID NO: 1346 - protein, 389 aa, Arabidopsis thaliana
MGRAARWFKGIFGMKKSKEKENCVSGDVGGEAGGSNIHRKVLQADSVWLRTYLAETDKEQNKHAIAVAAATAAAADAAVAAAQAAVAVVRLTSNGRSGGYSGNAMERWAAVKIQSVFKGYLARKALRALKGLVKLQALVRGYLVRKRAAETLHSMQALIRAQTSVRSQRINRNNMFHPRHSLERLDDSRSEIHSKRISISVEKQSNHNNNAYDETSPKIVEIDTYKTKSRSKRMNVAVSECGDDFIYQAKDFEWSFPGEKCKFPTAQNTPRFSSSMANNNYYYTPPSPAKSVCRDACFRPSYPGLMTPSYMANTQSFKAKVRSHSAPRQRPDRKRLSLDEIMAARSSVSGVRMVQPQPQPQTQTQQQKRSPCSYDHQFRQNETDFRFYN

SEQ ID NO: 1347 - protein, 339 aa, Arabidopsis thaliana
MVTELEELVEFLSSPSPPVKKAAVEIVSGLTGSEEGLQSLSKYSEILLPSLSQLLNESKEVSEPAAQALVNLSQKCELAKKMIQMGLIKVAMDMLYKPESCITRLLVMLLVNLTQLDDGVSSLLQIDDEKMHGLHIMKLVRSFCRSSGETADDQFEHVGSILVNISKTEDGRKLLLEPKRRLLKQIIRQFDSTNQLRKKGVAGTIRNCCFEAKNQLQNILLISEFLWPALLLPVAGSKTYSEQDVAKMPPELGSALSIEREPVTDPDIRVQTLEAIYLIILEEAGRRAFWSVNGPRILQLGYEYEEDPKAMRAYEQVGSLLVEEAGGPEESLEPTKAES

SEQ ID NO: 1348 - protein, 530 aa, Arabidopsis thaliana
MLETGAIWGITGTTVTSFMFFWAIYKQYVPAHFRAYVERYFHKMIGWISYYVDIKFTEYTDEGLKRSQAYDSIRNYLASKSTALAKRLKANETKNSKSLVFSMDDHEEIEDEFEGVKVKWYSNVKVIQPQSNYGQRSSEERRHFTLSFHRRHRGMIIETYLDHVLREGKAIGLMNRERKLYTNNSSQEWYPWRSGKWSNVPFHHPATFETLAMDPEKKEGIKKDLIKFSKGKDYYKKVGKPWKRGYLLFGPPGTGKSTMIAAIANFLDYDVYDLELTTVKDNSELKKLLLDTTSKSIIVIEDIDCSLDLTGQRKKKKEEDEEEDGEEKKEGEKKPKVDDKQSKVTLSGLLNSIDGLWSACSGEKIIVFTTNFVDKLDPALIRRGRMDNHIEMSYCKFEAFKVLAKNYLEIETHDLYGEIERKLEETDMSPADVAETLMPKSDEEDADICIKRLVKTLEEEKEKARKLAEEEEKKKAEKEAKKMKKAEEAEEKKKKTEEDEKKEKVKAKEENGNVSQQNGNSIDLNKKSDS

SEQ ID NO: 1349 - protein, 247 aa, Arabidopsis thaliana
MKTTPGLRIFKPIIPHTPKPDSRIYVEDAWTMLKPAIRAIFLDEPQDFACSGLFNAVNKSWCEKSSGEALYKLILEECEIYISAAIQSLESQCDTDPSLFLSLLEKCWLDFRRKLQFLCSIAGGEGQTVGPHSVWDLGSELSPKHLFSAQKVRDKLLSIILQLIRDQRSFMSVDMTQLKNTTRPVMSVHMTQLNNLRGLFYGQSLYKSPFFKKPFIDCAVEFYSAEAMQFKEQSDIPLYLKRVEYVA

SEQ ID NO: 1350 - protein, 370 aa, Arabidopsis thaliana
MGGSGNWIRSLISNRKPVNDQEKLSDKSSKKKWKLWRISSESLASSSFKSRGSYAASSLGSELPSFSADEAFTTAMAALIRAPPRDFLMVKREWASTRIQAAFRAFLARQAFRALKAVVRIQAIFRGRQVRKQAAVTLRCMQALVRVQSRVRAHRRAPSDSLELKDPVKQTEKGWCGSPRSIKEVKTKLQMKQEGAIKRERAMVYALTHQSRTCPSPSGRAITHHGLRKSSPGWNWYDDVGTFSRKSSESSVLSEYETVTVRKNNLSSTRVLARPPLLLPPVSSGMSYDSLHDETSTSSTSQSPVAFSSSVLDGGGYYRKPSYMSLTQSTQAKQRQSGLSCNGDARRSAGSDQCTDLYPPGNVWAKSQRS

SEQ ID NO: 1351 - protein, 211 aa, Arabidopsis thaliana
MALLRLPGISLQILGHKSNQKNPNPNVAFTNHSLSLSTPSLCRLHRHATFPDSIPAKSRNLTSYFSTTTQEPVLESSSSSSSAPEVVEEEISKTRLIAQNVPWTSTPEDIRSLFEKYGSVIDIEMSMHKKERNRGLVFIEMASPEEAATALKSLESCVSTTLPTCLYWNTIIEIWLRYVSYYLALRLVEVIHCAYWALLCCSYLNLIDYCM

SEQ ID NO: 1352 - protein, 429 aa, Arabidopsis thaliana
MVRSDENSLGLIGSMSLQGGGVVGKIKTTATTGPTRRALSTINKNITEAPSYPYAVNKRSVSERDGICNKPPVHRPVTRKFAAQLADHKPHIRDEETKKPDSVSSEEPETIIIDVDESDKEGGDSNEPMFVQHTEAMLEEIEQMEKEIEMEDADKEEEPVIDIDACDKNNPLAAVEYIHDMHTFYKNFEKLSCVPPNYMDNQQDLNERMRGILIDWLIEVHYKFELMEETLYLTINVIDRFLAVHQIVRKKLQLVGVTALLLACKYEEVSVPVVDDLILISDKAYSRREVLDMEKLMANTLQFNFSLPTPYVFMKRFLKAAQSDKKLEILSFFMIELCLVEYEMLEYLPSKLAASAIYTAQCTLKGFEEWSKTCEFHTGYNEKQLLACARKMVAFHHKAGTGKLTGVHRKYNTSKFCHAARTEPAGFLI

SEQ ID NO: 1353 - protein, 401 aa, Arabidopsis thaliana
MGFFGRLFGSKKQEKATPNRRRWSFATRSSHPENDSSSHSSKRRGDEDVLNGDKHAIAVAAATAAVAEAALAAARAAAEVVRLTNGGRNSSVKQISRSNRRWSQEYKAAMKIQSAFRGYLARRALRALKALVKLQALVKGHIVRKQTADMLRRMQTLVRLQARARASRSSHVSDSSHPPTLMIPSSPQSFHARCVSEAEYSKVIAMDHHHNNHRSPMGSSRLLDQWRTEESLWSAPKYNEDDDKILEVDTWKPHFRESPRKRGSLVVPTSVENSPQLRSRTGSSSGGSRRKTPFTPARSEYEYYSGYHPNYMANTESYKAKVRSQSAPRQRLQDLPSESGYKRSIQGQYYYYTPAAERSFDQRSDNGIAGYRGVSDGLDRNQSDKSKMYTSFFSSNPLFFQ

SEQ ID NO: 1354 - protein, 327 aa, Arabidopsis thaliana
MEEIVVESLLSGNRESQIEAAIELTNLSRKQRQKLAEREIISPLLSMLQSQDCITTEVALSALLSLAFGSERNKVRIVKSGAVPTLLEILQSETKMVVLELAMAFLLILSSCNKNKVKMASTRLVQLLVGLIGLDRLTIQAKVDGIATLQNLSTLHQIVPLVIASGAPYALLQVINFCDKSSELADKAVALLENIISHSPESVSSIGGAIGVLVEAIEEGSAQCKEHAVGILLGICNNDRETNRGMILREGVMPGLLQVSVDGTRRAKEMARELLLLLRDCSGYVIKNKQSKIEIVEQIMREIDQEGERIPGTMLKLVEEMISKLST

SEQ ID NO: 1355 - protein, 232 aa, Arabidopsis thaliana
MPIILCGDWNGSKRGHVYKFLRSQGFVSSYDTAHRYTDSDAHKWVSHRNHRGNICAVDFIWLLNPNRYRKLLKTSWSEAVFGMFRYLLRRASLTAEDAFAFLKTDNDGDHITFMGFCETLRQLNLTGHCNGLTTKEIKDLWTQADIDGNGLLDYKEFQQRIWNQTWSEQRDAEDGEAKGNQEQTVGFSVKNAVLFPPEVEKGMWPENYSLSDHARLTVVFSPIRMPCSQLVS

SEQ ID NO: 1356 - protein, 475 aa, Arabidopsis thaliana
MATLYSQVPSVSAVFSLYTSFSAITMLFRTILNEIVPKRIREYIAMKAVDFFSSYFQSDFTFVIEQRWEFVENQTFRAAEVYLPTCLAGLSTGKLLVGSSNLKNPAAEPKLGIPVNTKIIDNFEGIHLEWTLHSVETKKYLPEKRYFHLTCKKEFREKIMTDYFTYLAKSAEKIMSHRENLKIYTYNQDRSKWESAIFEHHTTFETLAVEPDLKKTLIDDLDAFSKGKDFFKSVGRAWKRGYLLYGPPGTGKSSMVAAIANHMKYHIYDLQIQSVRDDGELREILTSTKNRSILLIEDIDCGADASRRRQSKKKEEDGGEDDGEPQKRKKKFEVGISLSGLLNFVDGLWSSCGEEKIIIFTTNHKEKLDPALLRPGRMDVHILMDNCTPFVFKKLVALYLKTDEHVLFDPIEKLILEVSSTPAEVTQQLMASKNADIALKGLAEFLENKKLKKGEDSSVEEEGEIEDAETKEAET

SEQ ID NO: 1357 - protein, 220 aa, Arabidopsis thaliana
MALELWQTLKEAIHAYTGLSPVVFFTALALAFAIYQVISGWFASPFDDVNRHQRARSLAQEEEPPIPQPVQVGEITEEELKQYDGSDPQKPLLMAIKHQIYDVTQSRMFYGPGGPYALFAGKDASRALAKMSFEEKDLTWDVSGLGPFELDALQDWEYKFMSKYAKVGTVKVAGSEPETASVSEPTENVEQDAHVTTTPGKTVVDKSDDAPAETVLKKEE

SEQ ID NO: 1358 - protein, 414 aa, Arabidopsis thaliana
MASSSSQRRCVFVGNIPYDATEEQLREICGEVGPVVSFRLVTDRETGKPKGYGFCEYKDEETALSARRNLQSYEINGRQLRVDFAENDKGTDKTPGALGGPQVGSQFTQSNLQVPASDPLALHLAKMSRSQLTEIISSIKLMATQNKEHARQLLVSRPQLLKAVFLAQVMLGIVSPQVLQSPNIVQAPSHMTGSSIQDAQLSGQNLLPPLAQRSQQLSRAPHSQYPVQQSSKQPFSQIPQLVAQPGPSSVNPPPRSQVKVENAPFQRQQVVPASTNIGYSSQNSVPNNAIQPSQVPHQALPNSVMQQGGQTVSLNFGKRINEGPPHQSMNRPSKMMKVEDRRTTSLPGGHVSNSMLPNQAQAPQTHISPDVQSTLLQQVMNLTPEQLRLLTPEQQQEVLKLQQALKQDHMMQPS

SEQ ID NO: 1359 - protein, 414 aa, Arabidopsis thaliana
MGGSGNWIKSLITNKKNITDDQEKNIKKKWKLWRTSSEGLISSSKGFKSRGGSYGTPSLGSDPPSFSADDSFTAAVAAVIRAPPKDFFLVKREWAATRIQAAFRAFLARQALRALKAVVRIQAIFRGRQVRKQADVTLRCMQALVRVQARVRAHCNRGPSDGQELEKPSDQQKDDPAKQAEKGWCDSPGSINEVRTKLQMRQEGAIKRERAMVYALTHQPRTCPSPAKASKQGSVKKNNGSCKSSPGWNWLDRWVADRPWEGRLMEGPTNSSENARKSESSVSEHDTVQVRKNNLTTRVLARPPPMSSSATSSESSSTSQSPVPFSGSFLEEGGYYRKPSYMSLTQSIKAKQRRSGSSSSCSKTPFEKKQSMSYNGDVNVRRSAGSDPLNNQWTDLYPPAQVTGRHMWAKSQRG

SEQ ID NO: 1360 - protein, 476 aa, Arabidopsis thaliana
MQSRIVGLAPAFSLFPNLNTPHKTFTFHQILVLIITFTAYASFHASRKPPSIVKSVLGPPSLNSSSIDNGWAPFNGTQGTKRLGELDLAFLSSYALGMYFAGHLGDRIDLRYFLVFGMMGSGILTLVFGLGYWMNVHTLGFYMSVQIVCGLFQSIGWPCVVSVVGNWCGKEKRGLIMGLWNSHTSVGNILGSVIASSVLDFGWGWSFVLPGVLVLVSGVVVFMFLVVSPNDLGFEELGKEIEIEMSLGENVEESLRKHEAEGAVLLENVDDSSFAIGFLEAWRLPGVAPYAFCLFFSKLVAYTFLYWLPYYLRHTAVAGVNLSHKTAGILSTVFDVGGVLGGISAGFISDKIKARALTSITFLALSIPALIMYRVYGINGPYALITTAVAADLGTQDSIKGNGRALATVTAIIDGTGSVGAALGPLLAGYISSRGWNSVFFMLIVSIFFAGLFLVRLAKSEINTMRSGELIASSVP

SEQ ID NO: 1361 - protein, 573 aa, Arabidopsis thaliana
MALSKNSNSNSFNKKKVSYISVPSQIINSLSSSSLQSLLVSPKKSSRSTNRFSFSYRNPRIWFFTLFLVSLFGMLKLGFNVDPISLPFSRYPCSTTQQPLSFDGEQNAASHLGLAQEPILSTGSSNSNAIIQLNGGKNETLLTEGDFWKQPDGLGFKPCLGFTSQYRKDSNSILKNRWKYLLVVVSGGMNQQRNQIVDAVVIARILGASLVVPVLQVNVIWGDESEFADIFDLEHFKDVLADDVHIVSSLPSTHVMTRPVEEKRTPLHASPQWIRAHYLKRINRERVLLLRGLDSRLSKDLPSDLQKLRCKVAFQALRFSPRILELGNKLASRMRNQGQYLSLHLRMEKDVWVRTGCLPGLTPEYDEIVNSERERHPELLTGRSNMTYHERKLAGLCPLTALEVTRLLKALEAPKDARIYWAGGEPLGGKEVLEPLTKEFPQFYNKHDLALPGELEPFANKASVMAAIDYIVCEKSDVFIPSHGGNMGHALQGQRAYAGHKKYITPNKRQMLPYFMNSSLPESDFNRIVKDLHRESLGQPELRMSKAGKDVTKHPVPECMCSDRQQQEQQSDA

SEQ ID NO: 1362 - protein, 227 aa, Arabidopsis thaliana
MGSRQGPPKHQNKFAWVPKAGVKINETEVGGRFRPLSEITGVCYRCREQIAWKRKYGKYKTLTEATKCQKCTKRNVRQAYHKLCPGCAKEQKVCAKCCQSVDQILGRDIYEVEAEQKLLDETIKNARERDRRTLLRAMNKDNKPNKSDEEASRSDSSKVGDVFPSTSLEEYANKSGRVSGIIGHGSVPDHAHDDASGPESDEDDNVGDDEHDLREDSDENEQSQLQK

SEQ ID NO: 1363 - protein, 107 aa, Arabidopsis thaliana
MATIISCSALSSIRASSESDPARKKPVSSVSWWAPLFGMSSEPDYVNKTVNLESDLDKAEKRSLRCCLTEEKAKQLRRKTAEASTFHDVMYHSAIASRLASDVRVKK

SEQ ID NO: 1364 - protein, 233 aa, Arabidopsis thaliana
MVSSSLTKLVFFGCLLLLTFTDNLVAGKSGKVKLNLYYESLCPGCQEFIVDDLGKIFDYDLYTITDLKLFPFGNAELSDNLTVTCQHGEEECKLNALEACALRTWPDQKSQYSFIRCVESDTKGWESCVKNSGREKAINDCYNGDLSRKLILGYATKTKNLKPPHEYVPWVTLNGKPLDDSVQSTDDLVAQICNAYKGKTTLPKVCNSSASMSKSPERKWKLQVSYANKATNY

SEQ ID NO: 1365 - protein, 187 aa, Arabidopsis thaliana
MAFLVEKQLFKALFSFFLLVLLFSDTVLSFRKTIDQKKPCKHFSFYFHDILYDGDNVANATSAAIVSPPGLGNFKFGKFVIFDGPITMDKNYLSKPVARAQGFYFYDMKMDFNSWFSYTLVFNSTEHKGTLNIMGADLMMEPTRDLSVVGGTGDFFMARGIATFVTDLFQGAKYFRVKMDIKLYECY

SEQ ID NO: 1366 - protein, 115 aa, Arabidopsis thaliana
MGSGMIRTLVILAIALFMIGSDNVHVAKAQVCGANLSGLMNECQRYVSNAGPNSQPPSRSCCALIRPIDVPCACRYVSRDVTNYIDMDKVVYVARSCGKKIPSGYKCGSYTIPAA

SEQ ID NO: 1367 - protein, 110 aa, Arabidopsis thaliana
MLKFPLCCSELSLEPKILAFESQLVSGRRDTIKVSAGKIGNFSLGSIFKSCETCGAKGAIECPGCKGTGKNKKNGNMFERWKCFDCQGFGMKSCPKCGKGGLTPEQRGER

SEQ ID NO: 1368 - protein, 420 aa, Arabidopsis thaliana
MAATASSEASEGPVMGLINKRLRALRKKYNRITQMEESISQGKTLNKEQEEVLRSKPAVVILIDELEKIRAPLSAAVTEEISLATQLNRASSDQTTASEQKEVTDIPQEVSGGDDGAKLEDLVNFLYFGSLFDVKSQNEFTSIMLTRTHERSCCLSYDYVTDDATDLLGDRDLDSISQLWSLMVSRPVDSSLSHKNALERCVEHAKLWLANSEQPIESNCNTSYAALREKLKKIMASDYFTTTPEMKAPVDVAAAAGNYTSYQVPVDVEASGHYQQKEEDASNSKEVESVVNDQSQQDEHQKVELVTEGEVVHGQQEQGYTQVGGAENAKRDYVPRGSYQNQRGRRGARRGGGGYQNGRGGRGGGGGYQNGRYESYDQSGGNGYQRNYYNNRGRGRGGGGGGGNGHSYNNYQDPNVAVAS

SEQ ID NO: 1369 - protein, 300 aa, Arabidopsis thaliana
MLKVPEHQVAGHIASDGKLGPLVDDQGRFFKPLQGDSRGEHEAKFYESFTSNMKVPDHIHRYFPVYHGTQLVEASDGSGKLPHLVLDDVVSGYANPSVMDVKIGSRTWYPDVSEEYFKKCIKKDRQTTTVSLGFRVSGFKIFDHQESSFWRAEKKLVLGYNADGARLALRKFVSSNSPADSNLTPNCAFASEVYGGCNGILAQLLELKDWFETQTLYHFNSCSILMIYENESILMQGGDDAPAPRAQVKLVDFAHVLDGNGVIDHNFLGGLCSFIKFIKDILQSVEKHDETDTSLLENGR

SEQ ID NO: 1370 - protein, 429 aa, Arabidopsis thaliana
MAFRQTLSIRSRLFARRNQPVYHIIPRESDHERDSFCQETSQRSYHSFLHQRSVNNSDFSKVSGGSLHLPLAPTSGFAFYRYMSSAPGVGSEKIGVMSDIAEVITDSTLQDVPAQAAAAVSEVTLAAADSFFPIAALQQCIDMVHTFTGFEWWASIVVATILIRSSTVPLLIKQMKDTTKLALMRPRLESIREEMQNKGMDSVTMAEGQKKMKNLFKEYGVTPFTPMKGMFIQGPLFICFFLAIRNMAEKVPSFQTGGALWFTDLTTPDSLYILPVITGLTFLITVECNAQEGMEGNPMAGTVKTVCRVFALLTVPMTMSFPQAIFCYWITSNLFSLMYGLVIKRPQVKKMLRIPDLPPPPPGQQPSFDLFSALKKMKAMTQDHTQNQIEPPSPVNPRLSSTSLSPVSKRLKALESQVKGRKKNSSKKK

SEQ ID NO: 1371 - protein, 329 aa, Arabidopsis thaliana
MARELVSLQYLRPPLHISRQFLNLSSPPLTLNLRPKPPQNPIFIRTDSHRNKTSADDNGIPAEDVKTIAKFKSRHNYIRVIEVSRKTNHPLAGSRLLLLDNPGNIHSISFLLKTLTDSYFDVFATLPPIIPPGPIGILGFGAGSTARLILELYPPEIAVHGWELDPSVIDVGREFFGLSKLERDHKDRIFINIGDALNASVKTGFSGILVDLFSKGSVIKELQDPQVWEDLKSRLRYRGRIMVNVGGKCVEAEDSDRDGALVMEETLRVMSQVFGDKLFVLTLGNGNDSSVALTGDLPDLDAWKKRLPRSELRSYVDMWIPYREFCLRY

SEQ ID NO: 1372 - protein, 254 aa, Arabidopsis thaliana
MSTTTTTAALPQRHQSKVDPQNVNRAVKSLLKWWDSKSKTENSESLENDGFVYLIVTLKRIPQLDRTNPLMIPLPHPLIDLVAEDPPELCLIIDDKHKNKITKEAALKKIEAEKIPITTVIKVSKLKSDLRKLEEEKRFELYFAERRLMPMLPKLLGKEFVKKNKTPIAINLRHGSWKEQIEKACESALFFVGTGTCSVVKVAKLSMGRNEIAENVVAAMNGIGDLVPGRWKNVKLFHLKLLESLALPVYQSVA

SEQ ID NO: 1373 - protein, 339 aa, Arabidopsis thaliana
MLSGNNGNTAPPVFMNENQLQYQTNLRSNQLHLLGNMGGGCTVDPVNYFANDNLVPMIRPNKRGREAESISNNIQRQQQKLQMSLNYNYNNTSVREEVPKENLVSTGLRLSYDDDEHNSSVTSASGSILAASPIFQSLDDSLRIDLHRQKDEFDQFIKIQAAQMAKGVRDMKQRHIASFLTTLEKGVSKKLQEKDHEINDMNKKNKELVERIKQVAMEAQNWHYRAKYNESVVNVLKANLQQAMSHNNSVIAAADQGKEGFGDSEIDDAASSYIDPNNNNNNNMGIHQRMRCKMCNVKEVSVLIVPCRHLSLCKECDVFTKICPVCKSLKSSCVQVFFS

SEQ ID NO: 1374 - protein, 243 aa, Arabidopsis thaliana
MAGRSGGGRGGGGGGASADLHSAARSGDLAAVQSIISSNPLAVNSRDKHSRTPLHLAAWAGHNEVVSYLCKNKADVGAAAGDDMGAIHFASQKGHLEVVRTLLSAGGSVKSITRKGLTPLHYAAQGSHFEIVKYLVKKGASVRATTKAGKSPADVAGNAETQNFLEECEEQARKAKVNNEKKTEIVKPESCSNEGDVKDLKRKDSEDGNEGEEEEASSKPKKPKVALSHLQDIDDTEADQEEE

SEQ ID NO: 1375 - protein, 645 aa, Arabidopsis thaliana
MGASHSHEDLEICSSDEDEYEEYEEGREGEEEEETFQDSRDDTLGISSSGGRRLRPKSPSSSLDDVEAKLQALKLKYPLTQSAPSTQNSARLFRYINGNTPKAKWVTAEKLTAYCFVKTNKGDEDDEDDDENGDVENEWWILKVGSKIREKVSDEMQLKAYKDQRRVDFVAKAVWAMKFASSEDFSVFVSSYNNCLFENNHGVEFNEANKAKIYGKDFIGWANPEAADDSMWEDADDILLQSPGGGSATPARDTQDLTEAFEEATSEGIHSLALGALDNSFLVGDSGIQVFKNMRQGIQGKGVCVNFEPGYGRTHSSAPKKALLMRAETNMLLMSPMSQTPHSRGIHQLDIETGKIISEWKFEKDGVDISMSDITNDGKGAQLDPSASTFLGLDNNRLCRWDMRDRYGMVQDLATANTPVLNWAQGHQFSRGTNFQCFATTGDGSIVVGSLDGKIRLYSSNTMRQAKTAFPGLGAPVTHVDATFDGKWIVGTTDTYLIVICTLFTDKSGKTKTGFEGRMGNKIAAPRLLKLRPLDAHLAGSDNKFRNAQFSWVTEDGKQERHVVATVGKFSVIWNFQQVKNGSHECYHDQEGLKKCYCYKIVLRNESIVDSRFMNDNFAISGSPEAPLVIATPMKVSSFSLSSKR

SEQ ID NO: 1376 - protein, 217 aa, Arabidopsis thaliana
MEENPHRVSRRNHGGTHCQNDAVDEENRRRRHNHHTHGDEVKCSSKRCRSWAAAAIADCVALCCCPCAIINLLTLTLVKVPWMIGRRCLGGGGRNKKKRRVIHRRKRRGNINGEDEFYHHNNHHRRFETAEEGEKCGCGGGGGGCYGGGDYDDHRFVVERDGSLTKEEEEEERTTSCKGEDHDESRISARVEAERVWLELYQIGHLGFGRVSFTGIQ

SEQ ID NO: 1377 - protein, 419 aa, Arabidopsis thaliana
MHSPLQTQQPEQRCWPMTSTVSEIEEVLPDEDSDRTTLLNGEPLRRRVSGKSPVDEGPRRIFRQQSFGRDIGHAAAETYLITGLSFKLLRYLGLSMDDKITCPYMLCYASYAWLSSRLDLYLPSNNDGLKPVVVFVTGGAWIIGWLLVNKFMFANLVLIFRYKAWGSLLGMQLAERDIIVACLDYRNFPQGTISDMVTDASQGISFVCNNISAFGGDPNRIYLMGQSAGAHIAACALLEQATKELKGESISWTVSQIKAYFGLSGGYNLYKLVDHFHNRGLYRSIFLSIMEGEESFEKFSPEVRLKDPVVGKAASLLPPIILFHGSSDYSIPCDESKTFTDALQAVGAKAELVLYSGKTHTDLFLQDPLRGGKDELFDDIVSVIHAEDNDGLTKDSLAPPRKRLVPELLLKLAREISPF

SEQ ID NO: 1378 - protein, 135 aa, Arabidopsis thaliana; identical to SEQ ID NO: 1252

SEQ ID NO: 1379 - protein, 532 aa, Arabidopsis thaliana
MVARRNKPKAPLVKHRFSGGDSHKPKPPPATKQPFSGVESHKPKTSPATKQKFSGVESHKPKTPPGKQRFSGAESRKPKTPPATKQKFSSLERSALYARREAANILRTVLRGDAERRAVASIKSLVLSPSVRNKRGTFALVCETLKYLTVIKDVLDIANVLNSKWKRQEPLVFIVCYDILFGKDTPSIGDAEKFLMRHKEALLSGLATLLVRKKVDSVDQLLGSKLTGHLKPRYVRVNTLKMDVDSAVQELEKHYTVQKDETVPDLLVLPPGSDLHAHRLVANGRIFLQGKASSMVAAALQPQAGWEVLDACSAPGNKTIHLAALMEGQGKIIACELNEERVKRLEHTIKLSDIEVCHGDFLGLNPKDPSFAKIRAILLDPSCSGSGTITDRLDHLLPSHSEDNNMNYDSMRLHKLAVFQKKALAHALSFPKVERVVYSTCSIYQIENEDVVSSVLPLASSLGFKLATPFPQWQRRGLPVFAGSEHLLRMDPVEDKEGFFIALFVRANKLDNPKSSELPDRSLEWDLAQAQD

SEQ ID NO: 1380 - protein, 309 aa, Arabidopsis thaliana
MAQEADGIRLDQRHGKARVRVGRVWRHAHDGSHHFVEWNVSISLLSHCLSSYRLDDNSDIVATDTIKNTVYVKAKECGDRLSVEEFAILIGKHFCSFYPQVFTAIVNIIEKPWERVSIDGKPHLHGFKLGSENHTTEARVEKSGALNLTSGIGGLALLKTTQSGFERFVRDKYTILPETRERMLATEVNASWRYSYESVASIPTKGLYFSEKFMDVKKVLMDTFFGPPETGVYSPSVQRTLYLMGSAVLKRFADVSSIHLKMPNIHFLPVNLSTKENPSMVKFKDDVYLPTDEPHGSIEATLSRITSKL

SEQ ID NO: 1381 - protein, 263 aa, Arabidopsis thaliana
MASKFSGSHKQSKPTPGSSSSNLRKFPDFDTASESVPYPYPGGSTSSTPAWDLPRSSYHQSGRPDSRFTSMYGGERESISAQSCDVVLEDDEPKEWMAQVEPGVHITFVSLPSGGNDLKRIRFSREVFDKWQAQRWWGENYDRIVELYNVQRFNRQALQTPGRSEDQSQRDSTYTRIDSARESRDWTQRDNNFRPPGGSVPHHFYGPPMDAARITTSSRDEPPSMSNASEMQGEWVEEDEPGVYITIRQLPDGTRELRRVRFR

SEQ ID NO: 1382 - protein, 204 aa, Zea mays
MKLKLLSPCLLLLAFFATAAYAASASASRAAAVVRGAGAPSQSELESDPENQCVYTVYVRTGSIWKGGTDSTIGVTLLGPDGTGIRIRDLAGWGGLMGAGHDYYERGNLDIFSGRGPCMSQAPCAMNLTSDGTGAHHGWYCNYLEATVTGPHLGCAQQLFTVEQWLATDASPYRLYAVVDKCKTKRQEPRRSPAGEAEATVTAL

SEQ ID NO: 1383 - protein, 515 aa, Zea mays
MSAARRRSPIPVLLFFLLLHSASPSPIKTVVVLVMENRSFDHMLGWMKRLNPEIDGVTGREWNPANASDPAAGRVYFRDGAAYVDPDPGHSFQEIRQQVFGSDDDAADNPPRMDGFAQQARSIGGGAMSDAVMRGFNPADVAVYRELVSQFAVCDRWFASVPSSTQPNRLFVHSGTSGGATSNNPTLLAEGYPQRTIFDNLHDAGLSFGVYFQDVPAVLFYRNLRKLKYLLDFHPLRPSFADHARRGTLPNYAVIEQHYLDSKLDPANDDHPSHDVYQGQMLVKYVYETLRASPQWNQTLLVITYDEHGGFFDHVPTPVAGVPSPDGIVGPPPYNFTFDRLGVRVPAILVSPWIDRGTVVHGPHGPTPTSQYEHSSIPATVKKIFGLPQDFLTRRDAWAGTFEGVVQGRTEPRTDCPEQLPTPTRIRQTEADEEAKLSEFQQEIIQLASVLNGDHHLATLQDRIKNDMNVREGIDYMKAAVKRYFQAGASARRMGVDGDQIVKMRPSLTTRIQRP

SEQ ID NO: 1384 - protein, 349 aa, Nostoc sp. PCC 7120
MAKASESLDLSVNESTDKALDRDCTTLSRHVLQQLQSFSADAQDLSALMNRIALAGKLVARRLSRAGLMEGVLGFTGEVNVQGESVKKMDVYANDVFISVFKQSGLVCRLASEEMDEPYYIPENCPIGRYTLLYDPIDGSSNTDTNLSLGSIFSIRQQEGDDSDGQAKDLLTNGRKQIAAGYILYGPSTMLVYTMGTGVHSFTLDPSLGEFILSEENIRIPDHGAVYSVNEGNFWQWEESMREYIRYVHRTEGYTARYSGAMVSDIHRILVQGGVFLYPGTIQNPEGKLRLLYESAPLAFLIQQAGGRATTGLVDILDVVPKKLHQRTPLIIGSKEDVAKVESFIQNGH

SEQ ID NO: 1385 - protein, 557 aa, Sinorhizobium meliloti
MYRYDEFDHAFVSARVEQFRDQVQRRLSGELAEDAFKPLRLMNGVYLQLHAYMLRVAIPYGTLSSRQMRMLAHIARKYDRGYGHFTTRQNIQYNWPRLSDTPDILQELASVEMHALQTSGNCIRNVTADHFAGAAADEVADPRPYAEILRQWSSVHPEFSFLPRKFKIAVTGAERDRAAIQVHDIGLHLKKDENGKLGFAVYVGGGQGRTPLIAKKIRDFLPEEDLLSYTTAIMRVYNLHGRRDNKYKARIKILVHETGAEELARQVELEFANLKDTELKLPDADIQAIAAYFAPATLPNRTEGWGSLARWKKADPEFARWVHQNVQPHKHPDYGMVTISLKPIGGIPGDASHEQMDAVADIAEEYAFDEIRVSHEQNLILPHVALADLEPVYRALVAAGLATANAGLITDIIACPGLDYCALANARSIPVAQEISNRFGSPERQAEIGELKIKISGCINACGHHHVGHIGLLGVEKKGAELYQITLGGSGDEHTSIGEIIGRGFEPERVTDAVETIVDTYLGLRRDKSETFLEAYRRVGPQPFKDALYGGGAQAAA

SEQ ID NO: 1386 - protein, 475 aa, Bacillus halodurans
MFRGKLYIDGTWTGDLLDTFDVKNPATGEVVGVMPNGGKAEAAAAIEAAQRAFLKWRKYTAAERANFLMTWHDLLLQQKEEIAEMLTMEMGKPLAEARGEIEYSASFIRWFAEEGKRVYGRTVPASAENKRIHVQKQPVGVVAAITPWNFPAAMIVRKMAPALAAGCTFVGKPAELTPLTAVKIVELCEEAGFPKGVVNLVCGDAKEIGEEMTSHEHVRKLTFTGSTAVGKLLMKQSAGRMLNLSLELGGQAPMIICDDADLDKAVAGVVASKYRNAGQTCVCGNRIYVQETIVDEFVKRLTGKVVQLKVGNGLEEGVHIGPLIEKKGYEKVKAHVDDAVAKGARVVIGGKGQEGNDSYFYDPTILTDVHDEMLVMQEETFGPVAPIQTFATDEDVIEKANGTRYGLAAYFFTENYARGIRLSEALDFGIVGWNDGAPSIAQAPFGGMKESGLGREGGQEGIEAFLETKFVSIGL

SEQ ID NO: 1387 - protein, 906 aa, Pseudomonas syringae
MTSMAIQTTQVTASTCCYCGVGCGVLIEHDGQRILGVSGDPQHPANFGKLCSKGSSLHLTGDIEARALYPELRLSKGLARSVTDWDTALEHAATVFAESIREHGPDSVAFYISGQLLTEDYYAFNKLARALVGTNNIDSNSRLCMSSAVAGYKRSLGADAPPCSYEDLELSDCVMIVGSNMAYAHPILFRRLEEAKSRRPAMKLIVIDPRRTDTCELADLHLAIQPGTDVALFHGILHVLMSENLIDPQFIAAHTLGYDELAALVCDYPPERVANICGISQQHLHTCARWLGKSAGFLSLWCMGLNQSTAGSAKNSALINLHLATGQIGRPGAGPFSLTGQPNAMGGRETGSLSNLLPGHRDAANPEHRAEVAEYWGIDSLPATPGLSAIELFEQLQNGTIKALWIACTNPAQSLPDQNRIRQALETCPFVVLQEAFKTTETARFADLLLPAASWGEKEGTVTNSERRISNVRKAIQAPGEARSDWAITVDFAQRLQKRLQPEAPALFDFQTPKSLFDEFKGLTVGRDLDMSGIDRELIDRQGPQQWPFPTGASVGTPRLYLDGIFPTASGRAQFLAEPYIAARELRDAEYPLTLNTGRLRDQWHGMSRTGTAARLFGHVSEALLSLNPKQMLGHDLQNGDLVKLISRRGELLLPVSSDDSVVAGQAFLPMHWGERFLKGGVNVLTQPAFDPLSKQPELKHSGVRIEKARLPWQFFALIEGNVQQHMERLRPLCEAFTYLSMGLIGRERPALVVRAASTEAPDSTLLQRIDSLLNLDEGPVMAYDDPKRSIGKRVRIDNGRITAIRLAGETLAQHWLQTLWLQERADPALRRWLLAPLSSEPGKDSTLSRDKTLCNCMNVSQSTVMSGIERGLNLNQLKTQLGCGTQCGSCVPEIKRLINAVAVTE

SEQ ID NO: 1388 - protein, 765 aa, Nostoc sp. PCC 7120
MRIDVESQNINVTSLKEAPIHLSGQIQPHGVLLVLEEPGLKILQVSNNTWGILGINAENILQKKLEDLLDSFQIERIQSGLSSGNLEFINPTKIWIRKKGDDYAVFDAVFHRNTEGFLILELEPAITQENIPFLSFYHLAKASINQLQKTANLRDFCQIIVQEVRKVTDFDRVMLYKFDDDGHGSVIAEEKLDSLEPYLGLHYPESDIPKPARKLFISNSIRVIPNAQAQAIQMIPALNPVSDRPVDLTNSILRSAANCHLEYLHNMGVGASLTISLIKDNKLWGLIACHHLSAKYVSYELRKACEFLGRVIFAEISAREETEDYDYRMNLTHIQSLLVEYMSQEDNFVDGLIKHQPSLLDLTSAQGAAVCFGDHCTLIGETPKAEDLVFLVQWLKNNVEEEVFYTDSLPQVYPDAERYKNVASGLLAIPISQRNYVLWFRPEVIQTVNWGGDPNQPFEVNKLDGNVRLCPRKSFELWKETVRLTSLPWRYVEIRAALELRKAIVNIVLRQADELAQLAHDLERSNAELKKFAYVASHDLQEPLNQVANYVQLLEMRYQDQLDADANEFITFAVEGVSLMQTLIDDVLAYSKVDTQAIAFQLTEVEKALDKALGNLRQRIAETGANITHDPLPTVMAGSTQLMQLFQNLIANAIKFRSEEAPQIHIGAERLEDEWLFSVRDNGIGIDPQFSDRIFVIFQRLHTRDEYHGTGMGLAICKKIIECHRGRIWVESQLGEGATFYFTIPVGGRERERRNGRKTQNNLFS

SEQ ID NO: 1389 - protein, 650 aa, Nostoc sp. PCC 7120
MVKSAPPPTTGRKPSKVEGLKENSNFLREPVATQILEDTTHFTEDAVQILKFHGSYQQDNRDNRTKGQEKDYQFMLRTKNPGGLVPPQLYLALDKLADEYGNHTLRATTRQGFQMHGILKKNLKAAIATIVRNLGSTLGACGDINRNVMAPPAPFKNRAEYQYAWEYAQNIADLLSPQTGAYYEIWLDGEKAISAEESPEVKAARQSNGNGTIIHDTEEPLYGTYYMPRKFKVSVTVPGDNSIDLYSQDLTLVVLTDKKGNLEGFNIFAGGGLGRTHNKEETFARLADPIGYVAKEDVYSAVKAIVATQRDYGDRTDRRHARLKYLINDWGVDKFRAKVEEYFGKPIAPFKQLPEFKYHDFLGWHEQGDGNLFLGISIDNGRVKDEGAFQLKTALREIVEQFNLPIRLTPNQNLIFYEITPENKPAIQAILDRCNVVSDPTTIEPLVRYAMACPALPTCGLAITESERAIPGILERIRTLLDKLGLQNEHFVVRMTGCPNGCARPYMAELGFVGSAPESYQVWLGGSPNQTRLAQPYVEKLHDNDIESFLEPIFVYFRKYRKSGESFGDFCDRVGFDAIREFVAEYQPETTPVTIEPEQPEVVSKSRKARYRVSLHDDLYNKVKATATSQGRSMTDLVKDALEAYFQSLS

SEQ ID NO: 1390 - protein, 915 aa, Chlorobaculum tepidum
MANSHANEESAAAKKYIYSFAGGAAEGDASMKNLLGGKGANLAEMANIGLPVPPGFTLSTEVCAYYYDHQKTYPANLFETEIPAALKKVEDYLGKKFGDPENPLLVSVRSGARASMPGMMDTILNLGLNDKTVEGLARKSGNPRFAWDCYRRFVSMYGDVVLDLKPADKKQIDPFEEILEQKKQELGIHLDTELGVDDLKDLVGKYKKAILEKTGKTFPENPEEQLRGAISAVFNSWNNERAIVYRKLNHIPGWWGTACNVQAMVFGNMGEDCGTGVAFTRDAATGDNIFYGEFLMNAQGEDVVAGTRTPLKIEQLAQEKPAIYNQLEEIRSILEKHYRDMMDIEFTIENDKLFMLQCRVGKRTGLAAIKIAVDMYNEGLIDEKEVLRRIEPEQLNQLLRPVFDLKEKKAAIDSGRLLATGLNAGPGAATGRVYFNADDAMEANARGEKVILVRIETSPEDIKGMNAAEGILTERGGMTSHAALVARQMGKVCVAGCGTLRIDYKAGEMRVAGKDIVIKEGEYISIDGTTGEVIAGEVKTKNSEILEVLIDKTLDPADAPTFRIYNQLMQWADKYRKLNIRTNADQPDQAEIAITFGAEGIGLCRTEHMFFGGDRIDAMREMILADDIAGRKVALDKLLPYQRDDFYGLFKAMGSRPVTVRLLDPPLHEFLPHTDAEIDDLAGKIGKTSAEIKARIESLHEFNPMLGLRGCRLGILHPEIIVMQVRAIIEAACRIKQEGQEIVPEIMVPLVSTVKELEITSEVIHKTARSVISEQGVGVKYLVGTMIEVPRAAITSDQIAQAADFFSYGTNDLTQMGLGMSRDDSGQFLPIYQQQEIFARNPFESIDIDGVGRLVSISAKEGRSVKPDLKLGICGEHGGDPATVEFCHKTGLNYVSCSPFRVPIARLAAARAALL

SEQ ID NO: 1391 - protein, 428 aa, Synechocystis sp. PCC 6803
MTGSLFADASKRLEKALKYVAISDDAGERLKYPKTSLSVSIPVRMDDGSLKIFPGYRVRYDDTRGPGKGGVRYHPNVTMDEVQSLAFWMTFKCALLNLPFGGAKGGITLNPKELSRAELERLSRGYIEAIADFIGPDIDILAPDVYTNEMMMGWMMDQYSIIRRKISPAVVTGKPVTMGGSQGRNTATGTGAFYIMQGMLPKFDQYPENTTVAVQGFGNAGMVVAECLYQDGYKVVAISDSQGGIYNEQGIDIPAVIDYKQRHRTLAGMYCDQAICDLGENQQISNAELLALDVDVLIPAALENQITRDNADQVRARYIFEVANGPTTTAADDILASKGIYVFPDILVNAGGVTVSYFEWVQNRSGLYWSAKEVNDRLKEKMVEEAEHVWNITQELDVNVRTAAYIHALNRLSEAMDAKGTRDYYQDS

SEQ ID NO: 1392 - protein, 485 aa, Chloroflexus aurantiacus
MVDYPFFHVSHYIDGQFVDGGSRFDILYPATNQVIGSAPEAGADEVDAAVAAASRAFRQWSRMPAAERRLILKRFAQLIRDHEAELAAIETWDVGRPITENRSGYIPRIAANIEFFADFAVTHGSESYPMDNGYINYVLRQPVGVAALIAPWNIPLLQATWKMGPALAFGNTVVLKPAELTPIGTWRLAQLAHAAGVPAGVINVIHGFGPNSAGALLTRHPDVKLISFTGETTTGKIIMATAAPTLKRVSFELGGKGANIIFADADLDRAVAISLRSSFFNQGEFCLAGPRLLVQRPIYEAFLTRFQRATSQLQVGDPFDPQTRVGALISREHYERVTGFIDLARADGAHILTGGTDPVLPEPFAQGNFLQPTIITDVKPHDQVCQDEIFGPVVTVVPFDDEEEAIAIANGVSYGLSAVVQTRDVGRAVRMGSALEAGTIWINDFFVRDLRVPFGGMKQSGIGREGGHYSLEFYTEAKTICLSNQ

SEQ ID NO: 1393 - protein, 400 aa, Chloroflexus aurantiacus
MDKKTIRDVDWAGKRALVRVDFNVPLDDQGQITDDTRIRAALPTIRYLLEHGASVVLMSHLGRPKGKPNPKYSLRPVVERLFELLPEAKEVKKTEAITGPAAEAAVAMLKPGQVLVLENTRFDPREEPNDPAMAAELAKLGDVFVNDAFGTAHRANASTEGVAHYLPAVAGFLMEKELTYIGGALNNPQRPFVTVIGGAKISDKIGVIENLLGKVDALLIGGGMANTFLLAKGLNVGDSLVEPDSVPVAQQLMARAEERGARLLLPVDVVIADAFSADAQRQVVDVSDIPAGWRVLDIGPKTIERYSAEIRAARTVIWNGPMGVFELEPFAVGTRAIAQAMAEAAANGAITIVGGGDSVAAVEQAGLADKMSHVSTGGGASLELLEGRVLPGVAALQDAE

SEQ ID NO: 1394 - protein, 473 aa, Synechocystis sp. PCC 6803
MTRTPQEVLKWIQDENIKIIDLKFIDTPGIWQHCSFYYDQLDENSFTEGIPFDGSSIRGWKAINESDMCMVPDPNTATIDPFCKEPTLSMICSIKEPRTGEWYNRDPRTIAAKAAEYLRGTGIADTVYFGPEAEFFLFDDIRFGQTENSSYYFADSVEGRWNTGREEEGGNLGYKPGYKQGYFPVAPTDTAQDIRTEMLLTMAAFGVPIEKHHHEVASGGQNELGIKFDKLVNSADNLMIYKYVIKNVAKKYGKTVTFMPKPIFNDNGSGMHVHQSLWKDGQPLFAGDKYAGFSQMGLWYIGGILKHAPALLAFTNPTTNSYKRLVPGFEAPVNLAYSQGNRSASVRIPLSGGNPKAKRLEFRCPDATSNPYLAFAAMLCAGIDGIKNQIDPGEPLDVDIYDLSPEELAKIPSTPGSLEAALEALEKDHEFLTGTGVFSPDFVESWIEYKLDNEVNPMRLRPHPYEFSLYYDC

SEQ ID NO: 1395 - protein, 339 aa, Arabidopsis thaliana
MDEKDILRNLREEEEEEEENQSEETKILISSLPWEIDYLGNKLFKYQGYWYYEDVLQSIPNIHSSFQPQETDIVVASFYKSGTTWLKALTFALVQRSKHSLEDHHHPLLSHNPHEIVPYLELDLYLNSSKPDLTKFLSSSSSSSSPRLFSTHMSLDALKLPLKKSPCKVVYVCRNVKDVLVSLWYFSQNEKIIRAENYSFKAIFESFCNGVTLHGPFWDHAQSYWRGSLEDPKHFLFMRYEELKAEPRTQVKRLAEFLDCPFTKEEEDSGTVDKILELCSLSNLSSLEINKTGSLGGVDYKTYFRKGQVGDWKSYMTSEMVNKIDMIVEEKLKGSGLKF

SEQ ID NO: 1396 - protein, 491 aa, Arabidopsis thaliana
MDPCSFVRIIVGNLAVRFPSSSSSSSSSSGPSVSGINPTAPNCYCKIRFKNFPREIVSVPVMFRTESESETRCSSSGNVSTVAACFSLSKAQIEASLKKPKFSVLSVEAYSRGNSDGDDGVSGASCGLATAGEKLLGRFEVSLDLKSAETKSFLAHNGWVALPSKKTKSKTGSDPELHVSVRVEPDPRFVFQFDGEPECSPQVFQVQGNTKQAVFTCKFGSRNSNSGDRNLLHSSSMMSEISSTRSCISSMNSEKEQPSKERKGWSITVHDLSGSPVAMASMVTPFVPSPGSNRVTRSSPGAWLILRPDGCTWKPWGRLEAWREAGYSDTLGYRFELFQDGIATAVSASSSISLKNGGSFVIDVTGGTSTTASTPTTSPQGSWDLGSGSSAGSRPASRPGSGSGSDFGYLLPQHPSAAAQNRGFVMSATVEGVGKRSKPEVEVGVTHVTCTEDAAAHVALAAAVDLSLDACRLFSHKLRKELRQQSQLGVV

SEQ ID NO: 1397 - protein, 374 aa, Arabidopsis thaliana
MGCFGPSKASRTRNNEHDKITRQNPSHQPQTMRAEEVLLQIPRCRVHLIGESEAVELASGDFKLVKVSDNGVTLAMIVRIGHDLQWPVIRDEPVVKLDARDYLFTLPVKDGDPLSYGVTFSGDDRDVALVNSLKLLDQFLSENSCFSSTASSKVNNGIDWQEFAPRIEDYNNVVAKAIAGGTGHIIRGIFSLSNAYSNQVHKGGDIMITKAEESQRNGSYNNGNSSGNEKKNGINTHLQRVRKLSKATENLSKTMLNGAGVVSGSVMVPMMKSKPGMAFFSMVPGEVLLASLDALNKILDATEAAERQTLSATSRAATRMVSERFGDNAGEATGDVLATAGHAAGTAWNVLKIRKTFYPSSSLTSGIVKNAPRK

SEQ ID NO: 1398 - protein, 537 aa, Arabidopsis thaliana
MNFRNLIASGSRLGKRFCATVFAPASATGIVEASVSSPAAANVVEASVSSPAAENGVRTSVAAPTVASRQRELYKKLSMLSVTGGTVAETLNQFIMEGITVRKDDLFRCAKTLRKFRRPQHAFEIFDWMEKRKMTFSVSDHAICLDLIGKTKGLEAAENYFNNLDPSAKNHQSTYGALMNCYCVELEEEKAKAHFEIMDELNFVNNSLPFNNMMSMYMRLSQPEKVPVLVDAMKQRGISPCGVTYSIWMQSCGSLNDLDGLEKIIDEMGKDSEAKTTWNTFSNLAAIYTKAGLYEKADSALKSMEEKMNPNNRDSHHFLMSLYAGISKGPEVYRVWESLKKARPEVNNLSYLVMLQAMSKLGDLDGIKKIFTEWESKCWAYDMRLANIAINTYLKGNMYEEAEKILDGAMKKSKGPFSKARQLLMIHLLENDKADLAMKHLEAAVSDSAENKDEWGWSSELVSLFFLHFEKAKDVDGAEDFCKILSNWKPLDSETMTFLIKTYAAAEKTSPDMRERLSQQQIEVSEEIQDLLKTVCP

SEQ ID NO: 1399 - protein, 130 aa, Arabidopsis thaliana
MVRISVLNDGLKSMYNAEKRGKRQVMIRPSSKVIIKFLIVMQKHGYIGEFEYVDDHRSGKIVVELNGRLNKCGVISPRFDVGVKEIEGWTARLLPSRQFGFIVLTTSAGIMDHEEARRKNVGGKVLGFFY

SEQ ID NO: 1400 - protein, 168 aa, Arabidopsis thaliana
MASKNSASIALFFALNIIFFTLTAATDCGCNPSPKHKPVPSPKPKPVPSPKPKPVPSPSVPSPSVPSPNPRPVTPPRTPGSSGNCPIDALRLGVCANVLSSLLNIQLGQPSAQPCCSLIQGLVDLDAAICLCTALRANVLGINLNVPISLSVLLNVCNRKVPSGFQCA

SEQ ID NO: 1401 - protein, 208 aa, Arabidopsis thaliana
MAANDSSNAIDIDGNLDSDSNLNTDGDEATDNDSSKALVTIPAPAVCLFRFAGDAAGGAVMGSIFGYGLFKKKGFKGSFADAGQSAKTFAVLSGVHSLVVCLLKQIRGKDDAINVGVAGCCTGLALSFPGAPQALLQSCLTFGAFSFILEGLNKRQTALAHSVSLRHQTGLFQDHHRALPLSLALPIPEEIKGAFSSFCKSLAKPRKF

SEQ ID NO: 1402 - protein, 549 aa, Arabidopsis thaliana
MENQEPDIEKLPRDDVPDREPDHKKLKISTTGQETDSSAVTTGGSNVAERRAPKYRRRKVAIVFAFCGVGYQGMQKNPGAKTIEGELEEALFHAGAVPDADRNKPRNYEWARSARTDKGVSAVGQVVSGRFYVDPPGFVERLNSKLPDQIRVFGYKRVAPSFSSKKFCDRRRYVYLIPVFALDPCVHGEAEMVRTDLGYEYVKCVECSEKGYKIPLGVMGKDTDCCDTKSLEIQSDISSSTCDAIGADVKCETLSSSVPSAENNLNSEVLDGADVSALSSKAEGMEESNTLAKVEMNNGEGEDMTKSESKFCYGEKEKERFNRILSYYVGSHNFHNFTTRTKAADPAANRYILSFNANTVINLDGKDFVKCEVVGQSFMLHQIRKMIGLAVAIMRNYAPESLIEASFKKDVRINVPMAPEVGLYLDECFFTSYNKRFKGSHEEVSMEEYKEVAEEFKWKYVYSHIGSAEEKDGAVAIWLHSLNQRNYPDLRSNEYQPDEVIVYKKIGEASEENIHEGNAELFVVDKVNDETSEGTTMEERTTLEEKATG

SEQ ID NO: 1403 - protein, 202 aa, Arabidopsis thaliana
MSSQISEIEQEQLIEKLEIFKIHGRDKRGRKILRIIGKFFPARFLSLDVLKKYLEEKIFPRLGRKPFAVLYVHTGVQRSENFPGISALRAIYDAIPVNVRDNLQEVYFLHPGLQSRLFLATCGRFLFSGGLYGKLRYISRVDYLWEHVRRNEIEMPEFVYDHDDDLEYRPMMDYGQESDHARVFAGAAVDSSVSSFSMRCIS

SEQ ID NO: 1404 - protein, 407 aa, Arabidopsis thaliana
MDRERRSSGRNGTPEYSNGKFRDDNGFGFLDRLENCREKSPPRSKILRIPSPTSSPPPSSSSPPFHGSNSPDRGYIEHRISKFDTLAGVAIKYGVEVADVKKMNNLVTDLQMFALKSLQIPLPGRHPPSPCLSNGSLNHGEGCSCHEPESPNHSEQEVFDSFQSLRLKSSEKKVSPAMYSLQGYYGLKPADRTVSDGGCFEMGNYKTETSHHIFNNGDNGYLRPFPSTNTPLNHHRKSRSLVNALIEEVNQSPDNNTQEPTSDKFMRRRQKSEADFSSRTPELVLKEENGSSNGGFLSIAGKGLALRSKASSRTNLAAESENGNFNPVSMNLMDAPVSDSFSSVRKSSSASSLQDPDGNSNNGSLSLWPTSKWSLKPDLLTPAAITSSIFDGLPKPLTGRRNKTALD

SEQ ID NO: 1405 - protein, 345 aa, Arabidopsis thaliana
METNSEEKLSVIELLKRALKLLFGNINLLLFLCLCSLPLFFFLIFFELSLQTTVYLTSQFLWKLLILGEDLPENDLILISEKKNDLISWLIQTFLLYFFPYTILDLLTTTTIVAASSIVYTSKEEPLGLLYLVERSIKICQNRVGGCLITSLYVLLWSTSVFLFFFLFFFLQFLSGSTNYVSIPYLSREYKGFHYQPTGLFNVVVPLTLLMQCTLFIVLTAKYSKWSSGWNMGLVVSVLEEDEDGQGIYGGDALSLSGWYRKGHEKRDLWLMLMFLVFGLATRMPCLYSKCSASGNGVMYTGFYVGLICVGNLLKWVTCLACYHDCKTMVLRKKRDVEQAKTPAA

SEQ ID NO: 1406 - protein, 456 aa, Arabidopsis thaliana
MAAARRLRTLQSQPENKVCVDCSQKNPQWASISYGIFMCLECSGKHRGLGVHISFVRSVTMDSWSEIQIKKMDAGGNERLNNFLAQYGISKETDIISKYNSNAASVYRDRIQALAEGRQWRDPPIVKESVGGGLMNKKPPLSQGGGRDSGNGGWDNWDNDDSFRSTDMRRNQSAGDFRSSGGRGAPAKSKSSEDIYSRSQLEASAANKESFFAKRMAENESKPEGLPPSQGGKYVGFGSSPGPAPRSNQQSGGGDVFSVMSEGFGRLSLVAASAANVVQTGTMEFTSKVKEGGLDQTVSETVNVVASKTTEIGQRTWGIMKGVMAIASQKVEEFTKEEASTWNQQNKTEGNGYYQNSGIGNKTANSSFGGSQSSSSGHNNSYRNSNSWDDWGEENNSKKEAAPKVSTSNDDDDGGWAGWDDNDAKDDDFYYQPASDKKSVGHNGKSDTAWTGGGFL

SEQ ID NO: 1407 - protein, 610 aa, Arabidopsis thaliana
MDPIESVEYNGFETSNGNVDHGWKKVVYPKRHRKQKQADQATANGGKTVASNGTVANGGDNVFRSLEEQAEDRRRRILAAKMTAIDSDDDGVVRSKHRSNGYGDDGYDFDGSDDEIATLKVEEVKKPKPKKEKKPKVSLPEAASKIDPLNLEAFLVEASESYASQPEIQLMRFADYFGRALSGVSSVQFPWVKMFKESPLSKLIEVPLAHIPEPVYKTSVDWINHRPIEALGAFVLWAFDCILTDLAAQQGGAKGGKKGGQQTTSKSQVAIFVALAMVLRRKPDALTNVLPTLRENPKYQGQDKLPVTVWMMAQASQGDIAVGLYSWAHNLLPVVGNKNCNPQSRDLILQLVEKILTNPKARTILVNGAVRKGERLIPPPSFEILLRLTFPASSARVKATERFEAIYPLLKEVALAGAPGSKAMKQVTQQIFTFALKLAGEGNPVLAKEATAIAIWSVTQNFDCCKHWDNLYKENLEASVAVLKKLVEEWKEHSVKLSSSPNDALTLNRTMKSFRLKNEEVITEGGANASLYKEADKSCKTISGRLSRGSGCLKGTAITLVFLAAAGAAAAAVLSSNPEVTNELKNLVDSLELHEYINKYTEVISTALKK

SEQ ID NO: 1408 - protein, 410 aa, Arabidopsis thaliana
MFSSSFLRLILLLCLVSSSFSSTTSSSNSTAADQTLRPQEELQKLTLIRQELDKINKPAVKTIQSSDGDKIDCVSTHQQPAFDHPLLQGQKPLDPPEIPKGYSEDDGSYENSQLWSLSGESCPEGTIPIRRTTEQDMLRASSVQRFGRKIRRVKRDSTNNGHEHAVGYVTGRQYYGAKASINVWSPRVTSQYEFSLSQIWVIAGSFTHDLNTIEAGWQISPELYGDTYPRFFTYWTSDAYRTTGCYNLLCSGFVQTNRRIAIGAAISPRSSYKGGQFDISLLIWKDPKHGHWWLQFGSGALVGYWPAFLFTHLKQHGSMVQFGGEIVNNRPGGSHTTTQMGSGHFAGEGFGKASYFRNLQIVDWDNTLIPASNLKILADHPNCYDIRGGTNRVWGNYFYYGGPGKNPRCP

SEQ ID NO: 1409 - protein, 397 aa, Arabidopsis thaliana
MPATEYQRSFGRSFLNLRRDTAVNSVESTTVTPELTQMEAELVSFQRKVAERFIDLNASSCEDLLSLEWVGKLLDSFLSCQEEFRSIVINHRSMITKPPMDRLVSDYFERSVKALDVCNAIRDGVEQIRQWQKLIEIVICAFNNNGGGSSGKRPLGEGQFRRARKTLIELAIGMLDEKDSSSSSVSSQHRNRSFGRNKEQLHHRTIGHFRSLSWSVSRSWSASKQLQAIGNNLATPRASDITATNGLIVPVYTMTTVLLFVMWALVAAIPCQDRGLQVHFNVPRNYQWGGSLMSLHDRIIEESKKRERKNTCGLLKEIHQFEKTSRLMNELVDSVQFPLSEEKEMEVRERVEELGKLQEALKNGLDPFERKVREVFHRIVRSRTEGLDTVGKHHGSE

SEQ ID NO: 1410 - protein, 570 aa, Arabidopsis thaliana
MIVFFFFFFCSNYSYNNAQRVVSGKEVLVTSKVEESDVVSDLPSFEVAETNTVDRSGGMLETQNVGPEEISDDEIELPEGKSTDSQNVAPVQDHSLSDAERIQREIAATSVQAAFRGYLARRAFWALKGIIRLQALIRGHLVRRQAVATLFSVMGIVRLQAFARGREIRKSDIGVQVYRKCRLQLLQGNKLANPTDAYLGIKKLTANAFAQKLLASSPKVLPVHAYDTSNPNSNLIWLENWSASCFWKPVPQPKKTISRKPQNRLLVEAESAKPKKSVRKVPASNFESSSVQTSFEFEKPKRSFRKVSSQSIEPPAVEDPQIELEKVKRSLRKVHNPVVESSIQPQRSPRKEVEKPKLGVEKTRESSYPLVHETAEEPVNVCDEKKKQEISEQPEEEVHALEMEVHTPGPLETNEALDSSLVNQIDSNEKAMVEEKPSMEKDTKEEKTPKPNNKENSAGKENQKSRKKGSATSKTEREESNGHHETSPSIPSYMQATKSAKAKLRLQGSPKSAEQDGTEKATVPRRHSLPSPGNGRITSHSPRTTRLANSGDKTGNKKEKPLLSSREGNG

SEQ ID NO: 1411 - protein, 367 aa, Arabidopsis thaliana
MKLTVKTLKGSHFEIRVLPSDTIMAVKKNIEDSQGKDNYPCGQQLLIHNGKVLKDETSLVENKVTEEGFLVVMLSKSKSGGSAGQASVQCVRLLLFHSLFPLPHLRLSSIYNPVFTCSCFTYSCSRTTGTDTYGQAASTLVSGSSLEQMVQQIMEMGGGSWDKETVTRALRAAYNNPERAVDYLYSGIPQTAEVAVPVPEAQIAGSGAAPVAPASGGPNSSPLDLFPQETVAAAGSGDLGTLEFLRNNDQVAILTISAFSLNCEPMLQELGKQNPQLLRLIQENQAEFLQLVNEPYEGSDGEGDMFDQPEQEMPHAINVTPAEQEAIQRLEAMGFDRALVIEAFLACDRNEELAANYLLENSGDFED

SEQ ID NO: 1412 - protein, 130 aa, Arabidopsis thaliana
MVRISVLNDALKSMYNAEKRGKRQVMIRPSSKVIIKFLIVMQKHGYIGEFEYVDDHRSGKIVVELNGRLNKCGVISPRFDVGVKEIEGWTARLLPSRQFGYIVLTTSAGIMDHEEARRKNVGGKVLGFFY

SEQ ID NO: 1413 - protein, 638 aa, Arabidopsis thaliana
MAVAVFKTPLTGASKMEGKQHHKHQHLQRQSSGRRVFVQTETGCVLGMELDRSDNVHTVKRRLQIALNFPTEESSLTYGDMVLTNDLSAVRNDSPLLLKRNFMHRSSSTPCLSPTGRDLQQKDRSGPIEILGHSDCFSIVKHMVKDIVKAMKMGVEPLPVHSGLGGAYYFRNKRGESVAIVKPTDEEPFAPNNPKGFVGKALGQPGLKSSVRVGETGFREVAAYLLDYGRFANVPPTALVKITHSVFNVNDGVKGNKPREKKLVSKIASFQKFVAHDFDASDHGTSSFPVTSVHRIGILDIRIFNTDRHGGNLLVKKLDGVGMFGQVELIPIDHGLCLPETLEDPYFEWIHWPQASLPFSDEEVDYIQSLDPVKDCDMLRRELPMIREACLRVLVLCTIFLKEASAYGLCLAEIGEMMTREFRPGEEEPSELEVVCIEAKRSVTERDVFSPRSDVVGEAEFQFDLDCDDLESVYSSKIQLTDDYFTKNPFSNGRSSLGKLEESIKEEEEDEEEEEDKTENTVPMIIMKDSFFSSAAFHDKAPSLSKLSTSMKNTHLSDTTRKNPKPLTRGKSENTSSGHKSANEQLPVSASFVKVADMKEDEWVLFLERFQELLGPAFAKRKTATLSKRQRLGTSCQF

SEQ ID NO: 1414 - protein, 391 aa, Arabidopsis thaliana
MSDLPRDLLAEILSRVPLASLRSVRFTCKKWNDLSKDRSFLKKQIVEAKKKQLKSKEFEVIMMRNFRVYLTSVDLHNDVNPSFTPKGTLTSFSDDANQHQVDNVSSVFHCDGLLLCITKDLNFRLVVWNPYFGQTRWIQPRNSYHIKDIYAIGYDENKNHKILRLKDQYYDYDSHPRARICEFELYSFESNSWKVVLDVSPDWYIHSYHRGLSVKGNTYWYATEKHGYVNFLICFDFTTEKFGPRLPLPFNATESFTYDDVVTLSSVGEEQLALLFQSDATLMMEIWVTSKVDPTEVLWNKLFLAVDHDMIEFDYELKFVADAGSFFIDQKKNVVVVFDKDMNEHTHRGMAYIVGKNGYFKRVDIGEEAYTSCFPLVCSYVPSSVQIRQLT

SEQ ID NO: 1415 - protein, 85 aa, Arabidopsis thaliana
MADTGKGSASASCNDRCGCPSPCPGGESCRCKMMSEASGGDQEHNTCPCGEHCGCNPCNCPKTQTQTSAKGCTCGEGCTCATCAA

SEQ ID NO: 1416 - protein, 416 aa, Arabidopsis thaliana
MEYSDDGRFDVIVVGAGVMGSSAAYQLAKRGQKTLLLEQFDFLHHRGSSHGESRTIRATYPEDYYYSMVSESTRLWAAAQSEIGYKVHFPTQQFDMGPADQQSLLSVVATCQKHGLAHRVMDSHAVSEHFSGRISIPENWIGVSTELGGIIKPTKAVSMFQTLAIGHGAILRDNTKVANIKRDGESGEGVIVCTVKGDKFYGKKCIVTAGAWISKLVKTVAGIDFPVEPLETTVCYWRIKEGHEEKFTIDGEFPTFASYGAPYVYGTPSLEYPGLIKVAVHGGYWCDPDKRPWGPGVKLEELKEWIKERFGGMVDSEGPVATQLCMYSMTPDEDFVIDFLGGEFGRDVVVGGGFSGHGFKMAPAVGRILADMAMEVEAGGGGVEMKQFSLRRFEDNPKGNAKEYPDQVILDVPLKH

SEQ ID NO: 1417 - protein, 416 aa, Arabidopsis thaliana
MGASGKWVKSIIGLKKLEKDEIEKGNGKNKKWKLWRTTSVDSWKGFRGKHRSDSDGVDSSTVYSAAVATVLRAPPKDFKAVREEWAAIRIQTAFRGFLARRALRALKGIVRLQALVRGRQVRKQAAVTLRCMQALVRVQARVRARRVRMTVEGQAVQKLLDEHRTKSDLLKEVEEGWCDRKGTVDDIKSKLQQRQEGAFKRERALAYALAQKQWRSTTSSNLKTNSSISYLKSQEFDKNSWGWSWLERWMAARPWETRLMDTVDTAATPPPLPHKHLKSPETADVVQVRRNNVTTRVSAKPPPHMLSSSPGYEFNESSGSSSICTSTTPVSGKTGLVSDNSSSQAKKHKPSYMSLTESTKAKRRTNRGLRQSMDEFQFMKNSGMFTGELKTSPSSDPFVSFSKPLGVPTRFEKPRG

SEQ ID NO: 1418 - protein, 411 aa, Arabidopsis thaliana
MGILNDDAVLIEPGKISGDPTVVTVNCPDESGLGSTLCRIILEFGLSITRADFSTDGRWCYIVFWVTPDISSPKIDWDSLKNRLLSACPSCLGSFYFCLQSNVSKPPSLYLLKFFCRDRKGLLHDVTKVLTELEFTIQRVKVMTTPDGRVLDMFFITDAMDLLHTKQRQTKTCDHLTAVLGEHGVSCELELAGPELESVQRFSSLPPLAADELFGPDGFDISGSSSNKAVLTVDNQLSPAHTLLQIRCVDQKGLFYDILRTSKDCDVHIAYGRFSSKVKGYRNLELFVRGTDGNKIMDPKHQANFCARLKEEMVCPLRVIIVNRGPDTELLVANPVELSGKGRPRVFYDVTLALKSLGICIFSAEIGRHSTLDRQWEVYRFLLDESREFPLASLRARNQVVDRVTKTLMGW

SEQ ID NO: 1419 - protein, 160 aa, Arabidopsis thaliana
MMLRIVQIAFLCLVLVAGISISTAISETETIYEILLANGLPSGIFPKGVREFTFDVETGRFSVYLNQACEAKYETEIHYDANITGTIGSAQISDLSGISAQELFLWFPVKGIRVDVPSSGLIYFDVGVVRKQYSLSLFETPRDCVPVRGIHKVCRMSFFN

SEQ ID NO: 1420 - protein, 372 aa, Arabidopsis thaliana
MKLKSVFDASEIKSEFESAGINPKFAIQIWKYVIQNPDCVWDEIPSLPSAAYSLLHSKFKTLTSSLHSLFHSSDGTTSKLLIKLQNGAFVEAVVMRYDTRLGMLGGKPRPGGIRSTLCISSQVGCKMGCTFCATGTMGFKSNLTSGEIVEQLVHASRIADIRNIVFMGMGEPLNNYNAVVEAVRVMLNQPFQLSPKRITISTVGIVHAINKLHNDLPGVSLAVSLHAPVQEIRCQIMPAARAFPLQKLMDALQTFQKNSQQKIFIEYIMLDGVNDQEQHAHLLGELLKTFQVVINLIPFNPIGSTSQFETSSIQGVSRFQKILRETYKIRTTIRKEMGQDISGACGQLVVNQPDIKKTPGTVELRDIEDLLL

SEQ ID NO: 1421 - protein, 194 aa, Arabidopsis thaliana
MDEVMTAADVGSLGGGNRALYGSPPSHNLFPHNLPIFSAFLAFALAQFLKVFTNWYKEKRWDSKRMISSGGMPSSHSATVTALAVAIGFEEGAGAPAFAIAVVLACVVMYDASGVRLHAGRQAELLNQIVCEFPPEHPLSTVRPLRELLGHTPIQELKLVSLSTQEQIPNSFEIIDPSGTKIDSAISSDARLLE

SEQ ID NO: 1422 - protein, 299 aa, Arabidopsis thaliana
MAGIDTQKQLLSLIRDFTSERSRGEQRVVGLKKRIEILQSEVEAANSEVEKAKRIKEVAEEELNGYEVELSLNDATIQSLEARISLLQDEVTTIGSEVDALKVMFVKLLVLFVIFRDQFISQMEELNKEIREFQKTVDSSLSSDDGIGITANVKASEDGSGADLEAIKGMLSEVNSQLAKEEEGYLAEQKIQEQLQKELDDYEKKMSLMEAITDKTNSVQVLTRYPLILLADIGFTWGGAAKEMPMPTLRGGKFGSPELTSSGRSRYGGVLVKSRSHLWLLGKRLIYSGLKMDLRNILV

SEQ ID NO: 1423 - protein, 302 aa, Arabidopsis thaliana
MDPYSHGSSFMNLLTSQQEAHNLETNPYDDDVSPNQAAHTPKVKRERRKWSAGEDLVLVSAWLNTSKDAVIGNEQKGYAFWSRIAAYYGASPKLNGVEKRETGHIKQRWTKINEGVGKFVGSYEAATKQKSSGQNDDDVVALAHEIYNSEHGKFTLEHAWRVLRFEQKWLSAPSTKATVMSKRRKSDKASTSQPQTHEAEEAMSRPIGVKAAKAKAKKAVSKTTTVEDKGNVMLEIQSIWEIKQKDWELRQKDREQEKEDFEKQERLSRTKLLESLFTKKEPLTDIEVALKNKLINEMLSNS

SEQ ID NO: 1424 - protein, 246 aa, Arabidopsis thaliana
MMQSRLLAFASAARSRVRPIAQRRLAFGSSTSGRTADPEIHAGNDGADPAIYPRDPEGMDDVANPKTAAEEIVDDTPRPSLEEQPLVPPKSPRATAHKLESTPVGHPSEPHFQQKRKNSTASPPSLDSVSCAGLDGSPWPRDEGEVEEQRRREDETESDQEFYKHHKASPLSEIEFADTRKPITQATDGTAYPAGKDVIGWLPEQLDTAEESLMKATMIFKRNAERGDPETFPHSRILREMRGEWF

SEQ ID NO: 1425 - protein, 207 aa, Arabidopsis thaliana
MTGFSVSLFVSNLSNVASYLSPIFENIPSTKVVPAQIEKVVSLVSRTGRDLQRYDHAGYRQVVGCVPYRYKKQEVNGVETQVIQVLLVSAQKGKGMLFPKGGWETDESMEEAALRETIEEAGVTGELEEKLGKWQYKSKRHSIIHDGYMFALLVSQEFERWPEAEMRQRRWVSLDEAREVCQNWWMREALEAFINLKCLADDDESGN

SEQ ID NO: 1426 - protein, 202 aa, Arabidopsis thaliana
MTETHRTTTTFLDLLRRQMSGHDLTRRKRTLKERLRFKCIGCCGPTWNLRLTNNTTLHSPTSRDDEIEELQIETGLVLESDHGSGTGMNLATALEAERYNRGESTEAEADMTPRRVSLMRLLEETAEKIVDDDGKETEILTASIGTLTGNDSVCCVCMGRKKGAAFIPCGHTFCRVCSRELWLNRGSCPLCNRPIIEILDIF

SEQ ID NO: 1427 - protein, 287 aa, Arabidopsis thaliana
MAKLRHSRFQARKWSTLMLVLFMLFMLTIVLLMLLAFGVFSLPINNDESSPIDLSYFRRAATERSEGLGKRGDQWTEVLSWEPRAFVYHNFLSKEECEYLISLAKPHMVKSTVVDSETGKSKDSRVRTSSGTFLRRGRDKIIKTIEKRIADYTFIPADHGEGLQVLHYEAGQKYEPHYDYFVDEFNTKNGGQRMATMLMYLSDVEEGGETVFPAANMNFSSVPWYNELSECGKKGLSVKPRMGDALLFWSMRPDATLDPTSLHGGCPVIRGNKWSSTKWMHVGEYKI

SEQ ID NO: 1428 - protein, 242 aa, Arabidopsis thaliana
MVDLGKQRDHNYHHMQIITTPTSVDCSREFRHRRTLRSLIECMIPYCCTYQQQPYQNDTLSVSSTSSSSSSSDHSSSSQSSSTVSGTFFGHRRGRVSFCLQDAAVGSSPLLLLELAVPTAALAKEMDEEGVLRIALECDRRRSSNSRSSSIFDVPVWSMFCNGRKMGFAVRRKVTENDAVFLRMMQSVSVGAGVVPSEEEDQMLYLRARFERVTGSSDSESFHMMNPGGSYGQELSIFLLRS

SEQ ID NO: 1429 - protein, 158 aa, Arabidopsis thaliana
MFARTSQITHYNNRKRGALRDEYGDWRGSFALNLGRCTAPLAELWGVYYGLVIAWEKGITRLELEVDSKLVAGFLTTGIEDSHLLSFLVRLCYGFSSKDWIVRVSHVYREANRFADELANYAFSLLLGFLSFDSGLPFVDSIMREDAAGVAGARHVPM

SEQ ID NO: 1430 - protein, 143 aa, Arabidopsis thaliana
MSTTANTNATTAPKRKPVFVKVDQLKPGTSGHTLIVKVLESNPVKPAIRKSSLTQQPISSPRIAECLIGDDTGCILFTARNDQVDLMKTGATVILRNAKIDLFKDTMRMAVDRWGRIEITGPVSFEVNRANNLSLVEYEVITA

SEQ ID NO: 1431 - protein, 292 aa, Arabidopsis thaliana
MLNGKEEPKQKKGWSESLLEFRSGFGEKMKVVSKKRWKSLGPLHLKSKSVARFCFFSKLKSNNHGPGRAPVYLNVYDLTPINGYIYWAGLGIFHSGVEVTAIANSEHLAFTVHGVEYAFGAHDYATSGVFEVEPRQCPGFKFKKSIFIGTTNLNPTQVREFMEDMACSYYGNMYHLIVKNCNHFCQDVCYKLTGKKIPKWVNRLAQIGSVCSCILPESLKITAVCHDPDGQIPEEENEKRSLRSSFSCLSSISMRQKQLSTSSLFLQSPLRGCLPPWQLKRSKSNSSSLKER

SEQ ID NO: 1432 - protein, 154 aa, Arabidopsis thaliana
MGHRNTVLTILLTISIAIMVLIATVFVSNNKTETLLQTHTQTQTLITTGRVSRFLAQNAKNGRNLNAADHCNKEEEICKSQGMYNSTMACCSNKCVDLAYDNDNCGACKNQCKFTQTCCRGECVYLAYDKRHCGECNHSCLVGEFCVYGLCNYA

SEQ ID NO: 1433 - protein, 295 aa, Arabidopsis thaliana
MAVSFQTKNPLRPITNIPRSYGPTRVRVTCSVTTTNPQLNHENLVVEKRLVNPPLSKNNDPTLQSTWTHRLWVAAGSTTIFASFAKSIIGGFGSHLWLQPALACYAGYVFADLGSGVYHWAIDNYGGASTPIVGAQLEASQGHHKYPWTITKRQFANNSYTIARAITFIVLPLNLAINNPLFHSFVSTFAFCILLSQQFHAWAHGTKSKLPPLVMALQDMGLLVSRKDHPGHHQAPYNSNYCVVSGAWNKVLDESNLFKALEMALFFQFGVRPNSWNEPNSDWTEETETNFFTKI

SEQ ID NO: 1434 - protein, 313 aa, Arabidopsis thaliana
MSGEASTSRRKRQRVPSSVESVENGGGDAVARSGTLFELDLLDCPICCHALTSPIFQCDNGHIACSSCCTKLRNKCPSCALPIGNFRSRIMERVVEAVMVTCPNVKHGCTEKFSYGKELIHEKDCRFALCYCPAPNCNYSGVYKDLYSHFYVNHYDTWNQIGCGNFAGAWLRISEKILVLQYGQGPLIAVQCFKETQGMYVTVNCIAPCAPGVGELSFELSYKMPMGGNSTMMFKSEEMNRIQKVSFQTPEKDFMLVPYYFLGDFSTLKMEICIRKLKKDEEEADEDEESEEEEDDDDDDDDDDEEEDADEEE

SEQ ID NO: 1435 - protein, 308 aa, Arabidopsis thaliana
MCDPTRDDGSSRSRVVSTMQKRAYFQRQWPLVDVVRASVVVIVHFLCLLAPFNFKWEALRFGLVLFALTTLSITFSFHRNLSHRSFKIPKWLEYPWAYSAVFALQGDPMDWVSIHRFHHQFTDSDRDPHSPKEGLLFSHILWIFDTQYIKYKCGGRDNVLDLKKQWFYKFLRRTIAVHILMFWTILYLYGGLPYLTCGGGVGIFIGYHVTWLVNSACHIWGSRSWNTKDTSRNGFDDLVNIFRWLSLFTMGESWHNNHHAFESSARQGLEWWQIDITWYLIRLFEVLGIATDVKLPSELQKQKMALVR

SEQ ID NO: 1436 - protein, 159 aa, Arabidopsis thaliana
MVSGLINENPIIYPKKERRLRTDTSITDELTPEPIDQLEIFDILSSSNIKDPEHPNTLEDLRVVTEDSVEVDDENSYVRVTFTPTVEHCSMATVIGLCVRVKLLRSLPSRYKIDIRVAPGSHATEDALNKQLNDKERVAAALENPNLVEMVDECLPSEE

SEQ ID NO: 1437 - protein, 256 aa, Arabidopsis thaliana
MATQSNSGFDSLSSMMSRHAINFQSNTSSEMTPMSPYLGMNMNMINVGSPGFLQTGNSSNGSDSGSGLKLDTSMVSEWSNEEQYILDAGLEKYKDMPSIDMYIQIGNTLPDKSIRDIALRCRWLRRKRRKSEELNCGRRASSSKGKQVESSSKSSIPSVLPHNMASYPFSGPSTSTNLSSYATNLIEQNVRAFSQIRANLSSYKAGDNLDLFRQARNNLITIQNEINNMPGLMNKMPPLPVTINDDLSVSNTTLVS

SEQ ID NO: 1438 - protein, 206 aa, Arabidopsis thaliana
MLVPRSRSAAIKPEEYTASPRSPLDLNFPSPVHSKRFGSGGVGLGIVAALEETSNGINRHDPVRYSGRFRCPEIDLSDEEYTYVTSPNGPTKVYYNDDGFELSENDYRRVHKPMVTVDEPPVIERQSVRGPTEFLSSCCLCKKKLQGKDIYMYKGEMGFCSAECRSVQIMNDERQEQCKTQVSRNADVLSSPYAAGQRLSAGVFVF

SEQ ID NO: 1439 - protein, 296 aa, Arabidopsis thaliana
MFRWKNSSQTEQEQKEAALREAKMKELKTLIGQLSGRNSLYCSDACLKRYLEARNWNVGKAKKMLEETLKWRSSFKPEEIRWNEVSGEGETGKVYKAGFHDRHGRTVLILRPGLQNTKSLENQMKHLVYLIENAILNLPEDQEQMSWLIDFTGWSMSTSVPIKSARETINILQNHYPERLAVAFLYNPPRLFEAFWKIVKYFIDAKTFVKVKFVYPKNSESVELMSTFFDEENLPTEFGGKALLQYNYEEFSKQMNQDDVKTANFWGLGHSNNNQLHASNGFSGAEIAPEPIQNHP

SEQ ID NO: 1440 - protein, 198 aa, Arabidopsis thaliana
MVSRQEGTLYSRKRDFTVCGEEFHNSFKKSKQEDQSQSTLFNERPKSESMRSITFDFELHLHTPLPSDWQTKMSLDLELNLSPSGSPSRTTTKKYESSSIHNETVSSSKIKVLTNTSKKSIIGTGLSRSPSWLAFEGGDDNDVDHKGQEMVTTVCMKCHMLVMLCTSTPVCPNCKFMHPHDHSSTKLFKPSNLLRLLC

SEQ ID NO: 1441 - protein, 125 aa, Arabidopsis thaliana
MATAAAPAVISWTRSGIVSKSGQTQKKSEMKVSYITGLNSYGGLKAQNNKVVSMGSPLCTEQCFANVVMSLKGRRGNGGALSTTCNAVGEIFKIAAIMNALTLVGVAVGFVLLRIETSVEEAEAE

SEQ ID NO: 1442 - protein, 184 aa, Arabidopsis thaliana
METITESLEKSMMNCSLNDRRRRVVGDGFGRSSSNEHMTPISDRTLELNSHLSLPCHWEQCLDLKTGEIYYINWKNGMRVKEDPRKVMNADPDSGDSYGTVCSEEDSSYYDSEESSSESSPSSRENHKEEEEEEEEEEEEEEDVLVVAGCKACFMYFMVPKLVEDCPKCAAQLLHFDRPHSASS

SEQ ID NO: 1443 - protein, 207 aa, Arabidopsis thaliana
MLAVHRPSSAVSDGDSVQIPMMIASFQKRFPSLSRDSTAARFHTHEVGPNQCCSAVIQEISAPISTVWSVVRRFDNPQAYKHFLKSCSVIGGDGDNVGSLRQVHVVSGLPAASSTERLDILDDERHVISFSVVGGDHRLSNYRSVTTLHPSPISGTVVVESYVVDVPPGNTKEETCDFVDVIVRCNLQSLAKIAENTAAESKKKMSL

SEQ ID NO: 1444 - protein, 310 aa, Arabidopsis thaliana
MPLHMKIQPIDESDVSEEVPYPETMRQMPKSRLKRLFERQFTNKNVSEKFTGSDVEAPLSRGNSGDFEPSSVCLAKMVLNFMEDNNGGEKQRCGRSRCNCFSGSGTESSDDETECSSGEACEILKSLVLCKSIRVRNLLTDVTKIAETSKNCKLKDGSCLKSVANGLVSLGYDAALCKSRWEKSPSCPAGEYEYVDVIMKGERLLIDIDFKSKFEIARATKTYKSMLQTLPYIFVGKADRLQKIIVLICKAAKQSLKKKGLHVPPWRRAEYVKSKWLSSHVRVDQNSNGEVKQESVEVIAESVSSIVFGV

SEQ ID NO: 1445 - protein, 268 aa, Arabidopsis thaliana
MAICKVFRNYCKENDIQLHQANFSLSYDTNIPRQTGLSGSSAIVSAALNCLLDFYNVRHLIKVQVRPNIVLSAEKELGIVAGLQDRVAQVYGGLVHMDFSKEHMDKLGHGIYTPMDISLLPPLHLIYAENPSDSGKVHSMVRQRWLDGDEFIISSMKEVGSLAEEGRTALLNKDHSKLVELMNLNFDIRRRMFGDECLGAMNIEMVEVARRVGAASKFTGSGGAVVVFCPEGPSQVKLLEEECRKAGFTLQPVKIAPSCLNDSDIQTL

SEQ ID NO: 1446 - protein, 271 aa, Arabidopsis thaliana
MERREDHYSNYFVQSPSTVFHDPESEFQSPIRSDSAPLVLSSVNEFPRYSDFLRNSENNFLYEDDEKRLVPLGTSNSSWWIVLQVGWRFLFSLGVALLVFYIATQPPHPNISFRIGRFNQFMLEEGVDSHGVSTKFLTFNCSTKLIIDNKSNVFGLHIHPPSIKFFFGPLNFAKAQGPKLYGLSHESTTFQLYIATTNRAMYGAGTEMNDMLLSRAGLPLILRTSIISDYRVVWNIINPKYHHKVECLLLLADKERHSHVTMIREKCRLVS

SEQ ID NO: 1447 - protein, 457 aa, Arabidopsis thaliana
MLLSLTLFFHFFFIIFNRWEKFDDTEWTILGVEGESERERVMEALKTATFSPMSVLSEKRSEPRKPFSLPNLFPPKSQRPISQESFLKRFNGGLALLTSVLSSATAPAKSLTYEEALQQSMTTSSSFDSDGLIEGISNFVTDNPLVIAGGVAALAVPFVLSQVLNKKPKSWGVESAKNAYTKLGTDDNAQLLDIRATADFRQVGSPNIKGLGKKAVSTVYNGEDKPGFLKKLSLKFKDPENTTLYILDKFDGNSELVAELVALNGFKSAYAIKDGAEGPRGWLNSSLPWIEPKKTLSLDLSSLTDSISGVFGDRKQTLKQVDEFLNTKVAPKELVDELKEIGKALLPQSTSNKALPAPATVTAEAESATATTTTVDKPVPEPETVAATTTTVDKPVPEPEPVPEPVPVPAIEAAVAAQVITEPTETEAKPKPHSRPLSPYASYPDLKPPSSPMPSQP

SEQ ID NO: 1448 - protein, 149 aa, Arabidopsis thaliana
MLKTQVHVVVIYLLIQIAFSQVKPGSDLKWSTLKSVVTITNRLGDGSTLKLHCKSADDDLGLKILAPNGSWSFKFRPSIVPGVTLFFCHFTWPGQSKWFNIYDDDRDGVRMGIPCIYCIWDIGKYGPCRFSEIDDAFNICYDWNGNRRS

SEQ ID NO: 1449 - protein, 208 aa, Arabidopsis thaliana
MGYQFTLMSADIDEKSIRKEKPEELVLALAEAKADAIVSKLQISECEDEEQPRVLIASDTAEAIMQRIPDGENIEEDKSTLLITCDQVVVYEDAVREKPSSVEEAREYIRGYSKGHTATVSSVAVTNLKTGVRKGGVDRVEIYFNEIPEETIEKLIEEGMVLKVAGALLIEHPLILPCVKEVVGTTDSVMGLPKELTEKLIKEVLAST

SEQ ID NO: 1450 - protein, 429 aa, Arabidopsis thaliana
MSSSYASSCTKLISLTKQLSSYANQGNHEQALNLFLQMHSSFALPLDAHVFSLALKSCAAAFRPVLGGSVHAHSVKSNFLSNPFVGCALLDMYGKCLSVSHARKLFDEIPQRNAVVWNAMISHYTHCGKVKEAVELYEAMDVMPNESSFNAIIKGLVGTEDGSYRAIEFYRKMIEFRFKPNLITLLALVSACSAIGAFRLIKEIHSYAFRNLIEPHPQLKSGLVEAYGRCGSIVYVQLVFDSMEDRDVVAWSSLISAYALHGDAESALKTFQEMELAKVTPDDIAFLNVLKACSHAGLADEALVYFKRMQGDYGLRASKDHYSCLVDVLSRVGRFEEAYKVIQAMPEKPTAKTWGALLGACRNYGEIELAEIAARELLMVEPENPANYVLLGKIYMSVGRQEEAERLRLKMKESGVKVSPGSSWCLFKD

SEQ ID NO: 1451 - protein, 213 aa, Arabidopsis thaliana
MNIFTKKPNPREVLRESKREMTQATRGNRISAIRSMSVAQLEKKLVLEIKRTAKSGNEGATKILARQLIRLRQQIANLQGSRAQMRGIATHTQAMHAHTSVAAGMQGATKAMAAMSKNMDPAKQAKVMREFQKQSAQMDMTTEMMSDSIDDALDNDEAEDETEDLTNQVLDEIGIDIASQLSSAPKGKIGGKKAEDVGSSGIDELEKRLAALR

SEQ ID NO: 1452 - protein, 1451 aa, Arabidopsis thaliana
MDYDPAHAMSRGGSMRQTISRSVSKASRNMEDIFNTSSRRTKSVNEDEEALKWASIEKLPTYNRLRTSLMPELGEDDVYGNQILNKAVDVTKLDGEERQKFIDMVFKVAEQDNERILTKLRNRIDRVGIQLPTVEVRYDHLTVKADCYTGDRSLPSLLNAVRNMGEAALGMIGIRLAKKAQLTILKDVSGIVKPSRMTLLLGPPSSGKTTLLLALAGKLDKSLDVSGEVTYNGYRLNEFVPIKTSAYISQNDLHVGIMTVKETLDFSARCQGVGTRYDLLNELARREKDAGIFPEADVDLFMKASAAQGVKSSLITDYTLKILGLDICKDTIVGDDMMRGISGGQKKRVTTGEMIVGPTKTLFMDEISTGLDSSTTFQIVKCLQQIVHLTEATVLISLLQPAPETFDLFDDIILLSEGQIVYQGPRDHILEFFESFGFKCPERKGTADFLQEVTSKKDQEQYWVDPNRPYRYIPVSEFASSFKKFHVGSKLSNELSVPYDKSKSHKAALMFDKYSIKKTELLKSCWDKEWMLMKRNSFFYVFKTVQIIIIAAITSTLYLRTEMHTRNEIDANIYVGSLLFAMIVNMFNGLAEMAMTIQRLPVFYKQRDLLFHPPWTYTLPTFLLGIPISIFESTAWMVVTYYSIGYAPDAERFFKQFLIIFLIQQMAAGIFRFIASTCRTMTIANTGGVLVLLVVFLTGGFLLPRSEIPVWWRWAYWISPLSYAFNAITVNELFAPRWMNKMSGNSTTRLGTSVLNIWDVFDDKNWYWIGVGGLLGFTVIFNGFFTLALTYLDLTYMCIMTTALGKAQAILPKEEDEEAKGKAGSNKETEMESVSAKKGMVLPFTPLAMSFDDVKYFVDMPAEMREQGVQETRLQLLKGVTSAFRPGVLTALMGVSGAGKTTLMDVLAGRKTGGYIEGDVRVSGFPKKQETFARISGYCEQTDIHSPQVTVRESLIFSAFLRLAKEVSKEDKLMFVDQVMELVELVDLRDAIVGLPGVTGLSTEQRKRLTIAVELVANPSIIFMDEPTSGLDARAAAIVMRAVRNTVDTGRTVVCTIHQPSIDIFEAFDELLLMKRGGHVIYSGPLGRNSHKVVEYFESFPGVPKIPEKYNPATWMLEASSLAAELKLGVDFAELYKASALCQRNKALVQELSVPPQGATDLYFATQFSQNTWGQFKSCLWKQWWTYWRSPDYNLVRFIFTLATSLMIGSVFWQIGGKRSNVQDLTMVIGAIYAAVVFVGINNCSTVQPMVAVERTVFYREKAAGMYSAIPYAISQVTCELPYVLIQTTYYSLIIYSMVGFEWKASKFLWFIFINYFSFLYWTYYGMMTVSLTPNQQVASIFASAFYGIFNLFSGFFIPRPKIPKWWVWYYWICPVAWTIYGLITSQYGDVETPIALLGGAPGLTVKQYIKDQYGFESDYMGPVAGVLVGFTVFFAFIFAFCIKTLNFQSR

SEQ ID NO: 1453 - protein, 561 aa, Arabidopsis thaliana
MAPQEQAVSQVMEKQSNNNNSDVIFRSKLPDIYIPNHLSLHDYIFQNISEFATKPCLINGPTGHVYTYSDVHVISRQIAANFHKLGVNQNDVVMLLLPNCPEFVLSFLAASFRGATATAANPFFTPAEIAKQAKASNTKLIITEARYVDKIKPLQNDDGVVIVCIDDNESVPIPEGCLRFTELTQSTTEASEVIDSVEISPDDVVALPYSSGTTGLPKGVMLTHKGLVTSVAQQVDGENPNLYFHSDDVILCVLPMFHIYALNSIMLCGLRVGAAILIMPKFEINLLLELIQRCKVTVAPMVPPIVLAIAKSSETEKYDLSSIRVVKSGAAPLGKELEDAVNAKFPNAKLGQGYGMTEAGPVLAMSLGFAKEPFPVKSGACGTVVRNAEMKIVDPDTGDSLSRNQPGEICIRGHQIMKGYLNNPAATAETIDKDGWLHTGDIGLIDDDDELFIVDRLKELIKYKGFQVAPAELEALLIGHPDITDVAVVAMKEEAAGEVPVAFVVKSKDSELSEDDVKQFVSKQVVFYKRINKVFFTESIPKAPSGKILRKDLRAKLANGL

SEQ ID NO: 1454 - protein, 272 aa, Arabidopsis thaliana
MQVISPSSPAPRFAGKERFSEVYGELNDDFGSKLKISSKEEENRDDDSWWNQNGTDKDDEGREEDFSFASVNADNSPITADEAFEDGQIRPVYPLFNRNIFFDDPEEKTLRSPLKKLFVESTTTEEEEEESDTVGPYCSWTNRTVEQASPETCRKSNSTGFSKLWRFRDLVLRSNSDGKDAFVFLSNGSSSTSSTSSTAARLSGVVKSSEKGKEKTKTDKKKDKMRTKSAHEKLYMRNRAMREEGKRRSYLPYKHVGFFTNVNGLTRNVHPY

SEQ ID NO: 1455 - protein, 294 aa, Arabidopsis thaliana
MPNPLQKSLHGYLSKIKKETGKLQLSSSHSFSSSKNWVLGKHPKKLSFSFKHRRRSSKTRFSKEEPVYHQDSAHAATLSDIDRFLEENFKSLCIRDDQEDDQHQARVTKNKEKRESSSDDSDDDDDDDDYRHRFERTWGHAVYDSPKQPPDLLRTERLSPPPGSSEGRPSMETTSTSSERQSRSTLVLPENCIAVLRYTDEPQEDFRQSMVEMMESKLGMRESEVDWDLMEELLFCYLDLNDKKSHKFILSAFVDLIIALREKEKRITRKGHVRSLSTRAARDRLRKRMIMSDN

SEQ ID NO: 1456 - protein, 218 aa, Arabidopsis thaliana
MDELRQKLQYSSFELEAVKAKANEETKLHQEEVKNLLHLLKLARQERDEAKDQLQKLLTIKTNSSITESNSHGSSPVDSFFEPVSSSEFSNFNMVPEPINQVKFKNRQQLVNRNLKKIDPVDALMDEIIKGKALPEKGKLLQTVMESGPLLQTLLVAGPLPRWRNPPPLQQSFRVPPISNSYGCLPATTTTSMLNFRGCSVPRIATGIEVATKRQRFH

SEQ ID NO: 1457 - protein, 521 aa, Zea mays
MAIAALELLYVLGSLVALRLAWQVLEWGWLSPRRLGRALRAEGLRGTAYRFPAGDAKDEERLLAAARAKPMPSLSHAISARVGPLVHNAIHEHGKISVVWIGPTPKVILSDPKLVREVLSKSSKFGDFQKPKLPSHFIKLIAQGLTVHEGEKWAIHRKIIRSAFLVEKLKEMLPAFTACTGELMGRWEESMGCDGAREIDVWPEMQDLTGDAISRAAFGSSLIEGRRIFRIQAEQIKIANEMTNLYIPGYTYLPTKPNRRIKANAREVEALLRGIITKRETAMKNGHADDSDLLGKLMQSNVEEAHGGGGSSKPMMTMEDIIGELKLFYFAGMETTSALLAWTLIVLSMHPEWQDRAREEVLEVFGKNEPNINGTNSLKVVTMVLYEVLRLYPPIIDLERQTWKEMELGGVRYPPGVTLLLPILAIHHDPDLWGEDVDQFRPERFADGISKASRDTPAFFPFGWGPRICVGQNFALLEAKVALAMLLQRFSFGLSPSYTHAPFSVSTVQPEHGAQIVVKKI

SEQ ID NO: 1458 - protein, 321 aa, Zea mays
MVSVDDEGGTHEGIKTIPVQRACEFTTNSVLCVCIVTWNMNSKMSAEDVAKLVSSDRKFDLLVVGLQEAPKPDVSRVLQEALAGTHVLLGQKSMQSLRMLLFGSRSSEKYIREMKVDKHAVGGCGGIIGRKKGAVAMYINFSGIRMVFVSCHLAAHEHKVEKRNAEFQHISQSLFARYGAPTPYAQSADITVWLGDLNYRLQGISSTPARKMIEENRQSKLRGRDQLLQEAEKGQVFSGYCEGTLSFKPTYKYDVGGSVYDTSYKVRVPSWTGRILFKVGQSSGLDAVLSSYESLDCVRSSDHKPVKAHLCLKVRSDGDAD

SEQ ID NO: 1459 - protein, 488 aa, Zea mays
MGNQCPNGTLGSDYYNRPASRFADGCLEDDRYSDLKKFDKPWPEVNSFKPTAVGILKRGLDPTSITVLERKTADVREHYIIGRRLGQGQFGTTFLCTEISTGCEYACKTIPKRKLITKEDVEDVRREIQIMHHLSGHKNVVSIKDVYEDGQAVYIVMELCAGGELFDRIQEKGHYSEQKAADLIRIIISLVAMCHSLGVMHRDLKPENFLLWDKEDDLSIKAIDFGLSVFFKPGQVFTELVGSPYYVAPEVLHKRYGPEADVWSAGVILYVLLSGVPPFWAETQQGIFDAVLKGHIDFDSDPWPKISESAKNLIRKMLCPCPSERLKAHEVLRHPWICENGVATDQALDPGVLSRLKQFSAMNKLKKLALRADNDNNVTINYEEFIAATVPLNKIEREEHLMAAFTYFDKDGSGYITVDKLQRACGEHDMDDTFLEEIILEVDQNNDGQIDYAEFVAMMQGNKVGLGWQQMETTLNVTLRDAPQVHCH

SEQ ID NO: 1460 - protein, 108 aa, Zea mays
MEIESVKCECCGLKEDCTPHYIASVRSGFHGQWLCGLCCEAVRDEACRRKAHHGVEEAVRAHMAFCNMFKLNPAVRVADGMRQMLRRRSGDMSKPESAKKYESSVTLY

SEQ ID NO: 1461 - protein, 137 aa, Saccharomyces cerevisiae
MMKGSRRTGNNTATTLNTPVVIHATQLPQHVSTDEVLQFLESFIDEKENIIDSTTMNTISGNAADADAAAVANTSLNIDTNLSSSISQLKRIQRDFKGLPPAQDFSAAPIQVSTTEKKETSIGVSATGGKKTTFADE

SEQ ID NO: 1462 - protein, 776 aa, Arabidopsis thaliana
MDVPEETRLRHKRDFIQFLDSMYMEEIKALVHQKRHRLIINISDIHHHFREVASRILKNPNEYMQSFCDAATEATRAIDPKYLKEGELVLVGFEGYFVSRVVTPRELLSDFIGSMVCVEGIVTKCSLVRPKVVKSVHFCPSTGEFTNRDYRDITSHAGLPTGSVYPTRDDKGNLLVTEYGLCKYKDHQTLSIQEVPENAAPGQLPRSVDVIAEDDLVDSCKPGDRVSVFGIYKALPGKSKGSVNGVFRTILIANNIALLNKEANAPIYTKQDLDNIKNIARRDDAFDLLARSLAPSIYGHAWIKKAVVLLMLGGVEKNLKNGTHLRGDINMMMVGDPSVAKSQLLRAIMNIAPLAISTTGRGSSGVGLTAAVTSDQETGERRLEAGAMVLADKGIVCIDEFDKMNDQDRVAIHEVMEQQTVTIAKAGIHASLNARCSVVAAANPIYGTYDRSLTPTKNIGLPDSLLSRFDLLFIVLDQMDAGIDSMISEHVLRMHRYKNDRGEAGPDGSLPYAREDNAESEMFVKYNQTLHGKKKRGQTHDKTLTIKFLKKYIHYAKHRITPKLTDEASERIAEAYADLRNAGSDTKTGGTLPITARTLETIIRLATAHAKMKLSSEVTKADAEAALKLMNFAIYHQELTEMDDREQEERQREQAEQERTPSGRRGNQRRNNEDGAENDTANVDSETADPMEVDEPSVEQFSGTVSAARIETFERVFGQHMRTHRLDDISIADIETVVNNNGVGASRYSADEIMALLEKLQDDNKVMISDGKVHII

SEQ ID NO: 1463 - protein, 765 aa, Arabidopsis thaliana
MLEMERVAELKRLPSKGPVSGHLSRRPYLDFETRDAPGMHLESLRERAARYNTGRSVNPTTTLGRELSQVLNVHREDMMMTQFGGNMNDFQEFEPVVSSVRTMKAKYPLLEIEEIGAADDDVTCKGSNDMSEEAGSSSFRGVSHPPEPDDMDLITTVYVPISEKNKPDSVCLMKSMSTTKGPFIEDISLCVPPKKPSPRVLSPAESIVEEPATSLSPFSVARASQNTENSLLPPDSDKECVWDASLPPSTNVSPHSSSVESMNLARAMSIANSSSATSTTQRSDVVLSMDKNYFDRSISMVLDSFESTKTSASRASDSSGLSEESSWSNFTGSLNKPHKGNDPWWNAILAIRTRDGILGMSHFKLLKRLGCGDIGSVYLAELSGTRCHFAVKVMDKASLEDRKKLNRAQTERDILQLLDHPFLPTLYTHFETDRFSCLVMEYCPGGDLHTLRQRQPGKHFSEYAARFYAAEVLLALEYLHMLGVVYRDLKPENVLVRDDGHIMLSDFDLSLRCAVSPTLIKTFDSDPSRRGAFCVQPACMEPTSACIIQPSCFLPRSIFPNKNKKNKSRKTQADFFKSHSGSLPELVAEPNTRSMSFVGTHEYLAPEIIKGEGHGSAVDWWTFGIFVHELLYGKTPFKGSGNRATLFNVVGEQLKFPESPATSYAGRDLIQALLVKDPKNRLGTKRGATEIKQHPFFEGVNWALIRCSTPPEVPRQMETEPPPKYGPIDPVGFGSNSKRMMGPPAVSAAAADTKSGGKFLDFEFF

SEQ ID NO: 1464 - protein, 752 aa, Arabidopsis thaliana
MTENGVVTGGGHTVMVGVKFDESSNELLDWALVKVAEPGDTVIALHVLGNEIVDRADNSSLVSIVKNFDSVLEVYEGFCKLKQLKLSRGSSTRKILVKEAKMCSASKVVVGISRRFHTIHSSVSVAKYLARKVAKDCWVLAVDNGKVMFQKDGSSSIIHHSKGKSDARRNTLSSFFQMPVTLRKNTKVVNHSEVEEEEAEEDHSNGQSLRRSLVYACLGNCSVRDMNSLPTPGNLSRSSSCNGDQDDNADLHKAMALVPAKFPEDLTPFITMLVKELPEFRPGWPLLCRVASSDVLASAPRSSSFRKIPVVQWVLKLPARTNSVVGSSDTKQIGFDSSESEENDKLSSSNVERQAIVPDESMIVKCSLDHSSGRFPENVEGLQARISTSCQFFTYKELVSVTSNFCADNFIGKGGSSRVFRGYLPNGREVAVKILKRTECVLKDFVAEIDIITTLHHKNVISLLGYCFENNNLLLVYNYLSRGSLEENLHGNKKDLVAFRWNERYKVAVGIAEALDYLHNDAPQPVIHRDVKSSNILLSDDFEPQLSDFGLAKWASESTTQIICSDVAGTFGYLAPEYFMYGKMNNKIDVYAYGVVLLELLSGRKPVNSESPKAQDSLVMWAKPILDDKEYSQLLDSSLQDDNNSDQMEKMALAATLCIRHNPQTRPTMGMVLELLKGDVEMLKWAKLQVSNPLEDSMLLKDEKLRRSNLQSHLNLAFLDMEDDSLSMGSMEQGISVEEYLKGRTSRSSSFN

SEQ ID NO: 1465 - protein, 261 aa, Zea mays
FITSLYKKAGSCRTMPSFIDGPTFRALLRPSTNGRRTKISDSGGGGGGIFKMFKLMPMLSSGCKMVALLGKHNNRALLADHATTVTLFGPRRGRVSLAIHEDTRAPPLFLIELPMLTSALHREISSGALKLALESDTRSARRRLVEEYVWAVYCNGRKAGYSIRRKEASDDERHVLRLLRGVSMGAGVLPAAPEKEGGVPAGPDGELTYVRARVERVVGSKDSEAFYMINPEEGGNGADNNGGGGGAGGAPELSIFLVRMK

SEQ ID NO: 1466 - protein, 679 aa, Zea mays
MEISAGVTTVTAVSILILLLLPQPAAPFSFTYNFTSPSDTPPPGIAFQGDAFYNKAIRLTRDERLGPITSSTGRAFYSHAVPLADPVSRRPASFVTAFAFSIAAPDPASASGDGLAFFLSPFPSVLPESSAGGLLGLFNSSSVRAGTLVAVEFDTHKNEWDPSGDHVGVDLGGIVSSATADWPTSMKDGRTAHARVEYDGVAKNLTVSLSYGSARPNTTGDVLLWYAVDLRDHLPDSVAVGFSAATGEAAELHQVLYWEFTSTVDPKEETVVLWVVLGLCALLLVLVGAGIVWFVRQWRKAGQFDDGDIEVDDVMGGEYDELADEFVVQCGPRRFRYAELAAATKNFAEERKLGQGGFGAVYRGFLKELGFEVAIKRVSKGSTQGRKEYAAEVRIISQLRHRHLVRLVGWCHEHRGDFLLVYELMPNGSVDHHLYGKGMLLTWPMRYDISLGLASAMLYLHEECPQCIVHRDVKPSNVMLDAAFNAKLGDFGLAKLVEHGSQPYTTVLAGTLGYLAPECVMTGKASRESDVYSFGVVALEIACGRRPAELNNEPSKARLVPWVWELYGKNALLEAADWRLKGQFDEKQMERLMIVGLWCAHPDYAHRPSIRQALNVLTFEAPLPVLPEKMPVPTYFPLPDLVASISVGGTSSAEDPDPGVSDYGSSGKVSSVRDRLLEP

SEQ ID NO: 1467 - protein, 914 aa, Zea mays
MAAAFSAAILFHLLLLLFSPSAAQPGFISLDCGGARDHTDAIGIQWTSDASFVSGGQAAQLLVQNGLQQTQQQLTTVRYFPADNRKHCYTMNVRNRTRYLVRATFLYGNFDNSNVYPKFDISLGASPWSTIVVDDATTPVVEEAIILAAAPTLSVCLSNASTGQPFISTLELRQFNGSLYYTTDETRFFLGLSARINFGAGSNDSVRYPDDPFDRIWESDSVRRANYLVDVAPGTERISTTKPIFVGTNEEPPEKVMQTAVVGQDGSLNYRLDLEGFPANAWGVSYFAEIEDLAPNETRKFKLEVPGMPALSKPTVDVEENAQGKYRLYEPGYTNLSLPFVFSFGFRKTNDSSKGPILNALEIYKYVQITMGSQDANIMASMVSRYPQESWAQEGGDPCLPASWSWVQCSSETSPRIFSITLSGKNITGSIPVELTKLSGLVELRLDGNSFSGQIPDFRECGNLQYIHLENNQLTGELPSSLGDLPNLKELYVQNNKLSGQVPKALFKRSIILNFSGNSGLHIVSNGISHTIIIICVVIGAVVLLGVAIGCYFITCRRKNKSHEDTVVIAAAPAKKLGSYFSEVATESAHRFSLSEIENATDKFERRIGSGGFGIVYYGKLADGREIAVKLLTNDSYQGIREFLNEVTLLSRIHHRHLVTFLGYSQQDGKNILVYEFMHNGTLKEHLRGADNEKITSWLKRLEIAEDSAKGIEYLHTGCSPTIIHRDLKSSNILLDKNMRAKVADFGLSKPAVDGSHVSSIVRGTVGYLDPEYYISQQLTEKSDIYSFGVILLELISGHEPISNDNFGLNCRNIVAWARSHIESGNIHAIIDESLDRGCYDLQSVWKIAEVAIMCVKPKGAQRPPISEVLKEIQDAIAMERVLVSNCSNRMGSGSVEQNGGASFDELLMQPGLR

SEQ ID NO: 1468 - protein, 103 aa, Zea mays
MMMRGGRLTGLTSQVLRCFSTEIFVSRLSFYTTEEEFKDIFSPFGTVEEARLMRDHQTGRMKGFGFVKYSSQAEAEKAVKAMDGRILRGRLIFVEMAKGHESK

SEQ ID NO: 1469 - protein, 854 aa, Zea mays
MSPFVLAVVSVAFLNLLFLQAHGSGLLLSCGSNSTVDADGRRWTGDITPEGNFTLSSPGLAASLVGKSSSDEIFGPLYSSARFFNAATWYTISVLPGSYCVRLHFFPSTFGNLSANNSVFDVTANDFKLVSKFNASEEIAWRASVSNSVTSAVVKEYFLVVGARGLSIEFDPRPGSFAFVNAIEVMLTPDNLFNDTVSKVGSAGTQLPLGLSGRGVETMYRLNIGGPALKSPSDQYLHRPWYTDEAFMFSTNAAQTVSNASSIVYVSSNDSSIAPIDVYETARIMGNNMVVDKRFNVSWRFYVHPNFDYLVRLHFCELVYDKPSQRIFKIYINNKTAAESYDVYARAGGINKAYHEDFFDNSTQQADTLWLQLGPDSMASASGADALLNGVEIFKLSKDSDLSYVLGHIDTGNQMDSSKGGKIKGLWEELGIGSASFVAVTSVVLFSWCYIRKKRKAVNKEAPPGWHPLVLHEAMKSTTDARAASKSSSARNASPIGHRMGRRFGIAEIRAATKNFDESLVIGTGGFGKVYKGEIDEGATVAIKRANTLCGQGLKEFETEIEMLSKLRHRHLVAMIGYCEEQKEMILVYEYMAKGTLRSHLYGSSLPPLTWKQRIDACIGAARGLHYLHTGADRGIIHRDVKTTNILLDDSFVAKIADFGLSRTGPTLDQTHVSTAVRGSFGYLDPEYFRRQQLTQKSDVYSFGVVLFEVACARPVIDPTLPKDQINLAEWAMRWQRQRSLEAILDPRLDGDFSPESLKKFGEIAEKCLADDGRSRPSMGEVLWHLEYVLQLHEAYRRNVVESESFGSGELGFADISSSFFSLPHVIREGEEEHHHRSKKPSSIREELDTRENF

SEQ ID NO: 1470 - protein, 243 aa, Zea mays
MMSSSSDAAAALELQESGWEELRREARKLEGDLDVKLSSYARLAARSSSSASGAASPTADRSSWKSMEFEIQSLLGKLQDVNDAMSRCAASSATTTSVSQKLARHRDILHEFTQEFRRTRGNLSSMREHADLLNSVRDDITESRASGGMSPRVHLLRERASIHGSINQIDEVIGQAQSTRVALNNQRAMFGDIQGKVKQLGEKFPVIRGLLGAIKRKKSKDTIILSAVIAACTIFLIIYWLSK

SEQ ID NO: 1471 - protein, 210 aa, Zea mays
MGWATRFLAAVCFFAAGVLFVPEALLGSPSGAGAVTAAKLAHVLSFATSWGAALWATFIGGIIMFKNLPRHMFGNLQSKMFPAYFTLISACAAISVATFSHLHPWKTASTVERYQLGFLLSALGCNLSNLLVFTPMTIEMMKKRHKIERDLSIGEEVGWSKNQQVAKSNPTLAAMNKKFGMIHGLSSLANIMSFGSLAMHSWYLASKLEL

SEQ ID NO: 1472 - protein, 267 aa, Zea mays
MLWRAVRSMDVIMHSSSFLLPKLYQPVNKPVKNYALVVLNQHLPRFMPRLWDHANLRICADGGANHIFDEMYQITNDEDKKSTRNKYVPEIIEGDMDSIRPEVKLFYSSQGSKISDKSHNQETTDLHKCISRIHHCTPDDEKPNLCVLVTGALGGRFDHEAANINVLYLFSDMRIVLLSDDCLIRLLPRTHRHELYIESSVEGPHCGLFPVGAPSTSTTTTGLKWNLSESKMRFGSMISTSNIVQSEKVTVESDADLLWTISLRNLT

SEQ ID NO: 1473 - protein, 157 aa, Zea mays
MAAPLRRSLPSLGRALLTPAPARMLSAEASDALVEIKPGEIGMVSGIPEEHLRRKVLIYSPARTASQQGSGKVGRWKINFLSTQKWENPLMGWTSTGGPYANVGEAGLTFDSAESAKAFAEKHGWNYVVRKRHAPLLRPKAYAENFKWRGPPKAEQA

SEQ ID NO: 1474 - protein, 329 aa, Zea mays
MAASLQAAATLMQPAKIGGRAPFASLPSRPSSQLACRAFGVDAGAARITCSLQDVASRCVDAAKLAGFALATSALLVSGASAEGTPKRLTYDEIQSKTYMEVKGTGTANQCPTIDGGVESFPFKAGKYQMKKLCLEPTSFTVKAEGIAKNAPPEFQKTKLMTRLTYTLDEIEGPLEVGSDGTLKFEEKDGIDYAAVTVQLPGGERVPFLFTVKQLVATGKPESFGGPFLVPSYRGSSFLDPKGRGGSTGYDNAVALPAGGRGDEEELQKENIKNAASSTGNITLSVTKSNPETGEVIGVFESVQPSDTDLGAKAPKDVKIQGVWYAQLE

SEQ ID NO: 1475 - protein, 104 aa, Zea mays
MAEETNIEKEEEEFSTGPLSVLMMSVKNNTQVLINCRNNKKLLGRVRAFDRHCNMVLENVREMWTEVPKTGKGKKKALPVNKDRFISKMFLRGDSVIIVLRNPK

SEQ ID NO: 1476 - protein, 154 aa, Zea mays
MATSSSSLTTLHSRFFSPTPSSPYMAALPRRRRAGARYPRIRAIDLDQNTIVAISVGVVSIAVGIGVPVFYETQIDNAAKRDNTQPCFPCSGSGAQVCRFCSGKGIVTVVLGAGETEESQCVNCEGIGSLTCTTCQGTGIQPRYLDRREFKDDD

SEQ ID NO: 1477 - protein, 656 aa, Arabidopsis thaliana
MLSRFNIHQPFKRCKFRFFLRSIGNPDTILVESCSSSSCSSPEPSLVRSDYLTKPSDQDQIFPLNKIIARCVRSGDIDGALRVFHGMRAKNTITWNSLLIGISKDPSRMMEAHQLFDEIPEPDTFSYNIMLSCYVRNVNFEKAQSFFDRMPFKDAASWNTMITGYARRGEMEKARELFYSMMEKNEVSWNAMISGYIECGDLEKASHFFKVAPVRGVVAWTAMITGYMKAKKVELAEAMFKDMTVNKNLVTWNAMISGYVENSRPEDGLKLFRAMLEEGIRPNSSGLSSALLGCSELSALQLGRQIHQIVSKSTLCNDVTALTSLISMYCKCGELGDAWKLFEVMKKKDVVAWNAMISGYAQHGNADKALCLFREMIDNKIRPDWITFVAVLLACNHAGLVNIGMAYFESMVRDYKVEPQPDHYTCMVDLLGRAGKLEEALKLIRSMPFRPHAAVFGTLLGACRVHKNVELAEFAAEKLLQLNSQNAAGYVQLANIYASKNRWEDVARVRKRMKESNVVKVPGYSWIEIRNKVHHFRSSDRIHPELDSIHKKLKELEKKMKLAGYKPELEFALHNVEEEQKEKLLLWHSEKLAVAFGCIKLPQGSQIQVFKNLRICGDCHKAIKFISEIEKREIIVRDTTRFHHFKDGSCSCGDYW

SEQ ID NO: 1478 - protein, 157 aa, Zea mays
MANAGMKPVAGLLLVLNLCMYVIVAAVGGWAINHAINYGFFIGTGLHLPAHFSPINFPIGNAATGFFVIFAVIAGVVGAGSALAGLNHVRAWSTESLPAAASAGFIAWTLTLLAMGLAVKEIELHGRNARLICMESFTIILSATQLFYLLAIHGGLR

SEQ ID NO: 1479 - protein, 208 aa, Zea mays
MDGVVVRRVIPSDNSCLFNAVGYVMEHNRNKASELRQVIAATVAGDPEKFNEVFLGKPNEAYCAWILDPEKWGGAIELSILSEYYGREIAAYDIQTTRCDLYGQEKNYSERAMLIYDGLHYDALAMSPAEGAPEEFDQTIFPVNHDRSIGPAEGLALNLVREAQRKRSYTDTANFTLRCGVCQIGVIGQQEAVEHAQATGHVNFQEYK

SEQ ID NO: 1480 - protein, 121 aa, Zea mays
MASTGRSMLLSLLLFAVTLSLLEMYRAKFASSELMTIAGGFVCSLLFLLLLTFIGNYQEASGDRTGWGAVVVAQLVALIVAGTVHRVCITTCFLFSAGLLYEVDKLSGMILARSESKVRRH

SEQ ID NO: 1481 - protein, 107 aa, Zea mays
MSGVITKFAVTSMVMWMAPVAIMYGFYYQVFPGVSQMSSSAQTLASGFLAVISVNLVIGFYIFMAMKETPHQEPQPDPTFLEKAKASINQPTSSRVSDDSKGKGKVE

SEQ ID NO: 1482 - protein, 134 aa, Zea mays
MGKTWALITHLHALAGPSLTLIYPLYASICAMESATRVDDEQWLAYWIIYSFITLFEMAAEHVLYWIPLRYEAKLLLAAWLVLPHFRGASFIYDRFVREQLRKNGVRLHGHHHGHAADHVPHVFQAEHRHGVHS

SEQ ID NO: 1483 - protein, 204 aa, Zea mays
MENDRRQLGQIDPRRARFPCCVVWTPIPFITWLVPFIGHIGICREDGVILDFSGPHFVSVDNFAFGAVARYIQVNCDECYKLIEPEGDATWDGALKKGTQEFQNRNYNLFTCNCHSFVANNLNRLFYSGHDEWNVVSLAAVMFLRGRWVSTASVVKTLLPFAVVLSIGTFLGGTTFLTGLLAFAAAMTVWFLVGTYCIKGLIEL

SEQ ID NO: 1484 - protein, 270 aa, Zea mays
MCIAAWAWHCHPTHRLLLLFNRDEYHSRPTQPAQWWAAGEEAKEILGGRDELGGGTWMGCTRDGKLAFLTNVREPSSLIGAKTRGQLPVRFLQGSLCPLEYATEIAKEADQYNGFNLILADVNSGTMVYISNRPGGDPVIQTVAPGLHVLSNAAINSPWPKAMRLGQSFKRYLTIHDDAEASLKQMVEELMMDTARPDRSMVPDTGDDPEWEYKLSSIFIDTAKEQARYGTRSMVALAAKLEGEVTFYERYLENSLWKENLIQFQMEKAQ

SEQ ID NO: 1485 - protein, 445 aa, Zea mays
MRRRDRHHHHRRQPRDERCVSCTTFNILAPIYKRMDNENCRESQYRAYWFSRNEKIIDRLLADHSSIICLQEVWLGNDELVDMYQKRLGDANYMLFKLARTNNRGDGLLTAVHRNYFNVLNYRELLFNDIGDRVAQLLHVESAMPFLQNRSTSCVHQQSLIVNTHLLFPHDHSLSIVRLRQVYKILQYIEAYLEEHKLGPLPIILCGDWNGSKRGQVYKFLRSQGFVSSYDTAHQYSDSEEDAHKWVSHRNHRGNICGVDFIWLLNPDKCRKPLKTSWNEAVFGIIKYFLQVAFLSEENAFALLKADSLYDHITYSSFYRALCQLGMVHPDRLKSEEIEELWSEADRDGDGVINYKEFQCIWSPNCCSQEEDTEIDITDESLDTFEANNEAFGFTVKEAVLFPPEVEKGMWPENYSLSDHAPLTVVFSPIRMPCSPRNRGGALAI

SEQ ID NO: 1486 - protein, 643 aa, Zea mays
MAALQPSFSPAMTLKSSCSALKFPKTALLSGFGGIPRLQDAQDRNTSVAYLIPKAASVTDQSIAEPPKTKQNRHTVDPTAPEFLPLPSFEECFPRSTKESSEIIHEESGHVLKVPFRRVHLTGDQKHFDTYDTSGPQNISPRIGLPKIRKEWIDRREKLGSPRYTQMYYAKQGIVTEEMLYCASRENLSPEFVRTEVARGRAIIPSNKRHLELEPMIVGRNFLVKVNANIGNSAVVSSIEEEVHKLQWATMWGADTVMDLSTGRHIHETREWIIRNSPVPIGTVPIYQALEKVNGIAENLSWEIFRDTLIEQAEQGVDYFTIHAGVLLRYIPLTAKRMTGIVSRGGSIHAKWCLTYHKENFAYEHWDDILDICNQYDVALSIGDGLRPGSIYDANDSAQFAELLTQGELTRRAWAKDVQVMNEGPGHIPMHKIPENMEKQLEWCNEAPFYTLGPLTTDIAPGYDHITSAIGAANIGALGTALLCYVTPKEHLGLPNRDDVKTGVISYKISAHAADLAKGHPYAQAWDDALSKARFEFRWLDQFALSLDPVTAMAFHDETLPSEGAKVAHFCSMCGPKFCSMKITEDIRKYADENSYGTVEEAVIQGMNAMSAEFLAARKTISGEQHGEAGGEIYVPESYAAQK

SEQ ID NO: 1487 - protein, 286 aa, Zea mays
MSSGRYMAYSPSPSTTPHSPRIHGLRTPSAAVAEQEKYLSELLAERHKLTPFIPVIPHSVRLLNQEIFRVSTLLENASLLNQSGLEHGSPLTTGGLYSNGAATDMNGWPSAFQSESSPAYSWLGGSQGSSSGLIVKKTMKVDIPVDKYPTYNFVGRILGPRGNSLKRVEANTDCRVLIRGRGSIKDPAREEMMRGKPGYEHLNEPLHILVEAELPVDIIDARLMQAREILQDLLKPVDESQDFFKKQQLRELAMLNGTLREEGMQRFGSASPFHNGLGMKRAKTRG

SEQ ID NO: 1488 - protein, 393 aa, Zea mays
MGSSVGCLGGGSKSRQDQNGQVVAGSSPRSGHELSRPGNNVHVFSLNELKTATRNFHMLNCIGRGGFGAVYKGNLKNGTPIAIKKLAAESKQGISEFLTEINVISNVRHPNLIKLIGCCVEGSNRLLVYEYAENNSLANALLGPKNKCIPLDWQKRVAICIGTASGLAFLHEEAQPRIVHRDIKASNILLDKKLLPKIGDFGLAKLFPDTVTHISTRVAGTMGYLAPEYALLGQLTKKADIYSFGVLLLEMISGESSSKSTWGPNMHVLVEWTWKLREEGRLLEIVDPELEKYPEEQMLRFIKVALLCTQATSQQRPSMKQVVNMLSNQTEIDLQNVAPPGVLKEPRQRTGGFGGLIADTSSSQSTKGNPAESYSTQTNMNSSQFSTTDVSPR

SEQ ID NO: 1489 - protein, 523 aa, Zea mays
MASPPPALEILVREPDGVTVWSGPPYPPGTTSPPQRLPKTACSATSFSTDGARLLATVASASATVYDCRTLAVVKCFELPGLLAAALSPTGAYLQTFQKSSSPQEKNVTVWHVDTAAALYQHYQKSMSKTTWPMVQFSADESVACRMMPNEIQFFDPKDFAKGILYRIRMPGIATMKLATAPGSHVAGFVPEAKGVPASVQIFSCNKDAQNQVVARRSFFRCSTVQLQWNKGSTGLLILAQADVDKTNQSYYGETKLNYLTTDRAFEGIVPLKKDGPVHDVQWSSSGSEFAVVYGVMPPKATIFNKKCNPLVEFGEGPYNTIRWNPKGRFVVLAGFGNLPGDMAFWDYSEKKLVAKTKAECSVTSEWSPDGRHFMTATTAPRLQIDNCIKIFDHNGSLQFKKMFERLYQADWKPEAAERFTDIADLTTSLSTLKIEETKKQVSAQGSKSAQTSSKAPAITAPKPTAYRPPHAKGSAELQDKLFGGLAPAGGEMSKNALRNKKRREKQKEKKAAEASGSPADES

SEQ ID NO: 1490 - protein, 428 aa, Zea mays
MSSSAPAPAAMAVDDAEDDQLASMSTEEITRASRLLDNEIRVHKDELQRSNLELESIKEKTKENQEKIKLNKQLPYLVGNIVEILEMNPEDEAEEDGANIDLDSQRKGKCVVLKTSTRQTIFLPVIGLVDPDKLKPGDLVGVNKDSYLILDTLPSEYDSRVKAMEVDEKPTEDYNDIGGLEKQIQELVEAIVLPMTHKDRFQKLGIRPPKGVLLYGPPGTGKTLMARACAAQTNATFLKLAGPQLVQMFIGDGAKLVRDAFQLAKEKAPCIIFIDEIDAIGTKRFDSEVSGDREVQRTMLELLNQLDGFSSDERIKVIAATNRADILDPALMRSGRLDRKIEFPHPSEEARARILQIHSRKMNVNPDVNFEELARSTDDFNGAQLKAVCVEAGMLALRRDATEVTHEDFNEGIIQVQAKKKSSLNYYA

SEQ ID NO: 1491 - protein, 525 aa, Escherichia coli K12
MTENIHKHRILILDFGSQYTQLVARRVRELGVYCELWAWDVTEAQIRDFNPSGIILSGGPESTTEENSPRAPQYVFEAGVPVFGVCYGMQTMAMQLGGHVEASNEREFGYAQVEVVNDSALVRGIEDALTADGKPLLDVWMSHGDKVTAIPSDFITVASTESCPFAIMANEEKRFYGVQFHPEVTHTRQGMRMLERFVRDICQCEALWTPAKIIDDAVARIREQVGDDKVILGLSGGVDSSVTAMLLHRAIGKNLTCVFVDNGLLRLNEAEQVLDMFGDHFGLNIVHVPAEDRFLSALAGENDPEAKRKIIGRVFVEVFDEEALKLEDVKWLAQGTIYPDVIESAASATGKAHVIKSHHNVGGLPKEMKMGLVEPLKELFKDEVRKIGLELGLPYDMLYRHPFPGPGLGVRVLGEVKKEYCDLLRRADAIFIEELRKADLYDKVSQAFTVFLPVRSVGVMGDGRKYDWVVSLRAVETIDFMTAHWAHLPYDFLGRVSNRIINEVNGISRVVYDISGKPPATIEWE

SEQ ID NO: 1492 - protein, 540 aa, Nostoc sp. PCC 7120
MNTAVTLLTEQAPQPIEEFGQLERQIIIILDFGSQYSELIARRIRETQVYSEVLSYRTPAEHLRQLNPKGIILSGGPSSVYSDRAPHCDPEIWNLGVPILGVCYGMQLMVNQLGGEVAKADRGEYGKASLHIDDPTDLLTNVEDGTTMWMSHGDSVTKMPPGFEVLAHTDNTPCAAVADHEKKLYGVQFHPEVVHSVGGLALIRNFVYHICECEPTWTTAAFVEEAIREVRAKVGDKRVLLALSGGVDSSTLAFLMHKAIGDQLTCVFIDQGFMRKYEPERLVKLFQEQFHIPVEYVNARDRFLDIMSGVTDPEEKRRRIGHEFIQVFEETSKNLGPFDYLAQGTLYPDVIESADTNVDPQTGERVAVKIKSHHNVGGLPKDLRFKLVEPLRKLFKDEVRKVGRSVGLPEEIVQRQPFPGPGLAIRILGEVTADRLNILRDADLIVRQEINQRGLYNEYWQAFAVLLPIRSVGVMGDQRTYAYPIVLRIVKSEDGMTADWARVPYDVLEAISNRIVNEVKGVNRVVFDITSKPPGTIEWE

SEQ ID NO: 1493 - protein, 279 aa, Zea mays
MDLQLHVFYRALGLSFVGGLSTAIGALFVVLNPAPNLKVLGLLQGFAAGLMLSISFLDLAHNALNSIGFLKGNLWFFAGVLFFGFIIKFIPEPDFSPPADPSEKEADDGVSGKDMMRKHRRQVLFSGIITAVGISLHNLPEGMAVFLGSVKGLHVGLNLAVAIALHNIPEGVAVALPIYFATKSKKKAFYTAAFSGLAEPLGVVAVALLFPSSLNPDILEGLLGSVGGVMAFLTLHEMLPLAFDYCGQKQAVKAVFVGMACMSASLYFLEVSLPKEISL

SEQ ID NO: 1494 - protein, 600 aa, Escherichia coli K12
MVNNMTDLTAQEPAWQTRDHLDDPVIGELRNRFGPDAFTVQATRTGVPVVWIKREQLLEVGDFLKKLPKPYVMLFDLHGMDERLRTHREGLPAADFSVFYHLISIDRNRDIMLKVALAENDLHVPTFTKLFPNANWYERETWDLFGITFDGHPNLRRIMMPQTWKGHPLRKDYPARATEFSPFELTKAKQDLEMEALTFKPEEWGMKRGTENEDFMFLNLGPNHPSAHGAFRIVLQLDGEEIVDCVPDIGYHHRGAEKMGERQSWHSYIPYTDRIEYLGGCVNEMPYVLAVEKLAGITVPDRVNVIRVMLSELFRINSHLLYISTFIQDVGAMTPVFFAFTDRQKIYDLVEAITGFRMHPAWFRIGGVAHDLPRGWDRLLREFLDWMPKRLASYEKAALQNTILKGRSQGVAAYGAKEALEWGTTGAGLRATGIDFDVRKARPYSGYENFDFEIPVGGGVSDCYTRVMLKVEELRQSLRILEQCLNNMPEGPFKADHPLTTPPPKERTLQHIETLITHFLQVSWGPVMPANESFQMIEATKGINSYYLTSDGSTMSYRTRVRTPSFAHLQQIPAAIRGSLVSDLIVYLGSIDFVMSDVDR

SEQ ID NO: 1495 - protein, 230 aa, Synechocystis sp.
MSSRSAGRNSPILPLMSHSDLPLANAVPLDKIRYNDQGLVPAIAQDYLDGTVLMLAWMNEAALAKTLATGQVWYWSRSRQELWHKGATSGHFQKLLGIRYDCDSDALLLTIEQKGDIACHTGERSCFHQLDGHKSPPPADMLTELARVIGDRRDHPTPESYTCKLLAGGDNKILKKIGEESAEVVMACKDDDPEAIAGEVADLFYHTLVALAHHNVDLRAVYRKLGDRRR

SEQ ID NO: 1496 - protein, 459 aa, Zea mays
MDRFKLIKEVGDGTFGSVWRAINKQNGEVVAVKKMKKKYYSFEECMGLREVKSLRRMNHPNIVKLKEVIRENDILYFIMEYMECNLYQLMKDKVKPFSESEVRNWCFQIFQALAYMHQRGYFHRDLKPENLLVSKDVIKLADFGLAREVSSLPPYTEYVSTRWYRAPEVLLQSSAYDSAVDMWAMGAIMAELLTLHPLFPGTSEADEIHKICNVIGSPDEQSWPQGLSLAEAMKYQFPQIKGSQLAEVMTTASSDAIDLISSLCSWDPSKRPKAAEVLQHTFFQGCTCVPLPVRPKASSLPRTPPCVGSKGNSENSVARRFSTGTLSTMKSHSNASAKLNGLSKTGVQRKLNLDRQPSQKGMKPTETSNKLTTNRVPARNSPGNPVLRHSRSLPETGRGAIQKVSSITEKLSQMSVTSRTRSAVKPAAPMMKAGHGKSDFLGKSDDIPPAKRLTRKLVS

SEQ ID NO: 1497 - protein, 188 aa, Zea mays
MAVLNYSKASFLPVQVYHSSFADDDGITKACSCPLLPLKTHIKGPAPASDPDKADIVDEAITFFRANVFFKNFHVKSSADKLLIYLTFYINIALKRLEGCRTLAVGTKAIINLGLEKVPVPGEPGFPFPGLFTLPQSQEEAELLRNYLKQIREETSGRLLNCAYRANGFPNKWWLAFAKRKFMNIVIL

SEQ ID NO: 1498 - protein, 81 aa, Zea mays
MAPGAGDDSDPASYIHTVQHLIERCMTFGMSMEECMEALAKRADVQPVVTSTVWKELEKENKEFFDKYRQWISEKRSGSTS

SEQ ID NO: 1499 - protein, 226 aa, Zea mays
MATEQAAENYTVEDLVALNPYNPDILNDLEKFVNEQVSSQTYNLDANLSLLRLYQFEPERMSIQIVAHILIKALMAMPAPDFSLCLFLIPEHVQMEEQFKVLIVLSHYLETARFSQFWDEAAKNRHISEAVPGFEQAIQSYAIHVLSLTYQKVPRPILVEAINIEGLALDKFLEYHAANSGWVIEKGGQSQVIVLPRNEFNHPELKKNTADILPFEHVTRIFPVLG

SEQ ID NO: 1500 - protein, 382 aa, Zea mays
MAHAQEIQLQIRGIPDEESVDARDGPKVATGRSTRSSFRWWMTVLVDMLMVLCGTTVATLLGRLYFNSGGNSKWMATLTQSGGSPLLVVPLLLSPARSAEERRPAALKMVAIYAGIGVMIGFDNLMYSYALQYLPVSTFSLVAATQLGFNAITSRLINAQRFTALIANSVVVLTFSAAILGVGSSSDETSSNVPRGKYPLGFVLVLAASAVFALILSLFELTFEKVVRVRTARWVLRMQMHTNLVASAVSVAGLLASGDWRTIPGEMASFKDGRTRYVLTLVGTAVSWQAAAVGLVRLIMRVSSLFANVTCTLALPLVPVFAVALFGDRMTGIKIVAMLMAVWGFLSYMYQHYIDARRRAGAENAECRVCATRTGSHAVLPA

SEQ ID NO: 1501 - protein, 515 aa, Escherichia coli K12
MTDHTMKKNPVSIPHTVWYADDIRRGEREAADVLGLTLYELMLRAGEAAFQVCRSAYPDARHWLVLCGHGNNGGDGYVVARLAKAVGIEVTLLAQESDKPLPEEAALAREAWLNAGGEIHASNIVWPESVDLIVDALLGTGLRQAPRESISQLIDHANSHPAPIVAVDIPSGLLAETGATPGAVINADHTITFIALKPGLLTGKARDVTGQLHFDSLGLDSWLAGQETKIQRFSAEQLSHWLKPRRPTSHKGDHGRLVIIGGDHGTAGAIRMTGEAALRAGAGLVRVLTRSENIAPLLTARPELMVHELTMDSLTESLEWADVVVIGPGLGQQEWGKKALQKVENFRKPMLWDADALNLLAINPDKRHNRVITPHPGEAARLLGCSVAEIESDRLHCAKRLVQRYGGVAVLKGAGTVVAAHPDALGIIDAGNAGMASGGMGDVLSGIIGALLGQKLSPYDAACAGCVAHGAAADVLAARFGTRGMLATDLFSTLQRIVNPEVTDKNHDESSNSAP

SEQ ID NO: 1502 - protein, 191 aa, Zea mays
MAIAGQCSSCYYTSPTLQLQLQRRHSHLPLQPQAARRARRPRLQVATAAGSGPIRAATDAEFFQPSDTRPIMLFDGVCNLCNGGVRFVREHDPNRSIRYVPLQSESGRKLLQRSGRSPDDISSVVLVEKDRSFIKSEAVLRIMEYLNLPFPQLAVFLKFVPLFLRDFAYDNVANNRYAMFGRSEAEACEIL

SEQ ID NO: 1503 - protein, 146 aa, Zea mays
MPRSGFSGSFRSPKIDVVIDMGNPFLNRTVDGFLKIGAVGACKVAAEETFECLHRGDVSKHKVEHALRKMCKEGAYWGTVAGVYVGMVYGVERVRGRSDWKNAMIGGALSGALISGASNSDRGKVVKDAITAGAVATAVEFINCIT

SEQ ID NO: 1504 - protein, 203 aa, Zea mays
MEMGGMSDAERLFFFEMACKNSEVAYEQNPNDADNLTRWGGALLELSQVRTGPDSLKLLEDAEAKLEEALQIDPNKSDALWCLGNAQTSHGFFTPDNAIANEFFTKATGCFQKAVDVEPANELYRKSLDLSMKAPELHLEIQRQMVSQAATQASSASNPRQSRKKKDNDFWYDVCGWVILGAGIVAWVGLARASMPPPTPPAR

SEQ ID NO: 1505 - protein, 104 aa, Zea mays
MVRKAKVEFDEQPPDNFDPKNPYADPVAMLEYREHLVREKWIHIETAKIIRERLRWCYRIEGINHHQKCRHLVDQYLEATRGVGWGKDARPPELHEPKKTVKAE

SEQ ID NO: 1506 - protein, 405 aa, Zea mays
MGCFSTFCKKRRATRQPSSHHNEDVPGCSNITKYTYKELVRATNNFNPLNKIGEGGFGSVYKGQLRNGTVIAVKVLSSESRQGVREFLNELVAISDISHDNLVKLYGYCAEGDQRILVYNHLENNSLAQTLLGSSHSNIQFDWKTRVNICLGIARGLAYLHHGVSPHIVHRDIKASNILLDRDLTPKISDFGLAKLLPPNATHVSTRVAGTLGYLAPEYAIRGQVTRKSDVYSFGVLLLEIVCGRSNSDTRLAYGDQILLEKFPEITNGALLLQTWMHYEQGCLERIIDRSLGGGDLDVAQACRFLKVGLLCTQDVTRHRPDMPRVVAMLTGEWDVEPETVSKPAIISDFMDLKVRSTRKASDNVATPPTSSSTFLSSLMAHSSPLLSNESTQASMAFTGVSDRE

SEQ ID NO: 1507 - protein, 344 aa, Zea mays
MGILCLGASSTLLCGEDRNNVLGLGCGNELVEVGSGHDGLDSVVGAVFPVDTDEAVRALLEKETDHKPQDGYAERLERGGLEYSWRRDAMDWICKVHSYYRFGPLSLYLAVNYLDRFLSSYDLPHDKPWMRQLLSVACLALAVKMEETVLPLPVDLQVCDVKFEFEARTIGRMELLVLATLKWRMQAVTPFTFISYFLDKFNGGKPPSMALASRCTEIIIGTLKGSTFLSFRPSEIAAASALAAVSENQVVGSSSALSASEVPINKEMIARCYELLQEQALVRKTGHINGSPSVPQSPIGVLDATCFSFRSEDVRLGSSQSNNISSSSNDNQVSKRRRLSISPI

SEQ ID NO: 1508 - protein, 204 aa, Zea mays
MACLHDHSCEDHNCAADWSLYNHIDVPKVVALNESVPGSVKSVFKPWEQRLDTSGGFLESNEGDPELLIFIPFTSDVKIKSISVVGGADGTSPSRMRAFINREGIDFSDAQNMQPVQEWELAENLQGALEYQTRYSRFQGVANLTLHFSDNFGGDTTKIYYIGLRGEATQNKRDVVATIVYEVMPNPSDHKTKSETGGGFSHVE

SEQ ID NO: 1509 - protein, 224 aa, Zea mays
MRFTASPVVELPVSGAVLTFEQDNDSFEVGTSVWPSSLVLVKFVERCIRDPALPFADVLRFPGTRAVELGSGCGPAGLGLSRLGLTDLVLTDIAAVLPALRRNLRRNRVHLARAPRLAQLHWNCPAHLATLATPRRFDLVVAADVVYVQESVPHLIAAMDALADAERGVVLLGYQIRSPEAHQVFWETVPAVFPVIEKVAREHLDPEYAYEESDVFILRRSPRQ

SEQ ID NO: 1510 - protein, 514 aa, Zea mays
MEADIAFRYEIPRTAQFLRDGAYTRVALQFPDEMLKDAAAVARALRRELASGGADSGVRVFVMADTAYNSCCVDEVGASHIDAQCVVHYGHACMSPTSNLPAFFVFGKAPLDVHACAGTLLECSRKSNKRILVLYGLEYAYALDDLRQTFMESCKSNSGNHEVQYAEVLCSVMSPSSSTTEENKIPQSSGPSCNGDISRNSESATFLNNRNGMECSSSTQKYSLAGMTWNISVEEKMEDYFIFWIGQDSSAFANIVLTFNKCEIVRYDAIENQLTADVSHLMKILRRRYYLVEKAKDANIIGILVGTLGVAGYLHIIEQMKDLIKAAGKKSYTLVMGRPNSAKLANFPECEVFIYVSCAQTALLDSKDFLAPVITPFEAVLAFGRGREWTGEYLLDFKDLITSEKQEAASTTGEARFSFIKGVYVEDNCPQENEEQSETSLALAEVTEKALSIQNQHNDAVLYQGRAMSSIDYLKARSYRGLTGEYEGPVPDSVLVGRMGRAAGYSDEKTESAQ

SEQ ID NO: 1511 - protein, 580 aa, Arabidopsis thaliana
MGCVLCKESTGDKRKHNNPDEPPPADLRNTEDLPSSSSTTTAAISVEIGEKKKKDLDSIQIQPERRTWHTGDFSAGSSRRPGMSLRTPEGWPPWLIAACGDSIKDLTPRRATTYEKLEKIGQGTYSNVYKAKDLLSGKIVALKKVRFDNLEAESVKFMAREILVLRRLNHPNVIKLQGLVTSRVSCSLYLVFEYMEHDLSGLAATQGLKFDLPQVKCFMKQLLSGLDHCHSRGVLHRDIKGSNLLIDNDGILKIADFGLATFYDPKQKQTMTSRVVTLWYRPPELLLGATSYGTGVDLWSAGCIMAELLAGKPVMPGRTEVEQLHKIFKLCGSPSDSYWKKYRLPNATLFKPQHPYKRCVAEAFNGFTPSSVHLVETLLTIDPADRGTSTSALNSEFFTTEPLPCDPSSLPKYPPSKELNVKLRDEELRRQKGLAGKGSGIDGARRIRYRGDRTGRAIPAPEANAESQANLDRWRSISQTNGKSKSEKFPPPHQDGAVGYPLEDLSKKTSVFGAKTETSFGLSRSLKSGEGTSMRKISNKDGARGASSRKYIWGLKPPPALGLSMDLLFRSRSEVFGIRR

SEQ ID NO: 1512 - protein, 732 aa, Zea mays
MRLLRVATCNLNQWAMDFDTNLRNVKESIKRAKAAGAVIRVGPELELTGYGCEDHFLEQDTTAHAWECLKDILTGDYTDNILCSIGMPVIFNSVRYNCQVFCLNRKIIMIRPKMSLANDGNYREFRWFSAWTFKGEIVDFQLPVEVSEAISQDTVPFGYGYMRFIDVSLAAETCEELFTANAPRIDLALNGVEVFMNASGSHHQLRKLNLRIDSIRSATQTCGGVYMYANQQGCDGGRLYYDGCCCIAVNGDLVGQGSQFSLKDVEVLDALVDLDAVSSYRASVSSFREQASHKTNVPFVKVPYKLCQPFRSGMVPTSPVEIMYHCPEEEIAFGPSCWLWDYLRRSQASGFLLPLSGGADSSSVAAIVGCMCQLVIKDIEKGDEQVKADALRIGQYKDGAIPMDSRELAKRLFYTVYMGTENSSEDTRSRAKRLAEEIGSFHLNVPIDSIVSAFLSLFETLTGKRPRYKVDGGSNTENLGLQNIQARIRMVLAFMMASLMPWVHNKSGFYLVLGSSNVDEGLRGYLTKYDCSSADVNPIGSVSKQDLRAFLRWAAIHLKYSSLAEVEAAPPTAELEPIRANYNQLDEIDMGMTYEELSIYGRLRKIFRCGPVSMFQNLCHSWCGRLSPSEVADKVKHFFKYYAINRHKMTVLTPSYHAESYSPEDNRFDLRQFLYNSRWPYQFRKINELVQEMDKDGKWGTSAEGKLGAQTGAQGTGMGVVAAGSANPSAGF

SEQ ID NO: 1513 - protein, 257 aa, Zea mays
MLTLHTIQSCPSLRRSSLFRRALLGRKRSFISASSSEDAESGTPPPLGGDKHQQEVLAQIAMLQTQKVRITDFLDERSAYLTKFAKDADSEFDLIGQNAMKELDAVGDQILERLDSKMQAFEETAEVQRQEIEMNDKVLEDFEDWIEKEKNEGMFFKSLGKVKPRNKMEIKVKAKVEAQKVKEIAEESAGSKTRMNIYLGLMGILGITIANAIFATPEVEWRKVAALGLIFIGLVAQVIYEQDISPPEAEKTEKIEE

SEQ ID NO: 1514 - protein, 766 aa, Arabidopsis thaliana
MEESEQVLPLLTNPKDLTNPSYASSSSSSSEPRDETEDLLLPISDENEEEEEENSPIRQVALTVPTTDDPSLPVLTFRMWVLGTLSCILLSFLNQFFWYRTEPLTISAISAQIAVVPLGRLMAAKITDRVFFQGSKWQFTLNPGPFNVKEHVLITIFANAGAGSVYAIHVVTVVKAFYMKNITFFVSFIVIVTTQVLGFGWAGIFRKYLVEPAAMWWPANLVQVSLFRALHEKEERTKGGLTRTQFFVIAFVCSFAYYVFPGYLFQIMTSLSWVCWFFPSSVMAQQIGSGLHGLGVGAIGLDWSTISSYLGSPLASPWFATANVGVGFVLVIYVLVPICYWLDVYKAKTFPIFSSSLFSSQGSKYNITSIIDSNFHLDLPAYERQGPLYLCTFFAISYGVGFAALSATIMHVALFHGREIWEQSKESFKEKKLDVHARLMQRYKQVPEWWFWCILVTNVGATIFACEYYNDQLQLPWWGVLLACTVAIIFTLPIGIITAITNQAPGLNIITEYIIGYIYPGYPVANMCFKVYGYISMQQAITFLQDFKLGHYMKIPPRTMFMAQIVGTLISCFVYLTTAWWLMETIPNICDSVTNSVWTCPSDKVFYDASVIWGLIGPRRIFGDLGLYKSVNWFFLVGAIAPILVWLASRMFPRQEWIKLINMPVLISATSSMPPATAVNYTTWVLAGFLSGFVVFRYRPNLWQRYNYVLSGALDAGLAFMGVLLYMCLGLENVSLDWWGNELDGCPLASCPTAPGIIVEGCPLYT

SEQ ID NO: 1515 - protein, 609 aa, Arabidopsis thaliana
MELSETYACVPSTERGRGILISGNSKSDTILYTNGRSVVTLDLNNPLKVSIYGEHAYPATVARYSPNGEWIASGDVSGTVRIWGAYNDHVLKNEFKVLAGRIDDLQWSADGMRIVASGDGKGKSLVRAFMWDSGSNVGEFDGHSRRVLSCAIKPTRPFRIVTCGEDFLVNFYEGPPFKFKLSSREHSNFVNCVRFAPDGSKFITVSSDKKGIIYDGKTCEILGELSSDDGHKGSIYAVSWSPDGKQVLTVSADKSAKIWDISDNGSGSLNTTLNCPGSSGGVDDMLVGCLWQNDHIVTVSLGGTISIFSASDLDKSPFQFSGHMKNVSSLAVLKGNADYILSGSYDGLICKWMLGRGFCGKLQRTQNSQIKCFAAHEEEIVTSGYDNKISRISYKDDQCTNEESIDIGNQPKDLSLAPLSPDLLLVTFESGVVFLRDGKVVSTINLGFIVTALAVTPDGTEAVIGGQDGKLHLYSINGDSLTEEAVLERHRGAISVIRYSPDLSMFASADLNREAVVWDRVSREMKLKNMLYHSARINCLAWSPNSTMVATGSLDTCVIVYEVDKPASSRMTIKGAHLGGVYGLGFADDSHVVSSGEDACIRVWSFTPQ

SEQ ID NO: 1516 - protein, 737 aa, Arabidopsis thaliana
MRSVVLVALAAAIGNMLQGWDNATIAGAVIYIKKEFHLEKEPKIEGLIVAMSLIGATLITTFSGPVSDKVGRRSMLILSSVLYFLSSIVMFWSPNVYVLLFARLLDGFGIGLAVTLVPIYISETAPSEIRGLLNTFPQFCGSGGMFLSYCLVFGMSLQESPSWRLMLGVLSIPSIAYFVLAAFFLPESPRWLVSKGRMDEARQVLQRLRGREDVSGELALLVEGLGVGKDTSIEEYVIGPDNEENEGGNELPRKDQIKLYGPEDGQSWMAKPVKGQSSLALASRQGSMLPRGGSLMDPLVTLFGSIHENLPSENMNASSRSMLFPNMGSILGMMGRQESQWDPERNNEDSSDQDENLNSPLLSPQTTEPDDYHQRTVGTMHRRQSSLFMANVGETATATSIGGGWQLAWKYNDKVGADGKRVNGGLQRMYIHEETANNNTNNIPFSRRGSLLSFHPEGDGHDQVNGYVQAAALVSQASMMPGGKGETAMLPKEVKDGPGWRELKEPGVKRALMVGVGLQILQQFAGINGVMYYTPQILEETGVSSLLTNLGISAESASLLISALTTLLMLPCILVSMRLMDVTGRRSLMLSTIPILILSLVTLVIGSLVNLGGSINALISTASVTVYLSCFVMGFGAIPNILCSEIFPTSVRGLCITICALTFWICDIIVTYTLPVMLKSIGIAGVFGIYAIVCAVAWVFVYLKVPETKGMPLEVISEFFSVGAKQQDAAASFLSDG

SEQ ID NO: 1517 - protein, 614 aa, Arabidopsis thaliana
MDKHHHQHLLLQHHQHLHHHQKLSLAKSSRQSCSEWIFRDVPSDITIEVNGGNFALHKFPLVSRSGRIRRIVAEHRDSDISKVELLNLPGGAETFELAAKFCYGINFEITSSNVAQLFCVSDYLEMTEEYSKDNLASRTEEYLESIVCKNLEMCVQVLKQSEILLPLADELNIIGRCIDAIASKACAEQIASSFSRLEYSSSGRLHMSRQVKSSGDGGDWWIEDLSVLRIDLYQRVMNAMKCRGVRPESIGASLVSYAERELTKRSEHEQTIVETIVTLLPVENLVVPISFLFGLLRRAVILDTSVSCRLDLERRLGSQLDMATLDDLLIPSFRHAGDTLFDIDTVHRILVNFSQQGGDDSEDEESVFECDSPHSPSQTAMFKVAKLVDSYLAEIAPDANLDLSKFLLIAEALPPHARTLHDGLYRAIDLYLKAHQGLSDSDKKKLSKLIDFQKLSQEAGAHAAQNERLPLQSIVQVLYFEQLKLRSSLCSSYSDEEPKPKQQQQQSWRINSGALSATMSPKDNYASLRRENRELKLELARLRMRLNDLEKEHICMKRDMQRSHSRKFMSSFSKKMGKLSFFGHSSSRGSSSPSKQSFRTDSKVLMERTCASTD

SEQ ID NO: 1518 - protein, 125 aa, Arabidopsis thaliana
MESKTFWIVTLLLCGTIQLAICRSEEKSTEKTMMLGGVHDLRGNQNSGEIESLARFAIQEHNKQQNKILEFKKIVKAREQVVAGTMYHLTLEAKEGDQTKNFEAKVWVKPWMNFKQLQEFKESSS

SEQ ID NO: 1519 - protein, 363 aa, Buchnera aphidicola (Uroleucon rudbeckiae)
MKKKYRIAVLPGDGIGPEVMREAYKILNILKNHFSLPLETREFNIGGSAIDQEGTALPKKTLLGCENSDAILFGSVGGKKWDDLPINQRPERASLLPLRKHFNLFANLRPAKLYSELKYLSPLRSDIIKNGFDILCIRELTGGLYFGKPTGRLKKNNIEYAFDTEIYYNYEITRIAHLAFQLAQTRNFKICSIDKSNVLNSSVLWREIVKKVSKNYPDVHLSHLYIDNATMQIIKDPNQFDILLCSNLFGDIISDECAIITGSIGMLPSASLNEKKFGLYEPAGGSAPDIEGKNIANPIAQILSVSMLVRYGMNLKTIADKIDQSVISVLKKGYRTADISNNNNYLKTNEMGDVIANTLISGE

SEQ ID NO: 1520 - protein, 365 aa, Buchnera aphidicola (Macrosiphoniella ludovicianae)
  misc_feature (128)..(128): Xaa can be any naturally occurring amino acid
  misc_feature (346)..(346): Xaa can be any naturally occurring amino acid
  unsure (1)..(365): unsure at all Xaa locations
MKKQYRIAVLPGDGIGPEVMKEAYKILKILQNYFSLHIEIKEFNIGGIALDKEGVALPKDTLLGCENSDAILFGSVGGKKWNNLPIEKRPERASLLPLRKHFNLFYNLRPAKLYSELRFLSPLRSKTXIKNGFDILCIRELTGGIYFGEPRGRLKKNNIEYAFDTEVYYDYEINRIAHVAFQLARTRKNKVCSIDKANVLNSSLLWREIVTKVSKNYPDVHLSHLYIDNATMQIIQNPNQFDILLCSNLFGDILSDECAIITGSIGMLPSASLNEKNFGLYEPAGGSAPDIAGKNIANPIAQILSLSMLVRYGMNLKKIANKIDQSVISVLKKGYRTFDISDDNNXFLKTNEMGDVIADALINGE

SEQ ID NO: 1521 - protein, 362 aa, Ashbya gossypii ATCC 10895
MSQQDQFIADDVTSNQSNVTRQMLVKEYKRIGHGAFGTVVQAYLTPDNEKWYGPFAIKKVPAQTEYKSRELAILRIADHPNVVKLEYFFTHVSPSDGKVYQHLAMECLPETLQHEILRYTQNKLELPLKHIKMYTYQIARGMLYLHALGICHRDIKPSNILVDPKSGVLKICDFGSAKKLEQNQPSISYICSRFYRAPELIVGCTQYTTQIDIWGLGCVIGEMLIGKAVFQGQEPLLQLHEIAKLLGPPDKKFIFFSNPSYGGPLFSKPLFNGTPQQRFEKYFGHAGPEGIDLLMKVLCYSPERRLSPRRVLCHAFLDELRNDRYFFPAGSSQPKQMPELFDFSEFELEIIGTLLPSIVGHE

SEQ ID NO: 1522 - protein, 363 aa, Buchnera aphidicola (Uroleucon aeneum)
MTRKYRIAVLPGDGIGPEVMREAYKILNILKDDFSLPLEIKEFNIGGAAIDQEGVALPKKTLLGCENSDAILFGSVGGKKWDNLPINQRPERASLLPLRKHFNLFANLRPAQLYSELKNLSPLRSNIIKNGFNILCIRELTGGIYFGKPTGRLKKNNIEYAFDTEIYYNYEINRIAHLAFQLSQTRNYKVCSIDKSNVLNSSILWREIVKKVSKHYPDVHLSHLYIDNATMQIIKDPNQFDVLLCSNLFGDIISDECAMITGSIGMLPSASLNEKKFGLYEPAGGSAPDIEGKNIANPIAQILSLSMLVRYSMNLKKIADKIDQSVISVLKKGYRTADISNNNDYLKTNEMGDVIASALISGE

SEQ ID NO: 1523 - protein, 365 aa, Buchnera aphidicola (Uroleucon ambrosiae)
  misc_feature (128)..(128): Xaa can be any naturally occurring amino acid
  misc_feature (154)..(154): Xaa can be any naturally occurring amino acid
  unsure (1)..(365): unsure at all Xaa locations
MKTKYRISVLPGDGIGPEVMREAYKILNILKNHFSLPLEIKEFNIGGAAIDQEGVALPKKTLLGCENSDAILFGSVGGKKWDHLPIDKRPERASLLPLRKHFNLFANLRPAQLYSELKYLSPLRSDIXIKNGFNILCIRELTGGIYFGKPTGRXLKKNNIEYAFDTEIYYDYEINRIAHLAFQLAQTRNYKVCSIDKSNVLNSSVLWRETVQKVSKNYPDVHLSHLYIDNATMQIIKDPNQFDILLCSNLFGDIVSDECAIITGSIGMLPSASLNEKKFGLYEPAGGSAPDIEGKNIANPIAQILSVSMLVRYGMNLKKIADKIDQSVISVLKKGYRTADISNNNNYLKTNEMGDVIANTLISGE

SEQ ID NO: 1524 - protein, 216 aa, Glycine max
MEERVGILLLILLGAAWACDTRELAIISELNRKSDVCELCEEYTAEALDYLNDKENQREIIDSLHNICNHILSFKQQCIELVDHYAPRFFLEIASVQPGELCKQIHICQSAKISSEVEGNSCDSCKDTVSALLVKLNDPDTKLEIMEALLKACNSMDKFSKKCKRMVFEYGPLILVKAEKFLKTADICTTLHACPASTAVSNKEASIMEVPLISDS

SEQ ID NO: 1525 - protein, 364 aa, Buchnera aphidicola (Uroleucon erigeronensis)
MKKKYRIAVLPGDGIGPEVMQEAYKILNILKDHFLLPLEMKEFNIGGIAIDQEGIALPKNTLLGCENSDAILFGSVGGKKWDYLSIDKRPERAALLPLRKHFNLFSNLRPAKLYADLKYLSPLRSNIIKDGFDILCVRELTGGIYFGKPNGHSKKNDIEYAFDTEVYYDYEISRIAHLAFQLARNRKKKVCSLDKSNVLKSSILWKEIVEKISKNYPDVHLSHLYIDNAIMQIIKDPSQFDVILCSNLFGDIVSDECAAITGSIGMLPSASLNEKNFGLYEPAGGSAPDIAGKNIANPIAQILSVSMLVRHGMNLKKIADKIDESVVSVLKQGYRTADISNNSHNYLKTSEMGDIIANFLINGK

SEQ ID NO: 1526 - protein, 363 aa, Buchnera aphidicola (Uroleucon helianthicola)
MKQKYRIAILPGDGIGPEVMREAYKILSILKDHFSLSLEIQEFNIGGSAIDQEGIALPKKTLLGCQNSDAILFGSVGGKRWDHLPINERPERASLLPLRKHFNLFANLRPAKLYSELQHLSPIRSNIIKNGFDILCVRELTGGIYFGKPSDRVKKNNVEYAFDTEVYYDYEINRIAHLAFQLARTRKFKVCSIDKSNVLNSSILWREVVEKVSKMYPDVHLSHLYIDNATMQIIKNPNQFDVLLCSNLFGDIISDECAVITGSIGMLPSASFNEKNFGLYEPAGGSAPDIAGKNTANPIAQILSLSMLVRYGMKLNKIADKIDDAVALSLKAGYRTADISNDNNFLKTNEMGDVIANFLINGK

SEQ ID NO: 1527 - protein, 364 aa, Buchnera aphidicola (Uroleucon obscurum)
MKTQYRIAVLPGDGIGPEVMREAYKILKILKNNFLLSFEIEEFNVGGIAIDQEGLALPKKTLLGCEKSDAILFGSVGGKKWDNFPIEERPERAALLPLRKHFNLFANLRPAKIYSELKHLSPLRSNIVRDGFDILCIRELTGGIYFGQPSGRRLEKNNIEYAFDTEIYYDYEINRIAHLAFQLAQSRSHKVCSIDKSNVLNSSILWKEIVQKVSKNYPDVDLSHLYIDNAIMQIIKNPNQFDVLLCPNLFGDIISDECAIITGSIGMLPSASLNEKKFGLYEPAGGSAPDIAGKNIANPIAQILSLSMLVRYGMNLKDIADKIDKSVLSVLKKGYRTADISNNNNYLKTNEMGDVIANALISGE

SEQ ID NO: 1528 - protein, 394 aa, Oryza sativa (japonica cultivar-group)
MALPATMKVLGVAVGLVSILVMGILSEVTIELLVRFAVYCRALSYGEVVHKALGRPASIVAQMCVIINNAGVLIVYLIIIGDVMSGSLKHIGVMDQLIGHGEWDNRRLLILVVLVIFLSPLCALEKIDSLSLSSAASVALAVVFVVVSCIIALVKVVEGKISMPRMGPDFSSRAAMLDLLVVIPIMTNAYICHFNVQPIYNELKEKTPHNMYKIGRITTVLCVVVYALTAVSGYLLFGEDTESDVLTNFDKDLGIRFSSILNFIVRIGYVIHLVLVFPVVHFSLRQTVDSLIFGELAPHSRKKMLTLTVVLLALIYLGSTMIPNIWVAFKFTGATTGLALGFIFPALIALRLDKEGKSLGKGERLLSIVMLGLAMVVSIIGVIGNVYSLRSKSA

SEQ ID NO: 1529 - protein, 467 aa, Gluconobacter oxydans 621H
MTAENAATTGLHPVDEKLPVWRLGAYGLQHVLAFYSAAVIVPILVAGALHLPRETLIHLIDADLFTCGIASLLQAVGFGPVGVRLPLLQGVTFTAVGPMIAIGSAVGGGTPGLLSIYGSVIVAGFVTLLMARHFAGLVRFFPPVVTGSIILIIGLALLPVAANDIVSGASPSVMQDHVPLRSIWYGLGTLASILVIQRLFRGFIATIAVLIGLVLGTLVAWMLGDANFGDVTSAPLLSITHPFYFGMPTFHPVSILSMVIVMTISMIETIGNVYATGEIVDKPITSEDIARTLRADGIATMLGGVLNSFPYTCFAENVGLVRMTGVKSRWVVAAGAVIMMMLGCLPRLGALVAAVPLPVLGGAALAMFATVAVVGVQTLSRVDFNRQSNVIIVGTSIGLSMLATAQPHISDTFPMWAKIVFGSGITLGSLSAILLHLIFNVKRTIHEAAYATDVPREALIDERIRER

SEQ ID NO: 1530 - protein, 134 aa, Triticum aestivum
MVFVWLAAFFLVVTLIVLVIFQLMCLADLEFDYINPFDSSSRINKVVMPEFIVQALLSALFLLSGHWAMFLLSAPMVYYNYTLYERRQHLVDVTEIFNHLSREKKRRLFKIAALIVLLFLSLFWMIWSVLEEHE

SEQ ID NO: 1531 - protein, 615 aa, Mycoplasma hyopneumoniae 232
MLKNNIENLAINSLKMHGVAAVNKANSGHPGVILSAAKMVYALYRDHMNFDVENLNWINRDRFILSAGHASGLLYSLLYNLGILEQKDLENFRQMGSKTPGHPEYGHTLGVEATTGPLGQGIAMGVGLAMAQAHLHSKFPEINHYTYILCGDGDLQEGISYESLSLAGHLKLENLIILYDSNDIQLDSALDVVFSENVRQRIESQGLFYQLVEKNDVNLISEAIAKAKKSKKPSFIEIKTIIGEGTSKEKTSDVHGAPLGNDILTLKKNLNWEYDDFYLADELRQHWKNTLGKRSQKAFAEFKISKELKEFLEKGQNLDLEIDLDLAKNQATRNTSGQILDYISKHLPYWIGGSADLSVSTKAKGSDGIFSCQNYQGRNIMFGVREFAMASIANGIALHSVLRPFVSTFFVFADYLKPALRLSAIMKLPVSYIFSHDSLMVGEDGPTHEPVEQLAMLRSLPNLAVYRPGDENELKAAYELILAKKNQPSALILTRQNIKSFNSCKKGFKKGAYLVRKASSKWALIATGSELGLANEIANKLDVNLISLSNWQNGPIWDPNYAISLELATTFGWKAHAKYNFGHDDFGFSAPADKILEKIGFNFDNLVTKIKKIIV

SEQ ID NO: 1532 - protein, 440 aa, Streptococcus pyogenes MGAS315
MADNWKKSTRGKALLVIEAIFDQGAYTNIALNQQLSNKALSAKDRALLTEIVYGTVSRKISLEWYLAHYVKDRDKLDKWVYYLLMLSLYQLTYLDKLPAHAIVNDAVGIAKNRGNKKGAEKFVNAILRQFTSHPLPDMETIKRRNKYYSVKYSLPVWLVKKLEDQFGSDRSVAIMESLFVRSKASIRVTDPLKLEEVAEALDAERSLLSATGLTKASGHFAASDYFTNGDITIQDESSQLVAPTLNIDGDDIILDACSAPGGKTSHIASYLKTGKVIALDLYDHKLELVKENANRLGVADNIETRKLDAREVHRHFEKDSFDKILVDAPCSGIGLIRRKPDIKYNKESQDFNALQAIQLEILSSVCQTLRKGGIITYSTCTIFDEENRQVIEAFLQSHPNFEQVKLNHTQADIVKDGYLIITPEQYQTDGFFIGQVRRVL

SEQ ID NO: 1533 - protein, 286 aa, Solibacter usitatus Ellin6076
MNDRSRLLLGLIGAGMQSSLTPAMHEREAAEHGLVCLYQLIDLACLRLSASALPELLTAAERMGFDGLNITHPCKQSVLPLLEHVSSDAAALGAVNTVVLRDGRRWGHNTDWLAFSASFRSGLPGAPIGRIVQLGAGGAGAATAYAMLKMGAGHITIVDLDPPRADALAARCGALFREGRISVSADPAASLASADGLIHATPTGMHGHPGSAIPAELLRGDLWVAEVVYFPLETELLRAARAAGCRTLDGSGMAVHQAVEAFRLFTGLEPDAERMRRHFATMVQAR

SEQ ID NO: 1534 - protein, 319 aa, Mycobacterium smegmatis str. MC2 155
MSAIATVDLSRWYAGGAEADAVAAEVDAGLQRAGFIVVTGHGVDPTLAARVRAASREFFALPDEVKQRYSVPVGGRGWIGPGAEANGYAEGTETPPDLKESFSLGADDATGDPEVDRIWFAPNVWPDEVPALRSLVTEYTAAMRKLSDDLLALFAHALGLPANPFVALADRPTWTMNINHYPPMTVVGEPEPGQFRIGPHTDFGTVTVLDREPGAGGLQVYSQEAGWEDAPWEPGALTINIGDLLEYWSGRRWPSGRHRVLPPQPDAPEEDLVSLIYFYEANHDAVVTPLPPPVGRAAGLAPVTSSAFIKERLDAITVG

SEQ ID NO: 1535 - protein, 804 aa, Oryza sativa (indica cultivar-group)
MAPAQCARVQRVFHFGKGKSEGNKAMKDLVSMPGMMDTVLNLGLNDEVAAGLAAKSGDRFAYDSYRRFLDMFGNVVMDIPHALFEEKLEAMKAVKGLHNDTDLTATDLKELVAQYKDVYVEAKGEPFPSDPKKQLQLAVLAVFNSWDSPRAIKYRSINKITGLKGTAVNVQTMVFGNMGNTSGTGVLFTRNPSTGEKKLYGEFLVNAQGEDVVAGIRTPEDLDAMRDHMPEPYEELVENCKILESHYKEMMDIEFTVQENRLWMLQCRTGKRTGKGAVKIAVDMVNEGLVERRTALKMVEPGHLDQLLHPQFENPSGYKDKVIATGLPASPGAAVGQIVFTAEDAEAWHAQGKDVILVRTETSPEDVGGMHAAVGILTARGGMTSHAAVVARGWGKCCVSGCSSVRVNDASKIVVIEDKALHEGEWLSLNGSTGEVIIGKQPLCPPALSGDLETFMSWVDEVRKLKVMANADTPEDATTARQNGAEGIGLCRTEHMFFASDERIKAVRQMIMASSLELRQKALDRLLPYQRSDFEGIFRAMDGLPVTIRLLDPPLHEFLPEGHVEDMVRELCSETGAAQDDVLARVEKLSEVNPMLGFRGCRLGISYPELTEMQARAIFEAAITMTNQGIQVFPEIMVPLVGTPQELGHQVDVIRQIANKVFTDMGKTIGYKVGTMIEIPRAALVADEIAEQAEFFSFGTNDLTQMTFGYSRDDVGKFLPIYLSQGILQHDPFEVLDQRGVGELVKLATERGRKARPNLKVGICGEHGGEPLSVAFFAKAGLDYVSCSPFRVPIARLAAAQVLL

SEQ ID NO: 1536 - protein, 442 aa, Oryza sativa (japonica cultivar-group)
MGGSGKWVKSLIGLKKPDREDCKEKLQVPSVNGRGGGKGRKWKLWRSSSGDHGSLWRGSRGGGGGGGHHRSASSDASDDASSAAADPFTAAVATVARAPAKDFMAVRQEWAAIRVQTAFRGFLARRALRALKGLVRLQAIVRGRQVRKQAAVTLRCMQALVRVQARIRARRVRMSTEGQAVQKLLEARRTKLDILREAEEGWCDSQGTLEDVRVKLQKRQEGAIKRERAIAYAYSQQIEGATKCNQQPKPTSYGRLNQSGMLLKHQHFDKSNGNWSWLERWMAARPWENRLMEEHNQTNSSSPDLLSSKNCEDSFGILGDFSEPNSVKVRKNNVSKRVCAKPPVVSHHQRIKAQSISSLSTELHNDESSASSSSCFASTPISFSTFVTTEKTEDSIRARPNYMNMTESIKAKRKACNAQRTTAGKLMEDRKASGVELKVAQV

SEQ ID NO: 1537 - protein, 446 aa, Burkholderia vietnamiensis G4
MNENHAVPAAPPGIRRGQRIALALLMVSGIVNYLDRGTLAVASSAIRADLGLSLSQMGLLLSAFSWSYALCQFPVGGLVDRIGPRRLLGVGLIVWSIAQAAGGMVSTFGWFIVARIVLGIGEAPQFPSAARVVSNWFPLRARGTPTGIFNAASPLGTALAPLLLSVLVASFDWRLAFVATGALGLVVAVVWFALYRDPARAQLSVAERGYLDADAQTAAAAPKLTFADWRSLFSHGTTWGMLIGFFGSVYLNWVYLTWLPGYLTMERHMSLIRTGFAASVPFLCGFVGSLVAGWLSDFVTRRSRSPVVSRRNAVVVAMLGMVAFTIPAALVQSNTVALACISVVIFLANAASACSWALATAAEPRRIARRDPEFWRFHRRCTRADPDGRHRAEVVVRAGAADGRGDRVRRCDGLPAAGAQADSRAGGQRRARTAAGLSVAATPRIY

SEQ ID NO: 1538 - protein, 361 aa, Zea mays
MDVEARKDAAPARGKAVRRFLVALNCGMLALGAIGGPLLSRLYFSKGGHRQWLSAWLETGGWPLLLVPVAASFGARRARDRGAPVLLTPPRILLAAAGLGVATGVDDFVYAYGLAYLPVSTSAILISTQLAFTVFFAFLVVRQRLTAASVNAVALLTVGAVVLGLHVSSDRPPGVTRGRYWLGFSLTLCAAALYGLVLPLVELAYRRAAGGGRAVTYALVVEMQLVMGFFATAFCTVGMVVNKDFQAIPREARQYELGEARYYMVLAWAAVLWQCFFLGAVGVIFCVHTLLAGILIAVFIPVTEVAAVIFLHEKFSSEKGVALALSLWGLASYSYGEWSQAKAKKEKKSEEDDGEVAQAVP

SEQ ID NO: 1539 - protein, 309 aa, Burkholderia vietnamiensis G4
MKDHAEFPRIAVVGSLNVDLVTHAPRLPVPGETLLGTAFRTVSGGKGANQAVAAARLGASVAMIGCVGNDAFGARLHDALAAERIDLTHVHRIDGAATGVATIAVDASGANSIVVVPGANARLDAATIDAARDAIAGAALMVCQLEVPMETVVRAIDRARACGTPVLLNPAPARPLSDALLARLEYLVVNETEAESLTGITVGDDASAVRAADALHAKGAGNVLVTLGARGVCWRGSAGNGRHPALAVTAVDTTAAGDTFVGGFAAARAGGASMDDAIAFGQRAAAISVTRHGAQTSIPTREEVQHTTA

SEQ ID NO: 1540 - protein, 322 aa, Clostridium difficile 630
MNKLSDEIINSLSTTIREKVEKVSNNNLNIEEIRLRSQKPLILNANSKDYFYNQKTMTLDLNQQNSYVVTREDVEQTFQIICKYSIHSFMDDIKKGFITLRGGHRVGLVGKAIVEDGQVKNIKHISSLNIRVSREIIGCSDKILSHIIKGKNQINNTLIISPPQCGKTTLIRDIVRNLSNGNEDYGFKGLKVALVDERNEIAGAYLGVPQMDVGIRTDIIETCPKDLGITMLLRSMSPNVIVTDEIGSEKEIKALYTALNGGIGLITTVHGDSIEDIQNRKELNRLLDKELFKKVIILSAKRGAGTIEKIYDLEEKRWYFAN

SEQ ID NO: 1541 - protein, 511 aa, Oryza sativa (japonica cultivar-group)
MTMVEAEAGKEAIRRALRSLRRRHLVEEGAHRPAIEALARPFAAQAVEWKEKAEKHELELQQCYKAQSRLSEQLVTEIEEGKASKALLKEKETLITTMQTELEQTREENTQLKQSLEEKTSALDLIIQEHQAVKAELEQALTKQKVAEDENRNLIDRWMLEKMKDAERLNEANAMYEEMVLKLKSAGVGGIQHNALQEADGIIRRSEAGYMDIMETPIPSTCRITIRAHDGGCGSIIFQHNTDKLISGGQDQTVKIWSAHTGALTSTLQGCLGSVNDLAVTNDNKFVIAACSSNKLFVWEVNGGRPRHTLTGHTKNVSSVDASWVKSCVLASSSNDHTIKIWDLQSGFCKSTIMSGSNANSLAFIDGVTLCSGHRDGHLRLWDIRSAKCTSQTFAHLDVSSVSVSRNRNFILTSGKDNVHNLFDPRTMEVCGKFKAMGNRVVSSWGRPCISPDENSIAAGANDGSVYIWSRLKKDGVPTILQGHSSSVVSSSWCGLGPLATADKHHIYIWT

SEQ ID NO: 1542 - protein, 467 aa, Burkholderia mallei ATCC 23344
MEGSQTGLGTGLKQRHVTMLSIAGVIGAGLFVGSGHAIVEAGPAALIAYAIAGLLVVLVMRMLGEMAVAQPDSGSFSTYADRAIGHWAGFTIGWLYWWFWVLVIPIEATAAATILNAWFPGVATWIFALGITSVLTVTNLFSVKNYGEFEFWFALIKVVAIVVFLAIGGAAIVGLLPGSNVSGAARLVNAGGFMPNGVGAVLAAMLTTMFSFLGTEIVTIAAAESEHPERQIVRATNSVIWRISLFYLGSIFVVAALVPWNDALLPAHGSYQRAMELIGVPHAKGIIDVIVLVSVASCLNSALYTASRMIFSLSTRGDAPAFLRRTDASGTPRAAVLASTAFGFLTVIANYVMPEQVFGFLLATSGAIALLVYLVIAISQLRMRSTLDATGERLPLRMWCFPWLTWAVIVFICGVLVVMLLREDHRMEVGATAVLALAVVVASRMNRRARGGDEPTPAASRVSANLR

SEQ ID NO: 1543 - protein, 364 aa, Buchnera aphidicola (Uroleucon sonchi)
MKKKYRIAVLPGDGIGPEVMREAYKILNILKYHFSLPLEIEEFDVGGSAIDKEGVALPKKTLLGCENADAILFGSVGGRKWDSLPIDQRPERASLLPLRKHFNLFANLRPAQLYSELKYLSPLAFLIVIKNGFNILCVRELTGGIYFGQPSGRSKTNNFEYAFDTEVYYDYEINRIAHLAFQLAQTRNYKVCSIDKSNVLNSSILWREIVKKVSLSYPNVHLSHLYIDNATMQIIKDPNQFDVLLCSNLFGDIISDECAIITGSIGMLPSASLNEKKFGLYEPAGGSAPDIEGKNIANPIAQILSVSMLVRYSMNLKNIADKIDYSVISILKKGYKTADIAHDNNYLKTNEMGDVIADALISGE

SEQ ID NO: 1544 - protein, 526 aa, Ashbya gossypii ATCC 10895
MSFSDEEDFDDIYGDDNKQNSETAVAAGKRKADGEAGAGPTSKEEAARGADNSGASAAETTTTPASWLDQLAALQVLSSNLNQLQQSTNNNSNNNTNSSDSTSNDSNKGNVPDQMLARGMPDLSQLQQLQQTMNQLQQQAAPLTQQQQQEAKQVKADLSRDINKMFIGGLNWETTEDNLREYFSKYGNVTEVKIMRDGTTGRSRGFGFLSFADASSVDEVVKTQHILDGKVIDPKESDPTGRARKAGKIFVAGIGPDVRPKEFEEFFSQWGSIIDAQLMLDKDTGRSRGFGFITYDSPDAVDRVCQNKFIEFKGKRIEIKRAEPRQVQKQRTTNASPTGQPFSLNTSQAPQPPQQQFQMMANPMMANPLFNPQAMADYYAKMQEYYQQSGIDYSQMYQQQMQQMQQMMSMMTGGNAPAGGMPAGANGAGGNGDDTNGVPTIGEDSSSTSSGKDNNDKESSNNRHDSYGNRDRERSPDARRGHRNYNDREEGGHGFRRENRDRGFRGRERRGGGYGRDRRGYHPYSR

SEQ ID NO: 1545 - protein, 488 aa, Acinetobacter sp. ADP1
MVKELYIAGEWRLGRGKVIQSTFPADNSVNAEISTASFEDIEEAIVKADQAWRAPEWRNRLPHERAKILYKVADIIEARVDALAALQTRDNGKPLAETRGLVFSAAATARYVAAACETMNDELTSQRAPDFMTFSVHEPVGVVAAITPWNSPIASEVQKLAPALAGGNAVILKPAEATSLIALELAKIFEEAGLPKGLLSVLVGKGSVVGDAIVKHPLVRKISFTGGTTTGRHLAHIAADKLITTSLELGGKSPTIVLPDADIELAAKGIAYGIFSSAGQACIAGSRLFIHSSIYDQFLARLVEITKSLRVGHPEQKDVHMGSLINAAHLASVDRYVQLAKQEGGEILTGGQAMTEGEFAKGSFYLPTIITGLKNQAQVCQEEIFGPVLVVMKYEHEDDLIEQANDSCFGLAAGIWTESYRKAWRIARVLEVGTVWINTYKKFSISAPFGGFKDSGIGREKGRQGILSYMQQKSIYMGLNEQPNPWAD

SEQ ID NO: 1546 - protein, 548 aa, Ashbya gossypii ATCC 10895
MPAAHETESPPIQTLGQRKRQQNEKVDQKWKTLPEDMSAGSEIPMGSKCHGAEPVPRKSIWQRAREIFLKYMKFVGPGLMISVAYMDPGNYATDVSAGASHKFALLCIVLYSGLIAIFLQSLCIKLGTVTGLDLSRACREYFPRWLNITLYVLSEAAIIATDIAEVIGGAIALNILLKIPLPAGAVITCTDVLLVLLAYTPGTSSMRLVRVFELGVATLVLGVTVCLCIDLAYIPSTTSVAKIFRGFIPSREIFQNNGMYAAVGILGATVMPHSLFLGSGIVQPRLLEYDVQHGHYSMDIDSDDDSSLENKTSRQTKESRFLDYRPSIYAIRYAMKYSIIEVSVALLTFALFINCAILIVSGSALYDTPEAIDADLYTIHHLLSNTLAPAAGTIFMLALLFSGQSAGIVCTIAGQIVCEGHIRWTITPWKRRILTRAIALIPTLAVSTALGKNGLSQALNASQVALSVLLPFLTAPLIYFTCSKRIMSVKVSKPMPDGVPADEEEQTPEYVDMSNGWITSLAAIFIWIFISFLNIYAIVQLGLTSRQT

SEQ ID NO: 1547 - protein, 121 aa, Mesorhizobium sp. BNC1
MGEQAEGRLTTHVLDTAAGRPAAGMEIALYRFNGDMRTHLKTVRTNADGRCDAPLLEGRSFTPGRYEIVFEVGAYLRAMGTALPAPPFLDQVPIRFGMAEHAHYHVPLLVSPYGYSTYRGS

SEQ ID NO: 1548 - protein, 292 aa, Bacillus clausii KSM-K16
MITVVGSINIDLVVHTGTMPVLGETVLGGEFQTNPGGKGANQAVAAARLGADVTMIGKVGNDPYGKLVTDNLQNEQINTDYIEVEKDGHTGVAMITVTNNDNAIVVAPGANFSWKPEEAAQYRDVFKQTNVLVLQLEVPLPFIEEIAKIGKEERCIVILNPAPAQPLPSSLLDLVDYITPNETECQTIFKQSVEQAVQRYPNKLLVTEGKKGAAYHDGQQLVQVNGFPANVVDTTGAGDTFNGALAAALASGQQLAEAVTFANAAASLSVEQAGAQAGMPSKQQVLARLGSS

SEQ ID NO: 1549 - protein, 427 aa, Candidatus Kuenenia stuttgartiensis
MNYIGPEAILQKKQEYLIPCVYHFYKKPMQIVRGEMQYLYDHKGKKYLDLYGGVSVMNAGHCNPEIVEKICAQVNTLQHTTTIYLTQPIADLAEKLSEITPGNLKRSFFCASGSEANEGAALISQLFTKKSKFVAIEQGLHGRTKLTMNLTGIPMWRTDPYPSGNVTHIPAAYCYRCAYGLTYPNCDLKCARRLEDVVRDGDFAALIIEPIQGNGGIITPPPEYFQLIREILNKYKVLLITDEVQTGFGRTGKMFAIEHWDVVPDIMCMAKALANGTPLGAFITNDAVASAYTRPGASTTGGNPVSATAALATIDVIENYRLVEKAKELGDYFKNALNDLQQKYRIIGDVRGMGLMLGVELVKEDKIPAFDETDNILEQLKDLGILAGRTGISRNVLTFQPPLVITQNDIDHLCMVLGIILSKVSDG

SEQ ID NO: 1550 - protein, 208 aa, Zea mays
IPASTQRPIIYQYLSMESVPRKELQLVGISAMLIASKYEEIWAPLVKDLMCLCDNAFTRDQVLTKEKAFLDRLHWNLTVPTMYMFIVRYLKAAMCDTELENMAFFYSELALVHYAMLVYPPSVTAAAAVYAARSTLGMNPPWTDILEHHTGLAEPQLLDCARRLINFHTLAPESKQKAVYRKYSKPKLGSVALQSPVKKLLSGSQEVL

SEQ ID NO: 1551 - protein, 174 aa, Malus x domestica
MPRDRDPLVVGRVVGDVLDPFTRSVSLRVTYGTKEVNNGCELKPSEVVQQPRADIGGDDLRTFYTLVMVDPDAPSPSDPNLKEYLHWLVTDIPATTAASFGQEIVCYESPRPTVGIHRFVLVVFRQLGRQTVYAPGWRQNFNTRDFAELYNLGLPVSVVYFNCQREGGSGGRRR

SEQ ID NO: 1552 - protein, 168 aa, Oryza sativa
  misc_feature (154)..(154): Xaa can be any naturally occurring amino acid
  unsure (1)..(168): unsure at all Xaa locations
MALVEDNNAVAVSFSEEQEALVLKSWAILKKDSANIALRFFLKIFEVAPSASQMFSFLRNSDVPLEKNPKLKTHAMSVFVMTCEAAAQLRKAGKVTVRDTTLKRLGATHLKYGVGDAHFEVQGVKFALLDTIKEEVPADMWSPAMKSAWSEAYXHLVAAIKQEMKPAE

SEQ ID NO: 1553 - protein, 452 aa, Staphylococcus aureus subsp. aureus MW2
MNYTQQLKQKDSEYVWHPFTQMGVYSKEETIIIEKGKGSYLYDTNGNKYLDGYASLWVNVHGHNNKYLNKVIKKQLNKIAHSTLLGSSNIPSIELAEKLIEITPSNLRKVFYSDTGSASVEIAIKMAYQYWKNIDREKYAKKNKFITLNHGYHGDTIGAVSVGGIKTFHKIFKDLIFENIQVESPSFYRSNYDTENEMMTAILTNIEQILIERNDEIAGFILEPLIQGATGLFVHPKGFLKEVEKLCKKYDVLLICDEVAVGFGRTGKMFACNHEDVQPDIMCLGKAITGGYLPLAATLTSQKIYNAFLSDSHGVNTFFHGHTYTGNQIVCTVALENIRLYEKRKLLSHIETTSSTLEKQLHALKRHRNVGDVRGRGLMFGVELVTDKDSKTPLEIEKVERIVRKCKENGLMIRNLENVITFVPVLSMSNKEVKTMVRIFKKAVHNILDRKC

SEQ ID NO: 1554 - protein, 361 aa, Sulfitobacter sp. EE-36
MLLLGLESSCDDTAAALVRQLPGQRALVLSSVVVGQTELHASFGGVVPEIAARAHAEKLDLCVEKALAEAALTLADVDGFAVTAGPGLIGGVLSGVMCAKGLSAATGKPLYGVNHLAGHALTPRLTDDVPYPYLMLLVSGGHCQFLLVHGPDRFERLGGTIDDAPGEAFDKVARLISLPQPGGPAIEQAAKAGDPKRFALPRPLLDRPDCDMSFSGLKTAVLRTRDKVIDEKGGLSVQDQADLAAGFQAAVTDVLAEKTRRALRKYLDHAPDVRTLCVAGGVAANKAIGHGLETVAAEVDCAFIAPPLSLCTDNAAMIAFAAIEQSQLRAPDDLTLSARPRWPLDTRQPAMLGSGKKGAKA

SEQ ID NO: 1555 - protein, 524 aa, Mycobacterium smegmatis str. MC2 155
MTTGPITGSTKAYREVEHPGVDVPLRVPFRRVHLSDGDHLDLYDTSGPYTDTDAVIDLDAGLTPRPGVVRDRGTQLQRARAGEITAEMAFIAEREGVPAELVRSEVARGRAVIPANHNHPESEPMIIGKAFGVKVNANIGNSAVTSSIAEEVDKMVWATRWGADTIMDLSTGRDIHLTREWILRNSPVPVGTVPMYQALEKVNGDPTKLSWDVYRDTVIEQCEQGVDYMTVHAGVLLRHIPLTVDRVTGIVSRGGSIMAAWCLAHHTESFLYTNFEELCEIFARYDVTFSLGDGLRPGSIADANDAAQFAELRTLGELTTIAKNHGVQVMIEGPGHVPMHKIVENVRLEEELCDDAPFYTLGPLATDIAPAYDHITSAIGAAIIAQAGTAMLCYVTPKEHLGLPNRQDVKDGVIAYKIAAHSADLAKGHPRAQQRDDALSKARFEFRWHDQFALSLDPDTAREFHDETLPAEPAKTAHFCSMCGPKFCSMRITADLKDSIREAMDQKSAEFAEQGNRVYLPLTS

SEQ ID NO: 1556 - protein, 394 aa, Ustilago maydis 521
MDLVLEIADTYALDKVWATLWPALPRSVAHNASALASLADASATSSANLTSLLGLSTEAATWAASASSSALSPSHWFENTVLKQAVSSSLSGNKVNWSALGHVSALPRDNLVRQTISLHVLTYLGILVLYFTFAGLSYKYIFNKEMQKHPRYLKNQVRLEIESSMRAFLPLVVMTVPWFVLEVRGHSKLYNNISDHGWEYAVLSVPLFLVFTDFLIYWVHRIEHHPRLYKHIHKPHHKWIVPTPFASHAFHPLDGYVQSLPYHVFPFVFPLHRVVSICLFVFVNLWSILIHDSDMICDSVLEKLINGPSHHTLHHMFFTCNYGQYFTLCDRAGGSYRAPRREDDPLLAVNAAELKKAANKKAAAKAAHVASSESDASSSGDEGVVIKKLSRKNK

SEQ ID NO: 1557 - protein, 349 aa, Coccidioides immitis RS
MDVVLEVLDTFLFDYLYALAAPASQLGPLAYSQIPDGLNKTASAAGGFFYRPASQYLYLEPSKYAYMSALQRDNVYRQGFSLFIITWVFGLAVYFIFATLSYVLVFDKTTVNHPKYLKNQIRQEIAQTSRALPVMAILTVPFFLAEVRGYGKIYDTFAEAPFQLYNILQFPLFFMFTDGLIYWIHRGLHHPLVYKRLHKPHHKWIMPTPFASHAFHPVDGWAQSLPYHIFPFIFPLQKFAYVFLFMAINVWTILIHDGEYASNNPVINGAACHTMHHLYFNYNYGQFTTLWDRLGSSYRKPNDELFRRETKMGEEEWKRQVQEMETLVKEVEGDDDRQYLHEEEDKKNL

SEQ ID NO: 1558 - protein, 394 aa, Coccidioides immitis RS
MSQNRPSMFSSLRMGEVIREKVQDGVTGETREMQYTQCKIVGNGSFGVVFQTKLSPGGEDAAIKRVLQDKRFKNRELQIMRIVRHPNIVELKAFYYSNGDRKDEVYLNLVLEFVPETVYRASRYFNKMKTTMPMLEVKLYTYQLFRALAYIHSQGICHRDIKPQNLLLDPSTGVLKLCDFGSAKILVENEPNVSYICSRYYRAPELIFGATNYTTQIDVWSTGCVMAELMLGQPLFPGESGIDQLVEIIKVLGTPTREQIKTMNPNYMEHKFPQIKPHPFNKVFRKASPEAIDLITALLEYTPTQRLSAIEAMCHPFFDELRDPNTRLPDSRHPSASARELPKLFNFTHHELSISPSLNHKLVPPHAKSELFSRGIDIDNFIPLKKEEMMARLD

SEQ ID NO: 1559 - protein, 404 aa, Mycoplasma hyopneumoniae 232
MQPTYKNKKFIDDIDFLNKTVILRVDFNVPIKNGEISSIKRIIASLKTIKKIVNNGGKLVILSHLGRIKSKEDLPKKSLRIVAEKLAEILGQEIKFIPENRGPKVENAISQLEKGEILVLENTRFQDLNNKAESKNDAELGRYWASLGDVFINDAFGTLHRAHGSNVGIATYIKESAIGYLVKEELDALSKLIFSPQRPFYAIIGGAKISDKIGIISTLLEKADKVLIGGGMAYTFKKALGYKIGLSIYEDDKLELAASLVKKYPDKLILALDAALAPEFADLEPLYNQENPLEIPDHLEGMDIGPLTIELFKDHLKDGKTILWNGTLGVAEFKNFARGTKEVAKIIANLKECYSIIGGGDSIAAIEAEGLSNSFSHISTGGGASISFIENGDLIGLGPIQEKD

SEQ ID NO: 1560 - protein, 406 aa, Haloarcula marismortui ATCC 43049
MSRSPSLPERPRLELDPDMTPDERLEALREHFKEIVQVNEQLTEQLDAARDRQHDLTDEVDQLERENETLKTSSLYIATAEELTDDGVVVKQHGNNQEVLTEVSPSIRDGLEAGDRVAINDSFGVKQILDPETDARAQAMQVDGSPDVSYSDIGGLEEQIREVREAVEEPLVNAEQFREVGIEPPSGVLLHGPPGTGKTMLAKAVANETDATFIKMAGSELVRKFIGEGARLVRDLFELAAEREPAIIFIDEIDAIAAKRTESKTSGDAEVQRTMMQLLSEMDGFDERGEIRIIAATNRFDMLDRAILRPGRFDRLIEVPNPDVEGRERILEIHTQEMNLDDDVDLGAFATETDGLSGAELASLATEAGMFAIRDGRTTVQQADLHDALEKIEADDDASSVPVAFA

SEQ ID NO: 1561 - protein, 113 aa, Plasmopara halstedii
RSTGGKAPRKQLATKAARKSAPTAGGVKKPHRYRPGTVALREIRKYQKSTDLLIRKLPFQRLVREIAQDYKTDLRFQSTAILALQEASEAYLVGLFEDTNLCAIHAKRVTIMP

SEQ ID NO: 1562 - protein, 187 aa, Saccharomyces cerevisiae
MPIASYAQELKLALHQYPNFPSEGILFEDFLPIFRNPGLFQKLIDAFKLHLEEAFPEVKIDYIVGLESRGFLFGPTLALALGVGFVPVRKAGKLPGECFKATYEKEYGSDLFEIQKNAIPAGSNVIIVDDIIATGGSAAAAGELVEQLEANLLEYNFVMELDFLKGRSKLNAPVFTLLNAQKEALKK

SEQ ID NO: 1563 - protein, 438 aa, Magnetospirillum magnetotacticum MS-1
MTNENKTPKESVTLINNSTGKTTEFPLLAGSIGPKVADIRSLYASQDIFTYDPGYMSTGSCKSAITYIDGDAGVLLHRGFAIADLAENCSFLEVAYLILKGELPNAEQKTKFEFDIAHHSMVHEQINFFFRGFRRDSHPMAVLCGVVGAMAAFYHDSIDINDPHHRMVASYRLVAKMPTIVAWAYKYAQGQPFMFPQNKLSYSENFLHMMYATPCEEYKVSPVLARAMDRILILHADHEQNASTSTVRLAGSSGANPFACIAAGIASLWGPAHGGANEAVLQMLHEIGSVERIPEFIKKAKDKDDPFRLMGFGHRVYKNYDPRAKIMQKTCHEVLSELGVHDEPLLKLAMELERIALEDPYFVERKLFPNVDFYSGIIFRAMGIPTQVFTCLFALARTVGWIAQWNEMLTDPDQKIGRPRQLYVGPAQRDFVPLHKRG

SEQ ID NO: 1564 - protein, 647 aa, Oryza sativa
MWKMVDALLRCSALVALVLHFVVNGCSAVNTEGSALLKFQSRVEEDPHGAMAGWSERDGDPCSWNGVRCVDGRVVILNLKDLSLRGTLGPELGSLSHLRALVLSNNLFDGPIPKEMSDLAMLEILDLSNNNLTGEVPQEIAEMQSIKHLLLSNNNFQWPLIQNSYRNFDQEIDFDVYDERGDVDQRSENGFESDSSSEENTKDNNNLSARLSSQFAARNPTVQLSRRRLLEDTNLAAASANAPVPAVASVPSTGTGSFSAFKEIKVPPPLSPPSSPPMSSGPPQRSKRWLYAIVISSIALLLIGIACMFLLCRNKSVATIGPWKTGLSGQLQKAFVTGVPKLQRSELEGACEDFSNIVASYPHYTVYKGTLSSGVEIAVVSTVIATNKDWSKHSEGRFRKKIDLLSRINHKNFINLLGYCEEENPFMRMMVLEYAPNGTLYEHLHVEGFDHIDWNGRMRVIMGVAYCIQHMHELNPSITHPDLHSSAILLSEDGAAKVADMSVWQEVISKGKMPKNDDIVDHHEPVSADPAGNVCSFGLLMLEIISGRPPYSEHKGSLANLAMECIKDDRNISCLLDPTLKTHKENELEIICELIQECIQSDPKKRPGMREVTTRLREVLAISPEAATPRLSPLWWAELEILSVEAT

SEQ ID NO: 1565 - protein, 490 aa, Acinetobacter sp. ADP1
MSDVKLHRLYIHGQYTDATSGKTFDSINPATGEVIATIQQASQTDIEAAVKSAAEGQKVWAAKTAVERSRILRRAVDILRERNDELAQLETLDTGKAFSETSTVDIVTGADVLEYYAGLATAIQGEQVPLRESSFFYTRREPLGVVAGIGAWNYPIQIALWKSAPALAAGNAMIFKPSEVTPLTAFKLAEIYSEAGLPAGVFNVVQGAGREIGQWLTEHAVIEKISFTGGVETGKKVMASAAGSTLKEVTMELGGKSPLIICEDANLDRAADIAVMANFFSSGQVCTNGTRVFIPQRLKAAFEQAVVERVKRIRMGDPQHTDTNFGPLVSFPHMEKVLSYIESGKQQGAKVLIGGERATTGLLAQGAYVQPTVFTDCHDDMKIVQEEIFGPVMSILTYDTIEEAIERANNTNFGLAAGVVTQNISQAHQIIHQLEAGICWINTWGESPAEMPVGGYKESGVGRENGISTLNHYTRTKSIQVELGDYQSVF

SEQ ID NO: 1566 - protein, 420 aa, Ustilago maydis 521
MSSVENTPPTVTAPPGSGGRLSTDSAFSQSRPRRLSMLRFERHKHHGASGNPLPHRRHAFGKPSFSGFQQHFMAGLGELIGTTMFLFLAEGGAKTAQLSVSAAQNETATPLSNETIMFIALSFGMSLLVSAWMFYRITGGLFNPAITIALWWVGVLTSCRALVLFIAQILGGIAGAALVLGLTPTNSISQVTTTLQPGISLAQGFLIEMLLTSILVFSVLMLAVEKHRATYLAPVGIGLTLLAAHLFGVVWTGCGMNPARSFGPAVVAGEFNSDHWIYWIGPLAGGILAVAYFSFLKVLKYNSVVMDQDSDKEITGLKPMHVRIWNLVRHRQNPGALNPESSTHYDKSARQNFDKEETEAFEEREAIRKQMMDKPVFDGHAHEAANGRMSERNNAELMSTSTGSTARLSSGGHQGAILPK

SEQ ID NO: 1567 - protein, 348 aa, Triticum aestivum
  misc_feature (24)..(24): Xaa can be any naturally occurring amino acid
  misc_feature (106)..(106): Xaa can be any naturally occurring amino acid
  unsure (1)..(348): unsure at all Xaa locations
MAAAEAEVSNKGVILKQFVTGVPXEDDLELVTAVVRLAVPPGSASVMVKNLYVSCDPYMRNRMSEHNEASYIEQFVPGEVLATFSVGRVVASGHPNFKSGDLVWGXMSGCEEYTLITDPESLFKINHPELPLSYYTGVLGMAGLTAYAGFFDVSKPKQGDYVFISSASGAVGQLVGQLAKITGCYVVGSVGSDEKVNLLKTKFGFDDAFNYKKEEDLNAALKRCFPQGIDIYFENVGGAMLAAVLPNMRMNGRIAVCGMISQYNLEQPNGAPNLFCLVAKRIRMEGFMVLDYFGTYNKFEEEIAGYLKEGKISVVEDVAEGIENVPTALIGLFSGHNIGKQLVTIAHE

SEQ ID NO: 1568 - protein, 320 aa, Acinetobacter sp. ADP1
MQLTEEQLLAAYKRMRDIREFEDRLHEENNTGDIPGFIHLYSGEEAVAVGVCENLTDQDYITSTHRGHGHCIAKGCDIHDMMLEIFGKDAGLCRGKGGSMHIADLDKGMLGANGIVGGGPPLAIGAALTAKTLKTGGIGLSFTGDGGSNQGLTFEAINMAVVLKLPVIFVFENNGFGEGTAHDYAVGSKDIAGRAAGFGLPAEKVDGTDFFAVYAAAQKAIQRARRGEGPSVIETVTNRFYGHFEGDPGLIRSKDEIDYVKEHKDPIKIFREKVKGQIDEAKLDAIDAVSKANVDDAVAKARAAKYPEVSQLLTDVYVSY

SEQ ID NO: 1569 - protein, 452 aa, Bradyrhizobium japonicum USDA 110
MSMISARIERLPFARFHKHLLLMGGLGYMFDAMDAAVLAFILPVLRTAWNLSSVQIGVLGSSTYIGFLFGALLAGTLGDLIGRRAVMMSALALYCAASIVSAMVDTWPSFFAARVVAGMGTGAESAIVAPYLAEFVARRYRGSFTGALAGFFSFGFVAAALLGYFIVPAYENGWRIVLVITAVPVVMLLWWRRALPESPRWLESRGREKEAEALLDTIEAGFARQGHVLPHPVVEAVAPQGATGTLLANFAALLAGRQARITIMTWIMWLAITFSYYSFFVWIPGLLVQNGMSITKSFAYSIAIYCAQIPGYFSAAYFNERIGRQATIATYMVLGGASALGLAFAQSDQQIMAAGIFLSLFMNGTYAGVYAYTAEVFPTPVRTTGAGLASAIGRIGAIVSPILVGYLYPNFGFAGVFGVTTTVLLLGAVTVVLMGVPTRGRSLEEIAAGEVA

SEQ ID NO: 1570 - protein, 146 aa, Zea mays
  misc_feature (27)..(27): Xaa can be any naturally occurring amino acid
  unsure (1)..(146): unsure at all Xaa locations
SQTPLELLVFTAITLGLVYIGSCNEEXIAQAIIHALMVRSDNEMGEPLSRLLPVALGLLYLGKQESVEASAEVSKTFNEKIQKYCDITLLSLAYAGTGNVLKVQKLLGYCSQHLEKGETHQGSAVLGIGLVAMSEELGIDMAIRSL

SEQ ID NO: 1571 - protein, 468 aa, Gluconobacter oxydans 621H
MQNRNAHGRLSGHALTNFIATISATGGLLFGYDTGIISSALLQLRNQFHLDTLGAEIVTSAIILGALIGCLGAGSISDRIGRRRTVMIAAALFLLGTVVVSSAQSVAVLIIARLILGLAIGAASQIVPIYIAEVSPPERRGRLVVGFQLAVVFGITSSFVTGYLLRDSSWRLMFGIGMLPALILFVGMAFLPNSPRWLALNGQIEEARAVLRRVRLSDEAADRELEEIIENHDVQAPWSELAKPWVRPALTASVGIALLCQFTGINAVMYYAPTIFADAGFGQDSALLTSVAVGVGMVFATVFGGWAVDTWGRRTLLLRMLPGAVVALAVLGTTFAMHLTGGIGAWITVAAVMAYTIFNTGSLSVAIWLVGAEVYPLSCRGKGMSLVAGSHWGADLLISLTTLSLVQMLGAGWTFWLFAGVNAFAFWFVLRYVPETKGQSLEELERRLRNGTFAPVDRAVARSEARAR

SEQ ID NO: 1572 - protein, 187 aa, Arabidopsis thaliana
MEEENQKSHRVSRKDQSGSHWSQGADEEPRARCSGKRCRSWAAAAIADCVALCCCPCAVVNIFTLAFVKVPWMIGRKCIGRGGPSKKRMKKINREDRFHHHHHHRRSAEMVSGGCCGGGDGDGEFDDHRFVVERDGSLTKEEAKTASLKEEEETRISARVEAERVWLELYQIGHLGFGRVSFTGIHQ

SEQ ID NO: 1573 - protein, 249 aa, Hordeum vulgare subsp. vulgare
MDMGLEVSSSSPSSSSVSSSPEHAARRASPAKRPAGRTKFRETRHPVYRGVRRRGNTERWVCEVRVPGKRGARLWLGTYATAEVAARANDAAMLALGGRSATCLNFADSAWLLAVPSALSDLADVRRAAVEAVADFQRREAADGSLAIAVPKEASSGAPSLSPSSGSDSAGSTGTSEPSANGVFEGPVVMDSEMFRLDLFPEMDLGSYYMSLAEALLMDPPPTATIIHAYEDNGDGGADVRLWSYSVDM

SEQ ID NO: 1574 - protein, 363 aa, Vibrio sp. Ex25
MTDKSYKIAVLPGDGIGPEVMAQAHKVLDAIEKKHGIAFERDEHDVGGIAIDNHGSPLPESTVKACEESDAVLFGSVGGPKWEHLPPNDQPERGALLPLRKHFQLFCNLRPAQIHAGLEAFSPLRADISGRGFDIVVVRELTGGIYFGQPKGREGEGATEKAFDTEVYHRFEIERIAKIAFESARLRRKKVCSIDKANVLQSSILWREVVEEIAKDYPDVELSHMYIDNATMQLIKDPAQFDVMLCSNIFGDIISDECAMITGSMGMLPSASLNESKFGLYEPAGGSAPDIAGKNIANPVAQILSAALMLRYSLGEEAAAQDIEAAVSKALSAGELTGDLAGNNPALTTSEMGDKIAEYILNS

SEQ ID NO: 1575 - protein, 339 aa, Acinetobacter sp. ADP1
MPNKSYRNAIKEAIELEMRRDPTVIVVGEDVRGGHGGKNTDENKLEGFGGVLGVTKGLWTEFGSERVIDTPITESAIIGMTAGAAATGLRPVADLMFMDFYGVCHDMLYNQAAKFRYMFGGKAKAPMVVRGMIGAGFSAAAQHSQSPYNVFASVPGLKVVVPSSPYDVKGLLIQAIRDNDPVVFCEHKLLYDIKGEAPDEAYTIPFGVANYTREGTDVTIIALSLMVHRANEVADKLAKEGISVEVVDPRTVSPLDEDGILESVASTGRVVIVDESAARCGFGHDVAALIAQKGFHYLKAPIELVTPPHTPIPFSPVLEKEWIPSVERIEQAVRKILEA

SEQ ID NO: 1576 - protein, 307 aa, Ashbya gossypii ATCC 10895
MNRYPGDFQRFARVVQQQMNRAGYGPNQRRGGRGPGGLLPGAGLLLLGGGALFLNASLFNVDGGHRAIVYSRLSGVQQSVYGEGTHFVIPWLETPVLYDVRSKPRTVSSLTGTNDLQMVNITCRVLSRPDVQHLPLIYRTLGTDYDERVLPSIVNEVLKAVVAQFNASQLITQRESVSRLIRDNLVRRASRFNIMLDDVSITYMTFSPEFTSAVEAKQVAQQDAQRASFYVEKAKQEKQSMIVKAQGEAKSAELIGEAIKKSKDYVELKRLDTAREIAGILAASPNRVILDNEALLLNTITDSRDKK

SEQ ID NO: 1577 - protein, 513 aa, Acinetobacter sp. ADP1
MSEIKTLEIPKWGLSMEEGTVAQWLIEEGTSFKKGDEICEIETTKIVNVLEAPFDGTLRQILAHAGDTLPVGGLIAICAEADVSDTEIQNFAQNLNGTQSSNTPADAKVTTVQTPEVDQLAVANSQAQSQAIIETKAQVSKDGVEIPAALQGFKASDAFTTPHAFKLAEKHNIDLSQVTGTGRLGRISVQDLQSAVQAAGGQWAEIKRQGSSKAIKSTADDRHIAATPVARRLAQTWGINLNDCRVSGTRGRVCKEDVEAVYYREHPVSETASTASCADTPVELNSVKPIAMNAMRKAIASRLQLAKRNAPHFRLSIEVNVEALQALRQQINDTVPQLKLSINDMLIKAAAAALIKVPEVNVQYDEQKQQILQFKDADISVAVAIENGLITPIVKAANQKSLATISSTMRDLATRAKTGKLQPDEFQGGSFSISNLGMLGIKNFDAIINPPQGAIMALGRSEARAVVEHDLIVIRQMMTVTLSCDHRVIDGALGAKFLASFKQFVENPALILV

SEQ ID NO: 1578 - protein, 468 aa, Acinetobacter sp. ADP1
MSMSDTQFDLVVIGAGPGGYVAAIRAAQLGLKTAIVEATHLGGICLNWGCIPTKALLAGAELAHQFKHASQFGFELGDINFDLSKLVQHSRQVSAQLVQGIEHLLRKNQVSVFYAKARFIAKERLELVDAQQQKQMIRAPHIIVATGAHAASLPQIPVDGDYVWSYKEALQPKQLPKSLLVIGSGAIGSEFASLYQDLGSQVTLLDLARQILPTEDHEVAQYVRKQFEQKGMRILTESTVQHLEVCEGKVHCEIHDPSGVQSLSFDHVLSAVGVKPNTQNLGLEQLGVALTNGFIQTDEWCRTNVVGIYAIGDVAGAPCLAHKASHEAILCVEKIAGIADVHPLNRLQIPGCIFTHPQVASIGLTEQQAKAEGKQIHIGKFPMSANGKAIALGQTAGFVKTIVDVESGELLGAHMVGHEVTEQIQGYAIAQALEATDEHLAQVIFPHPTLSEAMHESILASMQRAIHI

SEQ ID NO: 1579 - protein, 481 aa, Xanthomonas campestris pv. campestris str. 8004
MFPGEPMSSVSIDGAPDAGENTRFIILISCVATIGGFLFGFDSGVINGTVDGLKQTFQSSAAETGFEVASMLLGCAIGAFFAGRLVDRWGRRAVLIISAALFLLSAIGAGASHSSGFFIFARVMGGFAVGAASVISPAYIAEVASARYRGRLATMQQIAIISGLFCAFLSNYLLANAAGASTEPLWGGQAAWRWMFWMQAIPSLLFLLLLLVIPESPRYLVVKGRREQALVVLKRLYGNAAAQTKLGEISASMSADQHKPKFSDLISKTTGKIRPIVWIGVGLAVFQQLVGINVVFYYGAVLWQAVGFSEQDALLINVLSGGLSIGACLVTVMLVDKIGRKPLLWIGSAGMAVSLALVTYAFATASLDPNGKLAMSDAMGMLALVAANVYVVFFNASWGPVMWVMLGEMFPNQIRGSGLAIAGAAQWTSNFAITVSFPILLGSIGLAGAYGIYTVAAFISVFFVLKYVYETKGKELEQMEG

SEQ ID NO: 1580 - protein, 388 aa, Neorickettsia sennetsu str. Miyayama
MTVIKELNFGPQHPAAHGVLRLIMQLDGETVERLDPHIGFLHRGTEKLIEHKTYLQALPYFDRLDYVSPMAQEHAYSLCVEKLLGITVPPRAQYLRVIFVEITRILNHLLNVTTHALDVGAMNPLFWMFEEREKMLSFYEKASGARFHAAYIRPGGLAADIPDGLDEEIMSFLESFTHKLDDVADVLTDNPIFKQRLVDIGKVSKREAVALGFSGPVLRASGVPWDLRKSQPYEVYESLDFAIPVGSCGDSYDRYLVRMAEMYESVKIIKQCIDKLPEGPVVVDDRKVAPPSRAEMKTSMEALIHHFKLYSEGYHVPEGETYFAVESPKGEFGVYIVSDGTNKPYRCRIRAPGFVHLQALDTLSRKHLLADVPAILGSLDIVFGEVDR

SEQ ID NO: 1581 - protein, 371 aa, Acinetobacter sp. ADP1
MCKVIQFKGFQQSFKRKITMKAARFYDRGDIRIEDIPEPEVTAGTVGIQVAWCGICGTDLHEFMEGPIFIPPCGHPHPISGESAPITMGHEFSGVVYAVGEGVDDIQVGQHVVVEPYIVADDVPTGPGENYHLSKNMNFIGLGGRGGGLSEKIAVQRRWVHPISENIPLDQAALIEPLSVGHHAYVRSGAKAGDVALVGGAGPIGLLLSAILKAKGLTVIITELSSKRKEKAKESGVADYILDPTQVDVIAEVMKITQDKGADIAFECSSVNKVLDTLVASTKPTGVIVIVSIWSHPATVNVHSVVMKELDIRGTIAYVNDHQETIKLVEQGKINLAPFITQRIKLDDLISQGFETLIHNNESAVKIIVHP

SEQ ID NO: 1582 - protein, 423 aa, Oryza sativa (japonica cultivar-group)
MMRRCELPARDLRLLDPLFVYPSTILGRERAIVVNLEQIRCVITADEVLLLNSLDSYVLQYAAELQRRLLQRAEGDELPFEFRALELALEAACSFLDAQLDSYYMDYDNQTVVEFLVAMLADKKDGFLCILFRCHWYGVLEITAGLVLTSSVSQSTSDWGLFCGYPHRGLKSLSSAAELEIEAYPLLDELTSKISTLNLERVRRLKSRLVALTRRVQKVRDEIEQLMDDDGDMAEMYLSEKKLRTEASFYGDQSMLGYNSVGDGTSFSAPVSPVSSPTESRKLEKAFSLCRSRHDSVKSSDNTATEHIQELEMLLEAYFVVIDSTLNKLTSLKEYIDDTEDFINIQLDNVRNQLIQFELLLTTATFVVAIFGVVAGIFGMNFETSVFSIQNAFQWVLIITGVIGAFIFCGFLWFFKYKRLMPL

SEQ ID NO: 1583 - protein, 233 aa, Ustilago maydis 521
MSSSNDVPTLKILLIGASSVGKSSLLLRFTDDEFLSPEETTATIGVDYRIKGIEVGGKRFKLSIWDTAGQERFRTLTSSYYRGAQGVIITYDVTQRDTFDALPTWFNELETFTTSDDVVKVIVGNKVDKEFSRVVTTKEGQEFAEKMGCLFVECSAKKGVGVNGAFDELVNRIISTPSLWQKTAPGERRPGDRMPGGAPAAHAADSSRGNISLTDPTGYVGYGLGVARDSCSC

SEQ ID NO: 1584 - protein, 375 aa, Arabidopsis thaliana
MVTKAEKQFAKNFNIDDLPDVPAGLPPHLKAQQTRVVSKNNAPAHTASAIYSGTYVSSTEEDDNVKLGNFYDNFKVDVVSLTKTDMEFDMIGIDAAFANAFRRILIAEVPSMAIEKVLIAYNTSVIIDEVLAHRMGLIPIAADPRLFEYLSEHDQANEKNTIVFKLHVKCPKNRPRLKVLTSDLKWLPNGSELLRESENKTSKPKTYTSFSCSQDSLPEFANNPITPCDLDILIAKLAPGQEIELEAHAVKGIGKTHAKWSPVGTAWYRMHPEVVLRGEVEDELAERLVNVCPQNVFDIEDMGKGKKRATVAQPRKCTLCKECVRDDDLVDHVDLGSVKNHFIFNIESTGSLPPEVLFTEAVKILEAKCEAITDF

SEQ ID NO: 1585 - protein, 128 aa, Oryza sativa (japonica cultivar-group)
MTLLRAATGVYLLRPLSIAAPSSTVVAAAIPRLKVVGPGSSARCYRRLSGFHRHQEPCHRRPIHTDSYSLQAANYLNIKGLLDLTCQTVADMIKGKTPEEIRKTFNIKNDFTPEEEEEIRRENQWAFE

SEQ ID NO: 1586 - protein, 380 aa, Mycobacterium smegmatis str. MC2 155
MVIEDSEIFAAHEGGKLSVELKSPLDTQRALSIAYTPGVAQVSRAIAADATLAKKYTWANRLVAVVSDGSAVLGLGDIGAAASLPVMEGKAALFKTFGGLDSIPLVLDTNDPDEIVETLVRLRPTFGAVNLEDISAPRCFEIERRVIEALDCPVMHDDQHGTAIVVLAALLGAVKVLDRDLASLKVVVSGAGAAGVACTNILRNSGITDIVVLDSKGIVSGGRTDLNSFKAELAQRTNPRGLTGGLAEALAGADVFLGVSAGLVPEELIATMAPNGIVFALSNPDPEIHPDAARKYAAVVATGRSDFPNQINNVLAFPGVFRGALDAGARRITEEMKVAAAHAIFSVVGDDLGVDHIVPSALDPRVGPAVAAAVAEASGV

SEQ ID NO: 1587 - protein, 210 aa, Aspergillus niger
MASTSGVGSYSNPLKKFKLVFLGEQSVGKTSLITRFMYDSFDNTYQATIGIDFLSKTMYLEDRTVRLQLWDTAGQERFRSLIPSYIRDSSVAVVVYDISNAKSFQNTRKWIDDVRGERGNDVIIVLVGNKTDLNDKREVTTAQGEEEAKKNGLMFIETSAKVGHNVKQLFRRIAQALPGMEGEANRGDNQTVIDVNITPKETTTNDGCAC

SEQ ID NO: 1588 - protein, 388 aa, Thellungiella halophila
MISSIKPVSPSLTAIGGVRRSAPGKLRFSPLPIIRNFEKPNPFPLQVLSAQNFSNFSVSAAAQRRDVFKVGAYEADRSQPIEIGIEISDEQSRQKVKIGIYFATWWALNVVFNIYNKKVLNAFPYPWLTSTLSLACGSLMMLVSWVTRVAEAPKTDLDFWKTLFPVAVAHTIGHVAATVSMSKVAVSFTHIIKSGEPAFSVLVSRLFLGDTFPLPVYLSLLPIIGGCALAAVTELNFNMIGFMGAMISNLAFVFRNIFSKKGMKGKSVSGMNYYACLSMMSLLIVTPFAIAVEGPQVWAAGWQNAVSEIGPNFVWWVAAQSVFYHLYNQVSYMSLDQISPLTFSVGNTMKRISVIVASIIIFHTPIRPVNALGAAIAILGTFIYFQVE

SEQ ID NO: 1589 - protein, 253 aa, Oryza sativa (japonica cultivar-group)
MAIARTGVYVDDYLEYSSTLAGDLQRILSTMRELDERAHGIMGQTKEQIKYLLGVPSHGFDRSNMDDDESASERMKKDIEASQDNALSLCTEKVLLARQAYDLIESHIKRLDEDLGQFAEDLKQEGKIPPDEPSILPAISAFSRDDKRRPGFSTPQATKKFREREWDRERGMDFDLMPPPGSNKKTTAPMDVDQTIDPNEPTYCICHQISYGDMIACDNDNCEGGEWFHYTCVGLTPETRFKGKWFCPTCRNL

SEQ ID NO: 1590 - protein, 268 aa, Oceanobacter sp. RED65
MLLTLVSLDDFFGRNMCLISFQWQPLSDQPLMMVANRDEFHERPSTQSHWWPEHPHVLAGKDLEAGGTWMGVTKSGYFAALTNVRQLPSHRQGQISRGHLVKDYLIAQEDPQTYAEGIADQAHLYDGFNLIIGNQRQCIFISNRNQHTQPLALHAGIYGLSNASLDTPWPKTLYAKKQLEMHAQGQNMTMPLLNRRQTYPQVEQPDTGIGQPWETLLSAPFIVSPSYGTRASSMLTIKQNHVEWIEQSFDHTGSLNHEVRESFYIKSI

SEQ ID NO: 1591 - protein, 503 aa, Neorickettsia sennetsu str. Miyayama
MRYYVTTPVYYVNDNPHIGHAYSSLIADVLTRALRLAGHEVRFTTGTDEHGQKVQNTAKKHGKCEIDFVNHVSRRFRDLCVAMHYDFSDFIRTTETRHKEAVQTLWSTLSKNNSISLGEYSGWYSERDEAFYTEAELQNSLAPTGSPVSWTKEACYFFKLSQFSEPLKKLYAENPTFIQPKSRFNEMLAFLNTGMHDLSISRTRVQWGINVPDNPTHTVYVWLDALTNYISSVGYPNTSADSLFSAFWDNARIIHIIGKDILRFHSIYWPAFLTAANLKTPDVILAHGWWLNDGEKISKSLGNIIDPFELISEFGVDPVRYFFIREITVGKDGNFSKVNLKERINSELADNIGNLLHRTLTLTAKLLGPKVSEIYESENELLEFAYSLATEYKNDIELLDLNSSLDRIIQLSNKANEYISMEEPWKLKEKPETAGRILHSVLEALRIIAIGLQPFVPQSASTMLDLLAVPPEERKLANMNKESRIRPGTQIKLPASPLFRKHQ

SEQ ID NO: 1592 - protein, 326 aa, Triticum aestivum
  misc_feature (206)..(206): Xaa can be any naturally occurring amino acid
  misc_feature (229)..(229): Xaa can be any naturally occurring amino acid
  misc_feature (241)..(241): Xaa can be any naturally occurring amino acid
  misc_feature (249)..(249): Xaa can be any naturally occurring amino acid
  misc_feature (263)..(263): Xaa can be any naturally occurring amino acid
  misc_feature (278)..(278): Xaa can be any naturally occurring amino acid
  misc_feature (288)..(288): Xaa can be any naturally occurring amino acid
  unsure (1)..(326): unsure at all Xaa locations
TNRSGMAGGDEGSLVPREVPGSYGMPFVSAIRDRLDFYYFQGQDKYFESRVDKYGSTVVRINVPPGPFMARDPRVVAVLDAKSFPVLFDVDKVEKKNLFTGTYMPSTSLTGGFRVCSYLDPSEPTHTKVKQLLFSLLASRKDAFIPAFRSHFSSLLATVESQLVLSKKSNFNTLNDATSFEFIGDAYFGVLPSASDLGTTGPTNGXPKWLIFQLHPLVTLGLPMILEEXILHTVHLPPILXVSGDYQAXLYKYFYAAETRALXTAEGLGLRRDEACHXLLVATDFTAXGGLRVLVPGSPAASGGRRKSTKTSSGNLPPLLTPRQVK

SEQ ID NO: 1593 - protein, 426 aa, Candidatus Kuenenia stuttgartiensis
MDNVISVILGGGRGTRLYPLTKERSKPAVPLAGKYRLIDIPVSNSLNSGINKIYVLTQFNSASLHRHITRSYKFDNFSKGFIEVLAANQTIGSLDWYQGTADAVRQNLRFFDQPNIEYILILSGDQLYRMNYQHFIREHIKSGAEVTVSAIPSERRHAQALGLLKINEQGRIVGFSEKPKDEAVIDTLSLDASFFEKRGVEPKGRTLLASMGIYLFNIGVLKEVLKKSQKPDFGKEIIPEIIKERAVHAYLFDGYWEDIGTIKSFYEANLELATLSPRFNLYSEKNPIYTSPLSLPGAIINNCRIIKSIIADGCIIDSGEISDSVIGFRTRIEKNTTIRSSVLMGADYYETKENIRANKEKGIPNIGIGENTKIVGAIVDKNVHIGENVHIENTKKIETFDAENYMIRDSIIIIPKGSVIPSNTVI

SEQ ID NO: 1594 - protein, 408 aa, Mesorhizobium sp. BNC1
MTLTIDTSTPESRALLRPDPTVEKKPLIGLSREEMAQALASIGVPERQVNMRVRQLWHWLYVRGVSDFSRMFNISKELRAKLDEHFTIARPEIVEEQISQDGTRKWLLRFPPRGAGRPVEVETVYIPEEDRGTLCISSQVGCTLTCSFCHTGTQKMVRNLTAGEILDQLLIARDRLGDFPDADTPDGAIVPAEGRKITNIVMMGMGEPLYNFENVKQALLVASDGDGLSLSKRRITLSTSGVVPEIYRTGEEIGIMLAISLHAVRDELRNELVPINKKYPLKDLLDACRAYPGLSNARRITFEYVMLKGVNDSLDDARELVRLLKGIPAKINLIPFNPWPGSAYECSDWEQIEKFAELVNRAGYASPIRTPRGRDILAACGQLKSASERMKKTERLKLEAMMIAGHGD

SEQ ID NO: 1595 - protein, 412 aa, Oryza sativa (japonica cultivar-group)
MNALAATSRNFRQAARLLGLDSKLEKSLLIPFREIKVECTIPKDDGTLASFIGFRVQHDNARGPMKGGIRYHPEVDPDEVNALAQLMTWKTAVAAIPYGGAKGGIGCAPGELSTSELERLTRVFTQKIHDLIGAHTDVPAPDMGTNSQTMAWILDEYSKFHGHSPAVVTGKPIVSLGGSLGRDAATGRGVMYATEALLAEHGKSISGSTFVIQGFGNVGSWAARIIHEKGGKVIALGDVTGSIRNKNGLDIPALMKHRNEGGALKDFHDAEVMDSSELLVHECDVLIPCALGGVLNRENAPDVKAKFIIEAANHPTDPEADEILAKKGVTILPDIYANSGGVIVSYFEWVQNIQGFMWDEEKVNMELHKYMNNSFQHIKAMCKSHDCNLRMGAFTLGVNRVARATLLRGWEA

SEQ ID NO: 1596 - protein, 361 aa, Oryza sativa (japonica cultivar-group)
MGVYLSTPKTEKLSEDGENDKLKFGLSSMQGWRATMEDAHSALLDIDNDTSFFGVFDGHGGRVVAKFCAKYLHREVLRSEAYSAGDLGNAAHKAFFRMDEMMRGQRGWRELQALGDKINQISGMIEGLIWSPRGSDSNDQHDDWAFEEGPHSDFAGPTCGSTACVAIVRNSQLVVANAGDSRCVISRNGQAYNLSRDHKPELEAERERILKAGGYIQMGRVNGTINLSRAIGDIEFKQNKFLSPDKQMLTANPDINTVELCDDDDFLVLACDGIWDCMSSQQLVDFIHEHINTESSLSAVCERVLDRCLAPSTLGGEGCDNMTMILVQFKKPISQNKNVSPAEQSAADKQPTGDTHWSEIQ

SEQ ID NO: 1597 - protein, 540 aa, Gibberella zeae PH-1
MNTLRRASLSKPEEAGKTWPAIAIGAFVAFGGVLYGYDTGTISGILAMPYWQSLFSTGYRDAKGHLNITTAQESGIVSILSAGTFFGALSSPFMTDYIGRRPGLMIATWVFNLGVCLQVAATSIPLFLAGRFFAGFGVGQISAIIPLYQSETAPKWIRGAIVGSYQWAITIGLLLAAIVNNATGGRNDTGSYRIPVAVQFAYSLILFGGMIILPETPRFLIKKDRHEAAAKALSRIRRLTPDHPAIQAELAEVRANHEYETSIGKSSYLDCFKPPILKRQFTGCALQALQQLTGINFIFYYGTKYFQNSGISSGFVISMITSAINVASTIPGMYAIDKWGRRPLLLWGAVGMCVSQFIVAMAGTFSTGQNADGTIFVKSLAGQKAAVSFVCIYIFFFASTWGPLAWVVTGEIFPLKTRAKSLSMTTATNWLFNWAIAYSTPYLVDYGSGKANLQSKIFFIWFGCCFLCIAFVYFFIYETKGLSLEEVDQLYDEVSVASKSKQWKPSESWEHRQSVSGADGKMFGGNDHQGEVTHNEKNEA

SEQ ID NO: 1598 - protein, 1715 aa, Ustilago maydis 521
MTSTASAQQPVLRTKTPSYHAPPSTDPLSGATIHTLRCLDTPIHLGYHLIPHIAKTLLSTLPSSTYVLITDQNLEARCSVTTAFRREFEKAAVHLSSSHSWRLLTKVIPPGEASKSRDGKNAIEDWMFEHRVTRDAVVLAVGGGVIGDLVGFVAATFMRGLKFVQIPTTLLAMVDSAVGGKTAIDHPLGKNLIGSFHQPNYVFIDAAWLKTLPVREFSNGMAEVVKTAAIWDPIDFAKLESSAPAIRSAVLGPFAKDAPLDQGRTLETRTESQSLLLDVIRGSVGVKAHIVTIDEKETGLRNLVNFGHTIGHAIEAVLTPEMLHGECISIGMILEAEVARYMHGLSQVAIGRLTRCLKEYDLPVSLSDSRVTRLAKSLDVTVDRLLDIMKVDKKNSGTNKKIVLLSSIGDTVQNMASTVSDHIIRRVLSLAATVTPIHEQPNKPKVTLSTPGSKSISNRALVLAALATNTCRLRNMLHSDDTQVMMAGLHDLQAARFEFEDGGETIVVHGNAGALARPANDKQIYLQNAGTAARFMATVVSLVHNDGNQHPVVITGNKRMKERPIAALVDALRSNGTSIDYLEGHGCLPLAVKGTTHGFKGGKIQLSATISSQYVSSILLCAPYAAEQVVLELVGGQVISQLYIDMTIAMMATFGIKVERLLDPTTGRPSNTYRIPKGHYVSPDVYDIESDASSATYPLAIAAITGTECTVPNIGSASLQGDARFAKEVLEPMGCTVVQTATSTTVIGPKLGQLRQIGLVDMEPMTDAFLTASVLLAVAAHSPANGSTSNARPSTRITGIANQRVKECNRIRAMMDELAKFGVNTKEHDDGLEIFGIDYRQLHANVRVHCYDDHRVAMAFSVLASLAPGAILEEKRCVEKTWPNWWDDLERKLGIRVHGVDPECSPSLCISPSHFTKASAASTNGKPPTCLSQLTCGKALTPRKYSKHATIICIGMRASGKTFLGAIGAAALSRTFIDADVVFNEKLGAKDGLGDFVREHGWPAFRQKELEILQELIARHPSGALISLGGGVVETEACRQILAEYAQTKGPVIYIVRDTNAIVKFLATSDRPAYGEPVMDVYRRRNPWFSECSSAELVSYSEGESLAIQPCAMNVPDPSFTIQKKFGLETEVARFFKFVVGQDTNQIRDLVVDSRKGGRRTYFLSLTFPDVVPKLELIRSMESGSDALEFRADLLNPSGQPVTTPQIPPTEYVKNQLAALRHRTSLPIVFTVRTHSQGGMFPDGKQHEYFELISLALRHACEYIDLELGWDDDLLSAVVQAKGNSQIIASWHDWSGRLDWESESTAKIYEKACRFGDIAKIIGKATTMEDNYSLERFRAKVSATATKPLLAVNMGSVGQLSRIVNPVFTPITHEAMPFKAAPGQLSFRQVQTALSLIGQADARRFALFGSPIGHSLSPLLHNTGFAALGLPHQYELLESTEINDAVAAFVRSPDFGGASVTIPHKLNIIKLLDEVTDEAKTIGAVNTIIPIRDAQGVVTSLVGDNTDWIAIETLARRSLRTVHLADPNLTGLVIGAGGSARAALFALYRLGVKRILLFNRTLANAEKLAREVPPEWNVSVLTSLDEVAQLSADQSPSVVVSNIPAEGSTLDASSRGLIHLPTCMLRNPAGGVVIDMSYKPHYTSLLQLAQQVNTNHELAIGTNATKAPTRKLWAAVPGITILLEQGCHQFHRWTGREAPRAQIEAAAWDVYLQRC

SEQ ID NO: 1599 - protein, 274 aa, Pseudomonas aeruginosa
MDRYCVFGNPIGHSKSPLIHRLFAEQTGEALVYDAQLAPLDDFPGFARRFFEQGKGANVTVPFKEEAYRLVDELSERATRAGAVNTLIRLADGRLRGDNTDGAGLLRDLTANAGVDVRGKRVLLLGAGGAVRGVLEPFLGECPAELLIANRTARKAVDLAERFADLGAVHGCGFAEVEGPFDLIVNGTSASLAGDVPPLAQSVIEPGRTVCYDMMYAKEPTAFNRWAAERGAARTLDGLGMLVEQAAEAFFLWRGVRPASAPVLETLRRQLATV

SEQ ID NO: 1600 - protein, 464 aa, Glycine max
MGFLRRLFGAKKPSDCKSGKKRWTFLKHTVRNKSLPPPPIPPALNTHFDSSTPLDANKHAIAVAAATAAVAEAALAAAHAAAEVVRLTSGGVAATSTSSRTAVTAARVGNLETAAVRIQSAFRGYLARRALRALKALVKLQALVRGHIVRKQSADMLRRMQTLVRLQAQARASRAHLSDNTPSFNFNSSLLSHYPVPEEYEHPPRGFSTKFDGSSILKRCSSNANSRNVDSERVGFDSNWLNRWMELDNKCSQTGDASLKNNGRPDDDKSDKILEVDTWRPHFKSHHNSSSSSQAAHYYLNADYNNENFAAAHESPSKRSAKALNQSFSSREVLQLRSLKFHKGKEEASSRTADNSPQAFSANSRNGSGARRGGGPFTPTRSECSLGFFSGYTGHPNYMANTESFRAKVRSQSAPRQRLEFDRYGSTRRPVPLVGSNSDHDSDLRNKVLPAFNQMNRIGSSNLR

SEQ ID NO: 1601 - protein, 336 aa, Legionella pneumophila str. Lens
MSYEELSNTMEQMLHEGKGILAADESNSTIGKRFASINTENTEENRRDYRLLLATTPDLEQYINGVILFEETFTQTDEHGTPIPELFANKGIIPGIKVDKGLVDLANTEHEKVTQGLDGLTERLLHFKKLGAKFAKWRNVYSISEYTPSLTAIKTGAENLGRYAAACQSVGIVPIVEPEVLMDGNHSIEHCAEVCEMVLHELFHTLFIHQVELEHIILKPSMVTCGKEVTPFSDPEEVADYTISVFRNNVPASVPTINFLSGGQTPQQATANLNAINQIGHQPWLLSFSFGRALQEDCLKEWCGNKANIAKAQEALIKRARLNSMACLGEYQNDME

SEQ ID NO: 1602 - protein, 376 aa, Prunus mume
MTFTLGKKEILIDILVRLPAKSLVRFLCTCKSWSDLIGSSSFVRTHLDRNVTKHAHVYLLCLHHPNFECAIDPNDPYIEEEVQWSLFSNETFEQCSKLSHPLGSTEHYVIYGSSNGLVCISDEILNFDSPIHIWNPSARKLKTPPISTNINIKFSCVVLQFGFHPGVNDYKAVRMMRTNKNALAVEVYSLRTNSWKMIEAIPPWLKCTWQHHKGIFFNGVAYHIIEKGPIFSIMSFDSGSEEFEEFIAPDAICSSLGLCIHVYKEQICLLSGFYGSEEEDMDKIDLWVLQEKRWKQLCPFIFPLDHCHRTIGFSADNELLMERRDFIKGITHLCLCNYESKQVLETGIRLAVMKYGDIEFLSAITYIESLVLLNNY

SEQ ID NO: 1603 - protein, 994 aa, Candida albicans SC5314
MAPSQEQSKEQIQSQTSKDQQPTKSDKSKVQKEEELSEEDQHLKDELELLVERLNEPNQDRALYNKYLDALKTFIKESTTSMTAVPKPLKFLRPHYPSLTELYTNWSNQFSAKDVIVIKLADILSVLATTYSDEGNRDSLKYRLLASDDTIADWGHEYMRHLALEIGESFQENLGVDEELVNKLVKLALQIVPFFLKHNAEADAVDLLLEIECIDKLPQFVDENTFARVCLYVTSCVPYLAPPDDVSFLNTAYSIYLSHNQLTQALTLAIKLDDNELIKQVFDSTTDESLHKQLGFILSQQNSNFKYPGENPEVQECISNVKLAEYFQYLVKELNLLDPKVPEDVYKSHLENSKFGLGTSGSIDSAKQNLAASFVNGFLNLGFGNDKLVQTEEDNKSWIYRTKGSGMASTTASLGSIHQWNINEGLQVLDKYTYSEDSEVKAGALLGTGVVSANVHDEVDAAFALLQEYVHEPNKLYQTAAINGLGIAFAGSANEDVLNLLLPLVSDLDISLEISCLAALALGHIFVGTCHGDVTSTILQTLLERDYTQLTNKFIKFMSLGLGLLYMGRTEQAEDVLETIDAIEHPISKTLKVLVNICAFAGTGNVLQIQALLQMCTAKPKDQLEEEKKLEQSEEEQQQQQQNKDTKSNGEGGEEEEDVEMEDAESKNETSENTTASATSTTSSSKEKGDSSSSAAAAAAAGDEKAQEGGDDKEDEEEIDEEEELYQGIAVLGLACIAMGEDIGQDMSLRHFGHLMHYGNSLIRRAVPLAMGLVSTSNPQMKVFETLSRYSHDPDLEVAQNSIYSMGLVGAGTNNARLAQLLRQLASYYIKSPDTLFMVRIAQGILHLGKGTLTLTPYNSERTILSKVSLASLLTIAIALLDPRSFILNDSTTETTHQLLYYLTPAVKPRMLVTVDEELKPIKVNVRVGQAVDVVGQAGKPKTITGWVTQSTPVLLNYGERAELENTDEWISLSSSLEGVVILKKNPEYMEIDS

SEQ ID NO: 1604 - protein, 447 aa, Brassica napus
MIMSLEIQQMDEANRLSVWNGYVDWRNRPALRGYHGGMLAASFVLVVEVLENLAFLANASNLVLYLSTKMGFSPSGAANAVTAFMGTAFFLALLGGFLADAFFTTFHIYLVSAAIEFLGLLVLTVQAHEHSTEPWARVVLYVGLYLVALGVGGIKGSLPPHGAEQFDETTPSGRRQRSFFFNYFIFSLSCGALIAVTVVVWLEDNKGWSYGFGVSTAAILISVPVFLAGSRFYRLKVPSGSPITTLFKVLTAALYAKYKKRTSRNVVTCHTRNECNDNIAKGDGEGDGSFLDEAVRERDSLPGPLRCTEEQVKDVKIVIKTLPIFMSTIMLNCCLAQLSTFSIQQASTMNTKLGSLTVPPAALPVFPVVFTMILAPTYNHLLLPLARKTTKTETGVTHLQRIGTGLVLSVVAMAVAALVEMKRKLVVKEVTCCSSINASSSYSSPLP

SEQ ID NO: 1605 - protein, 377 aa, Prunus mume
MTFSLRKKEILIDILVRLPAKSLVRFLCTCKSWGDLIGSSSFVSIHLNRNVTKHAHVYLLCLHHPNFERQVDPDDPYVEQKFHWSIFSNETFEECSKLSHPLGSTERYGIYGSSNGLVCISDEILNFDSPIHIWNPSVRKLRTPPMSANINVKFSHVALQFGFHPGLNDYKVVRMMRTNKNALAVEVYSLRTDSWKMIETIPPWLKCTWQHHKGTFFNGVAYHIIEKGPLFSIMSFDSGSEEFEEFLAPDAICNSWGLCIDVYKEQICLLFTFYDCEEEDMEKSDFWVLQEKRWKQLSPFIYPSNCYSTMGISIDNELLMQRRDHIKGGADLYLCNYESKQVLETGLRLGTVTYGEIEFLFSVTYIETLVLLNSLQY

SEQ ID NO: 1606 - protein, 409 aa, Prunus mume
MWEEMALRPILPRLPSKSLMRFKCVRKSWYSLINNPTFVENHLSNSMHSKLCTCVLFSRFVQRDTNSDGKELAFSFLYLRNDYDDDEHNVNFVVEDIKFPLSSGRFIGLEDVESPSILGHCNGIVCISPCSDNLVLCNPAIKEIKLLPKSGLPDWWGCAVGFGYDPKSKDYKVCRIASYQAEIDGLIPPPRVEIYTLSTDSWREIKNNSLETDTTCFFPDYFQMYFQGICYWVGYEQPKQSVEYEDEEQKPIVIFFDTGDEIFHNLLFPDSFYKYEEGSSYAYEMSYLMYCDLRIILWNGSIALFGFNRFSIFPDSYGVWVLDDFDGAKGSWTKHLTFEPLMGIKRVLEFWRSDEILMVTEDGDIVSYNLATEKLKNLPMNSLSDFETIVYVNSLVSITRGNKLESVDI

SEQ ID NO: 1607 - protein, 421 aa, Acinetobacter sp. ADP1
MQTPVPEYLAHVIDQCENNQTGKLADYIPELAHANPDQVALAMSTVDGQIYAVGDEDIEFTIQSMSKPFTYAYVLQQLGLDEVLDKVGVEPSGEAFNEISLGHDKRPKNPMINSGAITTHSLIPIKDQLESAEIIRRFMSELAGRELCFDEAVYASEIKTAYRNLSIGYMLRTVGILETDPVDIVNGYIRQCSILVTVKDLVKMGSILANGGIDATTGKRLLNRDVVRQVLSVMMSCGMYDAAGDWLTTVGIPAKSGVAGGILGVLPGQVSIAAFSPRLDEHGNSVRGIEMMERLSRDMGLHLMEGTPSAQTIVQSHYRTGKNASTSIYVLRGVLKFTEAEMLLRIFQGEAVDESTIVIDLTQISLIHDVGKRMFLEGVDRLIDDGHSVLLVDPEQRLEQARTHKDRVLHVYQNMDELLEK

SEQ ID NO: 1608 - protein, 399 aa, Prunus mume
MWEEMALRHILPRLPSKSLMRFKCVRKSWYTVINNPTFVENHLSNSMHNKLSTCILVSRFVQSDTNSDEKELAFSFLHLRNDYDDAEHNLNFVVEDIKFPLSSGRFIGLEDVESPSILGHCNGIVCLSPCSDNLVLCNPAIKEIKLLPKSGLPDWWGCAVGFGYDPKSKDYKVSRIASYQAEIDGLIPPPRVEIYTLSTDSWREINNNSLETDSTCFFPDYFQIYFQGICYWVGYEQPKQSVEYEDEEQKPMVIFFDTGDEIFHNLLFPDSFYMYEEGSSYAYEMSYLMYCDLRIILWDGSIALFGFNRFSVCPDSYGVWVLDDFDGAKGSWTKHLNFEPLMGIKRVLEFWRSDEILMVTEDGDIVSFNLAIEKLKNLPMKIPSDFETIVYVNSLLPIT

SEQ ID NO: 1609 - protein, 432 aa, Anabaena variabilis ATCC 29413
MSIHEIFMPALSSTMTEGKIVSWVKSPGDKVEKGETVVVVESDKADMDVETFYEGYLAHIIVEAGDSAPVGAAIAYVAETEAEIEAAKSLGSSGGAAATPSAPPEPVAATAAVGVPAASQNGSNHREGRLVASPRARKLAKELKVDLTSLKGSGPYGRIVADDIEAAVGKVKQPATTPTAPTPTFTPAPVPATRTPAPAPAPAPVAAAPGQVVPFNTLQNAVIRNMVASLDVPVFRVGYTITTDGLDKLYKQIKSKGVTMTALLAKAVAVTLQKHPLLNASYSDQGLVYHPDINIAVAVAMDGGGLITPVLKNADKIDIYSLSRTWKSLVDKARSKQLQPDEYSGGNFTLSNLGMFGVDTFDAILPPGQGSILAIGASRPQLVATGDGSFAIKQQMQVNITSDHRIIYGADAAAFLQDLAKLIETDAQSLTL

SEQ ID NO: 1610 - protein, 969 aa, Zea mays
MAAPPKAWKAEYAKSGRASCKSCRSPIAKDQLRLGKMVQASQFDGFMPMWNHASVDDVEGIDALRWDDQEKIRNYVGSASAGTSSTAAPPEKCTIEIAPSARTSCRRCSEKITKGSVRLSAKLESEGPKGIPWYHANCFFEVSPSATVEKFSGWDTLSDEDKRTMLDLVKKDVGNNEQNKGSKRKKSENDIDSYKSARLDESTSEGTVRNKGQLVDPRGSNTSSADIQLKLKEQSDTLWKLKDGLKTHVSAAELRDMLEANGQDTSGPERHLLDRCADGMIFGALGPCPVCANGMYYYNGQYQCSGNVSEWSKCTYSATEPVRVKKKWQIPHGTKNDYLMKWFKSQKVKKPERVLPPMSPEKSGSKATQRTSLLSSKGLDKLRFSVVGQSKEAANEWIEKLKLAGANFYARVVKDIDCLIACGELDNENAEVRKARRLKIPIVREGYIGECVKKNKMLPFDLYKLENALESSKGSTVTVKVKGRSAVHESSGLQDTAHILEDGKSIYNATLNMSDLALGVNSYYVLQIIEQDDGSECYVFRKWGRVGSEKIGGQKLEEMSKTEAIKEFKRLFLEKTGNSWEAWECKTNFRKQPGRFYPLDVDYGVKKAPKRKDISEMKSSLAPQLLELMKMLFNVETYRAAMMEFEINMSEMPLGKLSKENIEKGFEALTEIQNLLKDTADQALAVRESLIVAASNRFFTLIPSIHPHIIRDEDDLMIKAKMLEALQDIEIASKIVGFDSDSDESLDDKYMKLHCDITPLAHDSEDYKLIEQYLLNTHAPTHKDWSLELEEVFSLDRDGELNKYSRYKNNLHNKMLLWHGSRLTNFVGILSQGLRIAPPEAPVTGYMFGKGLYFADLVSKSAQYCYVDRNNPVGLMLLSEVALGDMYELKKATSMDKPPRGKHSTKGLGKTVPLESEFVKWRDDVVVPCGKPVPSSIRSSELMYNEYIVYNTSQVKMQFLLKVRFHHKR

SEQ ID NO: 1611 - protein, 428 aa, Prunus mume
MMREMATLSKFSEDMMGNILSRLPPKSLMRFRCVLKSWHDLIDKPSFVDHHLSISMDNKVTSSTYVLLKHNVLTDPSIKDDEKAVRATLFNPDSNQRDILLSSLNLGSLVDDGLEIENHIVPPPMRGYALSLEISGSCDGLICLNTFNSEDIVLCNPALEEYRVLPKSCILLPPRVPRQFEENEDDDYYEEDDDDEIESNPKCVGFGYDPNSKDYKVVRAAQFVSGVFTQHPSKVEVYSLAADTWREVPVDIQPHGSLNPSYQMYFKGFFYWIAYWTEERNVILSFDMSEEVFHDIALPESGPDAYEYTSIAVWKDSLVLLTYPVENEAPKTLDLWVFDEDLKGAKGLWTKHLAIGPLEKGVEAPLVFWKDEELLMVTTNGDVVNYSLDTQKLKHVPRHGLGEPTNIQAVPYVNSIVSIKPGNKIESI

SEQ ID NO: 1612 - protein, 594 aa, Oryza sativa
  misc_feature (500)..(500): Xaa can be any naturally occurring amino acid
  unsure (1)..(594): unsure at all Xaa locations
MAMDDLAGSSSSSSAMDAVVADPSHGWQKVTYPKRHRKQGAAALPSAAAPDLGFLPNGGGKVNVFEAVDRNAEKRHRALLAARDAADPDAARIAAATASAYSDDDDDSDEAQATRPEGEVKKPKVKKPKKPKVTVAEAAALIDAENLAAHLVQISESYENQQDIQLMRFADYFGRSFASVSAAQFPWAKMFKESLVSKMVDIPLCHIPEPVRNTASDWINQRSPDALGDFVMWCIDSIMSELSGQAVGAKGSKKAAQQTPRAQGPEDCMVVAIFVVLALTVRRKPEVLTNVLPKIMGNNKYLGQEKLPIIVWVIAQASQGDLVTGMFCWAHFLFPTLCAKPSGNPQTRDLVLQLLERILSAPKARGILLNGAVRKGERLIPPVTFDLFMRAAFPVSSARVKATERFEAAYPTIKELALAGPPGSKTVKQAAQQLLPLCVKAMQENNADLTGESAGVFIWCLTQNAESYKLWERLHPENVEASVVVLSTIVTKWSELSHKXLSAESLKVTLKNLRTKNEAALEAATDSGKQASIKAADKYSKEILGRLSRGGACLKGSLLVITLAVAAGFVLSPNLEIPSDWDKLQAMVASHLSF

SEQ ID NO: 1613 - protein, 140 aa, Bradyrhizobium japonicum USDA 110
MSAHSHEIEEGLSFQPRFDASGLVTCVATDVATGDVLMVAHMNDEALRKTIATGEAWYFSRSRNALWRKGETSGQTQRVVEMRTDCDQDAVWIRVEQIGAACHTGRRSCFYRKVEAEDGGAKLVFVDADRLFDPDAVYKK

SEQ ID NO: 1614 - protein, 682 aa, Ustilago maydis 521
MSCSASTTAHLHQRRAPALREASSSSVEEDCKISGSSLGRVEPSSGSNTRPELSLNTSHAKQRASEVDAKNQKRGHIQKHEKIERIGLLRGSSYVKATDKDSVAEHELTTSIGLQDDAVYDAYLPAPIAFVRRYIVAVLRKEAPLHQQHQRLMRRPWLDRYFVNTSLLGTHSFFLVFLPMVFWLGSPRFGRGLINVLAFGVYLSSAIKDLFCVPRPYSPPVTRLTVGTHHLEYGFPSTHSTNSVSIALYVYLWVRRMRQAADPTHSTLFDSAFWEAGLLFYATSVVYGRIYAGMHSVIDCIAGSALGAAITAVQWKFFDHIEQFVKIDSWTVPAAIIPAGLLMVSVHPQPVDDCPCFEDAIAFVSVAMGVALARWCIRFGVVLHTDPFIHPFSRLFDPSLASTHLSSPVASATPLIQIPVAGAAEIWIKRALVMTIGLVNVLLLRVIVKTACKVILPPTFRLVDSLIGFSLPRRHYTPASDYNKIPLADLSAVPSVLDLPSQIIVTDESGHQQMIQSPVLSPTGASRRPGVDVRSGISNGSAFSPSPLARSPLASPVPSRTPSPNPIEMRRSLASKTKSCKPRIEFTIGGTVDEAEADHAADASADLPIPLTQSKAHPTFIAPDEQLARTLAADMKACSPKEVEKEVKHYDADVLTKVIVYTNIGLFSAGFIPALFQHLGLC

SEQ ID NO: 1615 - protein, 462 aa, Magnaporthe grisea 70-15
MLGVRKCSNVFDTSRYSWSIATYDEVIWPMPVRAPASYPQWVPAKDKDLIEGSVITSAQMASKGMWEVDPETRSKLLAIQKESKNSLCCDCGAPSPQWASPKFGIFICLSCAGVHRGLGVHISFVRSISMDAFKAAEIERMRLGGNERWREFFEKHADTELRGISWDDATIAERYGGEAGDEYKERLSALVDGREYVPGEKKKAAPAENTNRSTAPLGGSADGSKNGGGGGRFRDDPSLGGSRSESPSGGATSGGKTRVDDKYFARLGADNASRSEDLPPSQGGKYAGFGNTPAPAPGGAGGNTALPSMDELQNNPVAALSKGFGWFASTVTKTATTVNNNYIQPTAKQIADSDFAAQARNTAGTVGRAAQQGAKSAQTSFNRFVEGPDSRQYQQVRQAPIDETRKGFWDDFSDIPEQQQKQQPKPSSIGTAAMGKGGSGGAGGPGSASASQTAKKDEWDDW

SEQ ID NO: 1616 - protein, 412 aa, Lactobacillus reuteri
MPGGVNSPVRAFKNVGGDPLFIDHGKDEYIYDIDGNKYIDYVLSWGPLILGHADDHVVAELDKAVAKGTSYGAPTLQETELAKIVNKIMPSIEMIRMVSSGTEATMSAIRLARGYTHRKKIVKFVGNYHGHSDSLLVDAGSGLATFGINTSPGVPDDLAYDTLTVAYNDVAGVKKLFAEHGDEIACAIVEPVAGNMGVIPGTQEFLQTLRNVTNEHGALLIFDEVMSGFRAAYHGVQSLVNITPDLTTLGKVIGGGLPVGAFGGRREIMENITPAGDIYHAGTLSGNPLAMTGGISTLEQLTPDDYVEMDKKVTALTEGIKHAADQYGVPMTVHHVGTMWSYFYNSDPINNFDDVKACDQKLFEKCFWELLAHGVYVAPSQFETNFISTKHTDEDIEKTIAAFDAAFNAATK

SEQ ID NO: 1617 - protein, 1074 aa, Candidatus Pelagibacter ubique HTCC1002
MPKRKDLKTILVVGAGPIIIGQACEFDYSGTQACKALKDEGYKVILINSNPATIMTDPGVADKTYIEPITLEVLEKILKKEKPDAILPTMGGQTALNLAMEAEKKGILKKYKIELIGANSKAISNAEDRKKFRKNMLDIGLDLPKSKVVSHIRDAAKALKQIGLPAIIRPAFTLGGLGGGIAKTEKEYLKIVKDGLHESPVKQILIEECLEGWKEFEMEVVRDKKDNCIIICSIENIDPMGIHTGDSITVAPALTLTDKEYQVMRNASIACLRKIGVETGGSNVQFAINPKDGRMVIIEMNPRVSRSSALASKATGFPIAKVAAKLAVGYTLDELKNEITKTTPASFEPSIDYVVTKIPRFTFEKFSTSEAVLGTSMKSVGEAMAIGRNFKESLQKALVSLEIGFSGLDRIFPLNKKQIEKELKKNIPNRILLAAEAFRKKINLKRVHQLCKIDPWFLQQIKEIVDEENNIQKKGLPKDYNEFNRIKSIGFSDKKLSEITKIPEDLVRKKRTALKVLPVYKKVDTCAAEFKSFTPYMYSTYQRNYALNSECEAEPSSRKKIIILGGGPNRIGQGIEFDYCCCQASYALKDSGFETIMINCNPETVSTDYDTSDRLYFEPLKEEYVYNIIKKEQQKGNLVGIIAQFGGQTPIRLAKFLHDNKLPILGTQYTSIDLAEDRDRFRKLLDRLKLKQAESGIAKTYKQAIQIAEKIGLPLMVRPSYVLGGRAMEIVHEKSQLKNFVEEAFKAAEENPILIDKFISHAMEVDVDAISDGKQVFVAGIMQHIEEAGIHSGDSACCLPPVSIKPKLISEIEIQTKKLALALNVKGFMNIQFAIKNDEIYVIEVNPRASRTVPFVSKAKGLPLAKIASRVMAGEKLSKFNLKNKNKNLYAVKEAVFPFNKFPNSDLLLGPEMKSTGEVMGFDKDFGMAYAKSQIAASNSLPTKGLAFISLKDGHKDEGVDLAKQLIKLNFTLCATGGTAEYIRKHGIKCKTINKVSGGSPHIVDILNSKKIALVINTGGGNSEHRLHDAMALRRATLGNKVPYCTNMSTAQACLMGIRSLKTKEITVTALQDI

SEQ ID NO: 1618 - protein, 666 aa, Mycoplasma hyopneumoniae 232
MIFNYNTSLFRKNFRGESYWGPLGLIFNGNNFEFYLWSPNANRVHFAIYKDPEDKIPAEIIVMSKNNDVWFCQINASFHGYSYNLLIEHHDLKITEALDPYAFSIAPFDWRKNESPKAYLIDIFSEKTGKNPSKLEGFNKNPQIDAQIYQLHIRDFSSISKKTENKGTFIGALENDVFSYLNSLKFNFLQLLPIHSCYNFSQKNASILHKGDGNGHFSTYNWGYDPIGYFSINSSYSTDPIDPYLRIFEFKKFVDSAHKNKIGIVLDVDFSHTFKNSILEDVAHGHFYRDEAAVLPAGFPPLDTRKPMAFRLILDSLIFFTKYYKVDGFRFNLASFLDKKAITVIASELKKVNPNILLYGDFSNFSDLPSRNRLEKGKSGNSFNFGYLNDTIQTAIIGSGNPRDKGLILSKTSKKFAAYVSSIPGNIANFDFQNLPYSKKKYDLFANDISLNLAYLTCYNGPTLADKILSSTTRIGKREFIEVYRQALMMINFVQGKISLSAGTEFAFSRICDFSGGSYQNCYPNLNIKRPPFSFLAGKYLDFHSDKTTDFTNGLNFEILKNNEIKEKIFDFLAEINQFRQNSPFFRLDTNQKIKKQLKFETVDNNKGLIIFKITAKNKVIKVIHNFSHLSYEYDFKNFNILFSSKIKVIPNLIQKHQSILLIKNS

SEQ ID NO: 1619 - protein, 344 aa, Candida albicans SC5314
MSPSTQQQVHESNQSQSNDSSSIGLRLNDNNIQPIEIELSSFKHDSITFHKQDSSYWFYEKSKQSFPGQSFGLQVEKILYHTKSSFQDILIFKSTNFGNVLVLNGIIQCTEKDEFAYQELITHLPIMSHPSPKKVLVIGGGDCGVIRELIKHVNDQTIQEITMVEIDDMVIKLSTKFLPEMAKYHNHPKVNLIIGDGFEFLKNSSKEKKYDVIITDSSDPDDGPAEEFFQINYFKLLLNALNEKGIVIMQSSENIWLNLPYLKELKSKAATVFSNVKYCQCYMPSYTSGQLGLIIATMDTGKDLVNPLRKFDHDKELKLFKYYNQHIHTNSFVLPTWADDYLNN

SEQ ID NO: 1620 - protein, 396 aa, Haloarcula marismortui ATCC 43049
MHIDTAVVLAAGEGTRLRPLTRNRPKPMLPAANRPILEHVFDALVEAGIEKLVVVVGYKRDRVQDHFGPTYRGVPISYVSQTKQLGSGHALLQARSVVDGPVLVMNGDRLVDAATIEEVDTSYAETGNTSIAVLERQDTSRYGAVEVQDRDIVDIVEKPQHDEFRLINGGVYAFDGDIFEAIDETTRHAGELALTDTIELLLESDRVQAVEVDGMWVDATYPWDLLTVAREVLARGRVVESARDEQVWVDNSARVHDEATLQSPVVIGPDCEIGPDAVIGPNVALGRNTTIGANSVIQHTVLDADTRVDPSSTLIDTVTGQDVDLGVNTVVPGGPADVQVGTEVFEDQRLGAVIADRAVALGDVSFVSGSLVGPNARLATGVTVNGTVREGAEVVR

SEQ ID NO: 1621 - protein, 428 aa, Prunus mume
MMREMATLSKFSEDMMGNILSRLPPKSLMRFRCVLKSWHDLIDKPSFVDHHLSISMDNKVTSSTYVLLKHNVLTDPSIKDDEKAVRATLFNPDSNQRDILLSSLNLGSLVDDGLEIENHVVPPPMRGYALSLEISGSCDGLICLNTFNSEDIVLCNPALEEYRVLPKSCILLPPRVPRQFEENEDDDYYEEDDDDEIESNPKCVGFGYDPNSKDYKVVRAAQFVSGVFTQHPSKVEVYSLAADTWREVPVDIQPHGSLNPSYQMYFKGFFYWIAYWTEERNVILSFDMSEEVFHDIALPESGPDAYEYTSIAVWKDSLALLTYPVENEAPKTLDLWVLDEDLKGAKGLWTKHLAIGPLEKGVEAPLVFWKDKELLMVTTNGDVVNYSLDTQKLKHVPRHGLGEPTNIQAVPYVNSIVSIKPGNKIESI

SEQ ID NO: 1622 - protein, 468 aa, Neorickettsia sennetsu str. Miyayama
MCHFFVRMSEKEFDVVVIGGGPAGYVCSIKAAQLGMKVACVEKRPSLGGTCLNEGCIPSKALLHSSYAYYSAKKCFDVLGVECSDVKLNLTKMMGNKSRIVMELSQGIEFLFKKNKVTRFTGTGSILANGDTKKKSVIIDKTETIHTKYVVLATGSEAAELPFAKCDEKSILSSRGALELDAVPKSMIIIGGGAIGLEMASIWSRLGTEVTLMEYADRIAAASDGEVSDYLLKSLTKQGIKFHLSSRITEIKKGKLLSATFEKDEKIGSISAEKILVAVGRRPYSANIGVELERNPSGFIKVDKNFQTSVPGVYAIGDTIPGVMLAHKAEEEGVAVAEILAGRTGHIGWIPSVIYTHPEVASVGKTEEELKVIGIKYKASKFPFAANSRAKTTNDTGGFVKMLVDEHDTVLGVHIVGPSASSLIAEAVLAMEYGASAEDIARTCHSHPDLNEAMKEAALGAFFKPIHF

SEQ ID NO: 1623 - protein, 397 aa, Prunus mume
MEVQILARLPPKSLMRFKCVCKSWHALLNNPHFVAKHLHLYNNQPSSTCVLFKRSVLSRTEHNKEELVFTFLILRNDNEINADHNLINCKVEDLHFPRSMGLKSRGQFIELPGLELGESVHIVGHCDGLFCLSLYTGELVFYNPAIKEFRVLPQSCLEDACSCTLGFGYDPKRKDYVLLSIVSYGEEIFDDERLVIHPPQAEIYTLSTNSWREIETHYLETETTYFWGNETFSAYFNGVFYWLGYEEKKEFVSFYDRLEEEKKQVIILFDTFDEVFHNMPLPDCFYEFPSHEMSLTVWNESIALFGFYRCEFEPFEVWVMDEFDGWTKHLSVVPKVDQEVDIPLALWRRNEVLLVDRDGRIFSYNFDTENLKYLPVHGASRGDFQAVVCVNSIVSVK

SEQ ID NO: 1624 - protein, 94 aa, Arabidopsis thaliana
  misc_feature (80)..(80): Xaa can be any naturally occurring amino acid
  unsure (1)..(94): unsure at all Xaa locations
TTMPSIEVGTVGGGTQLASQSACLNLLGVKGASTESPGMNARRLATIVAGAVLAGELSLMSAIAAGQLVRSHMKYNRSSXREISGATTTTTTTT

SEQ ID NO: 1625 - protein, 220 aa, Aspergillus oryzae
MPEIIDDKSQHCIPFLLERLKAHQERFGNDPARTPPFFLGLNGVQGAGKTVLVSTLQSTLRSPPYSLPVITLSLDDLYLTHEEQVNLAKSHPANPLLQHRGQPGTHDLPLAKEVFESLRAGRATAIPQYDKSAYAGQGDRVPESQWEIVNGEGQEKIKVVIFEGWCVGFRALDDQLLREKWDAAVLRKEKGDYDGRLGYVPFEAAKAVNDALKDYDLITE

SEQ ID NO: 1626 - protein, 403 aa, Neorickettsia sennetsu str. Miyayama
MPVKILMPALSPTMKEGTLAKWLVSEGEKIEAGQVIAEIETDKATMEFEAVDEGVLGKILIPAKTAGVKVNQPIAVLLDDGEGEKELKKFLSTIDKPTVTDNKAETSDGDKIKNNPSSLPADKQQGRVIATPLARKIASINGIDLSLIGSGSGPDGRIVKNDLLKLLDDAPQVQMHGHCTETSIPISPMRRVIAQRLVESKQNVPHFYLSVTCYLQHLLSAKKKFYDCLETKVTVNDFVIKACAFALDKNPAMNVSWEGEFIRQNQTIDISVAVAIPDGLITPIVFSADKLSLSSISDEVRELVDKAKAGRLQPREFQGGSFTVSNLGMYGIDEFTAIINPPQAAILAVGAARKVPTVSADAVVVSDVVTLTLSCDHRVIDGALAARFMQSLKKAIEDPVIML

SEQ ID NO: 1627 - protein, 781 aa, Ashbya gossypii ATCC 10895
MAHRKLQQEIERVFKKINEGLEIFNTYYERHENCTNNPSQKDKLEGDLKREVKKLQRLREQIKTWQSAPEVKDKDALLDYRRSVEVPMEKYKAVEKASKEKAYSNTSLKRSEVLDPEERERREVSDYLSEKIDELERQYEQLQVDMDRLIGGRKRRGTAQEERKLELRQLQVRYRWHQQQMELALRLLANEELDPQAVRDIQDDITYFIESNQEPDFVEDETIYDSLNLDANEAIAHEVAASFAAQANEESDDEQRDMSCLSKKEQRRLEREAKRAAKLAAKGSLDSISSTPVTSAPSSALDHEPTDEVQDLASSSVVPKEDDPPTPASSQSPSPTSTPSSSIPSTANTIATHTQSSKPQTPLAKPRQLTHISPEHQGHTHIHQTLNGVTTSTLKPATVPAKPAGELKWAVAAAQALEKEKREKSASLMAMKTQGASSPRATMDMSSTSQLTDAHSSSNRSDTVYSTHAEDRGHLSGDNKDIPKVGNSAIKSTHLDALKKQEMPGLELVADNYESDSTDDELPEEPMPIQLDVEEYERRGSVSNQLFTELCQNFDLLKLPCGIQDMIMGSLITSHDLHPPDGKLGGFRNFPDICRVTRLFELPRGVNPPQPLDATRCTEQWDSVRIGLVDEKTVEDQEDQDLRISTYSKFRVLETFTLFYVYYYAYTPLEHDIAATILAEREWRVSKDGATWFLREGQPKFTNELCEVADFKIFKLDDWTAINKMNFTLDYSILKDSQKPTAAGSGTAGSTPSRHGSLSHGQTLLQQLRRGSSAMKVEPSH

SEQ ID NO: 1628 - protein, 374 aa, Prunus mume
MAFTLRKKEIVIDILVRLPVKSLVRFLCTCKSWSDLIGSSSFVSTHLHRNVTKHAHVYLLCLNHPNVEYLDDRDDPYVKQEFQWSIFPNEIFEECSKLTHPLRSTEDYMIYGSSNGLVCVSDEILNFDSPILIWNPSVKKFRTPPMSININIKFSYVALQFGFHPGVNDYKAVRMMRTNKNALAIEVYSLGTDSWKMIEAIPPWLKCTWQHLKGTFFNGVAYHVIQKGPIFSIISFDSGSEEFEEFIAPDAISTPWGLCIDVYREQICLLFDCYPFGEEGMEKIDLWVLQEKMWKQLRPFIYPEDYCYGIIGINVDNELLMGRRDLAKGVADLYLCNYESKQVIETGIKLGLMSYGEIEFLFSITYIESLVLLN

SEQ ID NO: 1629 - protein, 859 aa, Solanum lycopersicum
MSLGGIVDAILGKDDRPKVKGRVILMKKNVLDFINIGASVVDGISDLLGQKVSIQLISGSVNYDGLEGKLSNPAYLESWLTDITPITAGESTFSVTFDWDRDEFGVPGAFIIKNLHLNEFFLKSLTLEDVPNYGKIHFVCNSWVYPAFRYKSDRIFFANQAYLPSETPQPLRKYRENELVALRGDGTGKLEEWDRVYDYACYNDLGEPDKGEEYARPILGGSSEYPYPRRGRTGREPTKADPNCESRNPLPMSLDIYVPRDERFGHVKKSDFLTSSLKSSLQTLLPAFKALCDNTPNEFNSFADVLNLYEGGIKLPEGPWLKAITDNISSEILKDILQTDGQGLLKYPTPQVIQGDKTAWRTDEEFGREMLAGSNPVLISRLQEFPPKSKLDPTIYGNQNSTITTEHVQDKLNGLTVNEAIKSNRLFILNHHDIVMPLLRKINMSANTKAYASRTLLFLQDDRTLKPLAIELSLPHPDGDQFGTVSKVYTPADQGVEGSIWQFAKAYVAVNDMGIHQLISHWLNTHAVIEPFVIATNRHLSVLHPIHKLLHPHFRNTMNINALARETLTYDGGFETSLFPAKYSMEMSAAAYKDWVFPEQALPADLLKRGVAVEDLSSPHGIRLLILDYPYAVDGLEIWAAIKSWVTEYCKFYYKSDETVEKDTELQAWWKELREEGHGDKKDEAWWPKLQTRQELRDCCTIIIWIASALHAALHFGLYSYAGYLPNRPTLSCNLMPEPGSVEYEELKTNPDKVFLKTFVPQLQSLLEISIFEVSSRHASDEVYLGQRDSIEWTKDKEPLVAFERFGKMLSDIENRIMIMNSHKSWKNRSGPVNVPYTLLFPTSEEGLTGKGIPNSVSI

SEQ ID NO: 1630 - protein, 288 aa, Xylella fastidiosa Ann-1
MFDIPGLSTGDFHGFPSLLIQTPFSHAAISLFGGQLLSFVPSGGEEVMWLSPLVQPPPTAIRGGIPVCWPYFGRQGQRDTMPAHGFVRTVPWQQVESCQENDGSLFLVMAPPPLKHLGLHLRMTLRIGRTLEQELATENTSHAPISFTQALHNYFRVSNALQVTVQGLDGVEYLDKFEGYTQRHRQQGNWTLQDPRDPGRADRIYVDTSGHYVLVDPLFSRRIVLTTEGSHSLVVWNPGHAGASNMIDVANGWRDYLCLEPANAGPDEIELLPGARHVLRQSIAIAPL

SEQ ID NO: 1631 - protein, 484 aa, Sphingobium chungbukense
MTILNFIDGSYREGSEGKSFSNVNPATGAEIGVVHEASQAEVEDAVEAAKAALTGPWGKMTTARTGQADHRVATEIERRADDFLAAEVADTVKPRHVVSHIDIPRGAANFRMFADVVSTMPGESFNTPTPDGGQAFIYTVSKPKGVDAAVCPRNFPLLLMIWKVGPELACGNTAVVKPSEEIARTAALLGDVIDAGVNHHGVFNVAQRFGPASAGEFLTSNPDVDAITFTGETGTGQAIMQKAATGVRDISFELGGKNPAIVFADADLDKAVEGLSRSVFLNTGQVCLGTERVYVERPIFDAFVARMAAAAQDFKPGVTGDRAYLGPLISAEHREKVLAYYPRAVEDGPTVFTGGGVPEISGAETGGFFVEPTLWIDVAHGDTVMREEIFGPCCDILPFDSEDEVIALANDTVYGLCASVWTENLSRGHRVAAAMEVGVCWVNSWFLRDLRTAFGGSGHSGIGREGGVHSLEFYTEITNICVKL

SEQ ID NO: 1632 - protein, 512 aa, Mycoplasma hyopneumoniae 232
MQKNRKNVKKKLVLIIIDGLGLRFESQGNGFALAKTPVFDRLFQEYPNSLIAASGQEVGLPEGQMGNSEVGHLNIGAGFVVYTGISIINNALKTGKFFENEKFILAFRHSIKTGFPLQIMGLFSPGGVHSHQDHLFALIDFAANFGVKKLNLHLFGDGRDVGPKSIKPWIKMLNLKLKNYENYKIASISGRFYSMDRDKMFDRVELGYNALLGKAENTFTDPIDYVNFQYEKGVSDEFFEPAINLKVNKKDFLADDHPVIFFNFRPDRARQLSHLILQTDLYEQKPKNPIKTDVFVSMMKYEGINCLVAFEEMRVENPLGKLICMAGFRQLRLAETQKYAHVTFFVDGGVELELENSDRILIDSLKVQSYADFPQMSAVEITDKLLEVGQKYDFIIMNFANPDMVGHTGDLKATIKAVEILDFQIGRICKWAEEKNFDFFITADHGNAELTEDENGNPSTKHTTFPVMLISSDKTIKLKSGKLANIAPTILDYLGLDKHPDMDHDSLIIKDK

SEQ ID NO: 1633 - protein, 361 aa, Erwinia carotovora subsp. atroseptica SCRI1043
MKALAKLRPEEGIWMMDAPMPELGHNDIMIKIRKSAICGTDVHIYNWDEWSQKTIPVPMVVGHEYVGEIVAIGQEVNGFHIGDRVSGEGHITCGYCRNCRAGRRHLCRNAIGVGVNRPGSFAEYLVIPAYNAFRIPDNISDELAAIFDPFGNAVHTALSFDLVGEDVLITGAGPIGMMAAAVCRHVGARNVVITDVNAYRLELASKMGATRAVNVAEEKLTDVMIELGMTEGFDIGLEMSGAPSAFRAMLKAMNHGGRIAMLGIPHEPMSIDWGEVIFKGLFIKGIYGREMFETWYKMSALIQSGLDLSPIITHRFHIDEFQKGFDAMRSGQSGKVILNWDEAYTRHTSSCMCVDCATRHT

SEQ ID NO: 1634 - protein, 945 aa, Oryza sativa (japonica cultivar-group)
MEGSPSKSRGVTGPAHTDDGDWFSDVPDDIILNIMSFLTTRQAVQTCVLSRRWRNLWRSVPCINSDIDEFTRDSDSEGYYDEKTELAFIMFMERFRCKFELDEGFDDISDPEDINAWISHAVQKQARVLDIVVLCDKLYLDHSEFASRYLTRIEFTSVVLMEGFFKQLEMGCPAWESLFLDECAVNDVEISSQTLKVLTIKNTLFSSDKTTISTPSVTYLKLWRPVDSCVFNDMPLLVTSLLVLYHVQDSGDFFQNLRSLSAAKSLEFNYIGKELTMENNLQLYPKFNNLVRLTLGQWCLDANFYGLMVFLQTSPKLEKLTLKIEKEKTQRIIGKIEDRSFTCEHLTRVEIVCSEDDPLVKDVVTFFVNSGLTSAQVVGVVRARVAKAGGAWWGHTHLLEDDAAVVRAGDDGVFVRGSVHEGVTAVAPVVGGRRRGTGGGRGGGGGKGRGRSHRKRICLITFCSLSDLPRNHRKKGFLFGLLFTSGDQRLSFSRAARLQQQQEEEERCGGGSSHALHLFDETPARAVSSFYARDLFDETPLRACSAAMEGSPSKRRGVTAPAHTDDGDWFSDVPDDVILNIMSFLTTRQAVQTCVLSRRWLNLWRSVPCINADVGEFQRSDTEWEEYDQERESAFKMFMDRVLELRNPAAPIRTFRFRCCRLDGFEGTSDEADMNRWITHAMQKQPWVLDILVLYDALKLDHSAFTCRYLTRIKFINVLMMPGFFQQLEMGCPVLENLFLDESIVADVEISSRTLKVLTIKSTQFSYKFRTTISTPSVTYLKLWRPVNGIYVFNDMPLLVTSILVLYDVQDSSDFCQNLRSLSAAKRLEFDYFGRKLTMENNLQLYPKFNNLVSLTLGQWCLDANFYGLVVFLQNAPKLEKLTLELEKNTPERIIGKLEDRSFTCEHLTRVEVVCSEGDPLVKDVVNFFVNSGLTSAQVQIIRWC

SEQ ID NO: 1635 - protein, 293 aa, Solibacter usitatus Ellin6076
MFDRRSHLNCVTAGALALFHAGALAALFLFTWQALWVALALLWISGGWGIGMGYHRLLTHRGYETPRWLECILTICGTLALQGGPLFWVATHRLHHQNADKQGDPHSPQDGWWWAHAGWLLRGDPMRDSALAPYVPDLRRDPFHCWLEEWHVVPLLVLSVVLAVWGAVREGWFLAASLVAWGVFLRTVVELHGTWLVNSAAHTWGSRRFQTRDDSTNNWWVALLTFGEGWHNNHHAEPRRVRHGLAWYELDINWLCIRALGRIGLARNLCLGPAVRPATVQTAVPERQAPSNR

SEQ ID NO: 1636 - protein, 632 aa, Oceanobacter sp. RED65
MQTNDKQQNQTASNQIAAHAIPDIADNKITLGPLPASEKVYVTSPNRDDVRVPMRKVSLTDGTHVTLYDTSGPYTDNTAQIDVHKGLSTETRSAWIDERADTEFYEGRDMKPIDNGVTDEAQGQRFYNPLLQRQPRRAKAGRNVSQMHYARQGLITPEMEYVALRENQMREALANEFTTEERQARLKGNDFGAAIPDVITPEFVRDEIARGRAIIPANINHPELEPMIIGRNFLVKINANIGNSALTSSIEEEVEKMVWSTRWGGDTIMDLSTGKYIHSTRDYIVRNSPAPVGTVPIYQALEKVNGVAEDLTWEVFRDTLIEQAEQGVDYFTIHAGIRLAHIPLTADRVTGIVSRGGSIMAKWCIYHHKESFLYEHFEDICEIMKAYDVSFSLGDGLRPGSLADANDAAQFAELETLGELTQIAWKHDVQVMIEGPGHVPMHMIKANMDKQLECCDEAPFYTLGPLTTDIAPGYDHITSGIGAAMIGWYGCAMLCYVTPKEHLGLPNRDDVKTGIITYKLAAHAADVAKGHPGARYRDDLLSKARFEFRWQDQFNLSLDPETAQSFHDETLPKDSAKVAHFCSMCGPKFCSMKISQEVRDYSKDEIEQGMQQKSEEFKAQGAQVYVPVEEDA

SEQ ID NO: 1637 - protein, 554 aa, Mycobacterium bovis AF2122/97
MTAQLASHLTRALTLAQQQPYLARRQNWVNQLERHAMMQPDAPALRFVGNTMTWADLRRRVAALAGALSGRGVGFGDRVMILMLNRTEFVESVLAANMIGAIAVPLNFRLTPTEIAVLVEDCAAHVMLTEAALAPVAIGVRNIQPLLSVIVVAGGSSQDSVFGYEDLLNEAGDVHEPVDIPNDSPALIMYTAGTTGRPKGAVLTHANLTGQAMTALYTSGANINSDVGFVGVPLFHIAGIGNMLTGLLLGLPTVIYPLGAFDPGQLLDVLEAEKVTGIFLVPAQWQAVCTEQQARPRDLRLRVLSWGAAPAPDALLRQMSATFPETQILAAFGQTEMSPVTCMLLGEDAIAKRGSVGRVIPTVAARVVDQNMNDVPVGEVGEIVYRAPTLMSCYWNNPEATAEAFAGGWFHSGDLVRMDSDGYVWVVDRKKDMIISGGENIYCAELENVLASHPDIAEVAVIGRADEKWGEVPIAVAAVTNDDLRIEDLGEFLTDRLARYKHPKALEIVDALPRNPAGKVLKTELRLRYGACVNVERRSASAGFTERRENRQKL

SEQ ID NO: 1638 - protein, 335 aa, Solanum tuberosum
MVHDKRVKDVVSGWLTVFDDGSVDRTWTGPPEVKFMAEPVPPHDDFIDGVAVKDVVAGENSGSRFRVYLPERNDSSVDKLPVILHFHGGGFCISQADWYMYYAVCTRLARVANAIIVSVFLPLAPEHRLPAACDASFAGLLWLRDVSRKQDHEPWLNEYADFNRVFLIGDSSGGNIVHQVAARAGEEDLSPMRLAGAIPIHPGFMRSQRSKSELEQEQTPFLTLDMVDKFMELALPIGSTKDHPITCPMGDAAPAVEELKLPPYLYCVAEKDLIKDTEMEFYEALKKGEKDVELLINNGVGHSFYLNKIAVDMDPVTGSATEKLFEAIAEFINKH

SEQ ID NO: 1639 - protein, 332 aa, Neorickettsia sennetsu str. Miyayama
MTEITVREAIRNAMAEEMRRDSDVFIIGEEVGKYQGAYKVTQGLLEEFGEKRVVDTPISEHAFAGIATGAAFVGLRPIVEFMSFNFSLQAMDQILNSAAKTHYMSGGRLSCPIVFRGPNGAAVQVGAQHSQCFAAWYSHVPGLKVVAPYFASDCRGLLKSAVRDNNPVIFLENERTYGLVHTLTAEQEAEDYLVPIGEANVLRNGTDVTIVTFSICVELALEAAEALESEHNISVEVIDLRTLRPLDFQTIIRSLEKTNKLVTLEQGFPVLSFGSEVSARIMEEGFDLLDAPVVRISGRDVPMPYSSALEKLALPQLPEVIEVVKKVATSGI

SEQ ID NO: 1640 - protein, 510 aa, Vibrio sp. Ex25
MSAKKPLALVILDGYGYREDTASNAIANAKTPVMDALIANNPHTLISASGMDVGLPDGQMGNSEVGHTNIGAGRVVYQDLTRITKSIADGEFAETPALVEAVDAAVKAEKAVHIMGLMSPGGVHSHEDHIYAAVEMAAARGAEKIYLHCFLDGRDTPPRSAENSLQRFQDLFAKLGKGRVASLVGRYYAMDRDNNWDRVQVAYDLLTQAKAEFTAETAVAGLEAAYAREENDEFVKATAIKAEGEEDAIMQDGDAVIFMNYRADRARQITRAFVPDFDGFERAVFPAVNFVMLTQYAADIPLAIAFPPASLENTYGEWLSKQGQTQLRISETEKYAHVTFFFNGGVENEFEGEERQLVASPKVATYDLQPEMSSPELTEKLVAAIKSGKFDTIICNYPNADMVGHTGVYEAAEKAIEALDESVGKVVEAIKEVGGQLLITADHGNAEMMVDPETGGTHTAHTNLPVPLIYVGDKAVEFKEGGKLSDLAPTMLSLAGLEIPAEMTGEVLVK

SEQ ID NO: 1641 - protein, 157 aa, Zea mays
  misc_feature (98)..(98): Xaa can be any naturally occurring amino acid
  misc_feature (101)..(101): Xaa can be any naturally occurring amino acid
  misc_feature (115)..(115): Xaa can be any naturally occurring amino acid
  misc_feature (123)..(123): Xaa can be any naturally occurring amino acid
  misc_feature (125)..(125): Xaa can be any naturally occurring amino acid
  unsure (1)..(157): unsure at all Xaa locations
MASSMLSSAAVVTSPAQATMVAPFTGLKSSAAFPVTRKANNDITSIASNGGRVSCMKVWPPVGKKKFETLSYLPDLTEVELGKEVDYLLPAQWIPCVXFEXEHGFVYREHGSTPXYYDGRYWXMXKAPLFGCTDSAPVLRESKKCKRRPYRFLRIMD

SEQ ID NO: 1642 - protein, 456 aa, Corynebacterium diphtheriae NCTC 13129
MFAWLQAPGPAAPLSAEQVDRTYPRMRLQVFMGIFLGYAGFYLIRNNISAIAPLLIDESGAIDKPAIGIIGNAVLVSYGLSKFFSAMVSDRSNARYFLPLGLALSALMNLVVAFVPWVSASVGVFATVMFLNGWFQGMGYPPCGRIVVQWFSTSERGWKGSLWNTSHNLGAFGLPVLVGIGLSMTGENWRAAYWLPALVALVVALVAFLLIRDNPQSVGLPPIDDYRNDPAKVAEDTGEKISTKDLVFKHILHSRIIMLLAIANVFVYALRYGVLHWITTYLSEQHHMSIGSGLIGFAAFELAGFIGTVLCGWLSDNVFKGNRSAAISLFTLGAGLSIAAYWLAPVGTPFWLMVIFVAFIGGFIYGPVGLIGLQALDLSPRNVAGTAAGFTGLFGYLLGATLASTGVGFLVKFAGWNVTFIVFLVFTVLILVIFQVIWREEKKLMQERALKLEQGV

SEQ ID NO: 1643 - protein, 393 aa, Acinetobacter sp. ADP1
MHPIVIIGSGMAGYTLAREFRKLNPEHELVMICADDAVNYAKPTLSNALSGNKAPEQIPLGDAEKMSTQLKLQILSETWVKAINPETHELKLEKNGQETIQPYSKLVLAVGANPTRLAIAGDGSDDIHVVNSLIDYRAFRENLAKRQDKRVVILGAGLIGCEFANDLQHTGHQVTVIDLSPRPLGRLLPAHIADAFQKNLEESGIHFVLSTTVEKVSKINDGQDYAVTLANGQTLVADIVLSAIGLQPNIDLAKHAGVHTSRGILTNSLLETNLEDIYAIGDCAEVNGTLLPYVMPIMQQARALAKTLSGETTHVHYPAMPVAVKTPAAPLTVLPVPVDVDVNWETEEFEDGMLAKAIDNTDTLRGFVLLGATAGKQRLTLTKLVPDLIPAQL

SEQ ID NO: 1644 - protein, 139 aa, Prochlorococcus marinus str. MIT 9303
MASTNENLFETAMARYQSGAEASELIEDFKTITATAPNQAAGWTCLAWLQLLNAQPDEALRTARTAVKLNAQDPQARINLSLALLETNSKGVRDQIDMVQKILAVAPEFAKDLKDSIADGLLRKPNWQALKKVKAWLEL

SEQ ID NO: 1645 - protein, 154 aa, Magnaporthe grisea 70-15
MSTAARRRLMRDFKRMQTDPPAGVSASPVPDNVMTWNAVIIGPGDTPFEDGTFRLVMHFEEQYPNKPPSVKFISQMFHPNVYATGELCLDILQNRWSPTYDVAAILTSIQSLLNDPNTGSPANVEASNLYKDNRKEYIKRVRETVEKSWEGDDE

SEQ ID NO: 1646 - protein, 342 aa, Kluyveromyces marxianus
MRGSHHHHHHGIQMVSIAINGFGRIGRLVLRIALERKNIDVVAINDPFISVDYAAYMFKYDSTHGKYKGEVSHDGSNLIINGKKVAVFQEKDPATLPWGKLGVDIAVDSTGVFKELDSAQKHIDAGAKKVVITAPSKTAPMFVVGVNEDKYNGEKIVSNASCTTNCLAPIAKIINDEFGIEEGLMTTVHSITATQKTVDGPSHKDWRGGRTASGNIIPSSTGAAKAVGKVLPELQGKLTGMAFRVPTTDVSVVDLTVKLVKAATYDEIKAAVKKVSEGKLKDVVGYTEDAVVSSDFLGDTHSTIFDAAAGIQLSPKFVKLVAWYDNEYGYSTRVVDLVEHVA

SEQ ID NO: 1647 - protein, 114 aa, Clostridium perfringens str. 13
MSDCIFCKIVAGEIPSKKIYEDDKVLAFHDISPEAPVHFLVIPKEHIASLNEVNEENAEVFAHIFKTINKLVKEQEVAEDGYRVVTNCGEQGGQTVGHIHFHVLGGRNLNWPPG

SEQ ID NO: 1648 - protein, 369 aa, Photorhabdus luminescens subsp. laumondii TTO1
MKSRAAVAFGPGRPLEVVEIDVAPPQAGEVLVKISHTGVCHTDAFTLSGDDPEGVFPVILGHEGAGVVVEVGEGVTSVKPGDHVIPLYTAECGECLFCKSGKTNLCVAVRTTQGKGVMPDGTTRFSYKGQPIYHYMGCSTFSEYTVVAEVSLAKINPEANHEEVCLLGCGVTTGIGAVHNTAKVQSGDSVAVFGLGGIGLAVIQGARQAKAGKIIAIDTNPAKFELARQFGATDCLNPNDYDKPIQQVIIEMTEWGVDHTFECIGNVNVMRAALESAHRGWGQSVIIGVAGAGQEISTRPFQLVTGRSWRGTAFGGVKGRSQLPKMVEEAMKGEIELKPFVTHTLPLERINEAFDLMHEGKSIRTVIHY

SEQ ID NO: 1649 - protein, 292 aa, Corynebacterium glutamicum ATCC 13032
MLNDPRTLFPKVDPPKQSQPEPGLDIKLSPQADIGLSSYQGSGRLKGRKALITGGDSGIGAAVAIAYAREGADVAIAYLPEEQADADRVLQAIEETGQKAFSFPGDLRDPEYCRSLVQETVNALGGLDILVNNASRQVWAPGLTEITDENFDQTLQVNLYGSFRVTKAAIPHLKPGSSIIFTSSIQAYQPSETLLDYAMTKAALNNLSKGLASSLIGDGIRVNSVAPGPFWTPLQPSHGQPQEKIEGFGQHAPIGRAGHPVELAGAYVFLASDEASYVVGETLGVTGGTPTP

SEQ ID NO: 1650 - protein, 514 aa, Legionella pneumophila str. Lens
MSHNAPLVLMILDGWGYNENDRYNAIAKANTPQWDEWWQTCPHILLKASGLPVGLPDEQMGNSEVGHMHIGAGRVIQQDFTRINEAINNGKFAKNAVFHEVIDQLKKTEKSLHIMGLLSPGGVHSHEQHLFALLALCNQKKFRSVHLHLFLDGRDTPPQSALDSLKCLNEELAKHPVATINSICGRYYAMDRDKRWQRVEPVYNLLTQGKSERQFPDAETAIHFYYKNKISDEFVPPTLIGKEHSIQDGDAVLFFNFRADRARQLTSTFLDPSFKGFERKTLPKLSYFVSMTQYDKNLFTTTAFPPVPLNNTLGEVLSSHGLSQLRIAETEKYAHVTFFFNGGCESVFTNEERIMVPSPQVATYDLQPEMSAHELTKTLIAAINSQDYHVIICNYANADMVGHTGNFEATVQAIECLDQCMQQVWQALKNNGGKLLITADHGNAEEMFSEATNQAHTAHTSEPVPFLYVGGGWHFTHSEGSLIDIAPSLLALLGITPPPEMTGRILLEKNHAHA

SEQ ID NO: 1651 - protein, 357 aa, Desulfitobacterium hafniense Y51
MNTMKRMDCRDLNQSELTQHCAELGLPKFRGRQVFQWVQQKAVQNWEELKNIGAGDRQKLQDGLFLQPLRKVREQISQDGTRKFLFRCADGETLECVLMDYDRRKNRDRHTVCVSTQIGCAVGCAFCATGLGGWRRNLSPGEILGQVLDITYLMRQEDPDFQVTNIVFMGMGEPLLNYEAVLKAIELLNDPEGQGIGMRRMTISTSGVAPKIRQLAKDNPQVGLAVSLHSAHNTTRDQLIPMNRKYPLEELMEACRDYTTLTNRRITFEIALISGQATLEAAQAVGHLLKRQLAHVNLIPVNPVAGTGMARPTAKEVQQFAQCLESMGIPVSVREEKGTDIDAACGQLRRQLECEQK

SEQ ID NO: 1652 - protein, 336 aa, Oceanobacter sp. RED65
MAEAIQDTHELVDTVLLEAVNLAIHWEMQHDENVVVLGEDVGSNGGVFRATDGLKQKFGFKRVMDTPLAEALIGGLAVGMSTQGLRPIAEIQFSGFIFPALEHLMCHAARMRNRTRGRLSCPMVLRAPYGGGIHAPEHHSESIEALMAHIPGLRVVIPSSPARAYGLLLAAIRDPDPVIFLEPKRVYRSSKQSYENNGEALPLDSCFTLRQGKDITLVSWGASIAETLQAADALAEHGIDAEVIDVASIKPLDMQTILISVARTGRCVIVHEAAKSFAVGAEIAAQVSEKCFLNLQAPVQRVAGFDTHMPYFQNEHYYMPNVQDILAAVDKSMKEE

SEQ ID NO: 1653 - protein, 371 aa, Oceanobacter sp. RED65
MKLSQSRVTEQGHVPLARFVIDWIQFLNEHGEWTQPRPDFATDEWLRDMYKHMVMTRVFDQKAIALQRTGQMGTYPSSLGQEAFATAIGIALQNEDVFVPYYRDHGTLLMRGYDMSDILAYWGGDERGSTTGPKQDLPLCVPIATQITHAAGAAAALKIKAQDNLVITTIGDGGTSKGDFFESLNVAGAWQLPLIVVVNNNQYAISVPREIQCGAKTLAQKAIGAGIHGVQVDGNDPMALYQALLEARQRIQQHKGATLIEAVTYRLGDHTTADDATRYRSNDEVKEAWLKDPVKRLQSLLASLNLWDEQREQDWQKQCAKSVDAAVKRYLAREPQQPAAMFDYLYEQWPEVMNEQLDLLIDKIDRMSSSH

SEQ ID NO: 1654 - protein, 345 aa, Oceanobacter sp. RED65
MFDLMSQDKVQELHFSSNGPLKAIIALHNLRQGPALGGCRFIRYQNETQAIDDAIRLAKGMSYKAALAGVPQGGGKSVIMMPEGDFDRAELFSLFGKFINSLNGSYITAMDSGTSVSDMDIIRRQTPFVASSSNIGDPSPTTAKGIVLGLAEAVEQAFNQSVQGLTVAIQGLGHVGMVLAESLHQQGAKIIVCDVDEQKVDYAVKHFDAKAVSVNEIYSQQCDVFSPCGLGLSINDNTIKQLKCKVIAGCANNQLAHDGLGQQLHDLGILYTPDYVINSGGLIYASSNFRGLSLDKIDHQVLKLKDTLNKIFILSKQKNIPTQVIADEMAEHVLYGNDTTMQEAI

SEQ ID NO: 1655 - protein, 518 aa, Aspergillus oryzae
MLAQIAPLFGALCITFLVLQYLQRLYQQRKRAQSLGCQPAAQGPSGIFGIRSFVRLLNEVRHKRWVEYIAGQYGRYGNTYTQKALGKWMVSTIEPENIKALLATQFNDFGLGTRHREFYPLLGDGIFTLDGPGWSHARGLLRPQFTRDQVADLELMDGHISRMIDLIPQDGSSFDIQRLFFLLTIDSATHFLFGESVGALESSNSASLLGRSSVGSAQGFAEAFGTAQDYLTTRSRAMHFYWMVNPKEFREANQRVHEVVDHYVQLAIQSKNNPDKKSDRYIFAEALAADNDDPKVLRDNMLNILVAGRDTTASLLSSAFFYLSRNQDVWKKLRQTIIDEFGDSQNPKGEITQAKLKDIPYLRYVLNEVLRLLPPVPLNFRVAAKDTSLPVGGGPDGRSPVFIPKGQVVAYSVYAMHRRTDLYGPDSHSFRPERWEENGRRGWDYLPFNGGPRICLGQQYALTEASYTLVKLVQRFDTLECADPELKQPAILSTLTMSHDRGVKVRLSSSVPKCWFNQ

SEQ ID NO: 1656 - protein, 452 aa, Escherichia coli CFT073
MLSIFKPAPHKARLPAAEIDPTYRRLRWQIFLGIFFGYAAYYLVRKNFALAMPYLVEQGFSRGDLGFALSGISIAYGFSKFIMGSVSDRSNPRVFLPAGLILAAAVMLFMGFVPWATSSIAVMFVLLFLCGWFQGMGWPPCGRTMVHWWSQKERGGIVSVWNCAHNVGGGIPPLLFLLGMAWFNDWHAALYMPAFCAILVALFAFAMMRDTPQSCGLPPIEEYKNDYPDDYNEKAEQELTAKQIFMQYVLPNKLLWYIAIANVFVYLLRYGILDWSPTYLKEVKHFALDKSSWAYFLYEYAGIPGTLLCGWMSDKVFRGNRGATGVFFMTLVTIATIVYWMNPAGNPTVDMICMIVIGFLIYGPVMLIGLHALELAPKKAAGTAAGFTGLFGYLGGSVAASAIVGYTVDFFGWDGGFMVMIGGSILAVILLIVVMIGEKRRHEQLLQKRNGG

SEQ ID NO: 1657 - protein, 142 aa, Bradyrhizobium japonicum USDA 110
MTVRSILNTKGHQIMSVEPDAKLAAAIKLLGEKKIGAVLVMNQSRLEGILSERDIVRVIGERGAGALDEPVSQVMTRKVVTCKETDTVAELMETMTTGKFRHLPVIDNGKVVGLISIGDIVKRRVQEYESEQEALRDYIKTA

SEQ ID NO: 1658 - protein, 233 aa, Ashbya gossypii ATCC 10895
MTSVEVRRVLEQLLRDPCNQQCADCKNSAHPRWASWSLGVFVCIRCAGFHRSLGTHVSKVKSVDLDTWKEEHLQQVVRFGNNQQANKVFEGRLGGGSYVPDQSKMGQFIKTKYEVRKWYLEEGACEPALPEAAPAAASPLPVSVPMSPAGVGREASASPALAVSPAPASPPVYSANARPDLKKSILSLYAKPRQQSPGVASSASSLNSAAASAGVSYSAASLEDNELFKNVWT

SEQ ID NO: 1659 - protein, 896 aa, Magnaporthe grisea 70-15
MDGLTRDEAAASRVRQAEEFLDPHDQNARSYRPDIILMLQKNQRRLVVNIDHVRDHNAEIAEGLLLDPFEYSLAFNYALKQIVKTVPNARPDQTHDEVQYYCAWAGSFGSHACNPRTLSSQLLNRMVSIEGIVTRCSLIRPKVVKSVHHSEAEDKFYFREYRDQTMTNGVTTSSVYPTEDPKGNPLTTEYGFCTYRDHQTISIQEMPERAPAGQLPRGVDVILDDDLVDKVKPGDRVQLVGIFRTMGNRNTNHNSALFKTLILANNVVLLSSKASGGVATATITDTDLRNINKIAKKKNLFELLSQSLAPSIYGHDHIKKAILLMLLGGVEKNLENGTHLRGDINILMVGDPSTAKSQLLRFVLNTAPLAIATTGRGSSGVGLTAAVTSDKETGERRLEAGAMVMADRGVVCIDEFDKMSDIDRVAIHEVMEQQTVTIAKAGIHTSLNARCSVIAAANPIFGQYDPHKDPHKNIALPDSLLSRFDLLFVVTDDIEDARDRQVSEHVLRMHRYRQPGTEEGAVVRENTQQSLGVGMQSQSNDSQRPTDVFEKYDSMLHAGVTVTSGRGANKKPEVVSIPFMKKYIQYAKTRIRPVLTQEASDRIADIYVGLRNDEVEGNQRRTSPMTVRTLETIIRLATAHARSRLSNRVEERDAAAAESILRFALFKEVVEAESRKKRRKTQNVEYASSSEDDSSDEDDDGDLRSTARASTSRSARGTARTRRGAVNANGRRADTSGAPVDADDDDEDQEPEASAPRRSNRSGRGAVASSSQSQSQVSYASSVPASQLETQEEDDEDAEADGLADEAAALNIGQDDGPEITASRLGAFRQALGQLQSTDLFEDDTASLDNVVTAVNAKIGSRSGGAFSKDEAVKALRKMDEANQVMYTGGDLVYRI

SEQ ID NO: 1660 - protein, 463 aa, Escherichia coli O157:H7 EDL933
  misc_feature (155)..(155): Xaa can be any naturally occurring amino acid
  unsure (1)..(463): unsure at all Xaa locations
MLAFLNQVRKPTLDLPLEVRRKMWFKPFMQSYLVVFIGYLTMYLIRKNFNIAQNDMISTYGLSMTQLGMIGLGFSITYGVGKTLVSYYADGKNTKQFLPFMLILSAICMLGFSASMGSGSVSLFLMIAFYALSGFFQSTGGSCSYSTITKWTPRXKRGTFLGFWNISHNLGGAGAAGVALFGANYLFDGHVIGMFIFPSIIALIVGFIGLRYGSDSPESYGLGKAEELFGEEISEEDKETESTDMTKWQIFVEYVLKNKVIWLLCFANIFLYVVRIGIDQWSTVYAFQELKLSKAVAIQGFTLFEAGALVGTLLWGWLSDLANGRRGLVACIALALIIATLGVYQHASNEYIYLASLFALGFLVFGPQLLIGVAAVGFVPKKAIGAADGIKGTFAYLIGDSFAKLGLGMIADGTPVFGLTGWAGTFAALDIAAIGCICLMAIVAVMEERKIRREKKIQQLTVA

SEQ ID NO: 1661 - protein, 440 aa, Escherichia coli O157:H7 EDL933
MMLPFLKAPADAPLMTDKHEIDARYRYWRRHILLTIWLGYALFYFTRKSFNAAVPEILANGVLSRSDIGLLATLFYITYGVSKFVSGIVSDRSNARYFMGIGLIATGIINILFGFSTSLWAFAVLWVLNAFFQGWGSPVCARLLTAWYSRTERGGWWALWNTAHNVGGALIPIVMAAAALHYGWRAGMMIAGCMAIVVGIFLCWRLRDRPQALGLPAVGEWRHDALEIAQQQEGAGLTRKEILTKYVLLNPYIWLLSFCYVLVYVVRAAINDWGNLYMSETLGVDLVTANTAVTMFELGGFIGALVAGWGSDKLFNGNRGPMNLIFAAGILLSVGSLWLMPFASYVMQATCFFTIGFFVFGPQMLIGMAAAECSHKEAAGAATGFVGLFAYLGASLAGWPLAKVLDTWHWSGFFVVIAIAAGISALLLLPFLNAQTPREA

SEQ ID NO: 1662 - protein, 387 aa, Clostridium perfringens str. 13
MAKRDYYEVLGLQKGASDDEIKRAFRKMAMKYHPDRNPGDKEAEENFKEVNEAYDVLKDPDKKAKYDQFGHAAFDGSGGFGGGGFGGFDAGGFDFSEMGGFGDIFESFFGGGFGGGSSRRRNAPQRGADLEYRLNITFEEAVFGCEKEISITRTENCETCHGTGAKAGTSPKTCPKCNGSGQIRVQRQTPLGSFVSTTTCDQCGGTGKVIEDPCPDCKGKGTVRKNRKITVKIPAGVDTGNIIPLRGQGEQGANNGPAGDLYIRVNVAPSKIFRREGSDIYYDYKISMAKAALGAEITVPTVDGNVKYKVPAGTQPGTKFRLKGKGVPHVNGGGRGNQYVHMVVEVPKHLNKEQEEALKAFMKASGESVDDIDEKDEGFFSKFKKKK

SEQ ID NO: 1663 - protein, 408 aa, Arabidopsis thaliana
MASIAAPQSDHISMLSKFFAIYTSFSAIMIIVRNIINEIVPQKIRDYITVKFVDLFSSYFHRISFVIDHTFRAAKVYLKTRLAGLSTGEILVGSSDLKNPTAEPNLGIPPNTKIVDEFEGIHLEWTLHSLETKSYPYEKKYFHLTCKKEFREKILKDYETSQRSPIFEHHTTFETLAIEPKRLLKSVGRAWKRGYLLYGPPGTGKSSMVAAIANHMNCNIYDLQIQSVKDDAELRRVLTATNNRSILLIEDIDCGTDSSRRRQTKNEEDDKISLSGLLNFVDGLWSSCGEERIIIFTTNYKEKLDPALLRPGRMDVHILMDYCTPFVLKKLVAMYLKIDDHVLFDPIEKLVLEVSVTPAEVAQQLMVSKNTDIALKGLIEFIEKKKIEKEEVTKVEEEGEIEDAETNE

SEQ ID NO: 1664 - protein, 473 aa, Brassica napus
MSATLTGSGTALGFSCSSKISKRVSSSPSTRCSIKMSVSVDEKKKSFTLQKSEEAFNAAKNLMPGGVNSPVRAFKSVGGQPVLIDSVKGSKMWDIDGNEYIDYVGSWGPAIIGHADDEVLAALAETMKKGTSFGAPCLLENVLAEMVISAVPSIEMVRFVNSGTEACMGVLRLARAFTNKEKFIKFEGCYHGHANAFLVKAGSGVATLGLPDSPGVPKAATSDTLTAPYNDIEAVAKLFEAHKGEISAVILEPVVGNSGFITPTPEFINGLRQLTKDNGALLIFDEVMTGFRLAYGGAQEYFGITPDLTTLGKIIGGGLPVGAYGGRRDIMEMVAPAGPMYQAGTLSGNPLAMTAGIHTLKRLKQPGTYEYLDKITKELTNGILEAGKKTGHPMCGGYISGMFGFFFAEGPVYNFADAKKSDTEKFGKFFRGMLEEGVYFAPSQFEAGFTSLAHTSEDIQFTISAAERVLGRI

SEQ ID NO: 1665 - protein, 439 aa, Desulfitobacterium hafniense Y51
MCMDTSFLLAGKEEVFCFTKKGGQPMIREVQIHERLSLAQTIPLGLQHVFAMFGATVLVPFLTGLSPAVALLSSGIGTIVFLLLTKSQIPAYLGSSFAYIASLTYFVKDQNNLAAAMGGALVIGIIYVLLFALMSYFGSSWIHKIVPPVVAGPVVAIIGLSLTPTAAGMASEQWYIAIFTLAVTAFLSIYAKGFLKIIPILAGIVIGYIVAAFAGLVDFTAVTASVSVDSWDKIIVSPINADTWQAPVFNKAAILMFAPLAFVTIIEDLGHMIVLGNITHSDPIEKPGFNRVLLGNGLATGIASFLGGPPVTTYGENIGVLAVTRVYSTFNIWVAAFIAIILSFVNPLQALIMSIPTAVMGGVSLYLFGMIGVTGLRTLIEARVDFSKNKNLIIASVIFAVGIGVQSHGVAYATLAGIILNLVLREEKDEVAGSGKEVS

SEQ ID NO: 1666 - protein, 154 aa, Triticum aestivum
EEKTQYYPGKEIKRRKRHRRKQYVDQEPCIMRGVYFKNMKWQAAIKVDKKQIHLGTVGTQDEAARLYDRAAFMCGREPNFELSEEEKQELRKYTWEGFLAVTRNTITSKKQRKVGLPRRSKADLFMGQSDGDTEMANGGGSSNSDNGDAETSAS

SEQ ID NO: 1667 - protein, 463 aa, Pseudomonas putida KT2440
MDKQKQDLISQQDRGAVLHPFTQLKDFASGKAGDPTIIETAKGITITDATGREYIDGFAGLYCMNVGYGRTEVAEAISKQAHKLAYYHTYAAHTTEELARLSDRLVKMAPGKMSKVFYGMSGSDANETQAKLVWYYNNLRGKPNKKKIIARERGYHGCSVVSGSMTGMSFYHDHMDLPIAGILRTGAPHYYWGAEPGETELEFSARRARELEELILREGPDTIGAFIAEPVLGTGGITPPPEGYWAAVQPVLKKYDILLIADEVITGFGRTGAMFGCDKYGIEPDLITVAKGLTSAYAPLSASIVGEKVYKVMEEGADRVGAFSHGYTYSGHPIGVAAANAVLDIVEGENIPAHVDKVGQYFQKSMQETFSSLPIVGEVRGVGMMAAIEFVADPATKKRFDPALKVGARISKAARDRNLIARAMPHGEILGFAPPLVTTEQEVDRIISIAHEAVLSVLDELKV

SEQ ID NO: 1668 - protein, 279 aa, Mycobacterium bovis AF2122/97
MTTTRTERNFAGIGDVRIVYDVWTPDTAPQAVVVLAHGLGEHARRYDHVAQRLGAAGLVTYALDHRGHGRSGGKRVLVRDISEYTADFDTLVGIATREYPGCKRIVLGHSMGGGIVFAYGVERPDNYDLMVLSAPAVAAQDLVSPVVAVAAKLLGVVVPGLPVQELDFTAISRDPEVVQAYNTDPLVHHGRVPAGIGRALLQVGETMPRRAPALTAPLLVLHGTDDRLIPIEGSRRLVECVGSADVQLKEYPGLYHEVFNEPERNQVLDDVVAWLTERL

SEQ ID NO: 1669 - protein, 277 aa, Zea mays
MAMPFARRDIEAAGAGASSDDSPAAKKGKPELAGARPALTRSEAFAFAAVLALFTAGIFCVFLTAPRGEFGQILRLPRSLADVRLLKDNLAVYARDYQTNFILGYCSIYIFMQTFMIPGTIFMSLLAGALFGVIKGGILVVFTATAGGSSCYFVSKLIGRPLVSWLWPEKLRYFQSEIAKRKEKLLNYMLFLRITPTLPNTFINMASPIVDIPFHIFFAATLVGLIPASYITVKAGRALGDLKSVRELYDFKTLVVLFLIGSVVVVPTILKRKRTYE

SEQ ID NO: 1670 - protein, 629 aa, Medicago truncatula
MKGRRGKRSEAFWPSIVMKKWLNIKPKVNDFSEDEVDTETESEDDVCSPKQPRMQISDDSPFRTQGTQSIFSSQISDTSFKKGCKTRHRRGKSETLRAQYINTKEVRVAIGSWNVAGRHPSEDLDIDDWIYAEEPSDIYIFGFQEVVPLNAGNVLGAEDNTPIQKWEAIIRRSLNKSSEPDSKHKSHSAPPSPVLRTSSAADVLADNIDAANPIDMLNDELMENVDKYDLQQLEESNIISIGNDLHVRKVYGIDLDWPERPLDAISQIVDSNPKLRRVLSSSARIGFDLNENAFLYGGGGGGGLKRTHHSSGNLGSLLKEQQVIPKVVDSLDDVSEMLSDDGDDAFIELPENQDDDELGTTKSQARYVRIISKQMVGIYVSVWVQRRLRRHINNLKVSPVGVGLMGYMGNKGSVSISMSLFQSRMCFVCSHLTSGTKDGAEQRRNSDVNEILRRTCFSSVFATDQALTIPSHDQIFWFGDLNYRISMLDSEVRKLVAQKKWNELLNYDQLSNELRVGHVFDGWKEGLINFAPTYKYEINSDRYVGEIPKEGEKKRAPAWCDRILWLGKGIKQLNYERAEIKLSDHRPVSSIFLVEVEVFDHRKLRRALNFTNTAAVHPEIFPDEDGQFF

SEQ ID NO: 1671 - protein, 274 aa, Glycine max
KWNFSELNLLGKSNATYKGVLRDGSVVAVKSISKTSCKSDEAEFLKGLNILTSLRNENLVRLRGFCCSRGRGECFLVYDFVSNGNLSCYLDVKEGDGEVLEWSTRVSIVKGIAKGIAYLHAYKAKKQALVHQNISAEKVLIDQRYNPLLSDSGLYKLLTNDIVFSALKGSAAKGYLAPEYTTTGRFTEKSDVYAFGVLLFQILTGKQKITSAMRLAAESFKFPEFIDPNLRGKFFEYEAAKLARMALLCSHESPFERPSMEAIVQELGNCSSCL

SEQ ID NO: 1672 - protein, 152 aa, Zea mays
MTMKLDVPARQKSQDAEQNGRTAAAGVLGIDEPWSQPKLRHPGDAQADADALVPPLNFAMVDDGIFRSGLPDAGSFRFLLSLNLRSVVYLCPEPYPEENARFLQQNGIQLHQFGIEGSKEPFVYIPEEIIREALKVILGTGNFTDTIPLHFY

SEQ ID NO: 1673 - protein, 773 aa, Arabidopsis thaliana
MDEDGNLQISNSNYNGEEEGEDPENNTLNQPLLKRHRTLSSTPLALVGAKVSHIESLDYEINENDLFKHDWRSRSKAQVFQYIFLKWTLACLVGLFTGLIATLINLAVENIAGYKLLAVGYYIAQDRFWTGLMVFTGANLGLTLVATVLVVYFAPTAAGPGIPEIKAYLNGIDTPNMFGFTTMMVKIVGSIGAVAAGLDLGKEGPLVHIGSCIASLLGQGGPDNHRIKWRWLRYFNNDRDRRDLITCGSASGVCAAFRSPVGGVLFALEEVATWWRSALLWRTFFSTAVVVVVLRAFIEICNSGKCGLFGSGGLIMFDVSHVEVRYHAADIIPVTLIGVFGGILGSLYNHLLHKVLRLYNLINQKGKIHKVLLSLGVSLLHQLLFGLPFLANEACDPTIDEICPTNGRSGNFKQFNCPNGYYNDLSTLLLTTNDDAVRKHFLFKHSYEFGMVSLWIFFGLYCILGLITFGIATPSGLFLPIILMGSAYGRMLGTAMGSYTNIDQGLYAVLGAASLMAGSMRMTVSLCVIFLELTNNLLLLPITMFVLLIAKTVGDSFNLSIYEIILHLKGLPFLEANPEPWMRNLTVGELNDAKPPVVTLNGVEKVANIVDVLRNTTHNAFPVLDGADQNTGTELHGLILRAHLVKVLKKRWFLNEKRRTEEWEVREKFTPVELAEREDNFDDVAITSSEMQLYVDLHPLTNTTPYTVVQSMSVAKALVLFRSVGLRHLLVVPKIQASGMSPVIGILTRQDLRAYNILQAFPHLDKHKSGKAR

SEQ ID NO: 1674 - protein, 480 aa, Ehrlichia ruminantium str. Gardel
MLNVFSHIFSILGIFSVLVRYNVLPYTYLLAKRSVRKRPKGEKITMALQKLGPIFIKFGQSISSRGDIIGEEIANHLLFLCDKLPAFSYSDVVRTIEEDFKCAISEIFCEFDEVPVAAASISQVHKAKDIDGNIRAVKILRPKIDQIFEKNIKLMFWIAKIAQHFQSLRRFQLLELVQTFHEICKMEIDLRFEAANADELRGNMQDDSACYIPQVDWNRTTRRVLTLEWVDAIPIYNFYNLENNEALVKNLIFCFCNQVYRDRLFHADMHPGNLMVDTNGKIVIIDFGIVGRLDKATCMYVTEILVGFIKRDYQYVADVHYRAGYVDAKYSSFITACRAIGEPIVGKNTDNISIAALLSQLFKVTADFDMKLQPQLFLLQKTTVLVEGVCRQLSPSINMWKVAELWMEKYAVDKNKYLKKLRKSCLYQTMYDVTSFMKKVDRSLDIINNYDEINHSKYSISRDLMWAIIVIILVIKIIIG

SEQ ID NO: 1675 - protein, 469 aa, Arabidopsis thaliana
MSSRSDLKIKRVSLIIFLLSVLVEFCYGGFTSEYVRGSDLPDDMPLDSDVFEVPPGPNSPQQVHVTQGNHEGNGVIISWVTPVKPGSKTVRYWCENKKSRKQAEATVNTYRFFNYTSGYIHHCLIDDLEFDTKYYYEIGSGKWSRRFWFFTPPKSGPDVPYTFGLIGDLGQTYDSNSTLSHYEMNPGKGQAVLFVGDLSYADRYPNHDNNRWDTWGRFVERSVAYQPWIWTAGNHEIDFVPDIGEIEPFKPFMNRYHTPHKASGSISPLWYSIKRASAYIIVMSCYSSYGIYTPQYKWLEKELQGVNRTETPWLIVLVHSPFYSSYVHHYMEGETLRVMYEQWFVKYKVDVVFAGHVHAYERSERVSNIAYNIVNGLCEPISDESAPIYITIGDGGNSEGLLTDMMQPQPKYSAFREASFGHGLLEIKNRTHAYFSWNRNQDGNAVAADSVWLLNRFWRAQKKTWLDAF

SEQ ID NO: 1676 - protein, 495 aa, Rhizobium leguminosarum bv. viciae 3841
MNLNQHSPHPDHDSFELSAFSRGLYIGGAWRPAAGEARIEVIDPSTEAVITAVPDATLADAAAAVEAAARAAESWRETPPRKRSEILRRCFELMVERSETIARLISLENGKALRDARGEVAYAAEFFRWNAEEAVRISGEFGLAPAGGNRIVVDYQPIGICVLITPWNFPAAMATRKIAPALAAGCTVILKPASETPLTAYALAALYEEAGVPPGVVNVMTTSTPGPVIAAMLADPRVRKLSFTGSTGVGRTLLAEAAKNVISCSMELGGNAPFIVFDDADIDAAIEGLMVAKMRNAGEACTAANRIYVQSGIHDAFAEKFTRRMAALNVGPGADTDTECGPMITRKAVEKIERLVTDAISRGARALCGGRTLADRGFFYPPTVLVDVSPASDMGCEEIFGPVAPLYRFESEAEVIAAANDTEYGLAAYIYTRDIGRGMRVASKVEAGMIALNRGLVSDPAAPFGGVKQSGLGREGGQHHGIAEFMEAKYIATSF

SEQ ID NO: 1677 - protein, 142 aa, Ashbya gossypii ATCC 10895
MRRLTQTATVLARSMSSLTPVRTTAAPPPAASYSQAMRANGMVFVSGQIPYTPDNKPVEGSVADKTEQVIANVRNVLEASNSGLDRVAKVNVFLADMAYFAEFNSVYAKYFGEHKPARSCVAVRALPLNVDLEMEVIALERD

SEQ ID NO: 1678 - protein, 159 aa, Prochlorococcus marinus subsp. pastoris str. CCMP1986
MSEFSAFFDNSVLFWSLLACLIAQFLKIIFNFFATGKVRFEIMFETGGMPSSHSALITGATSGIGFQLGFDNPIFALAIALSLIVMYDASGVRKSAGIQAAEINKLSKKLDPKSQVALKETLGHTKFEVIIGSLLGPIITLPGIVFIGSPLNIIDLIIN

SEQ ID NO: 1679 - protein, 207 aa, Ashbya gossypii ATCC 10895
MHCSQPEGVDQRIGHMDIAQFPTDKLLEMLTGLLYKIIKSNDRLKPFDQEKHDINNKYVAHVLSFRGKHIPTITLGDYFARIQKYCPITNDVFLSLLVYFDRIAKRCNALDPQLFVMDSYNIHRLIIAAVTVSTKFFSDFFYSNSRYARVGGISLEELNRLELQFSILCDFELIVSIQELQRYADLLYKFWHREHLAKASTNAAVPH

SEQ ID NO: 1680 - protein, 773 aa, Arabidopsis thaliana
MSGFSSGNVNSRVVDILSGVVPLLKLICLTVIGLLLAHPKTQLVPRATFRLLSKLVFALFLPCLIFTELGESITLDNIVQWWFIPVNVLLSAVVGSLIGYLVVLICRPPPEFNRFTIVMTAFGNTGNLLLAIVSSVCHTKTNPFGPNCNSRGVSYVSFAQWVAVILVYTVVYHMMEPPLEYYEVVEEEGVEIEEINVENHDASRPLLVEAEWPGIEDKETEHCKTPFIARVFNSISSFSQTSFPEVDLGGEYGGESSSPRSIQCLAEPRVMRRIRVVAEQTPVKHILQPPTIASLLAIIIGSVPQLKSVVFGYDAPLSFITDSLNIMGSAMVPSVMLVLGGMLSEGPNESTLGLRTTIGISVARLLVLPLVGIGIVMSADKLGLISSADPMFKFVLLLQYSTPSAILLGAIASLRGYAVREASALLFWQHIFALLSLTFYIVIFFKLTVETTVQEKRVNFLECESFNYSFREKINHFGFVEESRSDFMEMSEWKFCAFKSQSKSRTMGSAFDPLVTATEDLAAVNSAPPLSNLTQEELKKIAAYKAVEFVESGMVIGLGTGSTAKHAVARISELLREGKLKDIIGIPTSTTTHEQAVSLGIPLSDLDSHPVVDLSIDGADEVDPALNLVKGRGGSLLREKMIEGASKKFVVIVDESKLVKYIGGSGLAVPVEVVPFCCDFTRGKLEELFRDSGCVAKLRMKIGSNGEEAAPAVTDNRNYVVDLYLERDIGDLEVASEAILRFPGVVEHGMFLGMATTLIVAGKFGVTVKDRFG

SEQ ID NO: 1681 - protein, 163 aa, Brassica napus
MHSVLQLLLLLLITTVTISIPVFAENDSIYDVLRAHALPMGLLPKGVKEFNVDVETGHFSVFLNQSCKAKYESEIHYEANITGTIGYGSIGGLTGVSAQDLFLWFPVKGIRVDIPSSGVIYFDVGVVRKRYPMSLFETPRDCVAVVEKVWTLVLPSLNLLSAL

SEQ ID NO: 1682 - protein, 153 aa, Brassica napus
MSLASPIQCIRILNPSSSSSTTSSSFRFSTIKPCVFVIRCSQAEGPLRRPSAPPTLREPSPPQKPVPPVPSSSPPPSPPLQKTVAVDGKGVVTVEFQRQKAKELQEYFKQKKLEAAGQGPFFGFQPKNEISNGRWAMFGFAVGMLTEYATGSD

SEQ ID NO: 1683 - protein, 730 aa, Arabidopsis thaliana
MTRDSSRNSSLKPWPRKKFLFPSVVIVIVGIIVAFTYQSKLKPPPPKLCGSSGGPPITAPRIKLQDGRYLAYKEHGLPREKANRKIVFIHGSDCCRHDAVFATLLSPDLVEELGVYMVSFDRPGYCESDPHPSRTPRSLVSDIEELADQLSLGSKFYVLGYSMGGQAAWGCLKYIPHRLAGVTLVAPVVNYYWKNLPLNVSTEGFNFQQKRDQLAVRVAHYTPWLIYWWNTQKWFPGSSIANRDHSLLAQPDKDIISKLGSSRKPHWAEVRQQGIHESINRDMIVGFGNWEFGPLDLENPFLNKEGSVHLWQGDEDMLVPAKLQRYLAHQLPWVHYHEVPRSGHFFHYTKGVVDDIVKSLLTSDSKLKPPQPKLCGSSSGPPITAPRIKLQDGRYLAYKEHGLPREKANRKIVFIHGSDCCRHDAVFATLLSPDLVEELGVYMVSFDRPGYCESDPHPSRTPRSLVSDIEELDDQLSLGSKFYVIGKSMGGQAAWGCLKPLSNKDHPLKPIKTNGPIGHNHWALDSPIDTSSLKYIPHRLAGVTLVAPVVNYYWRNLPLNVSTEGFNFQQKRDQWAVRVAHYAPWLIYWWNTQKWFPGSSIANRDSLLSQSDRDIISKRGYTRKPHWAEVRQQGIHESINRDMIVGFGNWEFDPLDLDNPFLNNEGFVHLWQGDEDMLVPVKLQRYLAHQLPWVHYHEVPRSGHFFHFTKGVVDNIVTTLLTTDTDTIRQ

SEQ ID NO: 1684 - protein, 179 aa, Brassica napus
  misc_feature (10)..(10): Xaa can be any naturally occurring amino acid
  misc_feature (19)..(19): Xaa can be any naturally occurring amino acid
  misc_feature (22)..(22): Xaa can be any naturally occurring amino acid
  misc_feature (25)..(25): Xaa can be any naturally occurring amino acid
  misc_feature (84)..(84): Xaa can be any naturally occurring amino acid
  misc_feature (131)..(131): Xaa can be any naturally occurring amino acid
  unsure (1)..(179): unsure at all Xaa locations
NWVNSRTWLXSKKDSKVRXFLXGDXSGGNIVHNVALKAGEAGIDVLGNVLLNPMFGGEERTESEKRLDGKYFVTVRDRDWYWKXFLPEGEDREHPACNPFGARAKSLRGLRFPKSLVVVAGLDLIQDWQFXYAEGLERAGKEVRLVHLEKATIGFYLLPNNSYFHSVMDEIAAFVNAES

SEQ ID NO: 1685 - protein, 490 aa, Pseudomonas putida KT2440
MKDLAPSALNKLRRNDLLETRAYIDGRWVTGEGSLDVTDPANDQVIAQVAHCDESWVDLAVEAASRAFDGWRNTLPTQRGAVLRKWAALMRENQEDLAVIMTCEQGKPLSESRGEINYGANFVEWFAAEGERCYGETIPSHLPNSQLVTKLQPIGVTVAITPWNFPSAMITRKAAAALAAGCPMIVKPAPETPLSALALARLAEEAGIPGGVFQVLTGDAPKMSARLLAASAVRAFSFTGSTEVGRILLRQSADTVKKVSLELGGHAPFIVFDDASIAEAVEGCIGAKFATSGQDCLGANRIYVHRNIYGQFVEEFTKATEKLRVGHGLEEGVDIGPMTRVTVANKCREQISNALSLGAKLTCGGIDNHLGSSFVLPTVLADVTDKMDIAFEETFGPVAAILPFDSEDEVVTRANNTEFGLAAYVYTNDLRRACRVSDRLEYGMVALNTPKFTGAPIPFGGWKQSGLGREGSKHGLAEYMELKYVCIGGL

SEQ ID NO: 1686 - protein, 711 aa, Streptococcus pyogenes MGAS315
MMSKLVFFWQNREKEFRDFGGFSEKSVYFCDTIDNRKRLILVVINREVLLMTFDAIDQLAVNTVRTLSMDAIQAANSGHPGLPMGAAPMAYVLWNHFMNINPKTSRNWSNRDRFILSAGHGSAMLYSLLHLAGYDLSVEDLKNFRQWGSKTPGHPEVNHTDGVEATTGPLGQGIANAVGMAMAEAHLAAKFNKPGFDIVDHYTFALNGDGDLMEGVSQEAASMAGHLKLGKLVLLYDSNDISLDGPTSMAFTEDVKGRFEAYGWQHILVKDGNDLEEIAAAIEAAKAETEKPTIIEVKTIIGFGAEKQGTSAVHGAPLGAEGIAFAKKAYQWTHQDFEVPAEVTERFAQGLQARGEKAEQAWNDLFAAYEAEYPELAAEYQKAFTNEAAQVELEAHELGSSMASRVSSQQAIQQISEQVASFWGGSADLSASNNTMVKAETDFQPGHYEGRNIWFGVREFAMAAAMNGIALHGGTRVYGGTFFVFSNYLLPAVRMAALQNLPTVYVMTHDSIAVGEDGPTHEPIEQLASVRSMPNLNVIRPADGNETNAAWKRAIAETDRPTMLVLTRQNLPVLEGTKELAEDGLNKGAYILSEAKGDLDGILIATGSEVKLAMDTQEALEAEGIHVRVVSMPSQNIFDEQSAEYKESILPAAVTKRLAIEAGSSFGWAKYVGLAGKTLTIDTWGASAPGNRIFEEYGFTVANATELYKSL

SEQ ID NO: 1687 - protein, 157 aa, Glycine max
MASSLVSCSLGLNPKMFDLHTSYGGSCGLIQPCYDTFGLNESISLSHSHMHGRENSPSNSSSKTSSFVSEVATKKRPSNCSLPKESEAKVKKSRPSCPPLKVRKEKLGDRIQTLQRLVAPFGKTSTAYVLSEAIGYIHFLHQQIQTLSIPYMKSAQS

SEQ ID NO: 1688 - protein, 546 aa, Erwinia carotovora subsp. atroseptica SCRI1043
MTPSELRRLYSIVRVLLSYGLDELIPKMRLTFPLRVGRRLLFWLPNRHRNMPLGERLRLALQELGPVWIKFGQMMSTRRDLFPPAIADQLAMLQDKVEPFDGKLAREQIELAMEGIPLEEWFDDFDIKPLASASIAQVHTARLKSTGKEIVIKVIRPDILPVIKADMRLMKRLAGWLPRLLPDGRRLRPREVVMEYEKTLLDELNLLREAANAIQLRRNFENSPMLYVPEIYSDYCRESMLVMERIYGIPVSDVDALKANGTDMKLLAERGVQVFFTQVFRDSFFHADMHPGNIFISYDHPEDPQYIGIDCGIVGSLNKEDKRYLAENFIAFFNRDYRKVAELHVDSGWVPPDTNVADFEFAIRTVCEPIFEKPLAEISFGHVLLNLFNTARRFNMEVQPQLVLLQKTLLYIEGVGRQLYPQLDLWKTAKPFLESWLKQQVGLPAVFRALKEKAPFWAEKLPEIPELFYDGLRQHKMLKQSVDKLAYELRTQQARQGQSRYLLGIGATLLIGGTLLLISRVEADMVPTGLIAAGIVAWIIGWRRTR

SEQ ID NO: 1689 - protein, 302 aa, Triticum aestivum
NKFVQKSRLVPVRNSRDIVDPRVRLNQDGLHGPSTTYPDSTTKDNDDMQSVLSLDDGRWSAPAEECTSTPSASLEGELSQLNIRQPSPPPVLAEVHPDRAPAISPSRVGDPTQGLAISETGRYHNLHVPVKLMECFLRVAEANTKRSLETCGVLAGTLKKRTFHITTLIIPKQKSTSDSCEATNEEELFEVQDKGSLFTLGWIHTHPTQSCFLSSIDLHNHYSYQVMLPEAIAIVMAPTDTRKKHGIFHLTDPGGIGVIHDCPERGFHPHKAPLDGSPIYEHCSHVYMNADTKFDMIDLREQ

SEQ ID NO: 1690 - protein, 559 aa, Aspergillus oryzae
MRSVFVNSPVRLGRISRPLLSSTYPVSQSSFVQCKRCLATQADHSAAIPESDRGKERVVILGSGWGGYTLSRKLSSKSFSPVIISPRSYFVFTPLLTDAAGGSLDFSNIVEPVRDPHAKVDFIQAAARAVNLEKKTVLCESTVVTSGVTETPRTHENERESEEGPDTTSMRPMQEARKWEKGDFFEVPYDKLVIAVGAVSKTFNTPGVRHNAMFFKDIGDARRVRRRVRECFELAVLPTTTPEMRKWLLHFAIVGAGPTGTELAASLRDFIYKDMTILYPALKDLPRITLYDVAPKVLSMFDESLSKYAMETMKKEGIDIKTSHHVEGLRWGEPGAEPPYEMDPKRCLTITTKEEGEVGIGMCVWVTGNAMNKFVNKALQDVETFPTASTLLKDGTHPPPELTKDTTWHIKKAPKVGALLVDGQLRVQLENADGKIAVYQDVFALGDNAMPETGAPPATAQATTQEAKWLATRLNKGDLQTSQPFSFHNMGTLAYIGDANALMQFPTEDDKPPKYLTGRMAWFVWNSAYLTMSMSWRNKLRIAFRWLLNNIFGRDVSRY

SEQ ID NO: 1691 - protein, 489 aa, Burkholderia xenovorans LB400
MAVFAIQRLYIGGAYVDATSGETFDTLDPATGETLASVQQASAADVERAVQSAREGQREWAALTAMQRSRVLRRAVEILRERNDELAALETRDTGKPIAETLAVDIATGADVIEYYAGLATAIEGQQIPLRPTSFVYTRREPLGVCAGIGAWNYPIQIACWKSAPALAAGNAMIFKPSEITPLSALKLAEIYTEAGVPAGVFNVVQGDGRVGAMLAAHPDIEKISFTGGVETGKKVMSLAGASSLKEVTMELGGKSPLLVFDDADLERAADIAMSANFFSSGQVCTNGTRVFVQRGVLERFEALVLERVKRIRVGAPTNAATNFGPLASAAQLQKVLGYIESGKQEGARLMAGGKRLTEGHFGNGQYVEPTVFTGCHDDMRIVREEIFGPVMSILVFDDEDEAIARANRTAYGLAAGVVTGNLARAHRVIHRLEAGICWINTWGESPAEMPVGGYKQSGVGRENGLTTLEHYTRIKSVQVELGPYQPVF

SEQ ID NO: 1692 - protein, 305 aa, Ehrlichia ruminantium str. Gardel
MIKNIEVLQMNSERLKGVFTALVTPFKNDFSVDQDAFTQLIEYQISNNVHGLVPCGSTGESTTLTFEEYCEIIKLCIKTTNNRVPIIAGSGSCSTQETIKRTLFVNSLNVDAALVVVPYYNRPTDEGIYQHFKAVHDATNIPIIIYNIPKRTGVDVSDTLLARILSLPRVIGVKDATCDISRPLNLKTLVQKDIVLFSGDDFTCLAFNAHGGSGCISAVSNVAPKICSDMQSAFFSNNIKEAIEISKTILKLSQALFCESNPSPAKYALSLITEYISPIVRLPLVELTQENKLKVENTLKELGFI

SEQ ID NO: 1693 - protein, 250 aa, Pseudomonas aeruginosa UCBPP-PA14
MTAPFKDHFSTGSANYAAHRPTYPARLVDELAALCPGTRLALDCGCGTGQLTVLLAERFERVVGTDASAAQIDKAQARERVEYRVSLAEDSGLAAASADLVTVAQAAHWLDLPRFYEEVRRVARADAILALVTYGVLHVDGPMEPLVQHFYHQVVGPYWPAERRHVEEGYRNLPFPFEERRLPDLAIEVAWTLDELLGYVGTWSAVKEAGKALGQDPGAAFVDELREAWGDPQTRYRVSWPLTVRAGVIR

SEQ ID NO: 1694 - protein, 399 aa, Burkholderia xenovorans LB400
MSSNRGVVYLGQGKVEVQSIDYPKMVDPRGRSIGHGVILKVVSTNICGSDQHMVRGRTTAEVGLVLGHEITGEVIEIGRDVETLKIGDLVSVPFNVACGRCPTCKAQHTGVCLNVNPSRAGGAYGYVDMGGWIGGQAEYVMVPYADFNLLKFPDRAQALSKIRDLTCLSDILPTGYHGAVMAGVKPGATVYIAGAGPVGMAAAASARLLGAACTIVGDMNEERLAHARKMGFQTVDLSKDATLGEQIEQILGKPEVDCAVDCVGFEAHGHGSSGSHEEAPAIVLNSLMEITRAAGAIGIPGLYVTDDPGAADAAARKGSLSIRFGLGWAKSHSFHTGQTPVMKYNQNLMQAILWDRLPIADIVNVTVVSLDQAPDGYRQFDGGAPKKFVIDPHGLLKAA

SEQ ID NO: 1695 - protein, 309 aa, Bacillus licheniformis ATCC 14580
MFLHHITEILPDTIKRALSGLGDHEIDQIEEIRVRTSRPLELVNKGKPRFLPYVATPEDSALLLNRLGNYSMYTLEEELKKGYVTIRGGHRVGLAGRVVVENGAVKGIREISSFNIRIAKEKIGISKPYVPHLFQNSWLNTLIIGPPQTGKTTLLRDLARLISSGSGNAPAKKVGIVDERSEIAGCVNGIPQYRLGDRADILDACPKAEGLMMMIRSMSPEVMIADEIGRMEDAEALLEAVHAGVTVIVSAHGYTYADLARRPSLKMLQEHRVFERIVELSRKNGPGSLSRILNGNGEPLGAAKRMLSC

SEQ ID NO: 1696 - protein, 289 aa, Triticum aestivum
MAMSDLAAAVISKANGGVDGEEPVEIREVWADNLEAEFALIRDVVDEFPFVAMDTEFPGIVCRPVGAFRSPADYNYATLKANVDMLHLIQLGLTFSGPTGELPALGAGRRRCVWQFNFREFDDERDIFATDSIELLRHSGIDFRRNAERGVDARRFAELLMSSGVVLNDAVYWVTFHAGYDFGYLLKILTCNSLPDTQAGFFKLMKIYFPTVYDIKHLMKFCNSLHGGLNKLAELLDVERVGESHQAGSDSLVTSCAFWKLKDSFFAGSTEKYAGVLYGLNAENGVSAH

SEQ ID NO: 1697 - protein, 458 aa, Rhizobium leguminosarum bv. viciae 3841
MYSNSLIELDRAHLIHPVASYRGHEKLGVRVLASAKGATVTDASGKQLIDGFAGLWCVNAGYGHESIVEAAARQMRELPYATAYFGLGSEPAIRLAGELADRAPGDLNHVYFTLGGSDAVDSTIRFIRYYWHARGRPERDQFISVEQGYHGSSTVGAGLTALPAFHAGFGVPFDWQHKIPSHYAYRNPVGDNPEAIINASLAALKSKVEAIGPERVAAFYVEPIQGSGGVLVPPKGWMKAMREFCRSHDILFVADEVITGFGRTGPLFACTEDEVVPDFMTTAKGLTSGYVPMGAVLMADHVYETIAEGAGAAAVGHGYTYSAHPVSAAVGLEVLKLYENGLLENGLRAGARLMQGLDSLRDHPLVGDVRGRGMLAAVELVVDKVNKTPLPASAEPARRIFDRAWENGLVIRAFGNGVLGYAPPLCCTETEIDAIVERTRMTLDETLEDPDVRRALQA

SEQ ID NO: 1698 - protein, 204 aa, Acinetobacter sp. ADP1
MTERSPLRVGIGGPVGSGKTALTLNLCRALRNKYNMAVVTNDIYTKEDSNFLTRNEAMTPDRIVGVETGGCPHTAIREDASINLAAIDDLCEKFDGLELIIIESGGDNLAATFSPELSDLTLYVIDVAGGEKIPRKGGPGITKSDLLIINKTDLAPMVGANLDVMEQDAKRMRGEKPFLFSNMKTEDGLTQIIEFIEKQGLFKA

SEQ ID NO: 1699 - protein, 431 aa, Bacillus cereus G9241
MSTIIDVYAREVLDSRGNPTVEVEVYTESGAFGRAIVPSGASTGEHEAVELRDGDKSRYLGKGVMNAVNNVNEAIAPEIVGFDVTDQAGIDRAMIELDGTPNKGKLGANAILGVSMAVAHAAADFVGLPLYRYLGGFNAKQLPTPMMNIINGGSHADNNVDFQEFMILPVGAPTFKESIRMGAEVFHALKAVLHDKGLNTAVGDEGGFAPNLGSNREALEVIIEAIEKAGYKAGENVFLGMDVASSEFYNKETGKYDLAGEGRTGLTSAEMVDFYEELCKDFPIISIEDGLDENDWDGHKLLTERIGDKVQLVGDDLFVTNTQKLAEGIEKGISNSILIKVNQIGTLTETFEAIEMAKRAGYTAVVSHRSGETEDATIADIAVATNAGQIKTGSMSRTDRIAKYNQLLRIEDELGEIAVYDGVKSFYNIKR

SEQ ID NO: 1700 - protein, 513 aa, Candida glabrata CBS 138
MEYQPGKRASVSFGSPSHSVHQSYTTSPFSSGVNLATTAEGVPNNTGGSGSGANGEDVFMTNRSPMYSPLDFLHPLYSPNYSQLHQIRAGLNNTLKNMNQGVVCEYGAHFPLYGVDWSIEDYVCIGSYKEDSRNKLQVIHSPDLFKWDNVAECDVIYPVSNIQWMPSAFRSRKIATASDSLRIWSLNTEENKLEEQLNLSLCKFHKQHPNNKAFVGLSQIPTKTSDVNPSVLGEFPPITSFHWNPVDTNILISSSIDTTCIVWDLQSSNYVKTQLIAHDSEVFDVRFLTQSTQLFASCGGDGSVRVFDLRCLAHSTIIYEPPASEPGTGNNSSRSDSTDENSHALLRLEPSPHDPNVLATFAIASNEILILDMRNPDSPLVVLNGHSASINQIKWHPTKKNTLISCSDDCQVLFWDISSYFDQGAVSHTTTPRPAASGASMEVDSEGDYSYDDSASKTSSIKATKPLSKDLDVPTMCYSNKTHEINNIVWRPQRGDWFGCVSGKKFQNVRTPL

SEQ ID NO: 1701 - protein, 112 aa, Bacillus clausii KSM-K16
MSGLTTHVLDIGHGVPARGVTVALYRLQKGEWKAIATAATNADGRIDSPFLTVEPLPGEYQLVFHIGEYYAKREVETFLSTVPVRFVLSSPQEHYHVPLLVSPWGYQTYRGS

SEQ ID NO: 1702 - protein, 80 aa, Brassica napus
MLTVDKDLKPLSVPVRVGQAVDVVGQAGRPKTITGFQTHSPPVLLAAGERAELATDKYIPLSPILEGFIILEENPDYREE

SEQ ID NO: 1703 - protein, 341 aa, Bacillus clausii KSM-K16
MVSLRSVHQTTERVGVEVENKRTMSYGKGNVFAYRTFMEPLSGLQPIPESAFTVRDNTVFGINVTVEVGGNAFLSSFTDGDNQMVVATDSMKNFIQRHLATFSGRTIEGFIRYVGEAFLTTYSHIDWVKLTGEAVPFENTTYANGEESSTSSLVYKHSRNERNEASIELVREGNGWQINSQNSRLLDLQLVKVKDNSFVGFIRDQYTTLPEDSNRPLFIYLNIGWSYETDDDALGEEPARYVAGEQVADLASSVFHELTSPSIQHLIYQIGCRMLKRFPQLQEVTFESQNRTWDTVVEDIPETEGKVYTEPRLPFGFQRFSVTKADLGPQTTSARTEKARL

SEQ ID NO: 1704 - protein, 240 aa, Bacillus cereus G9241
MNKTLSEAVSFVEEVKGQIPAASAVDAVVCSPALFLERLVAATEGTDLQVGAQNMHFEKNGAFTGEISPVALSDLKVGYVVLGHSERREMFAETDESVNKKTIAAFEHGLTPIVCCGETLEERESGKTFDLVAGQVTKALAGLTEEQVKATVIAYEPIWAIGTGKSSSSADANEVCAHIRKVVAEAVSPEAAEAVRIQYGGSVKPENIKEYMAQSDIDGALVGGASLEPASFLGLLGAVK

SEQ ID NO: 1705 - protein, 394 aa, Bacillus cereus G9241
MNKKSIRDVDLKGKRVFCRVDFNVPMKEGKITDETRIRAALPTIQYLVEQGAKVILASHLGRPKGQVVEELRLTPVAARLGELLGKDVKKADEAFGPVAQEMVAAMNEGDVLVLENVRFYAGEEKNDAELAKEFAALADIFVNDAFGAAHRAHASTAGIADYLPAVSGLLMEKELEVLGKALSNPERPFTAIIGGAKVKDKIGVIRHLLDKVDNLIIGGGLAYTFVKALGHEIGLSLCEDDKIELAKEFMQLAKEKGVNFYMPVDVVITEEFSETATTKIVGIDSIPSNWEGVDIGPKTREIYADVIKNSKLVVWNGPMGVFEMTPFAEGTKAVGQALADAEGTYSVIGGGDSAAAVEKFGMADKMSHISTGGGASLEFMEGKELPGVVCLNDK

SEQ ID NO: 1706 - protein, 391 aa, Pseudomonas viridiflava
MEQQCDVAVLGLGAMGAATLYQLAREGADVLGIDQYAPPHTQGSSHGDTRITRLSVGEGPQYLPLVRNSHRIWRELEAMTGEPLFEQCGVLVMTSSPAYDPQDPEDFTHKTIALAREYGVRHEVLSAEDIRERFPQFSPVLDTAIGYFEPDGGFVRPERCIAVQLQLAGKLGARVRLNETVTRLQAYGDQVRITTDQGSIIANKVVVSAWMWSSQLLGEPFTDLLRVCRQQLFWFALEDTAAFAPVSPSFILTHGPGEVDINYGFPPLPGEGSMKIATEQYVHTSVACELDRSISAEDEQTMFQTQVSGKIAGIKADVVKSSVCAYTVTPDYHFIIDDHPHLKNVTVVSACSGHGFKHSAGLGMALAQRCLRGSSEVDLSAFSLKRFGKTA

SEQ ID NO: 1707 - protein, 285 aa, Ralstonia eutropha JMP134
MSTPKELPPQHQERQPGLESAMHPKPDSGADDYVGSGRLNNKVALVTGGDSGIGRAIAVAFAREGADVAIAYLDEHSDARETVRLVEDAGRKCVSLAGDLADVSHAETVAARVVDAFGRLDILVNNAAEQHPQPSLEDVEAEQVEATFRTNVFAMFHLTRALLPHLQKGAAILNTTSVTAYRGSAHLLDYSATKGAIVSFTRSLALQVVKRGIRVNGVAPGPIWTPLIPSTFTAEEVAEFGKKTPMGRPGQPFEVAAGYVFLASDAASYITGQILHINGGEVVNG

SEQ ID NO: 1708 - protein, 545 aa, Porphyra purpurea
MKFHGSYQQDDRELRKRGAEKAYQFMLRLKMPAGEFPAAMYRELDDLSTELGNTTLRATTRCTFQMHGILKKNLKSVFSRILNAGGSTIGACGDLSRNVMCTPAPIDAPEYVAARHLSRMLAELFAPQTGAFSEIWLDGEKAASLEYWKKDLDMGAVGQLMREDANDTHLTFPGHEEPIYGDQYLPRKFKIGVTVAGDNSIDIYTQDIGVVVVMNADNTEVEGYNLTVGGGMGRTHKKETTFARTGDHLGYVPAADIYTACKAIIAAQRDHGNREVRANARMKYLVDKMGIDAFRTLVEGYYGKSFEEYRQLPAWEFKDWLGWYDQGNGKAFLGLFIENGRIKDEGTFRLKTALRKIVDDFGYDFVVTPNQNVLIRDVPNERKADLDSLLTEHGITLPADVNINHRLAMACPALPLCGLAVTEAERHMPTVIDRVNSVLAEADLADMPVVMRMTGCPNGCARPYMAELGFVGSGPQAYQLWLGGCPDQTRLAYPYDEKVKDADIEATLRPLLAAYKEDRTDGESFGAFTARWGKDALHKYVAEHA

SEQ ID NO: 1709 - protein, 335 aa, Xylella fastidiosa Ann-1
MTQTITVIRGDGIGPEIMDATLSVLNALQANLNYEFADAGLSALEKHGDLLPEATLNSISKNKIALKSPLTTPVGEGFSSINVALRRKFDLYANVRPAKSFPNTKSRFSDNVDLITVRENTEGAYLSEGQTISPDGEVATSRARVTRKGSERIVRYAFDLARTTGRKKVTAVHKANIIKSTSGLFLKTARDVASQYPEIDFQEMIVDNTCMQLVMRPEQFDIIVTTNLFGDILSDLCAGLVGGLGLAPGANIGNEQAIFEAVHGSAPDIAGQGKANPCALLLGAVQMLDHIGQPQNAERLRNAIVATLNAKDSLTPDLGGNGNTMGFAKAIASRL

SEQ ID NO: 1710 - protein, 908 aa, Agrobacterium tumefaciens str. C58
MKKWVYTFGNGAAEGGAGDVAILGGKGANLAEMASLGLPVPPGLTIIADACALYHKNGRDLPEELKLQVMAGLHGMEIVTGKTFGGSHSPLLISVRSGARASMPGMMDTVLNLGLNDRTVEALGHDAGDARFAWDSYRRFIQMYGDVVMGLDHEMFEEILEDEKGRLGHEYDTDMSAVEWQHVVSLYKKLIEDELGEAFPQDCHVQLWGAIGAVFASWTNHRAVTYRHLHNIPGDWGTAVNVQAMVFGNLGSSSATGVAFTRNPSTGEAELYGEFLVNAQGEDVVAGIRTPQSITEAARLVSGSDKPSMEKLMPEAFSEFLAICKRLETHYRDMQDLEFTIERGKLWMLQTRSGKRTTRAAMKIAVDMVEAGLISQEEAVCRIEPSSLDQLLHPTIDPGISRPIIGSGLPASPGAATGEIVFTSEEAVAAEAEGRRVILVRIETSPEDIHGMHAAEGILTTRGGMTSHAAVVARGMGIPCVTGAGSMRVDMRNKVLIGVGCMLKRGDVITIDGSSGRVLKGEVPMTQPELSGDFGKLMQWADNLRRMTVRTNADTPADARAARAFGAEGIGLCRTEHMFFEGDRIHVMREMILAESEKGRRAALDQLLPMQRSDFTELFQIMHGLPVTIRLLDPPLHEFLPKSDGEIVEVAAAMGMPQTVFRQRLDALHEFNPMLGHRGCRLAISYPEIAEMQARAIFEAAVAAARITGAPVVPEIMVPLVGLRSELDYVKAVIDTVAAEVAEETGMSIEYLTGTMIELPRAALRAHVIAEAAEFFSFGTNDLTQTTFGISRDDAARFINTYQRKGIIERDPFISLDFDGVGELIRIAAERGRQTRPELKLGICGEHGGDPASIHFCEDADLDYVSCSPFRVPIARLAAAQATLAAKAKQGETPSNVAFIPVRGSVGR

SEQ ID NO: 1711 - protein, 527 aa, Solanum tuberosum
MMQDVWTQLGPTIAAIMFTWTMYQNYFPHELRGHIRRYTDKLVSYFYPYMHIIFYELETEGWFERSKAYVAIERYLSKNSSTQAKHLKANAVKDGQSLVLTMDDHEEITDEYKGEKVWWISSQKPTSRQIISLHREDEKRYFKLKFHKKNRDLITNSYLKYVLDEGKAISVRERQRKLYTNNKGDGGGYRYRGGRMWSGVVFEHPSTFDTLAMDPNKKQEIIDDLETFSKSKDYYAKIGKAWKRGYLLYGPPGTGKSSMIAAMANFLKYDVYDLELTSVKDNTELRKLLIDTTGKSIIVIEDIDCSLDLTGQRETNKKKKEEEDKGKNEEDAVKEKMKKGGEVKEKQSEVTLSGLLNFIDGLWSAIGGERLIVFTTNYVEKLDPALIRRGRMDKHIVLSYCCFESFKVLAHNYLDVVESHVHFPEIRRLLEETNMTPADVAENLMPKSSKENAETCLERLIKALETAKEEAKLKAEEEERAKAAEKEKEEKDREEKKEVTATEEAKNADGVNEKDNGFKENGDVNKD

SEQ ID NO: 1712 - protein, 400 aa, Aspergillus nidulans FGSC A4
MSSSEEKVRTSGEVSRPEPTLPTVNPAVDKPEPPKPTFHPAVYVTSWIALSSSVILFNKHILDYAQFRFPIILTTWHLAFATFMTQVLARTTTLLDGRKTVKMTGRVYLRAIVPIGLFFSLSLICGNVTYLYLSVAFIQMLKATTPVAVLLATWGMGMAPVNLKVLTNVSVIVFGVIIASFGEIKFVFIGFLFQIAGIIFEATRLVMVQRLLSSAEYKMDPLVSLYYFAPVCAVMNGVTALFLEVPTLTMDHIYNVGVWTLLANAMVAFMLNVSVVFLIGKTSSLVMTLCGVLKDILLVVASMVIWNTPVTALQFFGYSIALIGLVYYKLGGDKIKEYTSQANRAWAEYGATHPAQRRFVIIGAALLSFFLLVGSMAPSYAPDSVANVKGMLGGASTGNA

SEQ ID NO: 1713 - protein, 95 aa, Glycine max
  misc_feature (54)..(54): Xaa can be any naturally occurring amino acid
  unsure (1)..(95): unsure at all Xaa locations
ASSKISFPVVTTDNRAGAGMVAPFTGLIFMAGFPTIKTNIDITSIASNGGRVQXFQVWPPAGNKKFETLTFLTDLDNAQLSNEVKYLLKKGWIPC

SEQ ID NO: 1714 - protein, 312 aa, Glycine max
MGKKRKHSETTQAVAQPKKEEAAPERPARTLLGWKDKNQVEDDSPIFRNKEKLLVTCSRRINYRYRHLMLNLVTLLPHCKKDNKVESKETKGATLNELVELKNCSSCLFFECRKHKDLYLWMAKCPNGPSVKFLVSAVHTMEELKLTGNHLQGSRPILTFSANFEKDAHWKLLKEMLLQIFETPKDHRKAKPFHDHVFVFSIVDDHIWFRNYQISAHHNESDKLPRGGLDKMTLIEVGPRFCLNPIKIFGGSFGGPTLYENPLYVSPNQIRALEKKKKSGKFAKKVKAKTRRKMHEMSNPLEPDEFADMWKD

SEQ ID NO: 1715 - protein, 348 aa, Glycine max
  misc_feature (184)..(184): Xaa can be any naturally occurring amino acid
  misc_feature (203)..(203): Xaa can be any naturally occurring amino acid
  misc_feature (224)..(224): Xaa can be any naturally occurring amino acid
  unsure (1)..(348): unsure at all Xaa locations
MLRPLISRLRPRPILFLSLLLLTQQTYLFLFCPSMEGSGSGVVTVYGNGAITETKKSPFSVKVGLAQMLRGGVIMDVVDAEQARIAEEAGACAVMALERVPADIRAQGGVARMSDPQLIKDIKRAVTIPVMAKARIGHFVEAQILEAIGIDYVDESEVLTLADDANHINKHNFRIPFVCGCRNXLGEALRRIREGAAMIRTKXGEAGTGNIIEAVRHVRSVMSXDIRVLRNMDDDEVFTFAKNIAAPYDLVMQTKQLGRLPVVHFAAGGVATPADAALMMQLGCDGVFVGSGVFKSGDPAKRARAIVQAVTHYSDPEILAEVSCGLGEAMVGINLTDDKVERFANRSE

SEQ ID NO: 1716 - protein, 484 aa, Comamonas testosteroni
MKDIQNFINGAYVSTGRSFDKHSPLTGKVIAKVHEAGRNEVDAAVTAARTALNGPWGRMSVAERVEKLYAVADGINRRFEEFLAAECADTGKPRSVASHIDIPRGAANFKIFADVVKNVPTEFFEMATPDGRGAINYGHRGPVGVVGVICPWNLPLLLMTWKVGPALACGNTVVVKPSEESPQTAALLGEVMNEAGIPPGVYNVVHGFGPDSAGEFVTSHPGVDAITFTGETRTGEAIMKAAAKGARPVSLEMGGKNAAIVFADCDFDAAIDGTLRSAFVNSGQVCLGTERVYVERPIYERFVAALKQQIEGWKIGVPEDDDTKLGPLISKEHQAKVLSYYQLAVQEGATVVTGGGMPDLGAQYADGAWVQPTIWTGLPETARVIKEEIFGPCCHIAPFDTEEEVLTKANDNVYGLASAIWTQDLARAHRVAQRMHVGISWVNSWFLRDLRTPFGGAKQSGIGREGGVHSLEFYTELKNVCIKL

SEQ ID NO: 1717 - protein, 3982 aa, Bacillus subtilis
MYTSQFQTLVDVIRERSSISDRGIRFIESDKNETVVSYRQLFEEAQGYLGYLQHLGIKPKQEIVFQIQENKSFVVAFWACILGGMIPVPVSIGEDDDHKLKVWRIWNILNHPFLIASEKVLDKIKKYAAEHDLQDFHHQLNEKSDIIQDQTYDYPASFYEPDADELAFIQFSSGSTGDPKGVMLTHHNLIHNTCAIGTALAIHSKDSFLSWMPLTHDMGLIACHLVPFITGINQNLMPTELFIRRPILWMKKAHEHKASILSSPNFGYNYFLKFLKNEPDWDLSHIKVIANGAEPILPELCDEFLKRCAAFNLKRSAILNVYGLAEASVGAAFSKIGKEFVPVYLHRDYLNLGERAVNVSKEDQNCASFVEVGQPIDYCQLRISDETNERVEDGIIGHIQIKGDNVTQGYYNNPESTEKVLTSDGWVKTGDLGFISESGNLVVTGREKDIIFVNGKNIYPHDIERVAIEMEEVDLGRVAACGVYDQKTQSGEIVLFVVYKKSPEKFAPLVKEIKKHLYKRGGWSIKEVLPIRKLPKTTSGKVKRYELARQYEAGNFSTESAAINECLESSPETSGQTPIHEIETELLSIFSEVLNGKKVHLADSYFDMGANSLQLSQIAERIEQKFGRELAVSDLFTYPSITDLAAYLSESRAEIKQDAAAKPSHVTPKDIAIIGMSLNVPGASTKSDFWNLLEKGEHSIREYPESRLKDAADYLKSIQSEFNESQFVKGGYLDEIDRFDYSFFGLAPKTAQFMDPNQRLFLQSAWHAIEDAGYAGGSMNGSRVGVYAGYSKVGYDYERLLSANYPEELHQYIVGNLPSVLASRIAYFLNLKGPAVTVDTACSSSLAAVHMACKSLMSGDCEMALAGGIRTSLLPICIGLDMESSDGYTKTFSKDSDGTGTGEGAAAVLLKPLQDAVRDGDHIYGVIKGSAMNQDGTTAGITAPNPAAQTEVIETAWKDAGIAPETLSFIEAHGTGTKLGDPVEFNGLCKAFEKYTAKKQFCAIGSVKSNIGHLFEAAGIVGLIKSVLMLNHKKNPPLAHFNEPNPLIHFHSSPFYVNQEAAEFTSGDEPLRGGVSSFGFSGTNAHVVLEEYISQSEYAPEDEHGPHLFVLSAHTEKSLYELAQQYRQYVSDDSQASLKSICYTASTGRAHLDHGIAMIVSGKQELSDKLTRLIQGDRNLPGVYIGYKNMKEMLPAHKEELNQQAAALIKQRLRTQDERITWLHRAAELFVQGAVIDWRALYSGETVQKTPLPLYPFERSRCWAEADQLRLNEDEKRGEAALNINQSKAHIESFLKTVISNASGIRAEELDLNAHFIGLGMDSIMLSQVKKAIADEFGVDIPMDRFFDTLTNLQSVIDYLADTVPSSFASAPPQENVPAQEIQVISEAQSESDRREGHQEHMLEKIIASQNQLIQDTLQAQLNSFNLLRNSGHHSDEKEYAKAQEKSIPSVKQGPPTVTAEKKAAQEAKPYVPFQPQNLNDQGHYTARQKQYLEDFIKKYADKTKGSKQYTDNTRFAHANNRNLSSFRSYWKEIVYPIIAERSDGSKMWDIDGNEYIDITMGFGVNLFGHHPSFITQVIDDSTRSSLPPLGPMSDVAGEVADRIRTCTGVERVAFYNSGTEAVMVALRLARAATGRKKVVAFSGSYHGTFDGVLGVAGTKGGAASANPLAPGILQSFMDDLIILHYNNPDSLDVIRSLGDELAAVLVEPVQSRRPDLQPQAFLKELRAITQQSGTALIMDEIITGFRIGLGGAQEWFGIQADLVTYGKIIGGGQPLGVVAGKAEFMNAIDGGTWQYGDDSYPQDEAKRTFVAGTFNTHPLTMRMSLAVLRHLQTEGEHLYEQLNQKTAYLVDELNRCFEQAQVPIRMVRFGSLFRFVSSLDNDLFFYHLNYKGVYVWEGRNCFLSVAHTADDIENIIQAVKDTVEDLRRGGFIPEGPDSPDGGGRKKSGTRELSPEQKQLVMASHYGNEASAALNQSIMLKVKGEMQYTSLKQAVRHIVDRHEALRTVIHPDDEVQQVLERMNIDIPVIDFTGHPHEHREPEIQKWLTEDAKRPFHFHEQKPLFRIHVLTSAHNEHLIVLTFHHIIADGWSIAVFVQELESNYAAIVQGKPISPKEADVSFRQYLDWQQAQIDSGHYEEGVRYWRRHFSEPIQQPILPSTASIRYPNGYEGDRCTVRLGRPLSEALRSLSIQMKNSVFVTMLGAFHLFLHQLTKQSGLVIGIPAAGQSHMKQHDLIGNCVNMIPVKNTSSSESTLSGYLGSMKESVNLAMRHQAVPMTLVARELPHDQVPDMRIIFNLDRPFRKLHFGKAEAEPVAYPVKCTLYDLFLNITDAHQEYVLDFDFNTNVISPEIMKKWGAGFTKLLQKMVEGDSIPLDAMMMFSDEEQHALQALYAEHQKRVSSIGSNTANFTEAYEAPVNETERQLARIWEELFGLERVGRSDRFLALGGNSLQATLMLSKVQKTFHQKVSIGQFFNHQTVKELARFIQNETKVVHLPMKAAEKKAYYPTSPAQQRVYFLHQLEPDQLAQNMFGHISITGKYDEQALISSLQQVMQRHEAFRTYFDIIDGDIVQKLENEVDFNVHVRTMSRDEFDAYSDRFVKPFRLDQAPLVRAELIKIENEQAELLIDMHHIISDGYSVNILTNELLALYHQKPLPDIEFEYKDFAEWQNQRLNDDAMKRQETYWLEQFQDEIPILDLPTDGSKAAERSSEGQRVTCSLQPDVIRSLQDLAQKAETTLYTVLLAAYNVLLHKYTGQEDIVVGTPASGRNHPDIEKIIGIFIQTIGIRTKPHANRTFTDYLEEVKRQTLDAFENQDYPFDRLVEKLNVQRETTGKSLFNTMFVFQNIEFHEIRHNECTFKVKERNPGVSLYDLMLTIEDAGQQIEMHFDYKPGRFTKDTIEQITRHYTAILNSLVEQPEMTLSSVPMLSETERHQLLTECNGTKTPYPHKETVYRWFEMQAEQSPDHEAVIFGNERYTYRQLNERANRLARTLRTKGVQADQFVAIICPHRIELIVGILAVLKAGGAYVPIDPEYPENRIQYMLRDSRAEVVLTQRSLLDQLPYDGDVVLLDEENSYHEEHSNFESDSDAHDLAYMIYTSGSTGNPKGVLIEHQGLADYIWWAKEVYVRGEKTNFPLYSSISFDLTVTSIFTPLVTGNTIIVFDGEDKSAVLSEIMRDSRIDMIKLTPAHLHVIKEMNIAGDTAIRKMIVGGENLSTRLAKSVSEQFKGRLDIFNEYGPTEAVVGCMIYHFDAVRDKREFVPIGTPAANTDIYVADASRNLVPIGVIGEIYISGPGVARGYWNRPDLTEEKFVENPYVPGAKMYKSGDLAKRLKDGNLVYIGRVDEQVKIRGHRIELGEIEAAMHNAEAVQKAAVTVKEEEDGLKQLCAYYVSDKPIAAAQLREQLSSGLPDYMVPSYFVRLEHMPLTSNGKINRKALPAPESSLQQTAEYVPPGNETESKLTDLWKEVLGISHAGIKHNFFDLGGNSIRAAALAARIHKELDVNLSLKDIFKFPTIEQLADKALHMDKNRYVPIPAAKEMPYYPVSSAQRRMYLLSHTEGGELTYNMTGAMKVEGTIDPERLNAAFRKLIARHEALRTSFDLYEGEPAQRIHQNVDFTIERIQASEEEAEDRVLDFIKAFDLAKPPLMRAGLIEIEPARHVLVVDMHHIISDGVSVNILMKDLSRIYEGNEPGPLSIQYKDFAVWQQSDLQKRNIKSQEAYWLDQFHGDIPVLDIPADYERPAIRDYEGESFEFLIPEHLKQRLSQMEEDTGATLYMILLAAYTILLSKYSGQEDIIVGTPSAGRTHLDVEPVVGMFVNTLVIRNHPAGRKTFDAYLNEVKENMLNAYKNQDYPLEELIQHLHLPKDSSRNPLFDTMFVLQNLDHAELIFDSLQLKPYPFHHSVAKFDLTLSIQADRDNYYGLFEYSKKLFKKSRIEVLSNDYLHILSAILEQPSILIEHIGLSGSNEEEENALDSIQLNF

SEQ ID NO: 1718 - protein, 402 aa, Aspergillus oryzae
MATVTDTVACQALVLHGAKDLRMGTKPVTAPTGSEVQVAIRATGLCGSDLHYYNHGRNGDFVVREPFCLGHESSGVVTAVGPEVTTLQVGDRVALEVGLPCRKCVLCKQGRYNICPEMKFRSSAKIFPHLDGTLMELTNHPAEMCHKLPDSVSFAGGALVEPLAVCLHAVRRSHPPSKEEVQLAESLGDQSAALIFGAGAIGLLLAGALATAENFSNIVVADIDPARLAIAESLNLGLKTALIPKADPAHPPPAKDAPHAEQTAYALQNAQRVAATLKDTIGLTSGFSRIYECTGVPACVQAGIYAAAPGSVLVQIGMGNPIQTLPVGAAALREVDVIGVFRYDGHAYPAAIALVASGKFNRVEELVVTHRLPLEQGERAFALAGKGVDETGRPVVKVVIES

SEQ ID NO: 1719 - protein, 127 aa, Clostridium acetobutylicum ATCC 824
MRKEIIKTDKAPGAIGPYSQAVKVGNLLFTSGQVPIDPKTGELVSKDIKEATDRVFKNIGAILEEAGTSFENVVKTVVFVKDMNDFSSVNEIYAKYFSKNEPARSCVQAKLPKDALVEIEVVAVVEG

SEQ ID NO: 1720 - protein, 262 aa, Aspergillus oryzae
MSASLFSLSGKTAIVTGGTRGIGQAMAFALAEAGADIVLIQRDESNTSTRDEIISRIGRKAWIHVAELSSRDAIKGVIPALTSQGLKPEILLNCAGIQRRHPSEQFPDEDWDEVIQVNLTSVFTLCREFGAYLLARDASEFPTGRRGSIINVASLLSFQGGITVPAYAASKGGISQLTKALSNEWVSKGINVNAIAPGYIATDMNTALINDSNRNAGIMARIPAGRWGSPDDFKGVIVFLASQASSYVSGEVICVDGGWMGR

SEQ ID NO: 1721 - protein, 1494 aa, Aspergillus oryzae
MSLLGTINPNLNPARAVGAQGDAEGAAPVSGGEPMPIFEGNDSARTSDTALDKLGKDESKYDEQIAEAEVTRLAQQLTRQSTRFSVSQNAENPFLETKEDSTLNPLGPNFKAKNWMKNLLALTSRDPERHPRREAGVSFRNLSVHGYGSPTDYQKDVFNMVLQVGALFRAVTGTGKQKIQILRDFDGLVKSGEMLVVLGRPGSGCSTFLKTLAGEMNGIYMDDKSDLNYQGIPAKQMRRQFRGEAIYNAETDVHFPQLSVGDTLKFAALTRCPRNRFPGVSREQYATHMRDVVMAMLGLTHTINTRVGNDFVRGVSGGERKRVSIAEATLSGSPLQCWDNSTRGLDSANALEFCKTLNLMTKYAGATVAVAIYQASQSAYDVFDKVTVLYEGRQIYFGRTDEAKEFFTTMGFECPERQTTADFLTSLTSPSERIVKKGYEGKVPRTPDEFAAAWKNSEAYAKLIREIEEYNREFPLGGESVQKFVESRRAMQAKNQRVGSPYTVSIYEQVRLCMIRGFQRLKGDSSLTMSQLIGNFIMALIIGSVFYNLQHDTSSFYSRGALLFFAVLLNAFSSALEILTLYAQRPIVEKQARYAMYHPFAEAIASMLCDMPYKITNAIIFNITLYFMTNLRREPGPFFVFLLFTFVTTMTMSMLFRTIAASSRTLSQALVPAAILILGLVIYTGFTIPTRNMLGWSRWMNYLDPIAYGFESLMVNEFHNTKWKCSSAELIPNYEGASLANKICSTVGAVAGSEYVYGDDYLEQSFQYYESHKWRNLGIMFAFMVFFLATYLTATEYISEAKSKGEVLLFRRGHYSRGAADVETHNEVSATEKTNESSDGAGAAIQRQEAIFHWQDVCYDIKIKGEPRRILDHVDGWVKPGTCTALMGVSGAGKTTLLDVLATRVTMGVVTGEMLVDGRLRDQSFQRKTGYVQQQDLHLHTTTVREALRFSAILRQPAHVSRQEKLDYVEEVIKLLGMEAYADAVVGVPGEGLNVEQRKRLTIGVELAAKPQLLLFLDEPTSGLDSQTSWSILDLIDTLTKHGQAILCTIHQPSAMLFQRFDRLLFLAKGGKTVYFGEIGERSSTLASYFERNGAPKLPVEANPAEWMLEVIGAAPGSHSDIDWPAVWRESPEREAVRNHLAELKSTLSQKSVDSSHSDESSFKEFAAPFSVQLYECLVRVFSQYWRTPVYIYSKAVLCILTSLYIGFSFFHAENSRQGLQNQMFSIFMLMTIFGNLVQQIMPNFVTQRALYEARERPSKAYSWKAFMTANILVELPWNALMSVIIFVCWYYPIGLYRNAEPTDSVHERGALMWLLILSFLLFTSTFAHMMIAGIELAETGGNLANLLFSLCLIFCGVLATPETLPGFWIFMYRVSPFTYLVSGMLATGVGRTTAVCEKVEFLHLTPPANTTCYDYMSDYIGSFGGYLENDNATDSCSFCQISSTDTFLSAVSSYYEDRWRNFGIMWAFIVFNIAAAVFIYWLARVPKGSRSKN

SEQ ID NO: 1722 - protein, 341 aa, Zea mays
  misc_feature (266)..(266): Xaa can be any naturally occurring amino acid
  unsure (1)..(341): unsure at all Xaa locations
CSRFARSSGDRASHGGSRRRRGRGRQPWRRGGGPSRYESQKRRDWHTFGQYLRNHRPPLELARCSGAHVLEFLRYLDQFGKTKDHAAGCPFFGHPSPPAPCPCPLRQAWGSLDALVGRLRAAFEEHGGRPEANPFGARAVRLYLREVRDSQAKARGIAYEKKRRKRPSSSASSQSSPQAATSPRQQAAPSSSPTLSDAAAERADVRAFVSDAGHGHGHGHQQQHHFFMPHPQFLHGFSLLPGNPEAVAGNGNGSSSSASVAASSGXDEIALALAAAEEAHAAGCMPAVAGVQLGRRIAKSEVGRMNSPGACLSGSRGSCMIVLTVAMELRRSTHVRSACCS

SEQ ID NO: 1723 - protein, 457 aa, Prochlorococcus marinus subsp. pastoris str. CCMP1986
MNVKTSFLKNKINEDSPNKNIVPVTTTINSEHKLFIGECSLEDLVSKYDSPLYVLDEITLRNSCKAYKKALEKYYPGPSLPIYASKANSSIFMSNLIASEGFGLDAVSEGELLTALKGGVPNEKIVFHGNNKSDKEIEFAIKNNIKVIVDNDHDLKRLEEISNSFNHDIEIMVRFTPGIECHTHEYIRTGSFDSKFGFGIESLGRLFEVISKTKHIKLTGLHAHIGSQIFELDPHNDLGKIMVDVILQAKDFGHNIKELNVGGGLGIKYTEEDDPPSIDEWIKTVSLSVVKACDKNNLNLPILMCEPGRSIVSTAGVTIYKIGSFKEIPGIRTYLSVDGGMSDNPRPITYQSKYSACLVNNPLNSNSKNKYTVAGKHCESGDVLFKELELGDCKTGDLICVFGTGAYNNSMSSNYNRIPKPAAILVCNGEAEIIQKRESPHDLLKYDVLPDRFIKQS

SEQ ID NO: 1724 - protein, 666 aa, Yarrowia lipolytica CLIB122
MLRPLTRAGALSSLTRPAAVRTAFRSLHCSRPALQTHTPLSRGKKFLKFSLATFGAIGLGATALVVSFLVYDISSYKEIDDCGDIDVHALALSPRRGGPKNLPIFDSWLDDTDTPEKAESSSKPRLVVLGSGWGSVALLNALKPGDYNVTLISPSNYFLFTPMLPSATVGTLELRSITEPVRRICAAAAAHFVNASANNIDFKERLIECSQRDPVTGDTVNFYVPYDKVVVGVGCTTNTHGVKGLQYCHFLKTVDDSKSIRNQLVANLEKAALPSTSIDERKRLLSFVVCGGGPTGVEMAAEVYDLMNEDLAKHYPKALRNLVSVHVIQSRSAILNTFDHSVSEYAMERFKHDNIDLLINSRVVEVKEDRVLFSQADPKDPSKKIIKEVPFGLCLWSTGVDQSPLTKSIVKDIGAPNQTNRRAIETDPQLRILGTPEGQAYAIGDCSTVRTHVLDTALDILKSHVLASRPFSANTQETPEALEKRVHEIKLTVGEVKRLTAVLQKTLPDSSEHFVRIDELFQEYDADHSGTLSYSELTKMLKDVDQKITSLPATAQRANQQGVYLGKKLRKIASIGAAAYDTPVPYGDIDAAYYKPFKYKHLGNLAYLGNAAVFDFGKHGTFTGGLLGMYIWRSAYFSQCVSFRTRALMFQDWLKRGLFGRDFIAP

SEQ ID NO: 1725 - protein, 464 aa, Clostridium perfringens str. 13
MLFGKNELGSQFETPIFGTVESNESIPKYELAKKSIAPQVAYRLIKDDLLDEGNARQNLCTFCQTYMDDEAVKLMAETLEKNAIDKSEYPQTTDLENRCVNILADLWHAPKDESFMGTSTVGSSEACMLGGMAMKFRWRNRAKALGMDVTSRKPNLVISSGYQVCWEKFCVYWDIEMRLVPMDEEHMSINVDKVLDYVDDYTIGVVGILGITYTGKYDDIKALDKKLEEYNKTAKLTVPMHIDAASGGMFAPFIEPELEWDFRLKNVVSISTSGHKYGLVYPGIGWVLWRDKEYLPQELVFDVSYLGGKIPTMAINFSRSASQIIGQYYNFLRYGFEGYRQIHQRTKDVAMFLASELEKTGLFQIYNNGENLPIVCYKLRDDVNVDWTLYDLADRLLMKGWQVPAYPLPADLQDTIIQRIVCRADLSHNLAELYLRDLKAAIEDLNNARVLNQKSKTGVQGFTH

SEQ ID NO: 1726 - protein, 425 aa, Candida glabrata CBS 138
MEHQPVITLNDVNGNSTDVLVSHNVKSRIRARSRALSNPNDYQELNVLNDPGNHPDEHYKAMSPIRFKVRSWLRKYVDNQSETLYYWQSRWRCKFLDLYFSYTSLMGSHTFYVLFLPLPVYFGYFEFTRDMVYILGYSIYLSGFLKDYCCLPRPRSPPLHRITLSAYTAKEYGAPSSHTANATGVSLLFLIALMQSTRYSGFSKAFLFAMVMFYYLTLVLGRIYCGMHGVLDLVSGTAVGVFCCIVRVATSWLLSEWDYGKELWFPVLSVVWGLTILFKHIQPIDECPCFEDSVAFMGVVSGLEVSDWVIRHFFDDRSLIYAFTNEYTYGQLASRLGFGVLLVVLWKYILSKPLVYSVFLKTICRMPDDRQEKQHLKIELTANSGEECIRYVGVAHIDIIGRFIIYAGIPISVMLVSPLILKWSP

SEQ ID NO: 1727 - protein, 291 aa, Yarrowia lipolytica CLIB122
MSNSAKAAVVPPAPTAEDIARANAGSKEEPVFQAKNFLSKFRLDGKVAIVTGGARGLGFSMAEGLCSVGLKGIAILDVQQDLGLDAIEKLHKAYGVQAQFYKADVRDEESVNEIIDRVVHDLGSVDVVVNSAGVADLVHAAEYPADKFRRVIDINLNGSFLVTQAAARHMIKQGTGGTVVFIASMSGSIVNWPQPQSAYNASKAAVKHLSKSLAAEWAVHNIRCNSISPGYMDTALNRAYNTLFEEWKDRTPLGRLGDPDELTGACIYLASDASSYVTGSDIIIDGGYTII

SEQ ID NO: 1728 - protein, 547 aa, Xanthobacter autotrophicus Py2
MTSNAHATDAAFKALAIAWTTREGRILDLFAQPDRFERFSVAYGDLLIDFSKTAITDDILSQLLELARAGGVEAQRDAMFAGDHINLTEDRAVLHTALRDQASDTIQVDGIDVKPGVVETLARLGDFATGVREGRIAGARGGVITDVVNIGIGGSDLGPAMVTLALAPYHDGPRCHFVSNVDSAHITDVLKGLDPATTLFIVASKTFTTVETMTNAATARAFIVNALGEDAVGAHFAAVSTALDKVGAFGIPADRIFGFWDWVGGRYSVWSAIGLPLMLAIGPDRFREFLAGAAAMDEHFRSAVLDQNLPVLLGLIGLWHRNACGFPSRAIIPYDQRLARLPAYLQQLDMESNGKSVTRDGAAVSRPTGPIVWGEPGTNAQHAFFQLLHQGTDIVPVEFLVGAQSHEPALKDHQDLLVANCLAQSEALMRGRTLEEATAQLRAKGISEDKVAEIAPHRVFPGDRPSLTIAYATLDPFTLGRIIALYEHRVFVEAAVWGINGFDQWGVELGKELATQFLPAVTGGALPPSASASTSGLIAHLDAVAGG

SEQ ID NO: 1729 - protein, 757 aa, Oryza sativa (japonica cultivar-group)
MRGAVLVAVAAAIGNYLQGWDNATIAGAVLYIKREFALETQPAVEGLVVAMSLIGATIITTFSGPVSDLVGRRPMLIASSLLYFAGGLIMLWSPNVYVLLLARLVDGFGVGLAVTLVPVYISETSPPEIRGRLNTLPQFTGSGGMFMSYCMIFAMTLSPSPNWRIMLGVLFVPSLLYLFVTVFYLPESPRWLVSKGRMKEARVVLEMLRGREDVSGEMALLVEGLGTGGDTEIEDYVVGPSEGDAGENEQARDTVTLYGPEQGLSWVAQPVAGGRGSMLGSSLGLQASRHGSMYEQMKDPVVALLGSVHERLPESGGGATGSMRGSTLFPNLGSMLSVNDRPGGSSWDEENVQPGDDDLDEEEEEYLSDDGKDDDDGGGLQAPLLSRQSTDVETKNEPASGQVAMQRHSSIGGGGGVETASTMGIGGGWQLAWKWTENVGPDGVKRGAVKRMYLHEESEAAPGGDSGAAGDAQSTAYVHAAALVSRSMLYTKDVLIGQSPTEPAFANPPEAVAAAASTGPAWRELLEPGVRHALFCGVTIQILQQFSGINGVLYYTPQILDQAGVSVLLASLGLSGDSTSILISGLTTLLMLPSIGVAMRLMDASGRRALLLWTLPVLVASLAVLVVANVVPMAATAHAALSTGSVIVYFCCFVMGFGPIPNILCAEIFPTRVRGLCIAICSLTFWLGDIAVTYSLPVMLSSVGLAGVFSFYAAVCCVALVFVALKVPETKGLPLEVIIEFFNVGAKAGTLPDEEFH

SEQ ID NO: 1730 - protein, 450 aa, Arabidopsis thaliana
MGKENAVSRPFTRSLASALRASEVTSTTQNQQRVNTKRPALEDTRATGPNKRKKRAVLGEITNVNSNTAILEAKNSKQIKKGRGHGLASTSQLATSVTSEVTDLQSRTDAKVEVASNTAGNLSVSKGTDNTADNCIEIWNSRLPPRPLGRSASTAEKSAVIGSSTVPDIPKFVDIDSDDKDPLLCCLYAPEIHYNLRVSELKRRPLPDFMERIQKDVTQSMRGILVDWLVEVSEEYTLASDTLYLTVYLIDWFLHGNYVQRQQLQLLGITCMLIASKYEEISAPRIEEFCFITDNTYTRDQVLEMENQVLKHFSFQIYTPTPKTFLRRFLRAAQASRLSPSLEVEFLASYLTELTLIDYHFLKFLPSVVAASAVFLAKWTMDQSNHPWNPTLEHYTTYKASDLKASVHALQDLQLNTKGCPLSAIRMKYRQEKYKSVAVLTSPKLLDTLF

SEQ ID NO: 1731 - protein, 193 aa, Clostridium perfringens str. 13
MVMKKVLVFLAEGFETIEALSVVDVCNRAKVTCHACSLTENRTVNSAHGTMVLCDKLISDNDLETYDAIILPGGMPGATNLRDNERVQSLIKKYNKENKIVAAICAAPIALAKAGVIEGKKVTSYPGFKEELGNVNYVEEDTVVVDGNIITSRGPATALVFGLEILKKLGYEKEAEEIREGMLINFFLEKEGK

SEQ ID NO: 1732 - protein, 603 aa, Solanum tuberosum
MNSKEEGAYRLFSEPSPRYYDEKKVFQKSNLFHMLPKGIPVPPSGPSRRHNGDATVAPIQWMKPCNMSSLKGVQLTFQQLPKELKRPFQLDKYQLPSIRRRFDKANFFVLQNMGLGGDGEKGESWDVEKSKGKKKKEVTEEETGCWTKLWFIGSCISSRSKVDSSISGISTHCDKSTYVLTSCIALAESKSTNTSRDQPVAPIISSTTTSNAESNSSTSKLEEELKVSSRLRKFAFNDLKLATRNFRPESLLGEGGFGCVFKGWIEENGTAPVKPGTGLTVAVKTLNHDGLQVLSIWQAEVNFLGDLVHPNLVKLIGYCIEDDQRLLVYEFMPRGSLENHLFRRSMPLPWSIRMKIALGAAKGLAFLHEEAERPVIYRDFKTSNILLDADYNAKLSDFGLAKDGPEGDKTHVSTRVMGTYGYAAPEYVMTGHLTSKSDVYSFGVVLLEMITGRRSMDKNRPNGEHNLVEWARPHLGERRRFYRLVDPRLEGHFSIKGAQKAAQLAARCLSRDPKARPMMSDVVEALKPLPNLKDMASSSYYFQTMQADRVGSSPSTKNGVRTQGSFSRNGQQHPRSLSIPNGSHASPYHQQFPQNSPKPNGKT

SEQ ID NO: 1733 - protein, 184 aa, Arabidopsis thaliana
  misc_feature (179)..(179): Xaa can be any naturally occurring amino acid
  unsure (1)..(184): unsure at all Xaa locations
MKSRRQNVSVARQTILGRDENFEPIPIDLVIEIFSRSPVKSIARCRCVSKLWASILRLPYFTELYLTKSCARPRLLFACQKHRELFFFSTPQPHNPNESSSPLAASFHMKIPFDGRFNIISPIGGLVFVRYEQILKGRKTPEFVSAICNPSTGQSLTLPKPKTRKRIWGTSHFGYDPIXKQFKV

SEQ ID NO: 1734 - protein, 98 aa, Arabidopsis thaliana
  misc_feature (18)..(18): Xaa can be any naturally occurring amino acid
  unsure (1)..(98): unsure at all Xaa locations
MASSMLSSATMVASPAQXATMVAPFNGLKSSAAFPATRKANNDITSITSNGGRVNCMQVWPPIGKKKFETLSYLPDLTDSELAKEVDYLIRNKWIPCV

SEQ ID NO: 1735 - protein, 489 aa, Rhizobium leguminosarum bv. viciae 3841
MENRMNGLRDSSLLRQQGLIDGEWRGAAAGHTIEVIDPATQHVLGTVPDMDGADTRAAIVAAEKAFGPWRAKTNAERGALLEAWHDLMLDNIEDLALILTREQGKPLTEARGEIRYGASFIRWFSEEARRIGGTTIPSPTADRRIVVLKEPVGVSAIITPWNFPNAMITRKVGPALAAGCTVVVKPSDLTPFSALALGVLAERAGIPKGVINIVTGMPAGIGDELMANQTVRKISFTGSTRVGSLLMRGAADSVKRLSLELGGNAPFIVFDDADLDLAVEGAIASKFRNGGQTCVCANRLLVQSGVYEAFAAKLSARVSAMKVGAGTDAGTDIGPMINKAAIEKIRRHVDDAVEKGARILATAGFMPEGDQYAVPMVLGGATTEMQLASEETFGPVAPLFRFDNEEEAIRIANATPFGLAAYFYTGSLKRSWRVAEALEFGMVGLNTGAISTEVAPFGGVKQSGLGREGAQCGIEEYLEMKSFHIGGLA

SEQ ID NO: 1736 - protein, 347 aa, Rhizobium leguminosarum bv. viciae 3841
MKTYKIALLPGDGIGRDVTAAAWAVLEKAARLNGFSLDATSYPWSCDYYLENGSMMPADGIEILRSFDAILLGAVGWPRKVPDSVSLHGLLLPIRKAFVQYANIRPHRLLPGVQGPLRSDGFNILCIRENTEGEYSGAGGRVHQGTDNEVAVETSIFTRKGVERILRFGFEQARARRGKLASVTKSNAQKYSMVFWDEITQRLSAEYPDVEVTSYHIDAMAARMVMAPDSLDVVVASNLFGDILTDLGAAIQGGLGFAASANINPDRSAPSMFEPVHGSAPDIADLGIANPIAAIWSGAMMLEHLGEPAAAARVMASIEATTARGIGSIPGKDKTDAITASVLSALG

SEQ ID NO: 1737 - protein, 302 aa, Mycobacterium bovis AF2122/97
MSGNEVHPDLRRIAVVTPRQLVGPRTLPVMRALIVVAGLRMSRTPPDIEVLTLESGVGVRLYRPAGSNEPAPALLWIHAGGYVMGTAQQDDRLCLRFSSRLGITVASVDYRLAPENPYPAALGDCYSALTWLASLPAVDPARVAIGGASAGGGLAAALALLARDRGGITPAFQLLVYPMLDDRTSIAPANPHYRLWNGRANRFGWRAYLGDADARVAVPGRRDDLGGLAPAWIGVGTHDLLHDEDLAYAERLTAAGVPCQVEVVEGAFHGFDRVAPNVGVSQRFFTSQCNSLRAALALSNRT

SEQ ID NO: 1738 - protein, 548 aa, Yersinia pestis biovar Microtus str. 91001
MKNINPSQTAAWKALQQHFEQMKDVTISSLFAKDDQRFNRFSATFDDQMLVDFSKNRITSETLEKLQDLAKETDLAGAIKSMFSGEKINRTEDRAVLHIALRNRSNTPIVVDGKDVMPEVNAVLAKMKQFCDRVISGDWKGYTGKAITDVVNIGIGGSDLGPYMVTEALRPYKNHLNMHFVSNVDGTHIAEALKPLNPETTLFLVASKTFTTQETMTNAHSARDWFLSAAGDPAHVAKHFAALSTNAKAVGEFGIDTNNMFEFWDWVGGRYSLWSAIGLSIALSVGFEHFEQLLSGSHAMDKHFAETPAEKNLPVLLALIGIWYNNFFGAETEAILPYDQYMHRFPAYFQQGNMESNGKYVDRNGHPVDYQTGPIIWGEPGTNGQHAFYQLIHQGTKLIPCDFIAPAISHNPLSDHHAKLLSNFFAQTEALAFGKSLEDVEAEFAAAGKTPEQVAHVAPFKVFEGNRPTNSILLREITPFSLGALIALYEHKIFTQGVILNIYTFDQWGVELGKQLANRILPELADDQEVTSHDSSTNALINRFKNWR

SEQ ID NO: 1739 - protein, 84 aa, Pisum sativum
LQNYDEMVKSPQKAYLKTITSKYQTLIDLSVIEILSRHASDEVYLGERDSKYWTSDSRAVQAFTKFGTKLAEIEGKIHSRNKDS

SEQ ID NO: 1740 - protein, 300 aa, Prochlorococcus marinus str. MIT 9303
MQDDGLNRGADSGARLAIRLLQDAAERGELDPWDVDVIAVVDGFLDQLRQRIEVPRQVAAQVQRQGGSYEQDLADSSEAFLAASVLVGLKAEVLEAQTFPPEPLFEEGFEAELGEQGWLDPSFALPRRPERHLLRRPAAPPPLRRPVTLGELIEQLESIAEQLESDELQQRRRKRTKRFSEREAIAQVTALAHREKLPETTAALGVFLNDWEQALHWVDFEQLVGQWEQVSTADLDSDRVGVFWALLFLCSQGKVELAQEGSLYAPLRLKRLLAPGTIAQLPLTSLNVPAATPAEVVNAA

SEQ ID NO: 1741 - protein, 155 aa, Xanthobacter autotrophicus Py2
MMTVDDMLRAKRDTRIITLRMHETVADAVLVMKRENISSVIVKDVCRTEGNTVVGVFSERDVTRAVLEHGANTPKMVLASLLKREVISCSLADSIETVLRLMVEHQVRHLPVIENHSLVGVISATDLMRHYLKEEEAALREPVTAGMEAGLAALR

SEQ ID NO: 1742 - protein, 539 aa, Enterococcus faecalis
MAYQFKLPDIGEGIAEGEIVKWFVKPGDTINEDDTLLEVQNDKSVEEIPSPVTGTVKNIVVPEGTVANVGDVLIEIDAPGHEDNDAAPAAPAQEQTPAQPAAVPTTEAAGGFFQFKLPDIGEGIAEGEIVKWFVKAGDTINEDDSLLEVQNDKSVEEIPSPVTGTVKNIVVPEGTVANVGDVLVEIDAPGHNSAAPAAAAPATNAPKAEASAPAASTGVVAAADPNKRVLAMPSVRQYAREKNVDITQVTATGKGGRVIKADIDAFVSGGSQAAPATEAAATEAAPKAEAAAPKAAPKAFTSDLGEMETREKMTPTRKAIAKAMVNSKHTAPHVTLHDEVEVSKLWDHRKKFKDVAAANGTKLTFLPYVVKALTSTVQKFPILNASIDDAAQEIVYKNYFNIGIATDTDHGLYVPNVKNANTKSMFAIADEINEKAALAIEGKLTAQDMRDGTITISNIGSVGGGWFTPVINYPEVAILGVGTIAQEPVVNADGEIVVGRMMKLSLSFDHRIVDGATAQKAMNNIKRLLADPELLLMEG

SEQ ID NO: 1743 - protein, 340 aa, Rhodospirillum rubrum ATCC 11170
MAQSLAENRRIVLARRPQGAPVAEDFRLETAPRPIAGDGQMLLRSLWLSLDPYMRGRMDDGPSYAAPVALGAVMVGGTVCRVEDSRLDGFLPGDLVLAYSGWQDYALSDGTGVERLEPHLDRPSLALGALGMPGLTAYVGLLDIGKPQPGETVVVAAATGAVGATVVQIAKLKGARVVAIAGGAEKTAYARETLGADVAIDHHDPAFAQTLATACPKGIDVYFENVGGKVFDAVLPLLNTGARVPLCGLIATYNGAGPDNAKRLPELMRSLLVRRITLRGFIIGDHRDRIPAFQKDMAGWLASGQIIAREDVVDGLERAPAAFISLLKGGNFGKLVVAVG

SEQ ID NO: 1744 - protein, 392 aa, Prochlorococcus marinus str. MIT 9303
MKAMILAAGKGTRVQPITHVIPKPMIPILQKPVMEFLLELLKEHGFKEVMVNVSHLAEEIENYFRDGQRFGVEIAYSFEGRIEEGELIGDALGSAGGLKKIQDFQQFFDDTFVVLCGDALIDLDLSEAVKRHRAKGALASLVTKRVPKDQVSSYGVVVTDENDCVQAFQEKPSTDAALSDTINTGIYLFEPEIFEHIPSDQPFDIGSDLFPKLVEMGLPFFALPMDFEWVDIGKVPDYWRAIRSVLQGEVRQVGIPGKEVRPGIYTGLNVAANWDKINVQGPIYVGGMTRIEDGATIIGPSMIGPSCCICEGATVDNSIIFDYSRIGAGVQLVEKLVFGRYCVGKNGDHFDLQEAALDWLITDARRQDLVEPSPQQKAMAELLGTDLTSAPS

SEQ ID NO: 1745 - protein, 422 aa, Gibberella zeae PH-1
MSSRPYDITVLGATGWTATICAEHIAKTFPINTEWCIAGRSPAKLEALRQSLQSINPDRLEPFIHVVSQIDEQALDPLVKKSKVIINGIGPYRRYATPIVAACARNGTHYVDFSTETSWISEIIRDYHELAVESGATIIPAIAGSSAPSDLVAWLIASYLNDHNLQEASEVVCSGRMTMLGMQGGSLHTVLDVAEKYGIGGWWTADTSILLPDTEPVVGTKTISVHRYDRHLGNLATSFVAWGNESVVRRSAVLDTPTYGQKFLYKEYSPAKSYVSAVFIHIITNIGILLLAIPWFRSFLRIKSFSPGEGPDRIESRKVENAEWQAVGYVAGVAEPVAFSIFSFQGALVDMAAILAVEGAATINDRLRMKDGSHLRAGLLTPSTLGGTFVDRLRAAGFSIEIKAPTGADRESDTSWGSKKQL

SEQ ID NO: 1746 - protein, 512 aa, Mortierella alpina
MGSLTSPTMRTTRSSSGKSSSMKTSLSAISSSSSSNSDCSDSEAVERLSISSAASVTSLEDSSSPVIAKHIKAIPKITTKNDFSVLYEPWTIGNFYKKLDWVHMLGLVFMPIYGFYMAFTSVPLQQKTAIFAVAYYFFTGLGITAGYHRLWSHRAYAAGPALQFILMIASTGAMQGSIRWWCRNHRAHHRYTDTEKDPYGAQKGLIWSHILWMLVRQDPTTVGWADVADLKANKLVRFQHDHFLWLAPLISLGLPTMVAGFGWGDYWGGFIYGGIIRQVVVHHATFCVNSLAHWLGDMPFDDRHTPRDHILTALVTLGEGYHNFHHEFPQDYRNAIRFYQYDPTKWLIAFCAFLGLASDLKRFPTNEIKKGEVRMQQQKLDRVKAGLIWGTPIDQLPVFTYEEFEALATEKGQAVTLIEGIIYDIEAFVDEHPGGRSLIKGAIGKDATTSFNGGVYDHSNAARHLLERMRVGVVAGGGFVEHRKSSTAPKQLSTIPLGSYPPASIPVVSRTA

SEQ ID NO: 1747 - protein, 825 aa, Solanum tuberosum
MSDYKLDLEEQWEKCNCFVLAWIMNTVSKKLLSGIVYADDATTVWKDLRDKVDGSRIYQLHREICTIYQERLNCSKECIGRKVHLPNGETTSVTYIGDYSMPGGDSLENVLVVHAFKDLLSVSQITRQLKCSINFFPKFVIFQDLSDGRVKGIDTSLIDDLVSQKVDLEDVTSSLLQEETFSDNSMYDIDLHHDAQNDLVDTNIPNDIVDNVDLPAENANLPIDVVQPRQSLGTPHPPIWMKDYVTQVSDSCQPYSLSNYVFYQNITPSYAAYLSKFSTEVELRNYEEAVQDNRWVEAMRLETKALEDNGTWKLVNLPASKPVIGCKWIFKIKYQADGKVDRFKASLVAKGYNQTEGIDYQETFSPVVKMVTVRSSKGIVMNQRKYALEMISEVGLAVAKPVLTPLECNMKLTSVEFDQSTTIIDELFMDVNKYQRLVGKLLYLTNTRPYITFTEQSLSQFMQKPKMSHWEATLRVVSEYHKLIPFNPLVKKIAVDIVRDYTGSEDGLESLGKYSNVVLPSLSRLLGEKKVVSEPAAQALVNLSQKPELAGCSHWFSTINMAKLNTSFFYSVIKKYWFLMLIMLIAFRDWQSADEKMHGLYVMKLVRSFCSSSCEGKVDPFEHVASVLVNISKKEDGRKLLLDQKRCLLKQIVRNDSKSLLRKRGVAGTIRNCCFEAENQLQNLLLISEFLWPALLLPVAGNKVYSEEDTRKMPLELASALSIEREPVTDPEIRVQVLEAIYLLILQLLCLSYETTDFIVRGSFPSAMDDSEAGRRAFWSVNGPRILQVGYADEDDPKAMEAYERAGSLLIQESGLDEELTETSS

SEQ ID NO: 1748 - protein, 107 aa, Synechococcus sp. RS9917
MDDQTKARIESLIQSSPIVVFMKGTKLMPQCGFSNNVVQILNSLGLPFETFDVLSDMEIRQGIKEFSDWPTIPQVYVKGEFIGGSDILIEMYNSGELKEKLEVALAS

SEQ ID NO: 1749 - protein, 181 aa, Synechococcus sp. RS9917
MRSRLSLTALALAAGLSLTPAVAMAQADGAADSGVAKVLASGGAGFNVAAVQDLINRGDAAVAAGNLPEARKDYDNARSAAKQLLAFYRDLSGAFRGLDARIPREMDAKGRAALGLLAEANLRLAALFRRQNQPEVAVPVLVEVVRLMTPSQPQGQKAYQSLVELGFVETPFAAAKTAPAN

SEQ ID NO: 1750 - protein, 256 aa, Solanum tuberosum
MTQSNNVGSSSRSHDREMQVQRLYLMLGNMDNYRLHSKKDEDEKNLVSKKEVVKGVLLQQIVQAAVATVLFAVTGDDGESGGDRHTSIFVLGRQLFIAMLMLDTWQYFMHRYMHQNKFLYKHIHAQHHRLIVPYAFGALYNHPLEGLILDTIGGALAFLVSGMSPRTSIFFFSFATIKTVDDHCGLWLPGNLFHIFFKNNSAYHDIHHQLYGTKYNYSQPFFVTWDMILGTYMPYELERRPEGGFEAKPVKDCKEH

SEQ ID NO: 1751 - protein, 340 aa, Debaryomyces hansenii
VAALVIDNGSGMCKAGFAGDDAPRAVFPSIVGRPRHQGIMVGMGQKDSYVGDEAQSKRGILTLRYPIEHGIVTNWDDMEKIWHHTFYNELRVAPEEHPVLLTEAPMNPKSNREKMTQIMFETFNVPAFYVSIQAVLSLYSSGRTTGIVLDSGDGVTHVVPIYAGFSLPHGILRIDLAGRDLTDYLMKILSERSYTFSTTAEREIVRDIKEKLCYVALDFEQEMQTSSQSSAIEKSYELPDGQVITIGNERFRASEALFRPSDLGLEAAGIDQTTYNSIMKCDVDVRKELYGNIVMSGGTTMFPGIAERMQKEITALAPSSMKVKIIAPPRKKSSVWIGGS

SEQ ID NO: 1752 - protein, 277 aa, Arabidopsis thaliana
MAETLKEDSIMIREVWDYNLVEEFALIREIVDKFSYIAMDTEFPGVVLKPVATFKYNNDLNYRTLKENVDLLKLIQVGLTFSDENGNLPTCGTDKFCIWQFNFREFNIGEDIYASESIELLRQCGIDFKKNIEKGIDVVRFGELMMSSGIVLNDAISWVTFHGGYDFGYLVKLLTCKELPLKQADFFKLLYVYFPTVYDIKHLMTFCNGLFGGLNRLAELMGVERVGICHQAGSDSLLTLGSFRKPKERYFPGSTEKYTGVLYGLGVEDGTTTTVAN

SEQ ID NO: 1753 - protein, 578 aa, Pseudomonas viridiflava
MSDLTSLSGSMGNLSSLPGVGGTSMGIGASLTGAGQGAQGGQSALQELAGMLAEMLLGSGSGSGSGSGAGGGQSAGKGAQGGQSDLDSLLQSLQGNGQNGDRQTKDSGTAGGGEKELLTQVLMALFEKILGGSDSSSGAGNGSGGGSGGASGIGGGGTGASKDAGALGQGQGLGGTQGAAGGSSTEDLVNTLMQKLGGGSLDNSIQPTADGGGEVSQNGKLKELLEMIAQFMDSHPETFSQPSDGASKGGGGGGGGGGGGGGGGGGGGVAPTGTGGGGGAPSVGGGGGGGGGGGGGGGSPSVGGGGGGGGGGGTPSLGGGGGTPSIGGGGSTPAPTPGAGGGTPTPTGPTGTPSPTGPTGTGTSGSATPVSFPTASSNPTVINETIKVGPGETFDGGGKTFTAGKALGDGGQGEGQKPMFELAEGATLKNVVLGDNAADGVHVRAASEKAVNVDNVHWTNVGEDALTVKGEGGAKVTNLNITNSSAQGANDKVFQLNADANVNVDNFKVKDFGTFMRTNGGQQGDWNLDLKNISAENGKFSFVKSDSEGLNLSTSGIDLKNVENAYSKLPGSTNHKEA

SEQ ID NO: 1754 - protein, 249 aa, Exiguobacterium acetylicum
MKYTVITGASSGIGYETAKLLAGKGKSLVLVARRTSELEKLRDEVKQISPDSDVILKSVDLADNQNVHDLYEGLKELDIETWINNAGFGDFDLVQDIELGKIEKMLRLNIEALTILSSLFVRDHHDIEGTTLVNISSAGGYRIVPNAVTYCATKFYVSAYTEGLAQELQKGGAKLRAKVLAPAATETEFADRSRGEAGFDYSKNVKKYHTAAEMAGFLHQLIESDAIVGIVDGETYEFELRGPLFNYAG

SEQ ID NO: 1755 - protein, 991 aa, Roseovarius nubinhibens ISM
MDRRAFLRGSGLAIGGLTAIAATGGTVTQASAAGAVTGKVDLKKSVCTHCSVGCTVVAEVAGGVWVGQEPGWDSPFNLGSHCAKGASVREHAHGERRLKYPMKKEGGEWKRISWEQAINEIGDQMEGIREESGPDSVYWLGSAKHSNEQAYLFRKFAAYWGTNNVDHQARICHSTTVAGVANTWGYGAMTNSYNDIHNSKAIFIIGGNPAEAHPVSLLHVLKAKEQNNAPLIVCDPRFTRTAAHADEYVRFRPGSDVALIWGILYHIFENGWEDKEFIRTRVWGMDQIREEVAKWTPEEVERVTGTPGSQLKRVAMTLANNRPGTVIWCMGGTQHTNGNNNTRAYCILQLALGNMGVEGGGTNIFRGHDNVQGATDVGVLSHTLPGYYGLSAGAWAHWARVWEEDSEWLSNRFAKVTGADGKEKSLQNLTGIPVSRWIDGVLEDPANTDNPDKVRAMVLWGHAPNSQTRMTEMKTAMEKLDMLVVIDPYPTVSAVLHDRTDGVYLLPAATQFETRGSVTASNRSLQWREQVVDPLFESKPDHEIIALFAKKFGFHDRLFRNIELEEDGLTPNVEDTLREINRGMWTIGYTGQSPERLKLHMENQHTFDRTTLRANGGPADGDFYGLPWPAWGTPEMKHPGTPNLYDMSKPVAEGGLCFRARFGVERDGDNLLAEGVSNPGAEIQDGYPEFTYQMLVDLGWDGDLTDAEKRSIAKVAGVDVAGDVGQSDDGEDKTTEGAQLTQPSGEQGAAEEVGEQSMSPFPSDFNERASTINWKTDLSGGIQRVAIKHGCAPFGNAKARAVVWTFPDPVPKHREPLYTNRRDLVEDYPTYEDRKFYRLPTLYASIQKQDFSKDYPIILTSGRLVEYEGGGDETRSNPWLAELQQDMFVEINPRDANNLGVRDGAQVWVEGPEGGKVKVMAMVTERVGEGVAFMPFHFGGHFQGEDLRSKYPDGADPYVLGESTNTAQTYGYDSVTQMQETKATLCKIMPA

SEQ ID NO: 1756 - protein, 189 aa, Triticum aestivum
  misc_feature (26)..(26): Xaa can be any naturally occurring amino acid
  misc_feature (53)..(53): Xaa can be any naturally occurring amino acid
  unsure (1)..(189): unsure at all Xaa locations
WASSAPSVSPFPGVKSTAGLPSSRRXNGASLGSVSNGGRIRCMQVWPIEGIKXFESLSYLPPLSTEALLNQVDYLIRSKWVPCLEFSKVGFIFREHNASPGYYDGRYWTMWKLPMFGCTDSTQVINEVEEVKKEYPDAYVRIIGFDNMRQVQCVSFIAFEPPGCEESPPPPPAHLRQAIYEVPLQVCQV

SEQ ID NO: 1757 - protein, 374 aa, Clostridium acetobutylicum ATCC 824
MANKDYYEVLGLEKGASDDEIKKAFRKLAIKYHPDKNRGNKEAEEKFKEINEAYQVLSDPDKKANYDRFGTADFNGGGGFGDFSGGFGDFGDLGDIFNSFFGGGFSGGSSRARKDAPQRGNDMEYSISLTFEEAVFGVEKSINITRSENCETCGGTGAKKGTSPKTCDKCGGTGTIRVQRNTPLGSFVTQSSCDKCGGRGTIISDPCHECHGAGHVRKKRKISVKIPAGVDTGNVIPLRGQGEHGKNGGPAGDLYISIKVTPHKKFKREGFDIYIDTHISFPKAALGTDMTVPTIDGDVKYTIPAGTQSGTVFRLKGKGVQRVNGGGRGNQYVKVIVDTPKALNDKQREALKMFMEASGEAKSEKKSGFKRFFE

SEQ ID NO: 1758 - protein, 244 aa, Triticum aestivum
  misc_feature (180)..(180): Xaa can be any naturally occurring amino acid
  unsure (1)..(244): unsure at all Xaa locations
MSGTGYTVEVTNLSSSASENDLHEFFSFSGPIEHIDLIRSGGYGSTAYVTFKEPFALETAVLLSGATIVDQPVCISRWGQPDEPCNFWDRPTWQVEEEIEYRDYQSCQFNATPQEALTVAQDVVKTMLSRGYILSKDALSRARAFDESHQLSGSAAAKAAELSRRLGLTDRVSAGVGQSXSGRETYHVTETTKTVATATGRTAVKVMNTIVTSSYFSAGAMMVSEALTRAAKAAENLAAHGRQN

SEQ ID NO: 1759 - protein, 395 aa, Oryza sativa
SPSSFGMGCCGGMSSTSRAPRGIREETLLRVPGASVHLLDGAEGPVELARGDLAVVRIAKDGVAVATVARVGRGLGWPITRDEPVVRLDRLHYLFTLPDSTGGGGGGGGGALFLNYGVSFAAPDDALLASLDAFLKANACFSTPSSPAPSRSSATTTTRPAPTTTATADGYWNDFAPRMDSYNNVLAKAIAAGTGQLVRGIFMCSEAYATQVQRGADLIRPQATGSVTKRSGGAGGGGASRTTGQPDAKRGGVNKSLKRVRKLSEMTEKMSQSLLDTVIAVTGSMAAPLLRSKQGKAFLATVPGEVILASLDAINKVMDAVEAAERRSLAATSNVVSGAVSRRYGESAGEATEDAFATAGHAVGTAWNLFKIRKAVTPSSSLPGNMVKSAVRNRK

SEQ ID NO: 1760 - protein, 114 aa, Clostridium acetobutylicum ATCC 824
MDECIFCKIIKGEIPSSKVYEDEDVLAFNDISPAAPVHVLVIPKKHISSLNDINEENSKVIAHVFVVISKLAKELGIDEDGFRVVSNCGEAAGQTVHHVHFHLLGKKKFTWPPG

SEQ ID NO: 1761 - protein, 969 aa, Oryza sativa
  misc_feature (813)..(813): Xaa can be any naturally occurring amino acid
  unsure (1)..(969): unsure at all Xaa locations
MSGEKVPLPVPEKDKPETDAEREARLAKERATGKDELRDLQQKVEKAPTETTSADVQHDDLSEDDLKLKENLAMLVTRITEPNNPPELRKSAIDALSTEIRSSTSSMTAIPKPLKFLRIHYDTLKKFFETPDAKPVQPYLADVLSVLSMVHQQESARDSLKYRFLGSQGDIGFWGHEYVRHLAAEIAVELEEREKAKQDTAEIFKLVGEITPFFMKHNAETDACDLLLEVDRVPDLTKFVTEDNHARVCAYLVACSEYTSDAEDKLKLLTTAFESLLQVKLYPDALRIAFKLSDPELVSKVFNECEDELVKKQLAFIAASHRYSVSALSDQSQDIQDIVGNVHLVKHFKVLAQDLDVQEAKTPEDIYKSHLAEGGGPMRRMRQNQPQKVDSAKQNLASSFVNAFVNVGFGNDALLLTKDSEWLYKNKEHGQLSAAASLGLLMLWDQENGVNAIDKYSHSSQVHIKAGALLAQGIISNGVTSEMDASLALLSDHLNSDQHLMRVSAVFGLGLAYTGTCREDVLEQLVPIVVDPNQPFEVVAFAAVSLGLVFAGSANEAISSTLVETFMERSDTDLRDSLARLMAIGLGLLFLGKTDQTEAVLVAISAIEHPIKDFLALTVETCSHFGSGDVLEVQKLLSIAGEHIEEPEKEEKKEEAKDGAAAAANPAANPLLASLGLGGAAAGAAAGAAKDKDKEEKDENVNFAQLHQAVAVLGIAMVTTSEELGAQMALRSLDHVLQYGDVNVRRAIPLALALLSISNPRLSVVDTLSKLSHDVDQEISQNAVLCLGLVGAGTNNSRIASLLRQLATYYSKXPNHLFLVRIAQGLLHLGKGLITLSPYHSDNLLFIPSAAAGLLVVLFSGLDFKNSILSKRHFLLYSLVSAVRPRMLLTVDEDLKPVPVKVKYGTSVDTVGQAGKPKTITGFQTHNTPILLSHGERAEIATDEWIPLTSVMEDIVIVRKNPNATKENE

SEQ ID NO: 1762 - protein, 600 aa, Escherichia coli CFT073
MVNNMTDLTAQEPAWQTRDHLDDPVIGELRNRFGPDAFTVQATRTGVPVVWIKREQLLEVGDFLKKLPKPYVMLFDLHGMDERLRTHREGLPAADFSVFYHLISIDRNRDIMLKVALAENDLHVPTFTKLFPNANWYERETWDLFGITFDGHPNLRRIMMPQTWKGHPLRKDYPARATEFSPFELTKAKQDLEMEALTFKPEEWGMKRGTENEDFMFLNLGPNHPSAHGAFRIVLQLDGEEIVDCVPDIGYHHRGAEKMGERQSWHSYIPYTDRIEYLGGCVNEMPYVLAVEKLAGITVPDRVNVIRVMLSELFRINSHLLYISTFIQDVGAMTPVFFAFTDRQKIYDLVEAITGFRMHPAWFRIGGVAHDLPRGWDRLLREFLDWMPKRLASYEKAALQNTILKGRSQGVAAYGAKEALEWGTTGAGLRATGIDFDVRKARPYSGYENFDFEIPVGGGVSDCYTRVMLKVEELRQSLRILEQCLNNMPEGPFKADHPLTTPPPKERTLQHIETLITHFLQVSWGPVMPANESFQMVEATKGINSYYLTSDGSTMSYRTRIRTPSYAHLQQIPAAIRGSLVSDLIVYLGSIDFVMSDVDR

SEQ ID NO: 1763 - protein, 130 aa, Zea mays
MVRVSVLNDALKSMYNAEKIGKRQVMIRPSSKVIIKFLTVMQRHGYIGEFEYVDDHRSGKIVVELNGRLNKCGVISPRFDIGVKDIEGWTARLLPSRQFGYIVLTTSAGIMDHEEARRKSVGGKVLGFFY

SEQ ID NO: 1764 - protein, 187 aa, Prochlorococcus marinus subsp. pastoris str. CCMP1986
MNPLSVSIETNKYDNMKVLKLIPIIFISLGIFSPTNTVYADSDDPNNYKVLKSTNKRLSITNVEALLREGDNLIKSGEIEKAKDSFDKARNLAKKLAGFYGDLNGSFKGLDARIPREMTEKGKNSLKIWAESNERLAAVYKSKNQPEVAVPLLVEIIRLMSPASSEGKEAYKELVQLGFVETPYKGL

SEQ ID NO: 1765 - protein, 107 aa, Prochlorococcus marinus subsp. pastoris str. CCMP1986
MENPTKNKIQNLIDLNPVMVFMKGTKLMPQCGFSNNVVQILNSLGVTFNTFDVLSDFEIREGIKEYSEWPTIPQVYLKGEFLGGSDILIEMYNAGTLKEKIEIALAS

SEQ ID NO: 1766 - protein, 189 aa, Xanthobacter autotrophicus Py2
MGDTIAALVVMGVSGCGKSSVGAAVAELAGARLIEGDSFHPASNIAKMSAGIPLDDDDRAGWLARLGEEMARTLADGAAPVLTCSALKLKYRDALRAAVPGLGFVFLDLTREMAAHRVAERPGHFMPASLIDSQFAALERPSAEALTLTLDATLPLSEMVPRVVEWWRASAERRAGARHIPGSTLSQAV

SEQ ID NO: 1767 - protein, 342 aa, Yarrowia lipolytica CLIB122
MFHALGSIASVVFPIFASYRAIKSHDMTYATPWLKYWVVMGIEQALENTFGVVLSVLPLYSLARLVFFAWLVLPQSQGAVRLYDEKVEPFLDRYNTQIEDFFANGHTYVRDYGLQYLSVLVKWLTGKGFDTEAAKSTSANPAPATPVVPQSYMDSVMGYIKSNSPATGGKITRLFDMYRAAGAVGGAVGSREVTETVEIPSSLPHSEQLGLIDKERSRLLAALSSLDARGSLLKSDTKSKSNASLASGVNITASDYSPLLASSSDTEFDVVKSEDVLGLDGNVKDERPNSRGWFWQRHYSKVGEANKAGYEKLVDPPSEPPVSGASMARESEEEEPLIPSNL

SEQ ID NO: 1768 - protein, 226 aa, Candida glabrata CBS 138
MLTGVLFTILYFLSHFSGPSSADSAFRQVGPGSRNSKGGGNLGPPIMEAEMNGNTNNIEKAEAGNKAMDTTSNSGTSNENAQLPGSKDQTDSNSNSLSNKEGQEDAEEAADAEYSPAKEFQKLVKSAPIVIFSKSYCPFSKNLKKLLDKNYRLDPAYVAVEVDQHPNGDKLYSYIKKLTGRNTVPNLIANGDSKGGFDDMLALHNSNELESKLIEWGVGELQVSKV

SEQ ID NO: 1769 - protein, 218 aa, Prochlorococcus marinus str. MIT 9303
MFGFLKKVADYTRDAADAANYLIQGLAVTFDHLRRRPITVQYPYEKLIPSERYRGRIHYEFDKCIACEVCVRVCPINLPVVDWVMNKETKKKELRNYSIDFGVCIFCGNCVEYCPTNCLSMTEEYELAAYDRHSLNYDNVALGRLPTSVTTDPSVQPLRELAYLPKGVMDPHDVPANQPRAGQLPAEVLKSLSLQQDSLQGDEGESLQDAPDQDQPKG

SEQ ID NO: 1770 - protein, 397 aa, Candida glabrata CBS 138
MRKEQGQTGFARRTIVPVVSVVSFLSCCVVLLVIQVTAKLRFSQNKTRLTHVYNYTKKQFIVLLTSILRIVAPCEIRVTTDNGSIPKGTFYQDSSSGRLRANLLERSITISNHQIYTDWVFLWWLAYAGDKAGNVFIMLKKSLRKIPVLGYGMENFNFIFMNRKWAYDRVNMSNHLSAIEADSLGCGPISGNKPVKVNSDGEEVWDMKSSAQRNIKWPYNLILFPEGTNLSAHTRKVNEAYAEKIGRVPYRHVLLPRATGLRFCLQKLRNSVDVVYDTTIGYSGILSTEYGQDAYSLKNIFFRGKYPKLVDIHVRSFKLSDIPIDDEIDFIEWLFKVWEEKDKMMEYFYEHGTFENMTDNQESVLVDCSIKNYEFFPVFIIPFCFVLLTYWIVRSIF

SEQ ID NO: 1771 - protein, 664 aa, Erwinia carotovora subsp. atroseptica SCRI1043
MSTEPLSINPLSAKPLSATQEPSTSSKPSRREQRAAAQRFIETLQGTAFPNSKRIYLTGSRDDIGVPMREIQLSPTLLGGSKDDPQYEPNEPIPVYDTSGPYGDPAAQPDVHVGLAKLRANWIAERHDTEALSGVSSDFTQQRMADAGLDHLRFEHLPRPLRAKAGKRVTQLHYARQGMITPEMEFIAIRENMGRERIRGEVLRQQHPGQSFGALLPENITPEFVRQEVAAGRAIIPSNINHPESEPMIIGRNFLVKVNANIGNSAVTSSIEEEVEKLVWSTRWGADTVMDLSTGRYIHETREWILRNSPVPIGTVPIYQALEKVNGVAENLNWEMFRDTLLEQAEQGVDYFTIHAGVLLRYVPMTAKRLTGIVSRGGSIMAKWCLSHHKESFLYEHFREICEICAAYDVALSLGDGLRPGSIQDANDEAQFAELHTLGELTKIAWEYDVQVMIEGPGHVPMQMIRRNMTEELEHCHEAPFYTLGPLTTDIAPGYDHFTSGIGAAMIGWFGCAMLCYVTPKEHLGLPNKEDVKQGLITYKIAAHAADLAKGHPGAQIRDNAMSKARFEFRWEDQFNLALDPQTARAYHDETLPQESGKVAHFCSMCGPKFCSMKISQEVRDYAAKQETEAKPIEIGMAEMSQEFRSRGSELYHSATSLQAEESK

SEQ ID NO: 1772 - protein, 435 aa, Ralstonia eutropha JMP134
MPPPEHCAPAIARACTSPDGWRGMLRFAGPGYLVAVGYMDPGNWATDLAGGSAYGYRLLWVIAMSSCMAVLLQILASRLGLVAGMDLAQACRHRSPRLSALAQWVLCEIAICAADLAEVLGTAIALNLLFGLPLAWGVALTVFDVLLVLVLQQRGYRRLEAFVISMVALVLCCFILMLLISRPAWPDVAAGLVPYGPTMRDPSALYIAIGIIGATVMPHNLYLHSAAVRTRALDGSPQDLRRALRFIAIDTVIALSLAFVINAAILITAAGVFFKAGRTDVAEIQEAYRLLSPLTGAAWASVVFGVALLASGQCSAVTATLAGQVVMEGFLRTRLPPWLRRLATRCVAIVPALVVAILYAERGIAQLLLASQVILSLQLPFAAIPLVRSTSSCALMREHVNPRWLAVLAWIAVAVIVSMNATMLWMLAGSPAAGG

SEQ ID NO: 1773 - protein, 780 aa, Arabidopsis thaliana
MVEEDLNQIGGNSNYNGEGGDPESNTLNQPLVKANRTLSSTPLALVGAKVSHIESLDYEINENDLFKHDWRKRSKAQVLQYVFLKWTLACLVGLFTGLIATLINLAVENIAGYKLLAVGHFLTQERYVTGLMVLVGANLGLTLVASVLCVCFAPTAAGPGIPEIKAYLNGVDTPNMFGATTMIVKIVGSIGAVAAGLDLGKEGPLVHIGSCIASLLGQGGTDNHRIKWRWLRYFNNDRDRRDLITCGSAAGVCAAFRSPVGGVLFALEEVATWWRSALLWRTFFSTAVVVVVLREFIEICNSGKCGLFGKGGLIMFDVSHVTYTYHVTDIIPVMLIGVIGGILGSLYNHLLHKVLRLYNLINEKGKIHKVLLSLTVSLFTSVCLYGLPFLAKCKPCDPSIDEICPTNGRSGNFKQFHCPKGYYNDLATLLLTTNDDAVRNLFSSNTPNEFGMGSLWIFFVLYCILGLFTFGIATPSGLFLPIILMGAAYGRMLGAAMGSYTSIDQGLYAVLGAAALMAGSMRMTVSLCVIFLELTNNLLLLPITMIVLLIAKTVGDSFNPSIYDIILHLKGLPFLEANPEPWMRNLTVGELGDAKPPVVTLQGVEKVSNIVDVLKNTTHNAFPVLDEAEVPQVGLATGATELHGLILRAHLVKVLKKRWFLTEKRRTEEWEVREKFPWDELAEREDNFDDVAITSAEMEMYVDLHPLTNTTPYTVMENMSVAKALVLFRQVGLRHLLIVPKIQASGMCPVVGILTRQDLRAYNILQAFPLLEKSKGGKTH

SEQ ID NO: 1774 - protein, 640 aa, Arabidopsis thaliana
MSSTFRAPAGAATVFTADQKIRLGRLDALRSSHSVFLGRYGRGGVPVPPSASSSSSSPIQAVSTKPETATKRSKVEIIKEKSNFIRYPLNEELLTEAPNVNESAVQLIKFHGSYQQYNREERGGRSYSFMLRTKNPSGKVPNQLYLTMDDLADEFGIGTLRLTTRQTFQLHGVLKQNLKTVMSSIIKNMGSTLGACGDLNRNVLAPAAPYVKKDYLFAQETADNIAALLSPQSGFYYDMWVDGEQFMTAEPPEVVKARNDNSHGTNFVDSPEPIYGTQFLPRKFKVAVTVPTDNSVDLLTNDIGVVVVSDENGEPQGFNIYVGGGMGRTHRMESTFARLAEPIGYVPKEDILYAVKAIVVTQREHGRRDDRKYSRMKYLISSWGIEKFRDVVEQYYGKKFEPSRELPEWEFKSYLGWHEQGDGAWFCGLHVDSGRVGGIMKKTLREVIEKYKIDVRITPNQNIVLCDIKTEWKRPITTVLAQAGLLQPEFVDPLNQTAMACPAFPLCPLAITEAERGIPSILKRVRAMFEKVGLDYDESVVIRVTGCPNGCRRPYMAELGLVGDGPNSYQVWLGGTPNLTQIARSFMDKVKVHDLEKVCEPLFYHWKLERQTKESFGEYTTRMGFEKLKELIDTYKGVSQ

SEQ ID NO: 1775 - protein, 675 aa, Aspergillus nidulans FGSC A4
MPPKLFKKLVIAVSGTFPGYRQGRNFCDVQFLIEFFKSTTRELTRHSYAGDLKAIVERHGATFTSSVGTDCTHLIATQKEADKKGAKLSLDWLLDSDKAKKPVSEAPYRFGASHSNRNSQADPAKSEKKRSAKAVQDTDDDRSNKKPKQIMEDAQMITAEKAAKVRVRVDEYYHSNEHTWQVFIDDSGLIWDATLNLTVSAANNNKFYLIQILNSKDGSRYQTWTRWGRVGERGQSVLLGDGTLDSAKKQFEKKFKDKSGLAWKDRLNSPKNNKYTFIERNYEESDDEDEKSDNKLVKQPSNIPASKLPAPVQNVISFIFNQKYFLETMAQMSYDANKLPLGKLSKRTLMAGYETLKELAELATKPSMAMSKYGMQLRPAMEQLSNRYFTTIPHVFGRNRPPVLDNQAYIKREIELLETLTDMEITNSILKDASKMEDANPLDSQYAGLGMQEMTPLDHASEEFRELEKYLSGTRGSTHGVKYKVIDIFRIERQGEHDRFKSSSYAGLKNSNRRLLWHGSRSTNYGGILSQGLRIAPPEAPVSGYMFGKGVYFADMSSKSANYCWSHNSDHKALLLLGDVELGDPIYELYDSDYNAGENAKKEGKIATLGKGRSIPAGWKDAGCIHPHLKGIQVPDADSGTTDHKTDQGYLLYNEYIVYDVAQIRLRYLFFVDMR

SEQ ID NO: 1776 - protein, 202 aa, Triticum aestivum
MDLSPNPESPNAPGGCGGSGAGGSSGGGGASSSAGGGGTPQTPSRYEAQKRRDWNTFGQYLRNHRPPLSLAQCSGAHVLEFLRYLDQFGKTKVHTASCPFFGHPNPPAPCPCPLRQAWGSLDALVGRLRAAFEEHGGRPESNPFAARAVRLFLREVREHQARARGVSYEKKKRKKPTPGDASSSGSHQAPPPPPPPPAGAAC

SEQ ID NO: 1777 - protein, 502 aa, Aspergillus nidulans FGSC A4
MLAYSRYPRAIITPDTGNKFSIHPNDIGINNVIHPSDSRLQAPQHRIGSKRKLPTYSSRGFGLAGLGVGARLAQQGLRRGADLIRRRMLIDVEITHKDDSYPWFLNWMTQYQQSQLSASRSQASGSGFVDSLLTKLTPRMRQLSVDTKTVKHSNGAINTHFTLVPGLGRHVLRYKNTFIFVNRMRESKAQELTTGRPWETMTLTTLYSHRHVFEDLFAEAHAYVVKANEGKTTIYRADTATWTPFGDPRRKRTLDSVILDKGVKERIVEDVKDFLATESWYHDRGIPYRRGYLLYGPPGTGKSSFIQAVAGELDYDIAILNLSERGMTDDRLNRLLTIVPKRTLVLLEDVDAAFSNRRTQTDEDGYRGANVTFSGLLNALDGVASAEERIVFLTTNHVERLDEALVRPGRVDMTVRIGELTRYQATCFWERFYGDLDSTGSYKQAFLERLYELGLIENENGERLDPPQSTSAAALQGLFLYNKGNMQGAIAMAEGLTYRIQE

SEQ ID NO: 1778 - protein, 524 aa, Oryza sativa (japonica cultivar-group)
MATCSWAATTAAAAPPRPPARCRSRVAALRRTAAASAAAASCVLAEAPKGLKVEQADAVEPAAAAAARRDVGPDTVASIILGGGAGTRLFPLTRTRAKPAVPVGGCYRLIDIPMSNCINSKINKIYVLTQFNSQSLNRHIARTYNIGEGVGFGDGFVEVLAATQTTGESGKRWFQGTADAVRQFLWLFEDARLKRIENILILSGDHLYRMDYMDFVQKHVDKGADISVACVPVDESRASDFGLMKTDKNGRITDFLEKPKDESLKSMQLDMGTFGLRPEVADTCKYMASMGIYVFRTDILLRLLSLRYADTLSLCSVSFRGHYPTANDFGSEVIPMAAKDYNVQAYLFDGYWEDIGTIKSFFEANLALTDQSPNFYFYDPVKPIFTSPRFLPPTKVENCKVLNSIVSHGCFLTECSVDRSVIGVRSRLEPGVQLKDTMMMGADYYQTEAERFSELSDGKVPVGVGENTIIRNCIIDKNARIGKNVMIMNSQNVQEAERPLEGFYIRSGITVVLKNAVIPDGTVI

SEQ ID NO: 1779 - protein, 693 aa, Nicotiana tabacum
MTTSFGAAINIAVADDPNPKLQIHNFSGLKSTSNSLLLSRRLHVFQSFSPSNPSSIVRAVSTPAKPAAVEPKRSKVEIFKEQSNFIRYPLNEEILNDAPNINEAATQLIKFHGSYMQYDRDERGGRSYSFMLRTKNPGGEVPNRLYLVMDDLADQFGIGTLRLTTRQTFQLHGVLKKNLKTVMSTIIKNMGSTLGACGDLNRNVLAPAAPFAKKDYMFAKQTADNIAALLTPQSGFYYDVWVDGEKVMTAEPPEVVKARNDNSHGTNFPDSPEPIYGTQFLPRKFKIAVTVPTDNSVDIFTNDIGVVVVSNEDGEPQGFNIYVGGGMGRTHRMETTFPRLAEPLGYVPKEDILYAVKAIVVTQRENGRRDDRRYSRLKYLLSSWGIEKFRSVTEQYYGKKFQPCRELPEWEFKSYLGWHEAGDGSLFCGLHVDNGRVKGAMKKALREVIEKYNLNVRLTPNQNIILCNIRQAWKRPITTVLAQGGLLQPRYVDPLNLTAMACPAFPLCPLAITEAERGIPDILKRVRAIFERVGLKYSESVVIRITGCPNGCARPYMAELGLVGDGPNSYQIWLGGTPNQTSLAKTFKDKLKVQDLEKVLEPLFFHWRRKRQSKESFGDFTNRMGFEKLGEFVEKWEGIPESSSRYNLKLFADRETYEAMDALASIQDKNAHQLAIEVVRNYVASQQNGKSMD

SEQ ID NO: 1780 - protein, 382 aa, Phaseolus vulgaris
MAIDCMTNIQTMSQPQKHHHQDNKEDEAPLVFDASLLRHQLNLPKQFIWPDDEKPCMNVPELVVPLIDLRGFLSGDPVATMEAARMVGEACQKHGFFLVVNHGIDANLISHAHSYMDDFFEVPLTQKQRAQRKTGEHCGYASSFTGRFSSKLPWKETLSFQFSAEEKSSTIVKDYLCNTLGQEFEQFGRVYQDYCDAMSNLSLGIMELLGMSLGVGKACFREFFEENDSIMRLNYYPPCQKPDLTLGTGPHCDPTSLTILHQDQVGGLQVFVDNEWHSINPNFNAFVVNIGDTFMALSNGRYKSCLHRAVVNSKTTRKSLAFFLCPKGDKVVSPPSELVDDLTPRLYPDFTWPMLLEFTQKHYRADMKTLEAFTNWLQQKRS

SEQ ID NO: 1781 - protein, 321 aa, Zea mays
MFYGGYAYHGNSFEQTYRCYPASFFDKPHLEGGDKVIMPPSALDRLASLHIEYPMLFELHNDATQRISHCGVLEFVAEEGMIIMPYWMMQNMLLQEGDTVHVKNATLPKGTYVKLQPHTTDFLDISNPKAILEKTLRNFSCLTTGDSIMVAYNNKQYYIDIVETKPASAVSIIETDCEVDFAPPLDYKEPEKPRQPTVLASKTPAEDGNTAAEDEPKFKPFTGFGKRLDGKASKLQASEVPSTALSAPSDSNKRANQQISAPAASGASSYSRQKTGKLVFGSSASNNKEPQKAPAKEEQPAKKDDELRFQAFSGKSYSLKR

SEQ ID NO: 1782 - protein, 334 aa, Aspergillus oryzae
MTAKVGINGFGRIGRIVFRNSFSHENTEVVMVNDPFIEVQYAAYMLKYDSTHGNFEYDVHIDGDSIVVNGKKVKFYAEKDPAKIPWKDAGAEYIIESTGVFTTVEKASAHLQGGAKKVIISAPSADAPMYVMGVNEKTYAGADVVSNASCTTNCLAPLTKVLHERFGVVEGLMTAVHAYTATQKLVDAPSKKDWRGGRAAAQNLIPSSTGAAKAVGKVIPELQGKVTGMSIRVPTSNVSVVDLTCRLEKGASYEEIITAIKEAAQGELKGILDYTEDDVVSSDMKGNPHSSIVDIKAGISLNPNFLKIVSWYDNEWGYSRRVLDLTAYIASVGK

SEQ ID NO: 1783 - protein, 2578 aa, Corynebacterium diphtheriae NCTC 13129
MRDSALPRYFRALVAVISAISLVGVGLHATQPTARADEELAPAVVAGTFQKNLGCSKEWEESCDKTRMKRKGNLYATTLKIPEGDWKFKVVLNGDWGTSYGAPGFDENNIPLKLTKDTELEFSFDPLSHRIGLKPVGLDDEKLKTYDDSKDKDIVGAPFKHSAAGKNFYFVLTDRFQNGNPENDRGGAKDGDKNDHGFDPTDKAYYHGGDIEGLIKQLDYIKNLGTTALWLTPSFKNRAVQCGHDPKDCSSGYHGYWITDFTQIDPHLGSNDDLKRLIEEAHNKGIKVYFDIVANHTADLIQLAGGNQYISEDQQKYKDVDGKEFLLKDYAGKKEFPELNDFSFPYKPIRKPEDNIIVPKELNDVHLYHNRGNNTWEGESVIHGDFEGLDDLMTEHPKVVSHMIEAYNKWAGFGLDGFRIDSVKHVNMEFWKEWTEAVKKHAKESRAGEKEDFFMFGEVFNGTAESLSPFVRDTQMDAALDFAFHYKALDFAKGQSTQGLHDLFYSDDWYTTTRSDATNLPTFLGNHDVGRIGYLLRDNDDKVQRDVLAHQLMFLTRGQPVVYYGDEQGFAGTGDGKDKQARQDMFGTQVDEFKNEQDIYGKQLGSDNHFKESGELYGKIKQLAELRTANKALATGAQIERWETPGPGIYAFSRVDRDEKQEYLVALNNSHLEQTATPAPLTPNASFTKIYGEGPDKISPNLDGTVNLKLPRLSAVVYKVESNQKVSGAVDGTGLSVKGQALKDNAPIMTNIGGKAWSETSFAWRELGTEEWKKLGTDTGQNARVFHDVRDLKPGTIVEYRTVTVDADNNKTASTGWGVVGVDLGVDTAALLAPSAVVAGDFTKDLGCTGGDQGNWDPACAKTELKSVGGTDWHTVKLNLKAGEHQYKIAVAGSWNENYGQEKDGDRPNDRGYHNGKNVKFNLDREQEVQFFYNPVTNEFFNSVEHGVITLPGTMGGALNCPKNDQKSDEHGNWGPACLATLMTKTGDHIYEFSSPKVPTPGNYDVKVAYGLEWGNDWGPDGHKTQRNYDVKITDSGILHYRWDENKHELTWNITERSSLDLQDTFAHWLDDRTIAVPRSQLRDASPSDVEGLLVSVSDGKPSIKSGKGASSQADAKIEEQKLHYVGQIGGDLLARNPHLDGMVTFRFKDEVQKDKARELLQGGLGFAVVKKKEQEPVSFTGVQIPGVLDAHYAADARDAQLGVHWKGDKPTVSLWAPTAKNVKLKLFGEEGSLGNGEDHKMDYDKTTGVWSVEGKPDWKNHAYQFEVEVYAPSTHKVEHNLTTDPYSVGLSMDSKYSVMLNLNDPELKPADWGKAMDPIDPVDRMIYELHVRDFSASDKSMDQQYRGKYKAFTQSGSKSVMHLKELADAGLNSVHLLPTNDIATIPEDPAKAKTPAITSTGAADTQQQEAVAAVQKEDAFNWGYDPYHYMAPEGSYATKPDAKTRVKEYREMVKALNGMGLHVVSDQVYNHAFQGQQDEKSVLDKVVPGYYHRLMLDGKIANSTCCANLATEHVMMEKLMTDSVKSWAKNYHIDGFRFDLMGHHSAANMINVQTELSELTVEKDDIDGSSIYLYGEGWNFGEVENNQRFIQATQENLAGTGIGTFNDGLRNGVHGHEGRTQGFGTGLAMEGNGTDQKDQGHLRHLTDIVRVGMAGNLQDFKFNSKDGYKRGGDIWLDGKRIGYGLMPQDTVNYVDAHDNQTLYDLSVLQLPQSLSMDDRVRMNTVQLATVALGQSPAFWHAGTEIMRSKSLDRDSYNSGDHFNKLDLSMQEHNFGVGLPIAEKNDKQWELYKGFLNDEHLKAKPEDLKKANDMAKELMTLRKDNPLMRLGDVDQIQEKVTFPANGPDAQPGLIVMNIDDTKGEDRDAKRDGILIVINSSPKQIEQTINELEGLDFTLEKTLAEGVDKETQKGSTWNKAEKKLTIPARTVAVFERTQNEAAHHDPQYPETKVFKDATEDVKVEGPKDMPETAKYSIDPAVDGVSVDEKTGALTVKPTAIKEDGLVVTVTVKYSDGSEDRAVAKFVTDTSIASMYDPTYEETKAESADKKVTIKKPMSGEKSLPEDAHFTLEGESAKKATIDGFTGEITVEPLKDERRLELDVKVTYADESVDMVKAVVVAGDTLADQHDPKYADTQMEKGTKTVIAAPEGMPENIKYELAEPQDGVTVRDDGSIEVTTDAESLDIKVKVTYSDKSTDTAVAHVTTVAQTEQSVEVTPGTQTLVDVPGNGDVTVTVPQNSGLKAEVAGNLVTLTSDGSVEGHVTVTYQVKDADGKTTTGKINVQVAKLAEASWPKSASVAAGDSTVITPEGVDTLPYGTTLSVGSLPEWATFDQTTGQLTLTADEDATDESTTATITVAYPDGLTKQYSVALSVGAATETTADQHDPQWESVVVNGDSVTSHGVDVPADAEVSVDKLPEGWTATVTGSDVEITPAAGSPAGHVIALPVTVRYADGTTDTAVINVLTQPDWSTSNKAPKADSGMFYQAGPGAPAWVRVNNDGSMTWADNAPEGTHEIPVIVTKDGVHYLVTASVNAPKKVVLDTEGSSSILGVVVAILAAGGIMALFALLFNCTWFKNCR

SEQ ID NO: 1784 - protein, 210 aa, Brassica napus
MAEPLCESPFVGDIDTSAPFESVREAATRFGGFGFWKPSSLSNIFEPSQNDVDEANIVASELEKELISKEGEALKVLKSLESIKAIVEELKSKLHRREDKENCDMSVLKELNQAKTNLCKTTEDLAAIRESVELLNMRLEEERAALEKTRERLNSENAAEISKEIQRLSDDALEFSKTGEEARFAVDKAVCEIERTRSKIKAAEMRLGRC

SEQ ID NO: 1785 - protein, 366 aa, Medicago truncatula
MASTLPPQVNQKSNNGITPFTSVKTLSESPDFNSIPSSYTYTTNPHDENEIVADQDEVNDPIPVIDYSLLINGNHDQRTKTIHDIGKACEEWGFFILTNHSVSKSLMEKMVDQVFAFFNLKEEDKQVYADKEVTDDSIKYGTSFNVSGDKNLFWRDFIKIIVHPKFHSPDKPSGFRETSAEYSRKTWKLGRELLKGISESLGLEVNYIDKTMNLDSGLQMLAANLYPPCPQPDLAMGMPPHSDHGLLNLLIQNGVSGLQVLHNGKWINVSSTSNCFLVLVSDHLEIMSNGKYKSVVHRAAVSNGATRMSLATVIAPSLDTVVEPASELLDNESNPAAYVGMKHIDYMKLQRNNQLYGKSVLNKVKI

SEQ ID NO: 1786 - protein, 396 aa, Prochlorococcus marinus str. MIT 9303
MGQEQVGEIRHDRSGISFRPGLEGVPVTQSAICDIDGMQGRLAYRGYPIAELSAHSSFLETTYLLIWGDLPSPQQLRDFEAEVQMHRRVSFRVRDMMKCFPASGHPMDALQSSAASLGLFYSRRAIDDPKYVYNAVVRLIAKIPTMVAAFKLIRKGQDPIQPRDDLAYSANFLYMLTEREPDPLAARVLDRCLILHAEHSLNASTFSARVTASTLTDPYAVVASAVGTLAGPLHGGANEDVLAMLEEIGSPEHAGDYLDEAIASKRKVMGFGHREYRVKDPRAVILQGLAEELFARFGTDEMYDVAKALEAAAATRLGPKGIYPNVDFYSGLVYRKLGIPRDLFTPVFAISRVAGWLAHWREQLGANRIFRPSQIYTGAQNRTWIPSDERVSSTGA

SEQ ID NO: 1787 - protein, 171 aa, Prochlorococcus marinus subsp. pastoris str. CCMP1986
MEILNELISTYKDHPKEGIDFKDVLEIVQHPIVFKELILKMASSKIVSNAEALISIDARGFIFGSAISFQVSKPMIFARKPGKLPGELIKKKYTLEYGENSLSIQKKSLNNFYSFAIIDDLLATGGTVNCVSNILKDNGKKITGLLTVVELIELEGRSKFDFPVESWLKCK

SEQ ID NO: 1788 - protein, 605 aa, Yarrowia lipolytica CLIB122
MSVAPSSNPNPIHHLSRVEDVPLSQTFRGNITDFVRSGGFADDDSKPCCIDAKTGQQLTQKQVWDYADKFRALLHHDNNLCPFNANTTDPALGDVMITLVPNHLFITSLHFAALDLGATVSPGSAGYTVAELVNQINLTGASLIVYTRPVFKVVREALAQIVVPVKIVEFEGLIERAEFVQSHKIQSTKKVTLSPEESYSRIAYLGMSSGTSGGLPKAVRLSHFNMASSAELSKRAAPSIAGSEQIAGAIIPVNHVYGLAKFLIAMPKSGATTVFHSKFDLIEILEAQQKYKVNMYALVPPIIVVLAKHPAVEKYIPSLREHLRYVSSGAAPLGANVIEACNKRLAGTASGENEFGGLKIVQGYGLTETSPVVSTFDPNDPERHARSCGKLVPNTQARIVSEDGVDQPAYELKDLSQLEAELKKGNLPTGELWLRGPQIMDGYHKNDEANAESFVDATDYTSNMPFYMKRWFRTGDVALVDTLGRYMIVDRTKEMIKSMSKQVAPAELEDILLGHPQVADAAVIGVQQVEKGTEAPRAFVVLRDPKFDAVEIKKWMDAQVPKYKQLHGGVVVLDAVPKNASGKILRRLLRQRENDVVLGLDKAKL

SEQ ID NO: 1789 - protein, 587 aa, Oryza sativa (indica cultivar-group)
MAMAMACLNPLALSPRLAYGGRAAPRRCCSVVVPTSSARAAAGRCRWRLAAVAEEPQAVRQQEQQQRTEGSGEAGAEAAADASSKLVLVVGGTGGVGKETHISSPSLHSFSVTFSPLECHYCHFTMPLSDYVKLIMLILIEQILAGQLVVASLLSRNIKTRLLLRDPAKAVTLFGEQDESVFQAYKADTRNAAELDPEIFEGVTHVICTTGTTAFPSKRWDGDNTPERVDWDGTRNLVSAMPRTIKRLVLVSSIGVTKYNELPWSIMNLFGVLKYKKMAEDFVQNSGIPFTIIRPGRLTDGPYTSYDLNTLLQATAGERRAVVMGEGDKLVGEASRLVVAEACIQALDIEFTEGQIYEINSVKEKMYGKEITVADREMVEERADQMLREAADADVAFLVVGDPFGATTHTDLVVRAKNMGVEVKVIHNASVMNAVGVCGLQLYRYGETISIPFFTETWRPDSFYEKIQNNRRLGLHTLCLLDIRVKEPTLESLCRGKKVYEPPRFMSVNTAISQLLEVEELCGGSAYGADSLCIGVARLGSDDQKIVAGPMKKLLDVDFGPPLHCLIIVGETHPVEEEMIEFHMIKS

SEQ ID NO: 1790 - protein, 356 aa, Solanum lycopersicum
MDGKENNGVNGSNKVGIPKCCLKARVFDPELEANCHSTVVSGWFSQPPTSFDGKEKVLYFNNPMWPGEAHSLKVEKVLFKGKSEFQEVLVFESASYGKVLVLDGIVQLTEKDECAYQEMIAHLPLCSIKSPKKVLVVGGGDGGVLREISRHSSVELIDICEIDKMVIDVSKKYFPDLAIGFEDPRVNLHVGDAVEFLKNTPEGKYDAIIVDSSDPVGPAIELVEGPFFAKIARALRPGGVLCNMAESMWLHTHLIQDMISICRETFSSVHYAWASVPTYPSGVIGFLLCSTEGPFVDFKHPVNPIEKLEGALQHQRELKFYNSEMHEAAFALPCFLRREVSGLRDSPRSAGSGVKI

SEQ ID NO: 1791 - protein, 475 aa, Magnaporthe grisea 70-15
MASSSSSVPELAAAFPDGTTDFKPMRNTKGYDVSKPHISETPMTLKNWHKHVNWLNTTFILFVPLAGLISTYWVPLQWKTAVWAVVYYFNTGLGITAGYHRLWAHSSYKASLPLKIYLAAVGAGAVEGSIRWWSNGHRAHHRYTDTEKDPYSVRKGLLYSHMGWMLLKQNPKKQGRTDITDLNEDPVVVWQHRNFLKCVIFMALVFPTLVAGLGWGDYWGGFIYGGILRVFFVQQATFCVNSLAHWLGDQPFDDRNSPRDHVITALVTLGEGYHNFHHEFPSDYRNAIEWYQYDPTKWSIWIWKQLGLAHNLKQFRQNEIEKGRVQQLQKKLDQKRAKLDWGIPLEQLPVVSWDDFVEQSKNGKAWIAVAGVIHDVGDFIKDHPGGRALINSAIGKDATAIFNGGVYNHSNAAHNLLSTMRVGVLRGGCEVEIWKRAQSENKDVSTVVDSSGNRIVRAGGQATKVVQPVPGAQAA

SEQ ID NO: 1792 - protein, 402 aa, Xanthobacter autotrophicus Py2
MITAVLPTYARIDLEFERGEGCWLVTTDGRRFLDFTGGIAVNVLGHAHPYLAEALSEQAKKLWHTSNLFRIPGGERLADRIKAVTFADTMFFTNSGAEALECAIKMARKYQFASGHPEKNRIITFEGAFHGRTLATIAAGGNAKYLEGFGPAMPGFDQVPFGDLDAARAAVTPETAAILVEPVQGEGGVRVPPSGFLKGLRALCDEKGLLLVLDEVQCGVGRTGKLFAHEWVGVTPDIMAVAKGIGGGFPMGACLATEEAAKGMTLGTHGSTYGGNPLAMAVGNAVLDLVLADGFLDHVNAMSTRLVQRLAEVRDRHPSVIAEVRGQGLLLGLRCAVPAADLVTALREEGMLAPGASDNVVRLLPPLIVSEEEVGIAVEKIEAACRRIEDRLVAAPVQGAAE

SEQ ID NO: 1793 - protein, 391 aa, Pseudomonas viridiflava
MEQQCDVAVLGLGAMGAATLYQLAREGADVLGIDQYAPPHTLGSSHGDTRITRLSVGEGPQYLPLVRNSHRIWRELEALTGESLFEQCGVLVMTSSPAYDPNDPEDFTHKTIALAREYGVRHEVLSAADIRERFPQFSPVLDTAIGYFEPDGGFVRPERCIAAQLQLAGKLGARIRLNETVTRLQAHGDQVRITSDQGSIIANKVVVSAGMWSSQLLGEPFTDLLRVCRQQLFWFALEDTAAFAPVSPSFILTHGPGEVDINYGFPPLPGEGSMKIATEQYLHASQACELDRSVSAEDEQTMFRTQVSGRIAGIKADVVKSSVCAYTVTPDYHFIIDDHPHLKNVTVVSACSGHGFKHSAGLGLALAQRCLRGTSDVDLSAFSLKRFGKTA

SEQ ID NO: 1794 - protein, 152 aa, Roseovarius nubinhibens ISM
MEITRPPYSYLDDPEVPTFDALRHLAVMDAQCALCARGARWIARHDRREEFRILPIQTPLGAALLRHYGMDPDDPNSWLYLTEGRAYSSLDATIRVAQHFGGLWRALSVLRLLPRPVQDWLYARVARNRYRLLGRTDMCALPDPALRKRLMS

SEQ ID NO: 1795 - protein, 406 aa, Pseudomonas putida KT2440
MSVEQAPVQRADFDQVMVPNYSPAAFIPVRGEGSRVWDQSGRELIDFAGGIAVNALGHCHPALVKALTEQANTLWHVSNVFTNEPALRLAHKLVDATFADRAFFCNSGAESNEAAFKLARRVAHDRFGPQKHEIIATVNSFHGRTLFTVSVGGQPKYSDGFGPKITGISHVPYNDLEALKAQISDKTCAVVIEPIQGESGVVPADKAYLEGARKLCDEHNALLIFDEVQTGVGRTGSLYAYQHYGVIPDILTSAKSLGGGFPIGAMLTTTELAKHLAVGTHGTTYGGNPLGCAVACAVLDVVNTPETLAGIKAKHERFKTRLEQIGQQYNLFSQVRGVGLLLGCVLTEAWKGKAKDVLNAAEKEGVMVLQAGPDVVRFAPSLVVEDADIDEGLDRFERAVATLTKG

SEQ ID NO: 1796 - protein, 262 aa, Oryza sativa (japonica cultivar-group)
MSQPAELSREENVYMAKLAEQAERYEEMVEFMEKVAKTVDSEELTVEERNLLSVAYKNVIGARRASWRIISSIEQKEESRGNEDRCTLIKEYRGKIETELSKICDGILKLLDSHLVPSSTAPESKVFYLKMKGDYYRYLAEFKTGAERKDAAENTMVAYKAAQDIALAELPPTHPIRLGLALNFSVFYYEILNSPDRACNLAKQAFDEAISELDTLSEESYKDSTLIMQLLRDNLTLWTSDISEDAAEEIKEAPKGESGDGQ

SEQ ID NO: 1797 - protein, 565 aa, Candida glabrata CBS 138
MNINDIKELVDQVSVEDVVNCVVNKTTRYLDDTPWYNILKDYVFLIVLYKFVKKIYYYLAGYGLLKSMQLLYKSVANWIFQRLLESPLLRGSVNKEVSKAVAGMEKELIKNDDQLADFEVLPKEGLSSESINSELDKLNSILPHTSWEQGRVSGAVYHGGKELIKLQSEAFEKYCVANQLHPDVFPAVRKMEAEVVSMTLKMFNAPETGCGTTTSGGTESLLLACLSAKVYGLKHRGITEPEMIVPVTAHAGFDKAAYYFGIKIHHVDLDPVTYKVDLKKVKRLINGNTVLLAGSAPNFPHGIVDDIEGLGKLAQKYKIPLHVDCCLGSFIIAFMEKAGFNDIGSFDFRVPGVTSISCDTHKYGFAPKGSSVIMYRNSELRKHQYYVDSKWTGGLYGSPTLAGSRPGALVVGCWSTMIHMGESGYKDSCTRIVSTARKLKDHIRNKLPQLEVLGDPKLSVVSFSSNKLNIYELADRLAKSGWHLNALQKPAALHLAITTLSVPTIDTFIETLTEAVEQMSADPTSTPSTEGTSALYGVAGSVKTTGVADKLITAFLDTLYKVKSD

SEQ ID NO: 1798 - protein, 489 aa, Medicago truncatula
MEGGNRAEAERWLYTANKLLSARDLHGARSFAIRARESDPTFDASELLLAVIDTLLAGESRINDHHRDWYGILQILRYTTNIDHIANQYRRLALLLDPNRNPFAFSGHAFSLVHDAWSVLSNPAKKAMYDSDLRLLTTPPVPSQPQPQLAPQYQQPPQQPLQQPPQPTPRKNSRSRDSTGATATEPTLSRQNRNPSEAGETTRQTRIASAAETVGNISFWTLCPYCYVHYEYPKEYEDCTLRCQSCRRGFHAVVIRSPPVNEIDSSFCTWGFFPLGFSGDSKDLNGASSNWNPIAPLFPCTMKGSSNRKKNWVYYDEEATAAFIDISDPSDNDSDDGDWRGGAGKRRGVKSSGVSTSKKIRKDSGNASGRGAVGRPRRSATGAASGNEKNVGAVDDASAAASGVRADANTIKKAALGSSRRRGAGNLDLNVEFSNDVEEPSRGVRAREGNATGNAEDNIDGVGFFEGLDEFLSSLPILNPVGDDKVKGH

SEQ ID NO: 1799 - protein, 469 aa, Corynebacterium diphtheriae NCTC 13129
MTEHYDVVVLGAGPGGYVAAIRAAQLGKKVAVVEKQYWGGVCLNVGCIPSKALLKNAEVAHIFNHEAKTFGISGDVSFDFGAAHKRSRQVSSGIVKGVHYLMKKNKITEIDGLGSFKDAKTIEITEGNDAGKVVTFDDCIIATGSVVRSLPGVTIGGNIVSFEEQILKEEAPKSMVIVGAGAIGMEFAYVLVNYGVDITIVEFMDRVLPNEDADVSKEIAKQYKKLGVKLLTGYKTTAITDNGDNVTVEVESKDGSKKDSLTVERCMVSIGFAPRVEGYGLENTGVKLTERGAIEIDDFMRTNVDHIYAIGDVTAKLQLAHVAEAQGVVAAEVIAGAETQELGDYMMMPRATFCNPQVASFGYTEEQAKAKFEGREIKTATFPFSANGKAAGLAETAGFVKIVADAEFGEIVGAHMVGANVSELLPELTLAQRFDLTCEEIGRNVHTHPTLSEAMKEAAEGIMGHMINL

SEQ ID NO: 1800 - protein, 319 aa, Oryza sativa (japonica cultivar-group)
MASLLIASTGGAHRLAWKDAAALGPAPRLARPWPAAVAAPAPLLRTSTADITSLRVITAVKTPYLPDGRFDLEAYDSLINMQIDGGAEGVIVGGTTGEGHLMSWDEHIMLIGHTVNCFGAKVKVVGNTGSNSTREAIHATEQGFAVGMHAALHINPYYGKTSIEGLISHFEAVLPMGPTIIYNVPSRTGQDIPPAVIEAVSSFTNLAGVKECVGHERVKCYTDKGITIWSGNDDECHDSRWKYGATGVISVASNLIPGLMHDLMYEGENKTLNEKLFPLMKWLFCQPNPIALNTALAQLGVHTVNTIVYRAEFKNLDKI

SEQ ID NO: 1801 - protein, 666 aa, Oryza sativa (japonica cultivar-group)
MATRVLLSSKVILALVLASLFSLPRHGRALELMNWSCNNGSAYAANTTYDTNVHSILATLTARTPNTTTGFATATTGRGTDTEAWGLALCRGDTDRVGCASCLAAVPAVAFNECRGDMDVTVFYDRCLARFSYVDFTARPDNTEVLIGSPSADRITADAGHFDALVADLAGALADWAAYNSTLRYAAGVMTSGDGFMSTTEDMVHNIYGVVQCTPDQAAAACRACLEALRVDMPKVFAGKMGGRFNAVWCNLRYETFVFFDGDPSVKLVAPPVVPEDGKRRSSPENAAAVVGAVLGALVILLSLFIIYLWKKLQAKQYAADKNVDSGSLLFDLAIIRKATANFAEHNKLGHGGFGAVYKGFLPDVGEIAVKRLDRTSGQGLEQLRNELLLVAKLWHNNLAKLLGVCIKGDEKLLVYEFLPNRSLDTILFDPQKREQLSWETRYQIIHGTARGLLYLHEDSQIKIIHRDLKASNVLLDSNMNPKISDFGLARLCSGTKTTSITSQVVGTLGYMAPEYAVLGHLSVKVDVYSFGILVLEIVTGRRNTDVFDADEESSNLLSYVWDHWQKGIPLEITDTLLLLSGSRGLQDMELLKCVHIGLLCVQENPADRPTMLSVLVMLQDVDTTNFAAPSKPAFTFANVRNTTSSSPSAAALSANEVSISEFHPR

SEQ ID NO: 1802 - protein, 383 aa, Synechococcus elongatus PCC 6301
MRGGGSSTVKIADFRRSPMTRSYRITLLPGDGIGPEIMAVTVDILRAIGRQFDLNFEFEEALIGGSAIDATGEPLPEATLATCRNSDAVLLAAIGGYKWDSLPRSQRPETGLLGLRAGLGLFANLRPAAILPQLVDASSLKREVIEGVDLMVVRELTGGIYFGEPKGCFADEQGRQRAFNTMVYREDEIDRIGRVAFDIARKRGKRLCSVDKANVLEVSQLWRDRMTLLGSDYADVELSHLYVDNAAMQLVRWPKQFDTIVTGNLFGDILSDIAAMLTGSIGMLPSASLGAEGPGVFEPVHGSAPDIAGQDKANPLAQVLSAAMMLRYGLDEPEAAARIEAAVNQVLDQGYRTGDLYSEGMTLVGCKGMGDALLAALESPVSA

SEQ ID NO: 1803 - protein, 201 aa, Triticum aestivum
MFVDAGFSFSAYSSSPQPLGYYYSPPLFSYPHPDYSSFSSALILRCPAQPPSPPLPLLHQQHQAAIIAAPDDDDAPAAMYHHLGDMGQPSLISEYDLGAEGDLFKAPEPIIEEPLLALDPVAAAISMMSGSNNALNDTIEASDMSLSEALYKCEKELMEESAIEETISELLNVKIPMLQVEDVPRELRASADECSLQKSIS

SEQ ID NO: 1804 - protein, 126 aa, Thiobacillus denitrificans ATCC 25259
MDKRIIQTADAPAAIGTYSQAIRVDNTVYLSGQIGLDPSTMQLVDGIEAQIHQVFKNLAAVAAAAGGSLADVVKLNVFLTDLGNFSQVNEIMAAYFKAPYPARAAVGVAALPRGALVEADAVMALA

SEQ ID NO: 1805 - protein, 714 aa, Rhodospirillum rubrum ATCC 11170
MSAPSTPLVWPGQPFPLGATWDGSGTNFALFSAHAEKVELCLFDRAGRKETARIVLPEYTDEIWHGYLPDIRPGQMYGYRVYGPYDPNAGHRFNANKLLIDPYAKSLKGEILWHDALFAYKLGHPDGDLTFDRRDSARHMPKCEVVDPAFTWGRSMEPHPWHETVIYEMHPRGFTMLHPGVPEELRGTFDGLAHRRVTDYLTDLGVTAIELLPVHAYVQDRHLIDRGLTNYWGYNSIGFLAPHATYLGHGRTASAFKAFVQKMHDAGLEVILDVVYNHTAEGNHLGPTLSFKGIDNRSYYYLMGEDLRHYNNFTGTGNALELRHPRVLGMVMDSLRYWATAMGVDGFRFDLATTLARVEGPFTEHAGFLDAVAQDPVLSHVKLIAEPWDTGLGGYQVGAFPPGWAEWNDQYRNTIRKFWKGDDGLLPTMAGRFSASSDVFNRRGRRPWASVNFITAHDGFTLADLVSYNGKHNEANGEDNRDGSDDNNSWNCGAEGPTDDEEINTLRRRQMRNMLATLLLSQGTPMLLAGDEFANSQNGNNNAYCQDNALSWLDWDGIDEKARSQIAFVTSLLRLRREHVVFHRTRFFTGSVIPGTEVKDVVWLRPDGEEMTEADWGNSVSQALAIRLSGEAGLTHLDRRGRQQTDDTFLLVLNASHTEVVFTLPEGGRWETVIDTMDEDGQSSLPKADGGTIRALPGRSLQVLRCRAAHGRSA

SEQ ID NO: 1806 - protein, 150 aa, Glycine max
  misc_feature (114)..(114): Xaa can be any naturally occurring amino acid
  misc_feature (120)..(120): Xaa can be any naturally occurring amino acid
  unsure (1)..(150): unsure at all Xaa locations
KSKASFPTRRHNNDIHSIASNVERVQSMQAWPPDGRQKCETLSYLPDIDHAQLATEVEYLFRKGCIPCMEFELEHGFVHREHDRSAGSFDGGSWTTCKMPTFGCTEASQVFKEXLYRVRXACPYGFIRIIGIVNVRRVQGIGFFADKPTG

SEQ ID NO: 1807 - protein, 363 aa, Arabidopsis thaliana
MTITNLPSDLLEEIFSRFPLNSMRAVRLACKTFYTLSKCKSFAKLHFGKETTTTKEGESQMILLMDYNLYLISVVVDGDPYIECKDTRLVVWNPYWGLTRWIEPRYSHHLIGCARFSYALGYVGNISCRSHKLLRFIDYFFHGPELEWYEIYDFESGLWTTLDVTPHWCISLGSHGISIKGNTYWSAITRNSRSHGLTIYDHDHIICFDFTSERFGPLLPLPLNAEYYGDVILSSVKEEKLAVLQQQNRANPYMFDIWITINIEPGHVLWTKFLKVDMETVMETPFKSSESFFIDEKNKIVMSFDETLNPYTISIFGEAGYYRVVNLEQHANTWSRSQMCTYVPSLLQIKQLPLIQVEKCFII

SEQ ID NO: 1808 - protein, 611 aa, Nicotiana benthamiana
MPAWWGKKSTKNKETQSKEKERDKYVKPRSFDEVLCRNSPRNSKDLNLGGSGSGFSGSGFSGFDSGSSLDKAHPLPRPSVGNDQGVVLGCGSVSVSSTSSSGSSDGPVNTTDQAQFDILFRGNGDNRLSPLSRSPVRSRGTTTTSSPLHPRFSSMNLDSPTGKLDNDVSSESHQLPLPPGSPPSPSALPNPRTCGVAEGSNVNMSKWKKGKLLGRGTFGHVYLGFNRENGQMCAIKEVRVVSDDQTSKECLKQLNQEIILLSNLSHPNIVRYYGSELDDETLSVYLEYVSGGSIHKLLQEYGAFREPVIQNYTRQILSGLSFLHARNTVHRDIKGANILVDPNGEIKLADFGMAKHITSSSLVLSFKGSPYWMAPEVVMNTSGYGLPVDIWSLGCAILEMASSKPPWSQYEGVAAIFKIGNSKDFPEIPDHLSNDAKNFIKLCLQREPSARPTASQLLEHPFVKNQSTTKVTHVGVTKEAYPRSFDGNRTPPVLDSGGRNISPTKGNYASHPVITISRPLSCPREIVKTITSLPVSPTSSPLRQYEPARRSCYLSPPHPAYGIGGHSGYDENDYLMFQARPTTRNTLEPWLEIPQFKVQTPSRSPKLRPIL

SEQ ID NO: 1809 - protein, 614 aa, Solanum lycopersicum
MPAWWGKKSTKNKDLQAKEKEREKYVKPRSFDELLSRNSPRTSKDFSGSGSGFSGFDSGSSLEKAHPLPMPSVSSLGNDHGVVLGCGSVSVSSTSSSGSSDGGGPVNTDQAQLDTFRGLGDNRLSPLSRSPVRSRGTTTTSSPLHPRFSSLNLDSSTGKLDDVRSECHQLPLPPGSPPSPSALPNPRPCVVAEGANVNMSKWKKGRLLGRGTFGHVYLGFNRENGQMCAIKEVKVVSDDQTSKECLKQLNQEIILLSNLTHPNIVRYHGSELDEETLSVYLEYVSGGSIHKLLQEYGPFREPVIQNYTRQILSGLSFLHARNTVHRDIKGANILVDPNGEIKLADFGMAKHITSCASVLSFKGSPYWMAPEVVMNTSGYGLAVDIWSLGCTILEMATSKPPWSQYEGVAAIFKIGNSKDFPEIPEHLSNDAKSFIRSCLQREPSLRPTASKLLEHPFVKNQSTAKVAHVGVTKESYLRSFDGSRTPPVLELHPGGRTISPGRNISPAEGNYASHPVITVSRPLICARENVKAITSLPVSPTSSPLRQYEPARKSCYLSPPHSSYGIGGQSGYEANDYSMFQTRPSTRITLEPWLEIPHFRTQTPSRSPKTRPIL

SEQ ID NO: 1810 - protein, 606 aa, Methylococcus capsulatus str. Bath
MCGIAGLFNCNLPADELRLDQAVAKLTHRGPDDRGIFLDGRFGMGHTRLSIIDLAGGHQPLFSEDRRLALIANGEIYNFIELRSELTAAGFRFQTQSDSEVILHAYLAFGEGFLERIQGMFAFALYDALEGRLILARDRLGIKPLFLARRPDGIAFASEIKALLPLLDQPREIDPQGLAQYFQNQFSTGATTVLRGVERVLPGEAVVVEAGKTTRRFRYWSPLAVRTEELDFDEAAARFDALMERVMVEHMRSDVPFGLFLSGGVDSSLLLALLTRYSGEPIRTFSVGFPGTSLTDELPLAEGLARRFRSRHREIRPGPQDILHSLPLTVWAADDLMRDNASLPTSLLARAAGEELKVVFSGEGGDEVFAGYGRYRTSPLERLFKSLLAPGSGGFRTRGSFRGRWPKTLFGPALLAAAQSARRPVQESWRETPREWSDLQRMQYVDLCHALPDNLLVKADRMLMAWGVEGRVPFLDHRVVEFGLSLPDRLKIEGRQGKLFLKRWGERLVPAEQLYARKRGFHVPLGEWLDEPFLERLNRILPEHPALTPWFKPAGIRALIARCRDERQGSAMLWAIIQFAIWHRLFISGNGERPEALTDPLEILQR

SEQ ID NO: 1811 - protein, 1507 aa, Candida glabrata CBS 138
MSSSSEISVAGSDVSFEGRLTQHGRHEETPADQLTKILSGRSHEDADGDDAHSDNRSILSRSRRSSTAELSPEMVGRVQSLADVLSRHTSRSGGNIDLSQLSESDRFDAERIIGSFVRDADEQGIHLRKAGVTLEHVSARGADSTAMEGATFGNVLCLPYTIYKAIRDKSGSKMRTILNDVSGLARAGEMVLVLGRPGAGCSSMLKVTAGEIDQFAGGVEGEIMYDGIPQKEMMKRYKPDVIYNGEQDVHFPHLTVQQTLDFAIACKTPSKRVNDVSREEYIASTRDLHATIFGLRHTYHTKVGNDFVRGVSGGERKRVSIAEALVTKGSIYCWDNATRGLDASTALEYAKAIRITTNLLGSTAFVTIYQASENIYETFDKVTVLYTGRQIYFGPIDEAKDYFYRMGYECPPRQVTAEFLTALTDVNGYHKIRPGYENKVPRTAEEFERYWQESPEYRQLLIDIDQYKKEIDTEKTKEIYDQSMQQEKSKHARKKSYYTVSFWEQIRLCTKRGFQRIYGDKAYTVITICSAIIQSLVSGSLYYNTPSSTSGAFSRGGVLYFCLLYYSLMGLANLSFEHRPILQKHKIYSLYHPAAEALGSTIANFPFRMIGMTCFLIIIYFLSGLNRTASSFFRVYLFLTMCSESINALFELIAAGCDNISQANSISGIVMMSISLYSTYMIQLPSMRPWFKWISYILPIRYAFESMLLAEFHGRHMGCGGTLVPSGPGYENIASENQVCAFVGSKPGQSWVLGDDYLRLQFEYEYKHEWRNFGIMWCFLLGYIALKALITEIKRPVKGGGDALIFKKGTRKYHMKLDEEDGELHEIDTKEKFSSRSGSSTTSEDEIFEELESKGIFIWRNVCYTIPYDGGMRQLLDNVSGFCKPGTLTALMGESGAGKTTLLNTLAQRNVGIITGDMLVNGKPIDISFERRTGYVQQQDIHISELTVRESLQFSARMRRAQNVPEEEKMEHVERIIKVLDMEEYADALVGDVGRGLNVEQRKKLSIGVELVAKPDLLLFLDEPTSGLDSQSSWAIVQLLKKLAKAGQSILCTIHQPSATLFEEFDRLLLLKKGGQTVYFGDIGDNSKTLLSYFERNGARKCSPSENPAEYILEAIGAGATASVTEDWHQIWKNSDEFISTEKEVDHLIDQLSNQKTESEFGDAPTKYATSYAYQFKWVLIRTSMSLWRNLDYIMSKMMLMTVGGLYIGFTFYDPGDSYTGLQNTLFAAFISIILSAPAMNQIQARAIAARELFEVRESKSNMFHWSLLLITQYLSEIPYHFLFSAIFFVSSYFPLRTHFQASASAVYYLNYSIMFQLYYIGFGLCVLYMAPNLQSANVILGLCLSFLIAFCGVVQPVSLMPGFWTFMWKTSPYTYFVQNMVGILLHNKPVICRKKELSIFDPPAGQTCQEFTQAFLDKRGGYIANPNATTACEYCIYEVGDDYLKHISASYSYLWRNFGLYWAYIGFNICAMVAIYYIFHVRGVSFKFDRVFKLFSRITRRGKKSN

SEQ ID NO: 1812 - protein, 356 aa, Zea mays
MAVESWTVPTPVKDLAALVDEPPSRFVQREEHRPGSLMLAADMPDPLPIVDLNKLSTADEAAKLRSALQTWGLFLATNHGIDASLMEDLMEASREFFHQPLQERQKYSNLREGTRFQLEGYGSDPVVAQDHILDWNDRLQLKVEPEDERSLAQWPEHPESFRDLLHEYASKTKIMRDRILRAMAKILELDEEDFIKQLGASPQAYARFNYYPPCPRPELVLGIKAHSDGPVLTVLLVDREVGGLQVQRENTWFNVPSVPHTLVINLGDSLEKFLVQIMSNGIFKSPVHRVVTNAEKERISLAMLYAVERDNVLQPAAGLLDEKRPARYRRITEADFLEGVKEHFSKGIRMIEPLKI

SEQ ID NO: 1813 - protein, 175 aa, Triticum aestivum
MPPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 1814 - protein, 688 aa, Oryza sativa (japonica cultivar-group)
MANTTLSSLLFLSMASALFLLTLLRILRSKKQQRRLRLPPSPPSLPPLHRALSGLAATHGPVLLLHFGSRAVLHVTDPAVAEECLTDHDVTFANRPRLPSSCHLSNGYTTLGSSSYGPNWRNLRRIATVEVFSAHRLLRSADVRGGEVPHMARWLYLAAPAAGPSEPARADVKARAFELVLNVVARMVAGKQYYGGEGDAEAETEEAARFREMVREYFAMHGASNLQDFVLLLGLVDIGGAKRRAVKLSRERNTWAQRLIDEHRATATAAAATEARTMVGDLLKMQASEPEAYSDKVITALCLTGTDTSSSTIEWGMALLLNHPAAMAKARAEIDRFVGTGRVVEEADLPNLPYLQCIIRENLRLYPVGPLLAPHESSADCSVSVAGGGRYAVPAGTMLLVNVHAMHRDARFWGPDPESFSPERFEGGRSEGKWMLPFGMGRRRCPGEGLAVKVVGLALATLVQCFEWRRVGDEEVDMTEGSGLTMPKAVPLEALYWPRPEMETVEEQAREVQRLKDQLARNTKNQEELKASLKDELMKEIQTMMLEQSKKPLTPGVIHSYCVHKANLDSNTSNEEADRSNVNNSDATALHTQERPVHTPETTNEIDPKSVITSEKENRPPTKQNIPTSNVTANKENMDPTTCKYRVSKVTKSSFTENAGKGTAAKYISSKQLLSGALTRASKRKQLV

SEQ ID NO: 1815 - protein, 447 aa, Arabidopsis thaliana
MALIQFGSSCVAQWGILRPRFAVKAFYPSRLESHQDNCISQINCLGASRSSMFAQGSLPFLSLTGVSPNTHSRRGARFTVRADTDFYSVLGVSKNATKAEIKSAYRKLARSYHPDVNKDAGAEDKFKEISNAYEILSDDEKRSLYDRYGEAGVKGAGMGGMGDYSNPFDLFESLFEGMGGMGGMGGGMGSRGSRSRAIDGEDEYYSLILNFKEAVFGIEKEIEISRLESCGTCNGSGAKAGTKPTKCKTCGGQGQVVASTRTPLGVFQQVMTCSPCNGTGEISKPCGACSGDGRVRRTKRISLKVPAGVDSGSRLRVRGEGNAGKRGGSPGDLFAVIEVIPDPVLKRDDTNILYTCKISYVDAILGTTLKVPTVDGEVDLKVPAGTQPSTTLVMAKKGVPVLNKSKMRGDQLVRVQVEIPKRLSKEEKMLVEELADMSKNKVANSRR

SEQ ID NO: 1816 - protein, 319 aa, Triticum aestivum
  misc_feature (190)..(190): Xaa can be any naturally occurring amino acid
  misc_feature (205)..(205): Xaa can be any naturally occurring amino acid
  unsure (1)..(319): unsure at all Xaa locations
MAKKRKRSSDAPASAAVEKPDDSAPERPERTLFGFKDSAAEPASKDAGPLFRNKEKVLITCSRRIIYRYRHLMQNVVSLLPHAKKDSKVESKQSKGSALNELVELRSCSSCLFFECRKQKDLYLWMVKSPAGPSVKFLVNAVHTMEELKLTGNHLKGSRPLLTFSSNFDQQPHWKLLKEMITQIFATPKXHRKAKPFQDHVFGVXPIVDDHIWFRNYQISVPHNEIDKVDKGGLDKMTLVEVGPRFCLNPIKIFGGSFGGPTLFENPFYVSPNQIRALEKRKKAGKYAKKVKAKVRRKMHEMENTLEPDEFADLWKGED

SEQ ID NO: 1817 - protein, 453 aa, Synechococcus sp. RS9917
MPTPFEPGSDPQSPNRNLAPVTAALDDEARLMVGGCRLSALAERYGTPLYVLDEASIRAACRAYREALQRHYPGPSLAVYASKANSSLAMTALVASEGLGLDAVSAGELLTALEGGMPPERIVLHGNNKSDEELLLAYRSGVTVVADNHHDIERLAQLVPDGGAPVRLMLRFTPGIECHTHEYIRTGHLDSKFGFDPDQLESVLRSLKGAAWAEVSGLHAHIGSQIFELDPHRDLAAVMADALRLARGLGHPVEDLNLGGGLGIRYVESDDPPSIDTWVQVVASAVAKACEERQLSLPRLLCEPGRSLVAAAGVTLYRLGSRKEVPGLRTYLSVDGGMSDNPRPITYQSLYTACLADRPQAAATETVTLAGKHCESGDVLLKDVALPASASGDVLVVLATGAYNASMSSNYNRIPRPAAVLVHDGEADLIQRRERPEDLLRYDEIPSRLSPVG

SEQ ID NO: 1818 - protein, 472 aa, Pseudomonas putida KT2440
MSGQNMHSGELKRGLKNRHIQLIALGGAIGTGLFLGSAGVMKSAGPSMILGYAICGFIAFMIMRQLGEMIVEEPVAGSFSHFAHTYWGGFAGFLSGWNCWVLYILVGMSELSAVGKYVHYWWPEIPTWVTAAAFFVLINAINLMNVKFFGEAEFWFAIIKVVAIVSMIGLGAYLLTSGSGGPEATVANLWTHGGFFPNGVSGLVMALAFIMFSFGGLEMLGFTAAEADKPKTVIPKAINQVIYRILIFYVGALVVLLSLTPWDNLVASIDASGGSYGSSPFVQVFSLLGSDVAANLLNFVVLTAALSVYNSGTYCNARMLLGMAEQGDAPASLAKVDKRGVPVRSILVSAAVTFVAVLLNYLMPQNALELLMSLVVATLVINWAMISYSHLKFRQHLDRTGQKPLFKALWYPYGNYVVLAFVVLILGIMLMIPGIQVSVYAIPVWLLAMLVVYMVKSRRQVNAGGAVETVAK

SEQ ID NO: 1819 - protein, 252 aa, Comamonas testosteroni
MNLNKQVAIVTGGASGFGAAIARRLSQAGAAVLVADLNAEGAQRMATELNAAGGRALGMACDVSKEADYRAVVDAAIAQLGGLHIVVNNAGTTHRNKPALAVTEDEFDRVYRVNLKSVYWSAQCALPHFAQQGHGVMVNVASTTGVRPGPGLTWYSGSKAAMINLTKGLALEFARSGVRINAVNPMIGETPMMADFMGMEDTPANRERFLSRIPLGRFTRPDDVASAVAFLASDDASFLTGVCLDVDGGRNI

SEQ ID NO: 1820 - protein, 476 aa, Comamonas testosteroni
MSTVLYRCPELLIGGEWRPGRHEQRLVVRNPATGEPLDELRLASADDLQLALQTTQQAFEHWRQVPAHERCARLERGVARLRENTERIAHLLTLEQGKTLAEARMECAMAADLIKWYAEEARRVYGRVIPARLPNSRMEVFKFPVGPVAAFSPWNFPLVLSARKLGGAIAAGCSIVLKAAEETPASVAAMVDCLNQELPPGVVQLLYGVPAEVSQALIASPVVRKVTFTGSVPVGRHLAELSARHLKRITLELGGHAPVIVCGDADIARTVNLMVQHKFRNAGQACLAPTRFFVDRRIYGDFVDAFGATQALRVGAGMAAETQMGPVASARRQAAVQDLIARSVAAGARPVASAVPEAGYFVAPTLLADVPLDAPVMSEEPFGPVACAVPFDSLDQAIAQANHNPYGLAGYLFTDSAKAILAVSERLEVGSLAVNGMGVSVPEAPFGGVKDSGYGSESGTEGMEAFLDTKFMHYVA

SEQ ID NO: 1821 - protein, 400 aa, Clostridium perfringens SM101
MNCIIAQSGGPTSVINASVYGLVKANKKLNLYENVYGGLNGIEGILNKKIINLSDLDELQLERFKNSPASGLGSCRYKLKPLSESEDEYLKLLDILNSLNIKAFFYVGGNDSMDTTAKLNAFAKAKNIDIKFFGIPKTIDNDLMHTDHTPGFGSAAKFISTAVLETYLDSKVYTNNGIFIIETMGRDTGWLAASGALATINGNKCADLVYLPERAFSVQSFLTDVARIFKEKKHVYIVASEGLKDENGKFLTETAPNDDSFGHAQLGGVGAYLKNLIIQASITHRVKSLELNTLQRCSMHASSKIDVNEAVMVGQAALEASVNSEGGYMVAIRRDSSFPYKSSTFLIEADKIANNIKYFPNEWINEEGNNITEEGLSYLKPLISDFEDRDSLPLYHSFVL

SEQ ID NO: 1822 - protein, 517 aa, Roseovarius nubinhibens ISM
MSTEVRVPTLGESVTEATVATWFKKPGDAVAQDEMLCELETDKVTVEVPAPAAGTMGEIVAAEGDTVGVDALLATIVAGDAKPAGNTGSPKDDAPAAKPASGGDAAKGNTDVMVPTLGESVTEATVSTWFKKVGDSVSQDEMLCELETDKVSVEVPAPAAGTIVEILAQEGDTVQANGRLAVLSGSADGTITPDTRPEASAADAAPAPAASGSGRSDVEDAPSAKKAMAEAGLNRDQVTGTGRDGRVMKDDVARAAAAGAATGASASAPAPAAPAAPRAVSADDAAREERVKMTRLRQTIARRLKDSQNTAAMLTTYNEVDMTEVMALRNEYKDLFLKKHGVKLGFMSFFTKACCHALKEVPEVNAEIDGTDIVYKNFVHMGIAAGTPTGLVVPVIRDADSMSFAAIEKAIAEKGARARDGKLSMAEMQGGTFTISNGGVYGSLMSSPILNPPQSGILGMHKIQDRPMAINGKVEIRPMMYLALSYDHRIVDGKGAVTFLVRVKEALEDPRRLLMDL

SEQ ID NO: 1823 - protein, 462 aa, Roseovarius nubinhibens ISM
MASYDVIVIGAGPGGYVAAIRCAQLGLKTACVEGRDTLGGTCLNVGCIPSKALLHASHMLHEAEHNFAKMGLKGKSPSVDWPGMLAYKDDVIGQNTKGVEFLFKKNKIDWLKGWGSIPEAGKVKVGDEVHEAKNIIIASGSEAASLPGVEVDEKIVVTSTGALELPKVPKKLVVIGAGVIGLELGSVYARLGSEVTVIEYLDAVTPGMDAEVQKTVQRMLKKQGMSFIMGAAVQKTEATKTKAKVHYKLRKDDSEHVLDADVVLVATGRKPYTDGLGLEALGVEMSQRGQIKTDDHWQTNVKGIYAIGDAIDGPMLAHKAEDEGMAAAEVIAGKAGHVNYGVIPGVIYTHPEVATVGKTEDQLKEEGRAYKVGKFSFMGNGRAKAVFAGDGFVKLLADKDTDRILGCHIIGPGAGDLIHEVCVAMEFGASAEDLAMTCHAHPTYSEAVREAALACGDGAIHS

SEQ ID NO: 1824 - protein, 205 aa, Candida glabrata CBS 138
MKLNIIWTLCLLFGIVSAAVKPEVTHKVYFDIEHDGVSKGRIVIGLYGKIVPKTVENFYELSISDDSNMGYLGSIFHRVIPQFMIQGGDFTHGTGIGGKSIYGSTFPDENFDLKHDRPGLLSMANRGKDTNGSQFFITTVATPWLDGRHVVFGEVLEGMDVVTYIENVKTNAQNRPLKDVVIADSGELETAPLGNKPRDVPDDEL

SEQ ID NO: 1825 - protein, 552 aa, Burkholderia xenovorans LB400
MNISSLAGKPLPPALLVNVPRLVASYYTGTPDPSLAAERVKFGTSGHRGSSLQRSFNEWHVLAITQAICRYRKLQGIDGPLFLGIDTHALSEPASASALEVLAANGVEVMIAPDGEYTPTPAISHAILTYNRGRSSGLADGIVITPSHNPPGDGGFKYNPPSGGPADETVTGWIEVAANSLLENRLDGVMRMPLANALRASTTHYHDFLRIYVADLDSVIDMSVLRGAPIRLGVDPLGGAGVHYWAAIAERYRLNLTVTDEDVDPTFRFMSADWDGQIRMDPSSPYAMQTLIGKADRFDTAFACDTDHDRHGIVTPTAGLLPPNHYLAVMIDYLCAHRPDWPAHAAIGKTMVSSRLIDHVAAKHGRALYEVPVGFKWFVGGLLDGSLGFAGEESAGATCLRLDGRAWTTDKDGMVPALLSAEIATRTGRDVAEHYRALTERLGEPRERRVQAAASASQRALLGRLSPAQFAHTELAGEKIDSVLDRAPANQAPLGGIKVSTKSGWFAARPSGTENIYKIYAESFLGDDHLARIVGEAQSMVDNALAASGGDA

SEQ ID NO: 1826 - protein, 721 aa, Oryza sativa (japonica cultivar-group)
MATATQAPTSPAAASGRGSVLPLLRGRPSTRVRLAVGRRPQTALRAQPPGAAEVVEQSVNTIRFLAVDSVEKAKSGHPGLPMGCAPLGHVLFDEFLRFNPKNPYWFDRDRFILSAGHGCMLQYALLHLAGYDSVTMDDLKAFRQWGSRTPGHPENFETPGVEVTTGPLGQGFANAVGLALAEKHLAARFNKPDLKIVDHHTMVHEGLRYVILGDGCQMEGVSNEASSLAGHWGLGKLIAFYDDNHISIDGSTGIAFTEDALARYEALGWHTIWVKNGNTGYDDIRAAIKEAKAVKDKPTLIKVTTTIGYGSPNKANTYSVHGSALGTKEVEATKNNLSWHHEPFHVPDEVKRHWSHHIDEGASLEAEWNKKIVEYEKKYRQEAAELKSIISGELPSGWDNSLPKYTPENPADATRNLSQQCLNALAKAIPGFLGGSADLATSNMTLLKMFGDFQKDTPEERNIRFGVREHAMGAISNGIALHSPGLIPYCATFFVFTDYMRAAIRLSALCGSRVIFVMTHDSIGLGEDGPTHQPVEQLFSLRAMPNILMLRPADGNETSGAYKIAVLNRQRPSVLALSRQKLQQLKGTSAEGVAKGGYIISDNSSGNKPDIILIGTGSELEIVEKAADELRKDGKTVRVVSLVCWELFEEQSEKYKESVFPSEVTSRISVEAGVTFGWEKYIGEKGKAIGVDRFGSSAPAGKIYKELGLTVENVIATAKSL

SEQ ID NO: 1827 - protein, 427 aa, Mycobacterium sp. JLS
MNSPSSGALARRLGTRDAVLIGLGSMIGAGVFAAFGPAAQAAGTGLLVGLAIAAVIAYCNAVASAQLAAQYPTSGGTYIYGRERLGPWWGFIAGWGFVVGKTASCAAMAMTVAAYAVPGPWWAQRLVGVAAVVGLAALNYRGVTKTAGLTRILVGCSLIALTVVVVGIAVGGQASLDHLGGWPALGAGGVYGVLQSAGLLFFAFAGYARIATMGEEVRDPTRTIPRAILIALFITVGVYLIVGVAALLAVGPDGLAHATAPLTAAVDGAGAGELAPVVRIGAVLAALGALLALIAGVGRTSLAMARHRDLPVWLSAVHPRYQVPHHAELALAVVVSVLVLTADLRDVIGFSSFGVLIYYAITNASAFTQPAAQRRWPRWLNVAGLAGCLILTATLPWPSVLAGAAMFAIGLAGRWLIVGRRTHTTHA

SEQ ID NO: 1828 - protein, 124 aa, Zea mays
MATQSPHVLVVDHSRVDCLVASIVLNSFNIRVTVAGGAMEALEFLDANNSHVDLILTDYCMPDMTGYDLLREVKESPRLKHIPVVITCTDVIPERIIECFEGGAEEYMIKPLKVSDVPRILSYM

SEQ ID NO: 1829 - protein, 359 aa, Zea mays
  misc_feature (39)..(39): Xaa can be any naturally occurring amino acid
  unsure (1)..(359): unsure at all Xaa locations
MSRPHLPKDPAFPRTNGSLDGGARDLGEIEEVGAAATVXVEQSPLQSSSPSASSPPAAAISSCGQYMLHRVRKLDTLAGVALKYGVEVADIKRLNGLSADLQMFAHKTLHIPLPGRHPPSSYQQNGSYESDDRECTPHRIQNDILDSILKTPKPKVSPAMSLLQGYYGLAPPPKRDQTSEGTEMAVYSKGKSAFLDVEPWLEPPNSDPFPLQNRKTKSLTIGSLDGDTDENGDSERFVRRRQKADGELLPREENGGDFLASAGKGLALRPKSSSRPDMNKSQQNLFAMAEPLFGSGMQTVRKSSSTPEFQEPETSTSSSIWSASKWSINTDAFALPLPIPRFDNIPKPIAAWRNKAARD

SEQ ID NO: 1830 - protein, 459 aa, Candida glabrata CBS 138
MGQILSNPVIDKEHHSGADLLTAFGLCAMQGWRMSMEDAHIVEPNVLPETDDEHIAFYSIFDGHGGSAVAQFCGSKMVSILTSQESFKEKKLKQALIDTYLKTDEELLKDPEMRNDHSGCTATSILVSKLQQTLVCGNSGDSRTVLSINGVAKALSFDHKPTLTSERSRIVAADGFVEMDRVNGNLALSRAIGDFEFKSNDKLGPHEQIVTCVPDIVEHRLNYDNDEFVILACDGIWDCLSSQECVDLVHHGIMKGDMSLNDISSRIIDVCCSPTTEGTGIGCDNVSIVVVALLKENETINAWFERMRNKGYKPPHSFEEQRRSIFSYYQFPEDDEKVFDVTTKKPQDRFNQDSEISTGDEDERNKMEIDEDDNDRSGAQKKTGASIPVDLLSLEALLNGAGNIQLNQGPDNVSYISGSSLTDMINSLSRAAAMANNTRDSDSEEEDTKIIEDVSDKQE

SEQ ID NO: 1831 - protein, 379 aa, Oryza sativa (indica cultivar-group)
MSTSAPISSPEPPEFIRGSLIPALPDDLAIHCVALLPRAAHPSLALVSRAFHTLLCRDPGPLLAARRRLRLSDPHVILSLRPPASASPLFFLLLPHPGWPPLPLPSPPVPVSSSSSVAVDGNRVFLFGGSVSGVPSPSVQILDPRTRFWSVGPRLSSPREFAAAVAHSGVLFVAGGCVPSSPFWAESLNLSSPDAKWSPVPSPPHFREKWMHGSASLAGKVLAVADRGGLAYDPAAPPTEAWAPVSPILDMGWKGRAAVVGGILYSYDYLGQVKGYDPDTDCWSKVEGLEQELPKFLCGATLANVGELLYLVWEGKWKGKGKAKGKGEARSMVVIDWAAIVVTKAEEGRLTGKVLSRDTIVFKDMPKGSAITHCIALEL

SEQ ID NO: 1832 - protein, 252 aa, Idiomarina loihiensis L2TR
MPNASLVIANWKMNGNRELTKTMSAALREKLNQLQQVKLVICPPFTLIGELANQCYYDDIAIGAQNVSEHTGGAFTGEISTAQLQEFGVSYVLVGHSERRQLFAETDKMVNEKALATVNAGMTAVICVGENKAQRDEGNTWEVVAQQAQAALADLPKEQAGKIVLAYEPVWAIGTGETASPEQAQDVHAKLRALLVEQFGAIGEKMPLLYGGSVKADNAAELFAQKDIDGGLIGGASLKESDFVAICQAAQG

SEQ ID NO: 1833 - protein, 516 aa, Clostridium perfringens SM101
MNTLNDILSKEIEEFREKGHKFLNKEMTVGEFRKVSGGMGVYAHRGGKEFVVRLRIPSGVARLSSLEQVYNWAKKYNLEKIHLTTRESIQLHGISIDAVCDIMQDGLTKGIYTRGAGGNFPRNVALNPLSGVQIGETFDVTPYALAANAHYMSKIYTYNLPRKIKTAFSNTEEDSAHCTVTDLGFLAVENNGKRAFKLYIGGGLGRNPRKSVEFDELIDEKDVLYCLEAITNLFIAEGDYKNNSKARIRYIVERMGEEEFKNCFRKHLEEVKVKGGLDLKVEDIKYSKKGEKTNIKHERLIPQKQEGLYTVLFHPVGGQLSLDVLKELIEKIENIEDVEVRLGMDENLYIRNLNGKEAEAILDFTQGKGGDTLAERSVSCIGTPICQMGVLESQKTLREFVKLLKENSIEEGVLPRVRFSGCPNSCGIHEVGNIGFAGKKKKVGDVLSNVFELHFGGKLGIGETRLGDYYGDILQDKVPEFLIKVAKAVEAKNSTFEEWIKDNSEEFKAIVEEYNV

SEQ ID NO: 1834 - protein, 405 aa, Zea mays
MDPTNQRSSGAGRRSSVAATMGRGGACVHGQQHVPAPTSLRSPSLPELQQAQSAMPPNPSWNFYPPNGFLNLINQPYMPMSSQPLGENFHFVGLTQNFNTSPPPPPSAKRTKKASRLAKETIQIGGDGDAATEESKAVNRRYWAHDEEVRLASSWLNCSHDPIHDNDKKGETFWKEIAEYFNKHAPADRQRDVNQLKIHWTRLKTVTNNFNGCWSAASKMHTSGYSGDQLMDEAQKMYANGSNGKPFTLVHWWKALRNEPKFCAQISQMIKEKGQSHTIDITKDKDQLPLQRPIGRDAAKAQRNGKRKAEEVLDGIARLGDSINKIIEVQHDRKQERKKVAETQLEISRLQLKAAQEQKEVKLLEVYSSLLQQDTSQLSNQGKINREKALQKMELKLFGDSENMM

SEQ ID NO: 1835 - protein, 1074 aa, Idiomarina loihiensis L2TR
MPKRTDIKSILILGAGPIVIGQACEFDYSGAQACKALREEGYRVILVNSNPATIMTDPEMADATYIEPIHWEVVEKIIERERPDAVLPTMGGQTALNCALDLDRHGVLERYKVEMIGANADAIDKAENRDRFDKAMKAIGLETPNAEMAHSLDEAFDVLSRLGFPCIIRPSFTMGGSGGGIAYNREEFEEICRRGLDLSPTNELLIDESLLGWKEYEMEVVRDKSDNCIIVCTIENFDPMGIHTGDSITVAPAQTLTDKEFQLMRDAAMAVLREIGVETGGSNVQFGVNPDTGRMVIIEMNPRVSRSSALASKATGFPIAKVAAKLAVGYTLDELENEITGGKTPASFEPALDYVVTKIPRFNFEKFANCNDRLTTQMKSVGEVMAIGRNFQESMQKALRGLELGASGFDPIVDLEAKDARSKVIRELKEPGAERIWYIADAFRLGMTVREVFELTRIDEWYLIQIEELVDLEKEVDELGLAGLTADVMTVLKRRGFADSRIADVLHVSEAEVRKKRYKYKIHPVYKRVDTCAAEFASGTAYMYSSYDEECEAAPTDNDKIMVIGGGPNRIGQGIEFDYCCVHASLALREDGYETIMVNCNPETVSTDYDTSDRLYFESITLEDVLEIVRIEKPKGVIVQYGGQTPLKLARELEANGVPIIGTSPDAIDRAEDRARFQTAVRRLGLKQPENSTVTGFNEALTEAKRIGYPLVVRPSYVLGGRAMEIVYDEADLQRYLTDAVKVSNDAPVLLDRFLDNAIEVDVDAICDGTDVLIGGIMQHIEEAGVHSGDSACSLPPYSLSDIIQAQLREQMRKLAFELNVNGLMNAQFAVKEDEIYLIEVNPRAARTVPFVSKATGVPLAKVAARVMVGQSLQEQGYVKEIIPPYYSVKEVVIPFAKFQGVDPIRGPEMRSTGEVMGVGESFEEAYAKANLGAGEALAKKGKALISVKDSDKQRLMDLARGLLALGFSLEATRGTAKMLGEEGIDCSIVNKLQEGRPNIVDAIKNGEYCYIINTVEGRQAIEDSVYIRREALLNKVIYTTTLNAAFATVKANTADDRARVSSVQELHKRVSLI

SEQ ID NO: 1836 - protein, 521 aa, Candida glabrata CBS 138
MSKRFVIENCIGRGNFGDVYKAKDTWLNEVVAVKVVNLENSEEEVELLAQEIFFLAELKSPYVTNYIATVVEDVSMWIAMEYCGGGSVGDLLKYHYTSGLPEHKTRFITREILKGLSYLHSQRKIHRDIKAANILLTDEGKVKLSDFGVSGKLLSSFRRDTFVGTPYWMAPEIVAHDSEGYDERADIWSLGITVIEMLRGSPPLSKYDPMKVIANLPKRKPPKLHGDFSDDAKHFVALCLIKESAIRPTAADLLTTRFTTNTRVENLKDDVDLIKHVKLKINRHSKSPKFPLEVKIYEDGTDCASANYWDFDTSGLSVVPATASVDNSFASNEASRIDETTEYHTGKGELVSAMTGSPISNNMISPYQDSYKSTVTPITPMPLGESFRKYSAPVKQQPAYDIGSGMEIDQQTCLDGEPHSSTDKVAHEDYKKSVDHKVNVKNTTISIVGFDYYRNVIHHSFKRMEDRAHDKRTKEVVLEILKHFAAVETTIPGFSEVFIEEISLRLEALRDYYEKHKSQLA

SEQ ID NO: 1837 - protein, 526 aa, Triticum aestivum
  misc_feature (29)..(29): Xaa can be any naturally occurring amino acid
  misc_feature (183)..(183): Xaa can be any naturally occurring amino acid
  unsure (1)..(526): unsure at all Xaa locations
MSEVKPEEISHPAMEQLQGFEYCIDSNPXIWGEAIILGFQHYILALGTAVMIPAVLVPMMGGSDGDRVRVVQTLLFVTGINTLLQSLFGTRLPTVIGGSYAFVIPVMAIVQDSSLAAISDDHERFLQSMRAIQGALIVSSSIQIILGYSQLWGIFSRFFSPLGMAPVVALLGFGLFERGFPVXVGRCVEVGLPMLILFVVLSQYLKNVQIREIPILERFSLFICIALVWAYAQILTSGGAYNHSTEVTQINCRTDRANLISSAPWIKIPYPLQWGAPTFSAGQSFGMVSAVLVSLIESTASYSAAARLASATPPPAHILSRGIGWQGIGILLCGLFGTGTGSTVSVENVGLLGSTRIGSRRVIQICAGFMIFFSMLGKFGALFASIPFTIFAAVYCVLFGLVAAVGLSFLQFTNMNSMRNLFIVGVSIFLGLSVPEYFFRYSMAAQRGPAHTKAGWFNDYINTIFSSPPTVGLMVAVFLDNTLEVKDAGRDRGMPWWVPFRSFKGDSRNEEFYSLPFNLNRFFPPS

SEQ ID NO: 1838 - protein, 267 aa, Arabidopsis thaliana
MAFCNKLGGLLRQNISSNGNVPVTSMLGSLRLMSTKLFIGGLSWGTDDASLRDAFAHFGDVVDAKVIVDRETGRSRGFGFVNFNDEGAATAAISEMGVEIQSPQEQSSYTVEQLVALNPFNPEILPDLENYVNVTSQTYSLEVNLCLLRLYQFEPERMNTHIVARILVKALMAMPTPDFSLCLFLIPFLSLSYQKVPRSVLAEAVNMDGASLDKFIEQQVTNSGWIVEKEGGSIVLPQNEFNHPELKKNTGENVPLEHIARIFPILG

SEQ ID NO: 1839 - protein, 447 aa, Staphylococcus aureus subsp. aureus MRSA252
MYMSKAHQLIQEDEHYFAKSGRIKYYPLVIDHGYGATLVDIEGKTYIDLLSSASSQNVGHAPREVTEAIKAQVDKFIHYTPAYMYHEPLVRLAKKLCEIAPGDFEKRVTFGLTGSDANDGIIKFARAYTGRPYIISFTNAYHGSTFGSLSMSAISLNMRKHYGPLLNGFYHIPFPDKYRGMYEQPQANSVEEYLAPLKEMFAKYVPADEVACIVIETIQGDGGLLEPVPGYFEALENICRENGILIAVDDIQQGFGRTGTWSSVSHFNFTPDLITFGKSLAGGMPMSAIVGRKEIMNCLEAPAHLFTTGANPVSCEAALATIQMIEDQSLLQASAEKGEYVRKRMDQWVSKYNSVGDVRGKGLSIGIDIVSDKNLKTRDASAALKICNYCFEHGVVIIAVAGNVLRFQPPLVITYEQLDTALNTIEDALTALEAGNLDQYDISGQGW

SEQ ID NO: 1840 - protein, 273 aa, Oryza sativa (japonica cultivar-group)
MASSSSAQETGRWSLAGATALVTGGSKGIGRAIVEELASFGATVHTCARNEATLNSCLEEWSAKKLSITSSVCDVSARADREALAGRVTAMFDGKLDILVNNVGFLFLKPAVNVTPEELSRVMAGNLERAIVEELASFGATVHTCARNEATLNSCLEEWSAKKLSITSSVCDVSARADREALAGRVTAMFDGKLDILVNNVGFLFLKPAVNVTPEELSRVMAGNLESCFHLSQLMHPLLKTSGKGNVVNISGISTVTGFPSLPICAFCAAKGS

SEQ ID NO: 1841 - protein, 294 aa, Glycine max
  misc_feature (256)..(256): Xaa can be any naturally occurring amino acid
  misc_feature (277)..(277): Xaa can be any naturally occurring amino acid
  unsure (1)..(294): unsure at all Xaa locations
MDQYEKVEKIGEGTYGVVYKARDRATNETIALKKIRLEQEDEGVPSTAIREISLLKEMQHRNIVRLQDVVHSEKRLYLVFEYLDLDLKKHMDSSPEFVKDPRQVKMFLYQILCGIAYCHSHRVLHRDLKPQNLLIDRRTNSLKLADFGLARAFGIPVRTFTHEVVTLWYRAPEILLGSRHYSTPVDVWSVGCIFAEMVNRRPLFPGDSEIDELFKIFRILGTPNEDTWPGVTSLPDFKSTFPKWPSKDLANVVPNXDAAGLNLLSSMLCLDPSKRIXARSAVEHEYFKDIKFVP

SEQ ID NO: 1842 - protein, 351 aa, Arabidopsis thaliana
MKKQYLKSGSGTRKEKDKAKRWFLDNGSIFLRELVADCNGKSIPIRSFSPEQILKATNNFDSSCFVSQDVYYKWYRGEIEDRSYMIKRFSEDEITGKRHRVKEVYNDIVLSARMSNHSNFLQLLGCCLEFPFPVLVFEFAEHGAMNQRGGVIVNGEESLLPWSVRLKIGKEIANAVTYLHTAFPKIIIHRDVKPMHVFLDKNWTAKLSDLSFSISLPEGKSRIEAEWVLGTFGYIDPLYHKTCFVTEYTDVYSFGICLLVIITGKPAIMTISDGDLQGILSLVRELCENGKLDEVIDPRLMKDITSGQRLQVEACVVLALRCCKERDEDRPKMIQVAKELKQIEASLKNSS

SEQ ID NO: 1843 - protein, 296 aa, Staphylococcus aureus subsp. aureus MRSA252
MNKEQLEKMKNGKGFIAALDQSGGSTPKALKEYGVNEDQYSNEDEMFQLVHDMRTRVVTSPSFSPDKILGAILFEQTMDREVEGKYTADYLADKGVVPFLKVDKGLAEEQNGVQLMKPIDNLDSLLDRANERHIFGTKMRSNILELNEQGIKDVVEQQFEVAKQIIAKGLVPIIEPEVNINAKDKAEIEKVLKAELKKGLDSLNADQLVMLKLTIPTEANLYKDLAEHPNVVRIVVLSGGYSREKANELLKDNAELIASFSRALASDLRAGQSKEEFDKALGDAVESIYDASVNKN

SEQ ID NO: 1844 - protein, 802 aa, Listeria monocytogenes str. 4b H7858
MLVSYNWVKEFFQDFPLTAEELGEAITRTGIEIEGVEELSASLKNVVVGEVLSCERHPDAEKLNKCLVQTDETEPVQIICGAPNVAAGQKVIVAKVGARLPGGLKIKRAKLRGEVSEGMICSLAELGFESKVVPKAYAEGIYVLPAHVETGVSAITLLGLDDAILDMAITPNRADALSMNGVAHEVGAIIHQKPAQPTEPDVSEKGKADDFISVEVENPAETPYYAIKMVENIEIKESPLWLQTKLMKAGIRPHNNVVDVTNYINLLYGQPLHSFDYDKIGSKKIVVRSAKEQEEITTLDGEKRTLQAGHTVITNGVEPIAIAGVMGGEFSEVTENTTTVALEGAIFSSSSIGKASRELYLRTEASIRYDKGSDAWKVEKALAHGGALIAELSGGTLVGGVVEVDNREKAVNKIETSLTRINRILGTAITLAEIETIFDRLGFVLEVKNDTLIIEVPTRRWDITIEADILEEVARIYGYDEIPVTLPATSTTGGLSDSQKARRVMRAYLEGAGLNQALTYSLTSKKDATRLALSDEKTVALSMPMSEEHSHLRTSIVPQLIRSASYNIARKNMDVALYEMGTVFYATEGDNLPIEQEHLAGLITGNWHTVDWQKTPKPVDFFVLKGIVEGLVNKLGIKSELHWKQTEKEELHPGRTASLILEGQEIGYLGALHPAVEANYDLKETYVFEINVAALLDATKEKVVYHPIPRYPEMTRDLALLVDKNTDHATISQVIQEHGGKLLVDIELFDIFEGESLGENKKSLAYTLTFLDSERTLVEEDVQKATNKVIEALQEKLHAIIR

SEQ ID NO: 1845 - protein, 136 aa, Candida glabrata CBS 138
MLSQIWILFTFMVCVIASKSKSDGLKFEITKKIPISKCKLKALPGDMVSVHYTGSLAENGKVFDSSLRRNEPIQFKLGAGQVIAGWEQGITGMCLGEKRTLHIPPELAYGSRGAGGVIPPNAVLDFDVELVDIARN

SEQ ID NO: 1846 - protein, 110 aa, Glycine max
  misc_feature (37)..(37): Xaa can be any naturally occurring amino acid
  misc_feature (50)..(50): Xaa can be any naturally occurring amino acid
  misc_feature (75)..(75): Xaa can be any naturally occurring amino acid
  unsure (1)..(110): unsure at all Xaa locations
PVAFARTPVTSSGVSSCGGTAQARIEARGFIFGSPIXGAKFVPLRKPKKXPGKVISQEHILEYGRDCLEMHVGLXAVEPAEHALVVDDLIATGGTLCAAMDLLGFDAWCS

SEQ ID NO: 1847 - protein, 496 aa, Staphylococcus aureus subsp. aureus MRSA252
MELLKHLSQRQYIDGEWVESANKNTRDIINPYNQEVIFTVSEGTKEDAERAILAARRAFESGEWSQETAETRGKKVRAIADKIKEHREALARLETLDTGKTLEESYADMDDIHNVFMYFAGLADKDGGEMIDSPIPDTESKIVKEPVGVVTQITPWNYPLLQASWKIAPALATGCSLVMKPSEITPLTTIRVFELMEEVGFPKGTINLILGAGSEVGDVMSGHKEIDLVSFTGGIETGKHIMKNAANNVTNIALELGGKNPNIIFDDADFELAVDQALNGGYFHAGQVCSAGSRILVQNSIKDKFEQALIDRVKKIKLGNGFDADTEMGPVISTEHRNKIESYMDVAKAEGATIAVGGKRPDRDDLKDGLFFEPTVITNCDTSMRIVQEEVFGPVVTVEGFETEQEAIQLANDSIYGLAGAVFSKDIGKAQRVANKLKLGTVWINDFHPYFAQAPWGGYKQSGIGRELGKEGLEEYLVSKHILTNTNPQLVNWFSK

SEQ ID NO: 1848 - protein, 418 aa, Fusarium proliferatum
MSDLQGRKVFKVFNQDFIVDERYTVTKELGQGAYGIVCAAVNNQTNEGVAIKKVTNVFSKKILAKRALREIKLLQHFRGHRNITCLYDMDIPRPDNFNETYLYEELMECDLAAIIRSGQPLTDAHFQSFIYQILCGLKYIHSANVLHRDLKPGNLLVNADCELKICDFGLARGFSVDPEENAGYMTEYVATRWYRAPEIMLSFQSYTKTIDVWSVGCILAELLGGRPFFKGRDYVDQLNQILHILGTPNEETLSRIGSPRAQEYVRNLPFMPKKPFPSLFPQANPDALDLLDKMLAFDPSSRISVEQALEHPYLHIWHDASDEPDCPTTFNFDFEVVEDVGQMRGMILDEVMRFRQTVRTVPGQGGPAGLQNQQGVPVPLPQGNGQWTAEDPRPQEYQGHGNTGLEQDLQGGLDASRR

SEQ ID NO: 1849 - protein, 543 aa, Lilium davidii
TREIRRRMLSGLSIRVRQLRHRLPKLSRPGLSIEDFQFFLFSDELNPPIGTQVHQDMTAPLSHYYIYSGHNSYLTGNQLSSDCSDVPIINSLQSGVRVIELDLWPNSTKDNIDILHGRTLTTPVDLIKCLKSIKEYAFVASPYPVIITLEDHLTPDLQAKVAKMVTETFGDMLYFPDSDYLKEFPSPEALEKRIIISTRPPKEYLEAKSFKKKDDDSPKEKNSDDEEWGSEAVDKTEADFDDGQSEHPHNEDEANDDDHKIKHDLAPEYRRLITITAGKPKGSVRDALKVDPDRVKRVSLSEQELEKVAVSHGADVIRFTQKNLLRIYQRGTRFNSSNSILVGWMHGAQMVAFNMQGFGRSLWRMQGFYRANGGCGYVKKPHFLLNNGPHGEVFNPKAKLPAKKILKVKVYMGDGWRMDFKSTHFDTYSPPDFYTRVGIAGVPADCTMKKTRTIEDDWTPVWDEELVFPLTVPELALLRIEVHEYDMSDKDDFGGQTCLPVSELKPGIRAVPLFTRKGVKYRSVRLLVRFEFLTDCFSSVEIE

SEQ ID NO: 1850 - protein, 391 aa, Pseudomonas viridiflava
MEQQCDVAVLGLGAMGAATLYQLAREGADVLGIDQYAPPHTLGSSHGDTRITRLSVGEGPQYLPLVRNSHRIWRELEALTGESLFEQCGVLVMTSSPTYDPNDPEDFTHKTIALAREYGVRHEVLSAADIRERFPQFSPVLDTAIGYFEPDGGFVRPERCIAAQLQLAGKLGARVRLNETVTRLQAHGDQVRITTDQGSIIANKVVVSAGMWSSQLLGEPFTDLLRVCRQQLFWFALEDTAAFAPVSPSFILTHGPGEVDINYGFPPLPGEGSMKIATEQYLHASQACELDRSVSVEDEQTMFQTQVSGRIAGIKADVVKSSVCAYTVTPDYHFIIDDHPHLKNVTVVSACSGHGFKHSAGLGLALAQRCLRGTSDVDLSAFSLKRFGKTA

SEQ ID NO: 1851 - protein, 547 aa, Lilium davidii
  misc_feature (253)..(253): Xaa can be any naturally occurring amino acid
  misc_feature (460)..(460): Xaa can be any naturally occurring amino acid
  unsure (1)..(547): unsure at all Xaa locations
TRGPDQLLRFLADSQGEVGATVADAEKVIDQLRQLRHRIAKLTRPLLTLDDFHHYLFSEELNPPIRSQIHQDMNAPLSHYYIYTGHNSYLTGNQLSSDCSDVPIIKALERGVRVIELDMWPNATKDNIDILHGRTLTTPVELIKCLKSIKEHAFVASPYPVVITLEDHLTPDLQAKVAEMVTETFGDMLYYPESDSLNEFPSPEFLKKRVILFTKPSKESLKLRARRMIFLMKMFLKRKKHGERKSRSQNRNXAGDKRENDESEDEEVDDDYVIPQNLAPEYKRLILLRAGKPKGELVDALQVDPDTVRRLSLSEQELAKAAISHGSDLVRFTQKNLLRIYPKGTRFTSSNYNPFVGWLHGAQMVAFNMQGYGRALWLMHGFYQANGGCGYVKKPDFLLNTGSHGETFHPKVPLPVKKTLKVKVYMGDGWRMDFKQTYFDAYSPPDFYTRIGIAGVPADXVMKRTKAIEDDWTPVWNEEFVFPLTVPEIALLRIEVHEYDMSEKDDFGGQTCLPISELRPGFRSVPLFDRKGMKFKSVKLLMRFEFI

SEQ ID NO: 1852 - protein, 253 aa, Oryza sativa (indica cultivar-group)
MATARAVRLIASRPPSTNLRSLVVVPGRRRLLSTSTEAGGAGDPSVHSGDPPSDDYPDRPPKFSGAEEATGGGDHGKNPSTAAATPSESTKERVPPFAMSDKLGSQELADPAGGSSFTQKRRRSSSSRPADSREEATPGGEEAAGRKVREEDREYYQTHKPSPLAELEFADTRKPITRATDGGSAADRLSDVPGKVVEDTADDSLARAEAMFREAASRGNPEWPHSRALAEMLARRRGEGDAAGSRSSAPWGS

SEQ ID NO: 1853 - protein, 501 aa, Candida albicans SC5314
MTIPLSVDVTLPDGKKFTQPTGLFINNEFIKSKSGKTLESINPGTSEINGEVYAAESEDIDYAVECASKAFKSWKKITGVERGKYLYKLADLVEQQRDLLGAMEAWDSGKTKSTNAVFDVDECIAVIRYAASWADKITGKVIQNDPKKFAYTIHEPWGVCAQIVPWNYPLLMSMWKIPIAVAAGNTVVLKTSEITPLSMLYFASLVKQVGFPPGVINIVSGFGATAGAALASHKKVAKIAFTGSTATGKIIQKLAAENLKAVTLECGGKSPLIIRSDADIDQAVKWGAIGIMSNQGQICTSTSRIYVHESIYDKFIEEFAAHVKSDYKQGDVFDDEAVVGPQVSKMQHDKILNYIDIGKKEGARCVLGGEKNIEGELSKGYFVKPTIFADVKPEMRIVNEEIFGPVVVVGKFSTDEEAITYANQTDYGLGAAIFTKDITAAHNMASDIEAGMVWINSSNDSDYHVPFGGVKMSGVGRELGEYGLNMYTQAKAVHVNLGTRL

SEQ ID NO: 1854 - protein, 455 aa, Coprinopsis cinerea okayama7#130
MGRPLPRARPSLESIQQLYTHHPSHGHQGHLDPHLEDKPTPQEVTITHSTPFAPPPPTSSAFLAAGAPSSLNTGFSGGGPFGGSSFVGSSTVGKGDGNKTNPFASHSFVPVEGAPGFKPDEYDWDKGHYEELEKELDGAPSKGGEVSRGRTQEKEGGGFGSRFSFGPFRRKTSADRVPSNTVGRGRTHTEPPSSKLEVPSYATVRGGNPSPSRRVPDLIERKFASVTLKGRNEGTDVVLKEKLAELIRPHLPPLSRLPKTWTLLYSLDQHGISLNTLYNNCETPERNRKRGEGYIGMGGAVLVVKDSLASENQDGDLFGAFVAEGLGKKSKGFFGGGDSFLWKYADGQLKVFKATGKNTYFAICNKEYMAFGGGSTSYGLYLDSGLFQGSSAPCPTFGNEVLCTIPFCKSRNDDTTSSSSFQPTLAPGLTTKSTLAVGDEVDFECVGLEVWGVGP

SEQ ID NO: 1855 - protein, 347 aa, Bacillus anthracis str. Ames
MKDLIIIGAGQAGLTMGYYLKQEGYNFLLLEAGNRVGDSWRNRYDSLQLFTPRSYSSLPGMALIGEKNEFPYKDEIATYLEEYARHFQLPVQLQTEVLKIRKEKGIFELHTSTEILQTKKVIIATGGFQQPFIPSVSANLSSHVFQIHSSQYKSPSQIPQGKVLVVGGGNSGMQIAVEFAKTHEVTMSISHPLTFLPLHLFRKSIFNWLDKLGLLYAEVNTKRGKWFQKRKDPIFGFEGKELIRNGAIQLQEKVVSASENNIMFQNGETYSAESIIWSTGFIQNYNWIEIEKVVNENGLPNHIKGISPVRGLYYIGLPWQSQRGSALICGVGKDAAYLLSEIKKIDQ

SEQ ID NO: 1856 - protein, 824 aa, Coprinopsis cinerea okayama7#130
MSACQIAAASHGLEAQTLKKPKWKFEHVADLRTSFARSPSSTHNHFAGVKVSVSMASTADKGGILEHRKASSSDEKFDEKKSIDGVETAESYQGDVYEDVRQIDLDETGRERPIETDLDVATRLISLEDDPTLPAFTFRMWFLGIGLSCFGAVLGQIFYFRPQTVFVSQLFIQIIAYILGRVLEEIVPGPGNEHENLKMPDNWFWRFLNPGPFNIKEHVAITIFASTAADSALAISIFAADDLYYNIQPSVVVGIFTLIGSQLMGYGIGGLMRSFLVYPTYIVFPNLLPTVQLFDALHRGKKIFLQKKRVKFFWSVFAGIFVWEWFPEYIAPTLTGISIFCLANRDSPWFTRIFGGAAGNEGLGAFALCLDWNYVGSGGGAIGALFTPLSTQLSLYCGTAICMIAFCACFAMNVWNGQNFPFLSQALFYENGTRFQQLRILDENFRLDPVKLEAEGLPWFASSQVIAKIAHNLAIGSTITHVLIWYGKDIIQVIRKYRAGEIYDPHLAKMKAYREVPVWWYIAMFVASFAMAMSTIYAAKSGLPWWGLIVALCLSTIFLPFVITVYAITGFSPNVTALVQMLGACMIPGNPQANMYFTLYGYNTLDQARGLIRDLKMGQYTKLPPRVTFTVQSLGSIIGGLLNYIIMKVIIKSHREILLQVQGTNVWSGQQVQTFNSNAITWGALGNILYAPSGRYWIVPFAILIGLAVPIPFWVVHRYWPNVKADKVVTPILCWTLGYLSVGINSSVFTTFCLAIFSQYYLRRYRPRWFRKYNFLLSAALDGGTQVMVFVYTFAVGGGSGRVVDMPRWALNPEGNPDYCMRLT

SEQ ID NO: 1857 - protein, 463 aa, Bacillus anthracis str. Ames
MANKELKRGLEARHIQMIALGGTIGVGLFMGSASTIKWTGPSVMLAYAIAGIFIFFIMRAMGEMLYMEPSTGSFATFGHKYIHPLAGYMTAWSNWFQWVIVGMSEIIAVGAYMQYWFPDLPAWIPGVIAMVILGAANLISVKSFGEFEFWFAMIKIVTILLMIIAGFGLIFFGIGNGGEAIGISNLWSNGGFFTGGFSGFFFALSLVVGAYQGVELIGITAGEAKDPKKTLTRAIQSTIWRILIFYIGAIFVIVTVYPWDQLSTIGSPFVATFAKVGITAAAGLINFVVITAAMSGCNSGIYSAGRMLYTLGVNGQAPKYFTKLSGNGVPLFGTVGVIIGLAVGVVLSYIAPKNLFVYVYSASVLPGMVPWFVILISQINFRKEKGAEMKDHPFKMPFAPVTNYLTIAFLIMVLVGMWFNDDTRISLVVGIVFLAIVTISFYAFGIGKRPPLDVPNDQEISSK

SEQ ID NO: 1858 - protein, 547 aa, Myxococcus xanthus DK 1622
MLPGRMMDFPLTLSHLMERARTFYPRSEIVSRNPDKSLHRYTYADFYARTCRLANALTRLGVKAGDRVATLSWNHYRHLEVYYGVPCMGAVVHTLNLRLHPNDLGYIARHAEDSVVVVDRSLLPLFEKFKDAVPSIRHVIVVPDAGPAPEGTLDYEALLAAESPDFDFPQLDENSASMLCYTSGTTGNPKGVLYSHRSTVLHALACCMTDVTGMREADAVMPVVPMFHAAAWGLAFDAVLTGAKLVLPGPHLDPPSLLDLMAAEKVTLAGGVPTIWIGILALLDQAPNKWDLSSMRSMLIGGSAAPPSLIEGFQQRHGLEVVHAWGMTEMSPVGTMAKVKGPLRQAAHEAKSSARASQGFALPFVETRVASDDGTLLPWDGETMGELEVRGPWVASSYFSDEGADRYTKDGWFKTGDVVTIDSHGYVRICDRSKDVIKSGGEWISSVALENALMAHPAVLEAAVFAGKHPKWDERPLAAVALKEGQQVTKEELTAHLAGQFAKMWLPDDYVFVPQVPRTSTGKFLKTKLREDYGDHLLKNPKADAAT

SEQ ID NO: 1859 - protein, 426 aa, Oryza sativa (japonica cultivar-group)
MSLGYAEKLSYREDVGNVGMPEIFDSPELLHKKIEELAVMVRESKHLVVFTGAGISTSSGIPDFRGPKGVWTLQVRSGKGVPGASLPFHRAVPTLTHMALVELEKTGRLKFVISQNVDSLHLRSGLPREKLAELHGNSFKEICPSCKKEYLRDFEIETIGLKDTPRRCSDKNCGARLKDTVLDWEDALPPEEMDAAKEQCQKADLVLCLGTSLQITPACNMPLLSLKNGGRVAIVNLQATPKDKKASLVIHGLVDKVSFPERPDMKPVVLKEQPFSLQRETSMNRPFVMLLTFNFSDGCGCSSSSIEWPVDFLKQKDSFVRDRSLVLQELQHAAEHRSRAGQHAILEREGVPRAETSIHALVTNIVRYDTEDSKAAVPMATWMNSNGSLSKRHMDAIGCNPASSKKQKLVATRHRRKGLNPATQKV

SEQ ID NO: 1860 - protein, 94 aa, Triticum aestivum
IAVAVSADECEGDRRAMIKECAKYQQWPANPKLDPSDACCAVWQKANIPCLCAGVTKEKEKIYCMEKVAYVANFCKKPFPHGYKCGSYTFPPLA

SEQ ID NO: 1861 - protein, 298 aa, Secale cereale
MAARRPSPPPASPPPPRPRSTTTTRTTSSASAAPAAAQRLVAMAGSGKFFVGGNWKCNGTKESISKLVSDLNAATLESDVDVVVAPPFIYIDQVKSSLTDRIEVSAQNTWIGKGGAFTGEISAEQLVDIGCQWVILGHSERRHVIGEDDEFIGKKAAYALSQNLKVMACIGELLEEREAGKTFDVCFKQMKAFADNITDWTNVVIAYEPVWAIGTGKVASPEQAQEVHAAVRDWLKTNVSADVASTVRIIYGGSVNAANCAELAKKEDIDGFLVGGASLKGPDFATICNSVTSKKVTA

SEQ ID NO: 1862 - protein, 351 aa, Oryza sativa (japonica cultivar-group)
MGAVLGTGRVGTLTRVALTIVVFLLLLPSHALAAAVAKDTSATLVETLPLPTTLVGPESVAFDKFGDGPYSGVSDGRILRWDGADEGWTTYSHSPGYNVAKCMAPKLHPAELTESKCGRPLGLRFHNTSGNLYIADAYKGLMRVGPRGGEATVLATEADGVPFKFTNGVDVNQVTGEVYFTDSSTRFQRSQHEMVTATGDSTGRLMKYDATTGYLDVLQSGMTYPNGLALSADRSHLVVALTGPCKLVRHWIDGPKAGTSEPFAELPGYPDNVRPDGKGGYWVALHREKTESPYGSDTHLLAVRIGRKGKILQELRGPKNVRPTEVIERGGGKLYLGSVVWRLWVPHTHTA

SEQ ID NO: 1863 - protein, 131 aa, Zea mays
  misc_feature (118)..(118): Xaa can be any naturally occurring amino acid
  unsure (1)..(131): unsure at all Xaa locations
MVRVSVLNDALKSMYNAEKIGKRQVMIRPSSKVIIKFLTVMQRHGYIGEFEYVDDHRSGKIVVELNGRLNKCGVISPRFDIGVKDIEGWTARLLPSRQFGYIVLTTSAGIMDHEEARXRKSVGGKVLGFFY

SEQ ID NO: 1864 - protein, 371 aa, Mannheimia succiniciproducens MBEL55E
MRYDKMSPFIVMDIVREAAKYPNAIHFEIGQPDLAPSEKVKKALQSAVENNKFSYTESLGLLALREKICQYYDRTYHVKITPNRVLLTPGTSGAFLIAYALTLAQDDKLGLTDPSYPCYKNFAYMMDIQPEFMPVDKHNCYQLEVGQLKGRNIKALQISSPANPTGNIYTAESLKSLNDYCMENHIDFISDELYHGLVYDQNAATALQFNPRAYVINGFSKYYCMPGMRLGWIIVPEDKVREAEIIAQNIFISAPTLSQYAALEAFEEEFLTATKQVFQQRRDFLYDALKDLFTIEFKPQGAFYLWADVSKYTDDSYQFAKKMLHEIQVAATPGIDFGENGTKHYLRFAYTRDIEHLREGVERMKQWLKNK

SEQ ID NO: 1865 - protein, 253 aa, Secale cereale
MGRKFFVGGNWKCNGTVSQVETIVNTLNAGQIASPDVVEVVVSPPYVFLPTVKDKLRPEIQVAAQNCWVKKGGAFTGEVSAEMLVNLGIPWVILGHSERRSLLAESSEFVGEKVAYALAQGLKVIACVGETLEQREAGSTMEVVAEQTKAIADKIKDWTNVVVAYEPVWAIGTGKVASPAQAQEVHANLRDWLKTNVSPEVAESTRIIYGGSVTGASCKELAAQPDVDGFLVGGASLKPEFIDIINAATVKSA

SEQ ID NO: 1866 - protein, 368 aa, Arabidopsis thaliana
MKLTVKTLKGSHFEIRVLPTDTIMAVKKNIEDSQSKDNYPCGQQLLIHNGKVLKDETTLVENKVTEEGFLVVMLSKSKTASSAGPSSTQPTSTTTSTISSTTLAAPSTTQSIAVPASNSTPVQEQPTAQSDTYGQAASTLVSGSSIEQMVQQIMEMGGGSWDKETVTRALRAAYNNPERAVDYLYSGIPETVTIPATNLSGVGSGRELTAPPPSGGPNSSPLDLFPQEAVSDAAGGDLGTLEFLRGNDQFQQLRSMVNSNPQILQPMLQELGKQNPQLLRLIQENQAEFLQLLNEPYEGSDGDVDIFDQPDQEMPHSVNVTPEEQESIERLEAMGFDRAIVIEAFLSCDRNEELAANYLLEHSADFED

SEQ ID NO: 1867 - protein, 588 aa, Mannheimia succiniciproducens MBEL55E
MSDKKQKGLEWQDNPLSDNERLKEESNHLRGTILDDLEDGLTGGFKGDNFQLIRFHGMYEQDDRDIRAERQEEKLEPRKFMLLRCRLPGGIIKPEQWIEIDKFARDNNYYQSIRLTNRQTFQYHGVPKTKLQDMHRLLHKLGLDSIATASDMNRNVLCSSNPVESELHQEAYEWAKKISEHLLPRTNGYLDVWISGKKVQSSDSFLGQEDEPILGNRYLPRKYKTAVVLPPLNDVDLYSNDMNFVGIKDEKTGKLAGFNVLVGGGLSFEHGNTKTYPNIALELGYVPVEDTLKAAESIVTTQRDFGNRADRKNARLRYTIQNMTLEGFREEVERRMGRRFEAIRPFEFTERGDRIGWVKGIDKKWHLTCFIESGRLVDKPDLPLMTGMLELAKVHKGDFRITANQNIIIANVAEEDKRQIEDIARQYGLIRKITKLRENAMSCVSFPTCPLAMAESERVLPEFIDELDKIMAKHHVEQDYIVTRITGCPNGCGRAMLAEIGLVGKAVGRYNLHLGGNIAGTRIPRLYKENITLDEILSELDGLIARWATERDQGEGFGDFVLRVGIIKPVVNPVVDFWDENLIPTVAV

SEQ ID NO: 1868 - protein, 169 aa, Synechococcus sp. RS9917
MTVAPSPDASLALLDNAVLAWGLAACGLAQLSKLFIELAWHRRWRPAVLIETGGMPSSHSALVTGTAAGVGWQLGFADPVFALAATVAFVVMYDASGIRRAAGSTAARVNALPETSWPQPPAKPLKESLGHTRLEVLVGSLIGPAIALPGLALVGSPWQLGTQIAQALG

SEQ ID NO: 1869 - protein, 429 aa, Roseovarius nubinhibens ISM
MPALSPTMEEGTLAKWLVKEGDTVSSGDLLAEIETDKATMEFEAVDEGVIGKILVAEGSEGVKVNTPIAVLLEEGESADDIGEASAPAAEPKAEAPKSDAAPKPEAAPAASAAPAAPKADGERIFASPLARRIAADKGLDLSQISGSGPRGRIVKADVENAQPSAAKPAAKDQPAAAPAAAAPAATGPSSSQVIAMYEGREYEEIPLNGMRKTIAARLTEAKQSIPHFYLRRDIRLDALLKFRGQLNKQLEARSVKLSVNDFIIKACALALQTVPAANAVWAGDRVLQLKPSDVAVAVAIEGGLFTPVLKDAEMKSLSALSSEMKDLASRARDRKLAPHEYQGGSFAISNLGMFGIDNFDAVINPPHGAILAVGAGVKKPVVGADGELSVATVMSVTLSVDHRVIDGALGAQLLDAIVQNLENPMVMLA

SEQ ID NO: 1870 - protein, 460 aa, Roseovarius nubinhibens ISM
MPTEILMPALSPTMEEGTLAKWLVKEGDTVSSGDILAEIETDKATMEFEAVDEGVIGKILVGDGSEGVKVNTPIAVLLEEGESADDIGEASAAPAEAPKSEDAAKPAPAKAKAPATESENLAPNTEPDWPEGTPMKTMTVREALNSAMAEEMRSDETVFVMGEEVAEYQGAYKITQNLLDEFGSKRVIDTPITEHGFAGIGVGAAWGGLKPIVEFMTWNFAMQAIDQIINSAGKTNYMSGGQLGCSIVFRGPNGAAARVGAQHSQDYAAWYAQVPGLKVVQPYSAADAKGLLKSAIRDPNPVVFLENEILYGKSFEVPALDDFTIPFGKARVWREGEDVTIVSFGIGMTYALDAAEKLAEDGISAEVIDLRTLRPIDYDTVIASVMKTNRCVTVEEGWPVASIGNHISATLMERAFDYLDAPVINCTGKDVPMPYAANLEKLALTSTAEVIEAVRKVTYK

SEQ ID NO: 1871 - protein, 208 aa, Brassica napus
MSWIRRLDLIDPYYTCSPPLLIHRETSIVKPPSSFFDYVFEEEEEDLAPFPFGFSPPPSPLDLFFETDLVLIEKSIRRRREEEYPPLQYLCDRVSQLETKFERCLVGGGRDGSDRKYKLTKEIKGGSGERKYKWEAEIQGPPGRKYKLEAEPTERKYKWEAEFECPGGERKYTWTTEIKGGKKKKDVVALKKAKAKAAAEAAEAEEME

SEQ ID NO: 1872 - protein, 434 aa, Glycine max
MPSLVAEAFQANGAEPLNLKPIFCASGIKGKRVTALSAEKNGLTDFIQRIIADKPDIDTPFSVLDLGVVMGLMDQWACKLPTVQPFYAVKCNPNLSLIGALAALGSSFDCASKAEIESVLSLGVSPDRIIYANPCKSESHIRYAASVGVNVTTYDSIDEVEKIRKCHPTCELLLRIKPPQDSGARTSLGLKYGALPEEVDELLQAAHEAGLKVTGVSFHIGSGGADTRAYHGAISAAKNVFESASRLGLPRMGVLDIGGGFTSGPSFEAAALKINAAIEGSFGKEEGLVVIGEPGRYFAETAFTLATRVIGKRVRGDVREYWIDDGIYGTLNNIVFDYATVTCMPLACTSKPENPTCCRDLNLKTYPSTVFGPTCDSIDTVLRDYQLPELQVNDWLVFPNMGAYTTSSGTNFNGFSSSAKSIFLACSSPEHTMF

SEQ ID NO: 1873 - protein, 461 aa, Listeria monocytogenes str. 4b H7858
MSLFSLKRKNHFVPLEIQRQQWFKHFIVAFMSVFICYLTVYLLRNNFKAAQTLLIEQNHFSTTELGMIGLAFSVMYGIGKTILGYAVDGRNAKKIMSFLLGISAIISIIIGILLVTKQATVGILFILWGANGFVQSPGGPASYSTITRWTPKLKRGRWLGFWNASHNIGGALAGIVAFWGATTFFNGGAGGMFIVPGIIAIIIAIICFSVGHDEPEELGWNSAAEIFEEREEQGESETKDLSRFQILCRFVINNPWVWTLCVINIFIYIVRIGIDNWAPVYCIQALGWSTKDAIMTISFFEIGALLGSLSWGWLSDIMKGRRMLCSIIAVVIEFFMLISYSQVTSVYSMYTVLFILGFLVFGPQLLIGVSVIEFVPRNALAVTNGLTGTFAYLFGDSFAKVFLGYIADPTKAGIQIFGYTLHGWGATFTIMFTALIIAGLMMIPVALKQEKIIRQAKVLHL

SEQ ID NO: 1874 - protein, 149 aa, Geobacillus stearothermophilus
MAERTFLMVKPDGVQRNLIGEIVSRFEKKGFQLVGAKLMQVSRELAEQHYAEHKERPFFGELVDFITSGPVFAMVWEGENVIAAARQMMGKTNPQEAAPGTIRGDFGLTVGKNVIHGSDSPQSAEREINLFFKEEELLNYTKLLNEWLY

SEQ ID NO: 1875 - protein, 331 aa, Xanthobacter autotrophicus Py2
MPDVSSIPENERVYGLKGVLEHSFERTRHDASGALADYIPELAKADPDRFGIAMASVSGEVVGVGDVDLPFTIQSISKALAYCLALEALGRDKVLAHVGVEPSGDAFNAIVFDALSNRPFNPMVNAGAITVSGLLSEAFGAEAFEVVLDRFSAAAGRRLVMDETVFRSEAQTGHRNRGIAHLLKCAGALGADVDDAVDLYFRQCSILVTATDLAVMGATLANIGENPLTGSAAFAVEAVRNTLSVMFTCGMYDFAGNWAFDVGVPAKSGVGGGILGVVNRQLGIGTYSPRLDAKGNSVRGISAFRDLAEEMGLHVFDPTNRGSSLLSAYRR

SEQ ID NO: 1876 - protein, 512 aa, Magnaporthe grisea 70-15
MDFVIDGWGVASEESPKNGDAIAAAETPVMDEFARSKTGYVELEASSLAVGLPEGLMGNSEVGHLNIGAGRVVWQDVVRIDQSIKTGEFSKNEVITQVIEAAKSGNGRLHLCGLVSHGGVHSKQEHLYSLLKAAKEAQVPKVFIHFFGDGRDTDPKSGVGYMEELLEKTKEIGIGQIATVVGRYYAMDRDKRWERVELAMKGLVLGEGEASEDPVKTVKERYEKGENDEFLKPIVVGGDEGRIKDGDNVFFFNYRSDRVRQITQLLGDVDRSPRPDFPYPKIKLATMTRYKLDYPFDVAFEPQKMGNVLAEWLGKQNVPQVHVAETEKYAHVTFFFNGGVEKAFALEERDESQDLVPSNKSVATYDKAPEMSADGVADQVAKRLGEQKFPFVMNNFAPPDMVGHTGVYEAAIVGCAATDKAIGKIYEACKAHNYVLFITADHGNAEEMKFPDGKPKTSHTTNKVPFIMANAPEGWSLKPVGGVLGDVAPTVLACMGLPQPEEMTGENLLVKA

SEQ ID NO: 1877 - protein, 389 aa, Streptomyces tendae
MTESYDVVVVGGGPVGLATAWQVAERGHRVLVLERHTFFNENGGTSGAERHWRLQYTQEDLFRLTLETLPLWRALESRCERRLIHEIGSLWFGDTDVVTNEGQISGTAAMMDKLSVRYEWLKATDIERRFGFRGLPRDYEGFLQPDGGTIDVRGTLAALFTLAQAAGATLRAGETVTELVPDADGVSVTTDRGTYRAGKVVLACGPYTNDLLEPLGARLAYSVYEMAIAAYRQATPVTEAPFWFAFQQPTPQDTNLFYGFGHNPWAPGEFVRCGPDFEVDPLDHPSAATGVADRRQMDRLSGWLRDHLPTVDPDPVRTSTCLAVLPTDPERQFFLGTARDLMTHGEKLVVYGAGWAFKFVPLFGRICADLAVEDSTAYDISRLAPQSAL

SEQ ID NO: 1878 - protein, 382 aa, Glycine max
  misc_feature (170)..(170): Xaa can be any naturally occurring amino acid
  misc_feature (201)..(201): Xaa can be any naturally occurring amino acid
  misc_feature (227)..(227): Xaa can be any naturally occurring amino acid
  unsure (1)..(382): unsure at all Xaa locations
MATQGQVITCKAAVAWEPNKPLTVQDVQVAPPQAGEVRVQILFTALCHTDAYTWGGKDPEGLFPCILGHEAAGIVESVGEGVTNVQPGDHVIPCYQAECGECKTCKSGKTNLCGKVRSATGVGVMLNDGKSRFSINGKPIYHFMGTSTFSQYTVVHDVSVAKIDPVAPLXKVCLLGCGVSPGLGAVWNTAKVESGSIVAIXFGLGNCWALLLQKGAKTVGASRVIGXIDIGSNRKERAKNLGVTEFINPNEHEKPVQQVIVELTDGGVDYSFECIGNVLVMRSALECCHKGWGTSVIVGVAASGQEICTRPFQLVTGRVWKGTAFGGFKSRSQVPWLVDKYLKKEIKVDEYITPSLSLAEINKAFDLMHEGGCLRCVLAMNV

SEQ ID NO: 1879 - protein, 331 aa, Saccharum hybrid cultivar H65-7052
MTITRHVLNEQSRNPESRGDFTILLSHIVLGCKFVASAVNKAGLAQLIGLAGETNVQGEEQKKLDVLSNEVFVKALVSSGRTCVLVSEEDEETTFVDPKLRGKYCVCFDPLDGSSNIDCGVSIGTIFGIYMIKDKDNVTLSDVLQPGKDMLAAGYCMYGSSCTLVLSTGTGVNGFTLDPSLGEFILTHPDIKIPKKGKIYSVNEGNAKNWDVPVAKFVEKCKYPKDGSPPKSLRYIGSMVADVHRTLLYGGVFLYPADQKSPNGKLRVLYEVFPMSFLMEQAGGQSFTGKERALDLVPTKIHERSPIFLGSYDDVEEIKALYAEQAKSSSA

SEQ ID NO: 1880 - protein, 528 aa, Burkholderia sp. 383
MKNHAWIRFTPIAVAAAAALTACGGDDVQQQGLSTVKNVVVIYAENRSFDNLYGNFPGANGLQNVTAASAQQKDRNGQPLATLPKVWGGLTAKGVTPAVTEAMTANLPNAPFAIDDPNGFNTSMSVTTRDLYHRFYENQMQINGGKNDMFAAWADSGGLVMGHYTPDATKLPLWKIAQQFTLADNFFMGAFGGSFLNHQYLICACAPFYANADKSPAAGSISAVAADGKSLQLATNSPASALDGIPKFVNSGNLTPDFYAINTMQPPYQPSGNKAASGGDPNLADPSAASTLPPQSQQNIGDLLTNAGVSWAWYGGAWNQALQAAQSGTANVIYGPNMTAPNFQPHHQPFNYYANQAPGSASRAQHLLDGGTDGSEFIKAIDAGTLPQVSFYKPQGNLNEHAGYTDVSSGDQHIANLIAHLQASPQWKNMVVVVTYDENGGFWDHVSPPKGDRWGPGTRIPALIVSPFSKKGFVDHTQYDTASILRFITRRFSLPRLTGLQQRDDALKANGGQPMGDLTNALQLSPNL

SEQ ID NO: 1881 - protein, 524 aa, Vitis pseudoreticulata
MAARRISSLLSRSLSVSSAFSLSLGKNFNRGKSIHRFSTAAAAVEELITPTVQINYTQLLINGQFVDAASVIANVAEGDAEDINRAVSAARKAFDEGPWPRMSPYERSRILLRFADLAEKHNDELAALETWNNGKPYEQAAKAELPLFVRLFRYYAGWADKIHGLTVQADGPHHVQILHEPIGVAGQIIPWNFPLMMFAWKVGPALACGNTIVLKTAEQTPLTALFAAKLFHEAGLPPGVLNIVSGYGPTAGAALASHMDVDKIAFTGSTDTGKIVQELAAKSNLKPVTLELGGKSPFIVCEDADIDQAVELAHFALFFNQGQCCCAGSRTFVHESVYDEFIEKAKARALSRTVGDPFKKGIEQGPQIDPEQFAKVLRYIKSGVESNATLECGGGRIGSKGYFVQPTVFSNVQDDMLIAKDEIFGPVQSILKYKDLDEVIRRANSTRYGLAAGVFTKNINTANTLTRALRVGTVWVNCFDVFDAAIPFGGYKMSGVGREKGIYNLNNYLQVKAVITPLRNPAWL

SEQ ID NO: 1882 - protein, 511 aa, Triticum aestivum
MIARGLLRSNASSQASKFVKYLTSAGGLQGHAESLSDASVRHFSSASSPQTNSTEENGFKGHGMLAPFTAGWQSNDVHPLVIERSEGSYVYDINGNKYLDSLAGLWCTALGGSEPRLVKAATDQLNKLPFYHSFWNRTTKPTLDLADDLLSMFTASKMGKAFFTNSGSEANDSHVKLVWYYNNALGRPNKKKFIARSKAYHGSTLISASLTGLPALHQKFDLPAPFVLHTDCPHYWRFHLPGETEEEFATRLAKNLEDLILKEGPETIAAFIAEPVMGAGGVIPPPKTYFDKVQAVVKKYDILFIVDEVITAFGRLGTMFGSDMYNIKPDLVTLAKALSSAYVPIGATLVSPEIAAVVDSQSNKLGSFAHGFTYSGHPVACAVAIEALKIYRERNIPDHVKQIAPRFQEGTKAFAGSPIVGEIRGVGLILGTEFANNKSRDDPFPAEWGVGAIFGQECQKRGMLVRVAGDSIMMSPPLTMTPGEVDELVSIYGEAMKSTEERVAELKSKKN

SEQ ID NO: 1883 - protein, 178 aa, Saccharomyces cerevisiae
MPAYHSTFPVDPNTDRMVGNFALLPLNTKFRGPAYPSNSDYDIIDECLDLFRANSFFKNFEIKSPADRVLIYGILFINDCLAHLKITTSFNEAVKVLTNVALDNFTLPGTPGFPLNNVYQVPVQDHNSMDLLKTYIQQFRQELAMRLLERVYSSTDSKEYPSKFWLAFTRRRFMNKSL

SEQ ID NO: 1884 - protein, 435 aa, Geobacter sulfurreducens PCA
MKTQIEQAREGIITPQMAAVAAEEHVSPEYVCRMVAEGKVVIPWNHVRAPKAVGIGKGLRTKVNASIGTSSDIVDYEAEVRKARAAQESGADTLMELSVGGDLDRVRREVIAAVDLPVGNVPLYQAFCEAARKYGDPNRLDPEMLFDLIERQCADGMAFMAVHCGINLYTIERLRRQGYRYGGLVSKGGVSMVGWMMANGRENPLYEQFDRVVGILKKYDTVLSLGNGLRAGAIHDSSDRAQIQELLINCELAEMGREMGCQMLVEGPGHVPLDEVEGNIQLQKRMSGGAPYYMLGPISTDVAPGFDHITAAIGAAQSSRFGADLICYITPAEHLALPNEEDVRQGVKAARVAAYIGDMNKYPEKGRERDREMSKARRDLDWQRQFELALYPEDARAIRASRTPEDEATCTMCGDFCASRGAGRLFAGDLRGDKV

SEQ ID NO: 1885 - protein, 348 aa, Saccharomyces cerevisiae
MPTLVNGPRRDSTEGFDTDIITLPRFIIEHQKQFKNATGDFTLVLNALQFAFKFVSHTIRRAELVNLVGLAGASNFTGDQQKKLDVLGDEIFINAMRASGIIKVLVSEEQEDLIVFPTNTGSYAVCCDPIDGSSNLDAGVSVGTIASIFRLLPDSSGTINDVLRCGKEMVAACYAMYGSSTHLVLTLGDGVDGFTLDTNLGEFILTHPNLRIPPQKAIYSINEGNTLYWNETIRTFIEKVKQPQADNNNKPFSARYVGSMVADVHRTFLYGGLFAYPCDKKSPNGKLRLLYEAFPMAFLMEQAGGKAVNDRGERILDLVPSHIHDKSSIWLGSSGEIDKFLDHIGKSQ

SEQ ID NO: 1886 - protein, 301 aa, Nitrosomonas europaea ATCC 19718
MNIEQLNKNYKIGEQVVFAEGEGGLPFIHVRNDKASALISVYAGQVLAYRPQSIQDDLLFLSKRAYYQAGKAIKGGVPICWPWFGPDPEGRGRPAHGFMRNCMWDIVEVSATPEGNTRIVLGSTDTEETQSIWSRSFVLRLEITIGDTLNLELVTRNSGSQACTVTQAFHTYFSVGDIRQTHVSGLENTRYIDKVDDNLEKNQTGSVTIDAEVDRIYQSVGSNLVIHDTARKRRIHITSKGNRTAVVWNPWAKISAEMADLEDDDYLRFICVETTNAATDRVHIQPGSEFRLIANYRIEQD

SEQ ID NO: 1887 - protein, 208 aa, Oryza sativa (indica cultivar-group)
MEGVVVRRVIPSDNSCLFNAVGYVMEHNRNKASELRQVIAAAVASDPAKYSEVFLGKPNEAYCAWILDSEKWGGAIELSILSEYYGREIAAYDIQTTRCDLYGQEKNYTERTMLIYDGLHYDALAMSPFEGAPEEFDQTIFPVDHKWSIGPVEGLALNFVKDEKRKRSYTDTANFTLRCGVCQIGVIGQKEAVEHAQATGHVNFQEYK

SEQ ID NO: 1888 - protein, 135 aa, Triticum aestivum
  misc_feature (119)..(119): Xaa can be any naturally occurring amino acid
  unsure (1)..(135): unsure at all Xaa locations
MAAHHQQQQQPQPQQQSQQQAVGFEDYLPVMAERLGEEGLMEELAAGCRLLMDPASGLITFHSLRRNAPLLGLGGMSDDDLRGMLAEGDFDGDGALSQMEFCVLMVRLSPDLMDQPRRXWLDDAVAQASHFLFTS

SEQ ID NO: 1889 - protein, 293 aa, Guillardia theta
AKFELAGSYVALITPFTDNDEVDYAKIEELVEWHIAEGTAGIVPCGTTGESPTLTEEENKKVIETVVKKANKRCHVVAGAGGNCTKKVVAFTKWCKEIGADCVLSVIPYYNKPTQDGLYGHFKAVADVGIPVMLYNIPGRCGGGGLTSATIAKLYNDCPTICAVKEATGSVDFSSEISSVCGIQIFSGDDSLTVPLMSIGAKGVVSVAANLTPRKVADLCKAMKDGDLKKAQQLHSELYKLCKAMFCETNPIPCKAAGAMMGKWKNNTRLPMTPMKAENEPQLKAALQAAGLL

SEQ ID NO: 1890 - protein, 1073 aa, Escherichia coli
MPKRTDIKSILILGAGPIVIGQACEFDYSGAQACKALREEGYRVINVNSNPATIMTDPEMADATYIEPIHWEVVRKIIEKERPDAVLPTMGGQTALNCALELERQGVLEEFGVTMIGATADAIDKAEDRRRFDVAMKKIGLETARSGIAHTMEEALAVAADVGFPCIIRPSFTMGGSGGGIAYNREEFEEICARGLDLSPTKELLIDESLIGWKEYEMEVVRDKNDNCIIVCSIENFDAMGIHTGDSITVAPAQTLTDKEYQIMRNASMAVLREIGVETGGSNVQFAVNPKNGRLIVIEMNPRVSRSSALASKATGFPIAKVAAKLAVGYTLDELMNDITGGRTPASFEPSIDYVVTKIPRFNFEKFAGANDRLTTQMKSVGEVMAIGRTQQESLQKALRGLEVGATGFDPKVSLDDPEALTKIRRELKDAGADRIWYIADAFRAGLSVDGVFNLTNIDRWFLVQIEELVRLEEKVAEVGITGLNADFLRQLKRKGFADARLAKLAGVREAEIRKLRDQYDLHPVYKRVDTCAAEFATDTAYMYSTYEEECEANPSTDREKIMVLGGGPNRIGQGIEFDYCCVHASLALREDGYETIMVNCNPETVSTDYDTSDRLYFEPVTLEDVLEIVRIEKPKGVIVQYGGQTPLKLARALEAAGVPVIGTSPDAIDRAEDRERFQHAVERLKLKQPANATVTAIEMAVEKAKEIGYPLVVRPSYVLGGRAMEIVYDEADLRRYFQTAVSVSNDAPVLLDHFLDDAVEVDVDAICDGEMVLIGGIMEHIEQAGVHSGDSACSLPAYTLSQEIQDVMRQQVQKLAFELQVRGLMNVQFAVKNNEVYLIEVNPRAARTVPFVSKATGVPLAKVAARVMAGKSLAEQGVTKEVIPPYYSVKEVVLPFNKFPGVDPLLGPEMRSTGEVMGVGRTFAEAFAKAQLGSNSTMKKHGRALLSVREGDKERVVDLAAKLLKQGFELDATHGTAIVLGEAGINPRLVNKVHEGRPHIQDRIKNGEYTYIINTTSGRRAIEDSRVIRRSALQYKVHYDTTLNGGFATAMALNADATEKVISVQEMHAQIK

SEQ ID NO: 1891 - protein, 214 aa, Clostridium perfringens SM101
MIKAVLFDLDGTLINTNDLILKSFKHTFKTILDLEPSEEEITMNYGRPLQEIFKSYDENRIEEMINCYRKINLELHDDECKEFAGVDLMLKTLKSKGIKIGVVTSKKNDMAERGAKLMGIFKYFDTFITSEITTKHKPDGEPVLKACENLGVSPSEALMVGDSPYDILAGKNAGAKTCGVKYTALPLEKLEESKPDFYVDKPLEILDLVEKLNS

SEQ ID NO: 1892 - protein, 371 aa, Rickettsia akari str. Hartford
MSQDYYKILGVSKTASQADLKKAYLKLAKQYHPDTTDDKDAEKKFKEINRAYDVLKDEQKRAAYDRFGHDTFQNQQSRGGGGSHAGFHHDINDIFGDFFSDFMGGGRRKPTSSKARGSDLKYDLTINLEEAFHGIEKNISFSSEVKCDTCHGSGSEKGETVTTCDACGGVGATRIQQGFFTIEQACHKCKGNGQIIKNPCKKCHGMGRCHKQRNLSVNIPAGVENGTRIRHTGEGEAGIRGGNSGDLYVDIAITPHDIYKVDGANLHCKLPISFVNAALGGEIEVPVIEGRKVNLTIPAGTQNGDQLRLRSKGMPKMRSTIRGDMITHIHIEVPKNLSKRQCELLEEFKKESISEKENDGSFFNKMKSLWS

SEQ ID NO: 1893 - protein, 276 aa, Arabidopsis thaliana
MASLSFVSSSHLTLRTPSIALRSTGSSPRTSVSFSVKAQSVALSQDDLKKLAAEKAVEAIKPGMVLGLGTGSTAAFAVDQIGKLLSSGELYDIVGIPTSKRTEEQARSLGIPLVGLDTHPRIDLAIDGADEVDPNLDLVKGRGGALLREKMVEAVADKFIVVADDTKLVTGLGGSGLAMPVEVVQFCWNFNLIRLQDLFKEFGCESKLRVDGDGKPYVTDNSNYIIDLYFKTPLKDGFAAAKEIGKFQGVVEHGLFLGMATSVIIAGKNGVEVMTK

SEQ ID NO: 1894 - protein, 363 aa, Ostreococcus tauri
MPRSGARLRNAWVRVFVVAFAAASCARAEESTETEEPRLIGWLGEVARPPAPSATGDGATNSSIEDALLSSSSESAVKGASEIGAKARGTWTTLSWSPRAFLYQNFLTEDECEHLIALGEKKLERSTVVGSKGKEGDVHSARTSFGTFITRRLTPTLSAVEDRVAEYSGIPWRHQEQLQLLRYEKGQEYGNGEKRIATVLMFLREPEFGGETHFPDATPLPATRSEFLGSRAKLSDCGWNEGRGFSVIPRKGDAILFFSHHINGTSDDAASHASCPTLRGIKYTATKWIHEKEFDTTTFETPMCEDKEDMCDQWANSGECEKNPVFMMGIETVGSCSKSCCARDRSRLSDIQKRFCEPCDEKM

SEQ ID NO: 1895 - protein, 233 aa, Triticum aestivum
  misc_feature (72)..(72): Xaa can be any naturally occurring amino acid
  unsure (1)..(233): unsure at all Xaa locations
AYLGDTIEQVCTKKQAGTGPEFPGYRRPTRPRGILLGNNGYSITLSRASAFIADMQQLRDRKPLAFCGIDAXLGILLRYVKASSAYLGKEEDSIDFDITYYRSFTKGEPNPHSDVLDELQQMALRKYGAMPHWGKNRNFAFEGAIDKYPKASKFFEVKGRYDSDGIFSSEWSDQVLGINGSPVIVEKRCAIEGLCVCSDDSHCAPEEGYYCQPGESVHQRRGSAHSSPPSDGV

SEQ ID NO: 1896 - protein, 915 aa, Oryza sativa (japonica cultivar-group)
MSRQARKEAAAAAQDMLKLDAAQMRKPAASQSRKGAAAPMRKAQGGARAASMVPEQSSSGLAARVPEHRSSRYGAASPPPSSFTDGSCFFNGSAGGFFGNAGQSPSDQNQSEDDYSTPISARDNTYVNVDSGDETPRTEKRIFWTQEEDVRMMSSWLLNSTDSTVGADRKNEQYWTDVEATYNETTPSHRRRNAKQIKDRFHKVNKWTDLFHSAWLKARMIYTSGYNDQMWIEKAHVFYIKDNEKLNLGPFVLMEVWNTVKTEAKWITYNNGLKAARKRIATKGLGKEKEGEDSSPLYVDELDEQPRPMGQKRAKKLQYAQSKEVDHIDLEELDKFSKLQNEQNANRLKVLEIQQKLSSEKIEQTKISHLAAKEQMEAAKVQREARKLEVEARMYETYNRLLVVDTSLMSDEEKVLEKIACYVTVRGEKAMQLLEIGLKASGASGGEHPGGDDEGSGGEFFASGGDGGDEDTVLEEIDPAEVYTLEDFLAEDEIMESFRRKIGDKLKAKIEGSSSGPPRRRQRQSGPRRYIPRPREKGHEDLVANYFSANPIYTDEQFRRRFRMNKPLFLRIVNALSNWDQFFTQRVDATGRDSHSPLQKCTAAIRMLGYGTPADALDEVLKIAASTSLECLGKFAVGIIECFGSEYLRPPTSDELEKILQENEARGFPGMIGSIDCMHWQWKNCPKGWAGMFINGFKGKPTMILEAVASRDLRIWHAFFGNAGSQNDIQVLNKSPLFIHAIKGEAPRVSYTVNGTQYDTGYYLADGIYPEWAAFVKTIRKPQTEKHKLYAQRQEGARKDVECAFGVLQSRFDIVNRPARLWKRNDVVNIMQACVILHNMIVEDEKDLVKIPLDLNENPSATIVLPPEVQTNDNPNPCFVDVLNRNSAIRAASTHRQLKNDLVEHIWQRYGPRGG

SEQ ID NO: 1897 - protein, 397 aa, Candidatus Desulfococcus oleovorans Hxd3
MMSTNIKEQADTVFANTYKRLPLVIERGEGCTLWDADGKAYTDFFAGIAVCGLGHAHPAVAEALYKQAGTLCHVSNLFYTTPQTELAALLVEKSFADRVFFCNSGAEANEAAIKLARKHFHDRGEHDRYTIVTMEKSFHGRTMGALSATGQAKIQKGFEPLLSGFVTVPFNDIDALKKQMSPRICAVMMEPIQGEGGVVCPSPGYLEAVRKLCDESGALLIFDEVQTGMGRTGKLFAHEHFGITPDIMTLAKALGNGLPIGAMLATEAAASAFVPGAHATTFGGTPVICAAALAVLRTMDQEKIVARCETMGTYFKEKLSALVSKHGCVTGVRGMGLLLGMELTGEGGPVVSACMEKGFLINCIQDRVLRFAPPLIVTKQEIDQLIACLDEVLGDLS

SEQ ID NO: 1898 - protein, 1102 aa, Magnaporthe grisea 70-15
MADLFDVFDEQPEAPAVGLDRNSSDTKTKKTKKSKRDKSKDKSKKRKADGHVKNLGAQDNGAEAQPDPQEDVEMANGTQPSTGDAGSEESSSDEHQDIKRRKKEGEADPILTDTFETAQSRQVAAAEGFGTKEEDSLVLSHNIQHQVALPPDLDYVYVPLSEHKPPEEPARKYAFKLDPFQSISVASIERDESVLVSAHTSAGKTVVAEYAIAHCLKRNQRVIYTSPIKALSNQKFRDFQAEFGDVGLMTGDVTINPTASCLVMTTEILRSMLYRGSEITREVGWVVFDEIHYMRDATRGVVWEETIIMLPDKVRYVFLSATIPNAFQFAEWIAKIHRQACHVVYTDFRPTPLQNYVFPAGGDGIYIMVDEKGVFREKKFMEAIGSIAGKNDDDDSMPRQKGKGKNKKAVKNTVPDSKADITKIIKMIMRRAYHPVIVFNFSKRECENLALKVSTLNFNHESEQKLVEDIFRNAIMSLSEEDQGLPQIQHLLPLLKKGIGVHHSGLLPILKETIEILFQENLIKVLFATETFSIGLNMPAKTVVFSQVKKFDGVKERPLTPSEYIQMSGRAGRRGLDDRGIVIMMIDDKLDPETAKGMVCGQQDRLNSAFHLGYNMILNLQRIETVSPQYMLERCFYQFQNASSVPALEKKLIELQQQRDAMVIPDESTVKDYHTVRQQIEAYKKDMEAVIQHPNNCLEFMQPGRLIRIKTPDGVDFDWGVVVNFLPRKPVKFGEEEPPPQESYLMDVALFVSEDSISPPPHASVSKEGHIADGVEPSGSVDHGRLEVVPCLLTCMVAISQIRIFMPKDMDHLGKSQVSHGLEEVQRRFPDGVPILDPIENMGIKDDSFKKLMRKIEVLESRLLSNPLHGSPNLPELWDKYKIKTELTSQIKETKRAINKSYSIAQLDELKSRMRVLRRLNFINENEVVQMKARVACEISSTEGHELVISELLFNGFFNELEPEVCAAILSCFVFDEKMEGTPLKEDLDKLVREIHAQAKTIARISRESKLDVSDEQVVGNLKWQLTETVLAWAKGRPFAEICKMTNAYEGSLVRIMRRLEELLRQMAEAGKVMGSEMLQKKFEKALSLISRDVVSAASLYL

SEQ ID NO: 1899 - protein, 589 aa, Zea mays
  misc_feature (559)..(559): Xaa can be any naturally occurring amino acid
  misc_feature (572)..(572): Xaa can be any naturally occurring amino acid
  unsure (1)..(589): unsure at all Xaa locations
MCGILAVLGCSDCSQARRARILACSRRLKHRGPDWSGLYQHEGNFLAQQRLAIVSPLSGDQPLFNEDRTVVVVANGEIYNHKNVRKQFTGAHSFSTGSDCEVIIPLYEKYGENFVDMLDGVFAFVLYDTRDRTYVAARDAIGVNPLYIGWGSDGSVWMSSEMKALNEDCVRFEIFPPGHLYSSAGGGFRRWYTPHWFQEQVPRTPYQSLVLREAFEKAVIKRLMTDVPFGVLLSGGLDSSLVASVTKRHLVETDAAEKFGTELHSFVVGLEGSPDLKAAREVADYLGTTHHEFHFTVQDGIDAIEEVIYHDETYDVTTIRASTPMFLMARKIKSLGVKMVLSGEGSDELLGGYLYFHFAPNREELHRETCRKVKALHQYDCLRANKATSAWGLEVRVPFLDKEFVDVAMGMDPEWKMYDKNLGRIEKWVLRKAFDDEEHPYLPEHILYRQKEQFSDGVGYNWIDGLKSFTEQQVTDEMMNSAAQMFPYNTPVNKEAYYYRMIFERLFPQDSARETVPWGPSIACSTPAAIEWVEQWKASNDPSGRFISSHDSAATDRTXATSWRWPTAAGTXAANGTVNGNDVAVAIAV

SEQ ID NO: 1900 - protein, 485 aa, Saccharophagus degradans 2-40
MSLTLTNSKLQRQGSVIDGAWLQSSDEFVVENPATGQVVATVANAGAAEAEAAVLAAERAGVQWREFSAKKRSTLLKAWYELVVSNANDLAVLLTTEQGKPLAEAKAEILYGASYIEWFAEQAKRIEGAVIPAPASNQRIVTVKQPVGVVAAITPWNFPMAMLARKIAPALAAGCTVVAKPAKETPLSALAMAYLAQEAGIPPGVINLVTGQDSSAIGGVFTQHPSVKKLTFTGSTAVGKTLLEQSAATIKKCSMELGGNAPFIVFDDADIDAAVAGCIAAKFRNAGQTCVCVNRIFVHDKVKAAFTKKLVEAVAKLKVGDGIEEGVAIGPLINAAAFKKVSELVIDACNKGAKAIVAEGHTHLNGALFYPPTVVTEATTQMDVFNEEIFGPVAVVYSFSSEEEAIALANNTPFGLAGYFYSRDIGRVWRVASALEVGMVGVNDTAISNEMAPFGGVKESGFGREGSQMGLDDYLETKYMLMGGL

SEQ ID NO: 1901 - protein, 652 aa, Burkholderia sp. 383
MSLLNFPSDRPIDLACLGRVAVDLYAQQYGSRLEDARSFQMYLGGSSGNVAFGVARLGLKTAMISRVGDEQMGRFLRETLEREGCDTSQLQTDRERLTALVLLGLKDRDTFPLLFVRENCADMAVRADEISEDFIAGCRALAITGTHLSTPGTREASLTALGYARRHGVVRILDIDYRPVLWGLTSRGAGENRYVPDAQVTRQLQQVLGEFDLLVGTEEEFLIAGGVPHDVIGSLQAVRKITNATLVVKRGALGCCVIEGDIPARIDDAPTFLGERVEVLNVLGAGDAFLSGLLSGLLRGRDWAESTRIANACGAIVVSRHACSAAMPTPAELAHWFDGSRNPVVDADHTLAHLHRVTVPRREWDDLCVMAFDHRSQFYELAVQAGADEARIKTLKRLLVRAVEQVERDRHIEGHVGVLIDGGGYGSDALASATGRGWWVGRPVELPGSRPLRFDETRSVGSSLTHWPTEQVVKCLVHYHPDDQVDLRVEQEQRVLELWEATRASGNELLLEMIPPRAVTPAGTEDDAVLRTIARFYNLGVMPEWWKLTPLSADGWTRLAALIAERDPHCRGAVILGLNQPLQYLVDSFRSATNPIVKGFMVGRTLWADASLNWFAGRIDDQALIDEVAGNFAQLVDAWLGRRAAAARAAAA

SEQ ID NO: 1902 - protein, 665 aa, Streptococcus agalactiae 2603V/R
MTEKKSFYITTPIYYPSGKLHIGSAYTTIACDVLARYKRMMGFDVQYLTGLDEHGQKIQQKAEEAGITPQEYVDGMAESVKTLWELLDISYDKFIRTTDTYHEEAVAKIFEQLLAQGDIYLGEYTGWYSVSDEEFFTESQLAEVYRDENGNMIGGVAPSGHEVEKVSEESYFFRMSKYADRLKAYYAEHPEFIQPDGRMNEMLKNFIEPGLEDLAVSRTTYTWGVQVPSNPKHVIYVWIDALMNYISALGYGWSDDLSQYHKFWPADIHMIGKDILRFHSIYWPIMLMALDLPLPKRLVAHGWFVMQDGKMSKSKGNVVYPEMLVERFGLDPLRYYLMRSLPVGSDGTFTPEDYVGRINYELANDLGNLLNRTIAMVNKYFDGEVPRFAVATDFDADLASVATDSIENYHKQMEAVDFPRALEAVWNLISRTNKYIDETAPWVLAKDETDRDKLAAVMSHLVASLRVVAHLIQPFMMETSDAIMEQLGLGATFDLEKLTFADLPEGVRVVAKGSPIFPRLDMEDEITYIKEQMNAGKAPVEKEWVPEEVELTSSKGQIKFEDFDAVEIRVAEVIEVEKVEGSDKLLRFRLDAGDEGHRQILSGIAKFYPNEQELVGKKLQIVANLKPRKMMKKYVSQGMILSAEHDGKLTVLTVDSAVANGSIIG

SEQ ID NO: 1903 - protein, 397 aa, Rickettsia rickettsii
MLSKLNKPALFALIFYPIFIISLVVKYSFDYGIGLTEVIFIIASYYINNITVGIGLHRLWSHNAYKINKYAEFVLIMLSAGTLQGPALSWASNHYKHHRYTDQDQDPHTPLKFDNKFLGFMWSHIGWMLVGSGSYKSIDRITWAKHGKNNLLKWQLKYYWQIAAFMNIVVPLFIGYLVGGTMQSAYAGFLFMGLGRFLQQQATFCVNSLCHFAGSKKYYKGTAGDIWWMALFLLGENWHNYHHAFPSDYRNGAKWYHLDVHKWIIFLMSKIGLASELERTTKVRIQAKMQETLSYLSEKQKQKLTLMQTKIDHLLENLCLKIKELEESSITIKEQFKKSFVEIQESLKNLAEQVSAAKQITEKSSEKLLKIVNKKIIDAEQSIYKLYNQLNTLKVSN

SEQ ID NO: 1904 - protein, 1106 aa, Candida albicans SC5314
MRFFFSSSLVMRCMLNRTRTTKRKKKFIVKFNPLTIKHYNQLQKMDDLFDVFDEAPQAAPPKIEEIKDEVKPETTDNQTRSTKKRQFDNNNKTTTNSNNSSSSNNKKHKQAEDIKPVVFDSVEIETSREVKPSEGLSNSATVDADNKLKLKHQIRHQVAIPPSYPYVPIGEHKRKHEARTYPFTLDPFQDTAISCIDRNESVLVSAHTSAGKTVVAEYAIAQSLRDKQRVIYTSPIKALSNQKFRELQAIFGDVGLMTGDVTINPDAGCLVMTTEILRSMLYRGSEVMREVAWVVFDEVHYMRDKSRGVVWEETIILLPDKVHYVFLSATIPNAMEFAEWIVKIHNQPCHVVYTDFRPTPLQHYLFPAGGDGIHLVVDEKGTFREENFQKAMATISDNSGDDPASSDSGRGNKKGKTNKGRNHQDGKGDIYKIVKMIYMKKYNPVIVFSFSKRDCESLALKMSKLDFNTDEERNSLTQIFYNAIELLPEADRELPQIKNILPLLKRGIGIHHSGLLPILKEIIEILFQEGFLKVLFATETFSIGLNMPAKTVVFTSVRKWDGVGFRWVSGGEYIQMSGRAGRRGLDDRGIVIMMIDEKMEPQVAKGMVKGQADRLDSAFHLGYNMILNLMRVEGISPEFMLEHSFFQFQKASSVPILEGKLAQCKQEFADITIEDEPIIKDYYDLKQQLLKYNEDVRKVITHPGNILPFLQDGRVIKVKIGDLDYGWGMVTTFTKRNRRHQEEFAPHDAYVVEVFITTMFIDSPVNLIKKFNPMLPEGIRPAKSGEQTRAEFISITLSSIEKISTVRLRVPDDYKSSTAKRTLVKTLKDLPKRLPDGIPLIDPVQSMKITDDDFKKLLQKIDILDSKIVSNPLNNSARLDDLYAKYTAKVDLNNQIKKLEEQIFQAKSIIQLDQLSNMKRVLKKLEFTGSEEVVELKGRVAAELSTGDELMITELLFSGFFNELTPQQICGLLSAFIFQERAKELPKLKPELAEPAKVIHETANKIAKISKQSGLEIVEKDYIEQFNLALVEVVFVWSNGASFSSICKMTDIYEGSIIRALRREIELIKQLVDASKIIGNQELVDKFEKCIELINRDFVQVSSLYM

SEQ ID NO: 1905 - protein, 417 aa, Robiginitalea biformata HTCC2501
MGTFTENYTKMKPYNASDAIQDLQYFGEFGGVNPSISDSSTYTFLSAKTMFDTFEGNTEGCYLYSRHSSPSNLYLGEALAALEGTESANVTASGMGAITAVILQLCSSGDHLVSSRTIYGGTYAFLKNFLKRFDIAVSFVDITDPEAVAAAITDKTRMIYCESVSNPLLEVADIPTLAKLANDRGIRLVVDNTFSPLSLSPARLGAHIVVHSLTKFINGSSDAVAGAVCADSDFCLALKDVNDGAGMLLGSTLDSLRAASILKNLRTLHLRIRQHSSNAAYLAGKFREAGLRVVYPGLESHPGHQLMQRQMNPDFGFGGILTVDAGSAEKADALMEMMQRENLGYLAVSLGFYKTLFSAPGSSTSSEIPEEEQQEMGLGSGLIRFSIGLDNNIERTCERMLRCMQQLGVTSESQPAG

SEQ ID NO: 1906 - protein, 240 aa, Brassica napus
  misc_feature (201)..(201): Xaa can be any naturally occurring amino acid
  unsure (1)..(240): unsure at all Xaa locations
MSEEVEYRCFIGGLAWSTSDRGLRDAFEKYGHLLEAKVVLDKFSGRSRGFGFITFDEKKAMDEAIAAMNGMDLDGRTITVDKAQPLQGGSGRDHEGDRSRDRGYDRDRSRPSGGRGSGGGDCFKCGKPGHFARECPDESGRGGGGRYSSRDDRYGAKDDRYGAKDDRYSSKDDRYSAKDDRYGAKEDRYGRDGGRDRYGPXDRNGDRSGGRSRDGGSRGGPGGERHSRAPYDRPRAGGFH

SEQ ID NO: 1907 - protein, 472 aa, Neisseria meningitidis FAM18
MSIKNAVKLIEESEARFVDLRFTDTKGKQHHFTVPARIVLEDPEEWFENGQAFDGSSIGGWKGIQASDMQLRPDASTAFVDPFYDDVTVVITCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDCGQDLRSAMVNILEGLGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFKEEDVRRIRMAPHPLEFEMYYSL

SEQ ID NO: 1908 - protein, 269 aa, Neisseria meningitidis FAM18
MTALPRYSVFGNPVAHSKSPQIHQQFALQEGVDIEYERICADIGGFAQAVSTFFETGGCGANVTVPFKQEAFHLADEHSERALAAGAVNTLIPLKNGKLRGDNTDGIGLTNDITQVKNIAIEGKTILLLGAGGAVRGVIPVLKEHRPARIVIANRTRAKAEELAQLFGIEAVPMADVNGGFDIIINGTSGGLNGQIPDIPPDIFQNCALAYDMVYGCAAKPFLDFARQSGAKKTADGLGMLVGQAAASYALWRGFTPDIRPVIEYMKAM

SEQ ID NO: 1909 - protein, 375 aa, Saccharomyces cerevisiae
MGITLYTNIGLVHKRVYKHDRKTDVDRKNHGGTIDISYPTTEVVGHGSFGVVVTTVIIETNQKVAIKKVLQDRRYKNRELETMKMLCHPNTVGLQYYFYEKDEEDEVYLNLVLDYMPQSLYQRLRHFVNLKMQMPRVEIKFYAYQLFKALNYLHNVPRICHRDIKPQNLLVDPTTFSFKICDFGSAKCLKPDQPNVSYICSRYYRAPELMFGATNYSNQVDVWSSACVIAELLLGKPLFSGESGIDQLVEIIKIMGIPTKDEISGMNPNYEDHVFPNIKPITLAEIFKAEDPDTLDLLTKTLKYHPCERLVPLQCLLSSYFDETKRCDTDTYVKAQNLRIFDFDVETELGHVPLVERPAIEERLKHFVSAPSSSL

SEQ ID NO: 1910 - protein, 141 aa, Aspergillus nidulans FGSC A4
MARTKQTARKSSLCKSTGGKAPRKQLASKAARKAAPSTGGVKKPHRYKPGTVALREIRRYQKSTELLIRKLPFQRLVREIAQDFKSDLRFQSSAIGALQESVEAYLVSLFEDTNLCAIHAKRVTIQSKDIQLARRLRGERS

SEQ ID NO: 1911 - protein, 402 aa, Glycine max
  misc_feature (219)..(219): Xaa can be any naturally occurring amino acid
  misc_feature (221)..(222): Xaa can be any naturally occurring amino acid
  misc_feature (283)..(283): Xaa can be any naturally occurring amino acid
  unsure (1)..(402): unsure at all Xaa locations
MINGFCSPFVNLGCEYSMGSIRGIKKRKKADNKDGPDASATSFDWWHHFSLRISGPLARSKNIEKFESVFKISRKTFNYICSLVEEDMLARASNFVDLNGNRLSLNDQVAVALRRLSSGESLSTIGESFRMNQSTVSQVTWKFVETMEERGLHHLSWASTEMEMEEIKSKFENIRGLSNCCGAVDSTHIMMTLPSVDALNSVWLDREKNCSMVLQAIVXPXXRFRDIVTGWPGSMSDEQVLRSSSFFKLAEEGKRLNGGKKTLPDGTLFREYIIGDTGFPLFXWLLTPYEGKGFSNVQVEFNKRVVETQMVAKKALARLKDMWKIIQGVMWKPDKPKLPRIILVCCILHNIVIDMEDEVLIDMPSCPQHDSRYQDQTSEFADNTAPLMREKLSLYLSGVLPT

SEQ ID NO: 1912 - protein, 93 aa, Aspergillus nidulans FGSC A4
MSGRGAKRHRKILRDNIQGITKPAIRRLARRGGVKRISAMIYEETRGVLKTFLEGVIRDAVTYTEHAKRKTVTSLDVVYALKRQGRTLYGFGG

SEQ ID NO: 1913 - protein, 373 aa, Triticum aestivum
TSLYKKAGWYRSGIPGISSTHASASFGTDENHSIKSGSDNILVDFYHKLREESMAMIFRYNKDIKEAQKSSAHSDGNKKETAIEREIQEIWEKLRDSSLAEGFRIEEQPSRDESISGLLNSTKEEHIKDFEQHYHLAEKIALAQHDMSLAVELYKHSVSTLHTLGLASKEEQCDYVAAWYSMFLSCAQELQHGAVLWQESCHPKVHDLVISEGANWFVALGEIYRVAHLLHLSLQYFKPWVLADPGMFSKMLACWDSCINAWTSGLETALKTVVDSNHLAAPAGKALLESIISINELEVANFQHFLANNELTCRLTLLPTGLLQGGEVVVWNGNHYFVKVANFWANRVSSDPPRLSLVHISSMDSTSNSCLPC

SEQ ID NO: 1914 - protein, 110 aa, Shewanella sp. MR-4
METVEKIKQQIAENPIIVYMKGSPKLPSCGFSSQVAQIMINCGEQFAFVDILQHPDIRAELPKYANWPTFPQLWIEGELIGGCDIVVDMYQKGELQPLIKATADKYKTAE

SEQ ID NO: 1915 - protein, 1034 aa, Sinorhizobium meliloti 1021
  misc_feature (205)..(205): Xaa can be any naturally occurring amino acid
  unsure (1)..(1034): unsure at all Xaa locations
MEAVPMNVDLSRRSFLKLAGAGAAATSLGAMGFGEAEAAVVAHVRPHKLTTTTETRNTCPYCSVACGVIIYSKGDLRKGEAADIIHIEGDADHPTNRGTLCPKGAALKDFVKSPTRLQYPMHRKPGSDKFERISWEDAFDRIARLMKDDRDANFIAANAAGVPVNRWTTVGMLAASATTNETAWATFKFAKALGIVGFDNQARVXHGPTVSSLGPTFGRGAMTNSWTDIKNTDLVVVMGGNAAEAHPCGFKWVTEAKATRGAKLIVVDPRYTRTASVSDYYAPIRQGTDIAFLNGVMKYCIDNDKVQWDYMKAFTNASYLVKDGFGYQDGLFTGYDAEKRDYDKSTWDYVLGDDGFVVTDPALQHPRCVWNLLKAHLAPYTPEMVERICGTPKDKFLKVAEMISECSSPTKTMTSMYALGWTQHSSGSQNIRAMAMLQLILGNIGVRGGGMNALRGHSNIQGLTDLGLMSHLLTGYLTMPTEKDVDFTTYMSTRQFKPLRPGQTSYWQNYRKFMVSFQKAMWGDAARIDNDWAFNYLSKLDVPAYDVLRVFELMYAGKVNGYICQGFNPLLAFPNRDKNTKALSNLKWLVTMDPLDTETARFWENHGDFNPVDTASIQTEVFQLPTTCFAEEEGSLTNSGRWLQWHWAGGTPPGEAKHDTYIVAQIFLRMKEMYRNEGGAFPDPILNLSWDYADPNEPTPEELAKEINGRALTDLMDPANPMKVQVAAGKQILNFSQLRDDGSTMCGCWIYSGNFNEQGNNMARRDNHDPDDTGAYLGWSFAWPLNRRTLYNRASADLQGKPWDPSRKLLEWDGTKWAGYDVPDIAPTAKPDEIGPFIMNQEGTARLFSRGLMRDGPFPAHMEPFESPVANVFNPKMRGNPVSRVFQTDVAQMGLSDEFPYAATSYRLTEHFHYWTKHNRVNSALQPEFFVEISEELAEEKNIENGGWVRVWSKRGSVKAKAVVTKRIRPLMCDGKPVHVVGIPLHWGFTGSAKKGLGPNSLAPFVGDANIETPEYKAFLVNIEPSTAPEEATV

SEQ ID NO: 1916 - protein, 412 aa, Shewanella sp. MR-4
MKRLAIPLQGAQMLFVAFGALVLMPLLTGLDTSVALFTAGIGTLLFQLITKRQVPIFLASSFAFIAPILYGVQTWGIPSTMGGIIAAGLVYILLGALVKVRGTDFIHRLLPPVVVGPVIIIIGLGLAPVAVNMALGKSGDGSLTLVPTNTALIISLASLCTTIAVAIFAKGLLKVMPILAGIVVGYGLSLAFGIVDFAVVTAASWIAIPKFVAPEFNWHAIAFMIPVAIAPAVEHIGDILAISNVTGKDFMKKPGLHRTLTGDGVATIAAAAFGGPPNTTYSEVTGAVTLTRNFDPRIMTWTAITAITLAFVGKLGALMQTIPVPVMGGIMCLLFGSIAAVGLNTLIRNHVDLSEPRNLSIVGVTLVFGIGGMAFGIGSFSLTGISLCGIVAITMNLLLPASKHHERDAASH

SEQ ID NO: 1917 - protein, 646 aa, Oryza sativa
  misc_feature (139)..(139): Xaa can be any naturally occurring amino acid
  unsure (1)..(646): unsure at all Xaa locations
MSMACYYLAAAAAGLALLLLHAPLTDAQTLVPLCGDSGNYTEHGTYHANIQYLATSLPSYASSSPSLFASGSSGTVPDAIYALALCRGDTNSSSCATCVAAAIQSAQELCPLVKTVIVYDDTCILRFANDAFPISPTSXNSQGMVVAWKAQNVSAAVAPAFEAAVVRLINTTADYAATDSVRRFGTGEEAFDETTFPKIYSLAQCTPDMAATACRSCLEDIVGRMVSGNLIGRMGGRVLGVRCNLWFEVYPFFSGRSLLQLPGPSPSPAPPVTAAGERSKNKRSAILAISMPTIALVLATIAAWFCSTSWRRRRLARKTLRPKSSEDEMQSFASLVLDLQTLRTATDNFSEHKRLGEGGFGVVYKGDLPEGQEIAVKRLAQTSRQGIEELKTELLLVAKLNHNNLVRLIGVCLEENEKILAYEYMPNRSLDTILFDAERIKELDWGQRFKIINGIARGLQYLHEDSQLKIVHRDLKASNVLLDSAYNPKISDFGLAKIFERDQSQVITHRIAGTYGYMSPEYAMRGQYSMKLDVYSFGVLVLEIITGRRNFGSYGSDHVVDLIYVTWEHWTSDKAIELIDPSLGNHYPVDKVLKCIHIGLLCVQPKPADRPLMSAVNAMLSSTGTVRLPCLSRPSFWVQEIGATAS

SEQ ID NO: 1918 - protein, 183 aa, Anthoceros formosae
MFSMVNGFRNYSQQAIQASRYIGQGFIVTLDHMNRLPMTIQYPYEKLVPSERFRGRIHFEFDKCIACEVCVRVCPINLPVVDWKFKKDIKKKQLKSYSIDFGVCIFCGNCVEYCPTNCLSMTEEYELSTYDRHELNYDQIALGRLPISIIEDRTIESISSFDFSSKKIMEEHSKSRTVTKFLD

SEQ ID NO: 1919 - protein, 466 aa, Robiginitalea biformata HTCC2501
MKSYDVAIIGSGPGGYVAAIRCAQLGMKTALIEKYDTLGGTCLNVGCIPSKALLDSSHHYHDAITHFEKHGIDIPGDVKVNLKQMIARKQSVVEENTKGIEFLMDKNKVDVYHGLGSFKDATHIEIAGKEKTEIEAKHSIIATGSKPASLPFIELDKERIITSTEALKLQEVPKHLIIIGGGVIGLELGQVYNRLGAQVSVVEYMDRIIPGMDGALSRELTKVLKKQKVKFYLSHKVTGVSRKGEKITVEAEDKKGKSVSLEGDYCLVSVGRKPYTDGLNAEAAGVKLNDRGQVEVDEHLRTSAGNIYAIGDVVRGAMLAHKAEEEGVMVAEILAGQKPHIDYNLIPGVVYTWPEVAAVGKTEEELKEAGVAYKSGQFPMRALGRSRASMDTDGFVKILADKETDEVLGVHMIGARVADLIAEAVVAMEYRASAEDIARMSHAHPTYAEAVKEAALAATDNRPLHS

SEQ ID NO: 1920 - protein, 308 aa, Bacteroides thetaiotaomicron VPI-5482
MRKVIGIGETILDIIFRGNQPSAAVPGGSVFNGIVSLGRMGIKVGFISETGNDRVGNIILQFMRENNIPTDHVNVFPDGKSPVSLAFLNEQSDAEYIFYKDYPKQRLDVLYPKLEEDDIVMVGSYYALNPVLREKILELLDQAREKKAIIYYDPNFRSSHKNEAMKLAPTIIENLEYADIVRGSLEDFFYMYGLQDVDKIYKDKIKFYCPRFICTAGGDKVSLRTNLVSKEYPIEPLEAVSTIGAGDNFNAGLIYGLLKYDVRYRDLNNLNEEVWDKVVQCGKDFAAEVCRSFSNSVSVEFAGQYASK

SEQ ID NO: 1921 - protein, 331 aa, Salmonella enterica subsp. enterica serovar Typhi str. CT18
MTIKVGINGFGRIGRIVFRAAQKRSDIEIVAINDLLDAEYMAYMLKYDSTHGRFDGTVEVKDGHLIVNGKKIRVTAERDPANLKWDEVGVDVVAEATGIFLTDETARKHITAGAKKVVLTGPSKDNTPMFVKGANFDKYEGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYEQIKAAVKAAAEGEMKGVLGYTEDDVVSTDFNGEVCTSVFDAKAGIALNDNFVKLVSWYDNETGYSNKVLDLIAHISK

SEQ ID NO: 1922 - protein, 236 aa, Oryza sativa
  misc_feature (37)..(37): Xaa can be any naturally occurring amino acid
  unsure (1)..(236): unsure at all Xaa locations
MGMGTFTTDESDKHEESYLSLGLTVSQSKKNNTEYPXVLLLLAAYLDRSVQKNEDLLDSNKIKDSSTIFHGHRAPDLSIKLYAERIFKYSECSPSCFVLALIYMERYLQQPHVYMTSLSVHRLLITSVVVAAKFTDDAFFNNAFYARVGGISTVEMNRLELDLLFNLDFRLKVDLETFGSYCLQLEKETMVLVIDRPIQQVHGVNSTKDLSRNSSIDESCKSELMRYSSQALQGCS

SEQ ID NO: 1923 - protein, 201 aa, Bacteroides thetaiotaomicron VPI-5482
MIDSIKQLLQQEAQAVLNIPVTDAYEKAVQLIVEQIHQKKGKLVTSGMGKAGQIAMNIATTFCSTGIPSVFLHPSEAQHGDLGILQKNDLLLLISNSGKTREIVELTRLAHNLDPELKFIVITGNPDSPLANESNVCLSTGKPAEVCTLGMTPTTSTTAMTVIGDILVVQTMKKTGFTIEEYSKRHHGGYLGEKSRSLCEK

SEQ ID NO: 1924 - protein, 224 aa, Triticum aestivum
  misc_feature (61)..(61): Xaa can be any naturally occurring amino acid
  misc_feature (175)..(175): Xaa can be any naturally occurring amino acid
  misc_feature (193)..(193): Xaa can be any naturally occurring amino acid
  unsure (1)..(224): unsure at all Xaa locations
MAAAATAAAATGTLLPHALLNHRSPPPPQLLALSSSFRRLSLSTSHRRTTHLVAHSDAGAXSPEPVSEPAPEGEPVAASADSEEGEAEGAVALAEEEEEPAPRPKPIKFGEIIGILNKQFIEEAEKVKVLPDLKPGDIIELRMQRPHKRRLSLFKGIIIAKHKSGVHTTIRVRRXILPVFGVEITFPIYSPRXIREIKVIRHKKVRRAKLYYLKYKLPRFSTFK

SEQ ID NO: 1925 - protein, 293 aa, Robiginitalea biformata HTCC2501
MKAIEEPLKTAEMPEFKKMGYVEEWAGVRTRVYQYEIVEPRGCVVLVHGFGEYAGRYEPGVVPNLLQAGWAVLTFDLVGHGHSGGKRGHCQGYGQLIGQVSAAYEKAGQLYPGQPRVLYGHSLGGNLVLNAVLRGAVSPSGVVASSPYLRLAFQPPAWKLVVGKILLRLAPSVTLPAGLDPSGISSQPEEVAAYKEDPLIHDRVSPNYSLPVIAAGEWVLEHASDWNIPLLIAHGGDDPIIDPEGSRILNRRVPGSKLLVLDGNRHELHHDRGRAAFFKAVSDWLEALAVPPQ

SEQ ID NO: 1926 - protein, 386 aa, Oryza sativa (japonica cultivar-group)
MDSSSGGAGGGGGAQIKGMGTHGGRYVLYNVYGNFFEVSSKYAPPIRPIGRGAYGIVCAAVNSENGEEVAIKKIGNAFDNHIDAKRTLREIKLLRHMDHENSDGDFNTGSQIIAIKDIIRPPRRDNFNDVYIVSELMDTDLHQIIRSNQPLTDDHCQYFLYQLLRGLKYVHSANVLHRDLKPSNLFLNANCDLKIADFGLARTTTETDLMTEYVVTRWYRAPELLLNCSQYTAAIDVWSVGCILGEIVTRQPLFPGRDYIQQLKLITELIGSPDDSSLGFLRSDNARRYMKQLPQYPRQDFRLRFRNMSAGAVDLLEKMLVFDPSRRITVDEALHHPYLASLHDINEEPTCPAPFSFDFEQPSFTEEHIKELIWRESLAFNPDPPY

SEQ ID NO: 1927 - protein, 324 aa, Neisseria meningitidis FAM18
MAENGKYLDWAREVLHTEEEGLREIATELDENFVLAADALLHCKGRVVITGMGKSGHIGRKMAATMASTGTPAFFVHPAEAAHGDLGMIVDNDVVVAISNSGESDEIAAIIPALKRKDITLVCITARPDSTMARHADIHITASVSKEACPLGLAPTTSTTAVMALGDALAVVLLRARAFTPDDFALSHPAGSLGKRLLLRVADIMHKGGGLPAVRLGTPLKEAIVSMSEKGLGMLAVTDGQGRLKGVFTDGDLRRLFQECDNFTGLSIDEVMHTHPKTISAERLATEALKVMQANHVNGLLVTDADGVLIGALNMHDLLAARIV

SEQ ID NO: 1928 - protein, 633 aa, Bacillus cereus ATCC 14579
MCGFVGCLCENPREFSETEKHQFENMNTMIFHRGPDDEGYFRDEHVQFGFRRLSIIDLEAGHQPLTYENDRYVIIFNGEIYNYVELREMLLEKGATFATQSDTEVIIALYAHMKEKCVDYLRGMFAFMIWDREEKKLFGARDHFGIKPLYIAQQGDTTFFASEKKSIMHVMEDKGVNPTSLQHYFTYQYGPEPETLTIDVNKIEPGHYFVKEIGKEMEIHRYWKPYFNASSATKEEHIQAIRDVLYDSVKVHMRSDVPVGSFLSGGIDSSIIASIAREMNPNLLTFSVGFEQRGYSEVDVAKETAEKLGVKNHNVFISAKEFMDEFPKNHWHMDDPLADPAAVPLYFVAKEARKHVTVVLSGEGADELFGGYNIYREPNSLKMFSYIPSPGKSVLKALSGALKEGFKGKSFLERGCTPIEERYYGNAKIFREEEKAELMKYYNESVNYMDITKPLYNEIKDYDDVSKMQYIDMFTWLRGDILLKADKMTMANSLELRVPFLDKEVFDVASKIPTEFKIANGTTKAILREAARGIVPDHVLDRKKLGFPVPIRHWLKDEMHDWAINIINESKTEHLIDKQYVLNLLEAHCADKGDYSRKIWTVLAFMVWHQIYVEHKYDTNKFHEETKRAYSLV

SEQ ID NO: 1929 - protein, 489 aa, Arabidopsis thaliana
MAAVTQFLSQPSSIRGTLNQYQLNQTSLSRIPFLSLKSTLKPLKRLSVKAAVSQNSTKTLTKESASSFDHCFKKSSDGFLYCEGTKVQDIMETVEKRPFYLYSKPQITRNLEAYKEALEGVRSVIGYAIKANNNLKILEHLRSLGCGAVLVSGNELRLALLAGFDPTKCIFNGNGKSLEDLVLAAQEGVFVNVDSEFDLNNIVEASRISGKQVNVLLRINPDVDPQVHPYVATGNKNSKFGIRNEKLQWFLDEVKAHPKELKLVGAHCHLGSTITKVDIFRDAAVLMIEYIDEIRRQGFEVSYLNIGGGLGIDYYHAGAVLPTPMDLINTVRELVLSRDLNLIIEPGRSLIANTCCFVNHVTGVKTNGTKNFIVIDGSMAELIRPSLYDAYQHIELVSPTPPEAEVTKFDVVGPVCESADFLGKDRELPTPPQGAGLVVHDAGAYCMSMASTYNLKMRPPEYWVEEDGSITKIRHAETFDDHLRFFEGL

SEQ ID NO: 1930 - protein, 1533 aa, Magnaporthe grisea 70-15
MYPGSSQSRPYQVPPPPPMSPPLSQMHQQMSFVPPPPPPLNRYQTTPNLGASAPPPPPPGPPPASALNPQAPWNGAWGGVPAPRQAYDNRSGMYAQAPIQQYNPQAHAATAPGLNIPPPPLQTDAPMSDTYNPGQDPMFDGFMPDLSFDLEQETMGSSQTWQTTSSSSTNTASVNDNVQSNAPTEERTRRNNSASITGTQSSSNVPGIPSDITASWSLDKVIAWLQMNSFSRDWQETFKSLNIHGAQFLELGSGHFGRGNFGMMHQQVYPKLAKVCTASGTGWDQPREREEGKRMRRLIRGLVHARAVPDSARVPSSHGRQGSINSRGNDKGTHDGSDSPNTPIMKTPSSQSRSTTIPTFPDGSSFSNHRGVLKNIDIDRHSSPKLNGDSPAASPNPVMASSTPKSSTLSVSPHSSRFGNNVRNSTDSVKAIYGSGIPADAQKMMSNSNLDELINGRGARQSPSDLGDNSAGTDSPVSARDTKLPFRQRMQAKDIDGNLSSPNGEGSLSPQMYRNGLGLDDYLRFKKPGGSIYLMATADGWNYRVVDVTDVETVLDLRSEISRGLGIPDEDGVEFYLTELGKSDHSQPLDDNQLMNHNKSRADAEGTLKLFVKPPPMSQQSTWSAGDTGQRHRFGTSSSMSRQQNTLKDDQSEEARLRAQREYKAEIDRKGREYLAIRKAKLESNNNGLSSSTEGIGIVGKPVDFDTPRHSPYEDKNTDRMFPTRNAPAPPVAPSATLNRVNSLMTGQRRVQGSMDGYPSQRVPPGVGTTTSPKEMSEDRRRQPMSGSQPMGGITSALVDMGRNLGGVALPNRGVSANNVPSKPSPPYRVATAPVSGRDFVSPDNRAAFPRSQTAGDLSPISQMPANFAAYQEPNPSPRGFGAAPVSSAAHKRAPSGPDIDFTEPEVSFDRPAPSTAQNEAQSDDDSGDDSDDGLFVIPIAARKASMKKAKSRASVTFDASDSGDGKRPALTVNTARDRKSVSFNSPQSARTGDDDDDSGRQRRTPKSDMWDSEDGKLGRRKSFKMDVWANRPPAEALINNLEDFFPGMDVDQPVLEEGDQEQNIDGSPVAPSPIAEVDETQSPGHLQINATPLNSLPPSRVQSMYNESDTLGSDESTLKALERPPSFQSLAQRSVRRSGGLGRMKSIREKARGAHEAHKRYTQTSMAAPQGLSRSGGTPATETQPTQNNSSALLRRKSTKMFNANIVQIRPNRDSMLVPDIPQDSISSSSRGAPKHPTTFRWFKGQLIGKGTYGRVYLGMNATTGEFLAVKEVEVNPRAAAGDKKRMKELVAALDQEIETMQHLDHVNIVQYLGCERKETSISIFLEYISGGSIGSCLRKNGKFEESVVQSLTRQTLSGLAYLHREGILHRDLKADNILLDVDGTAKISDFGISKKTDNIYGNDKSNSMQGSVFWMAPEVIRSQGEGYSAKVDIWSLGCVVLEMFAGRRPWAKEEAVGAIYKIANGEIPPIPEDVQDTISPIAVAFMMDCFTVDSHDRPTANKLLSQHPFCELDPNYNFLDSELYAKIRGTY

SEQ ID NO: 1931 - protein, 327 aa, Oceanobacillus iheyensis HTE831
MPVMSYIQAITTAMKEEMRRDKDVFVLGEDVGKKGGVFKATDGLYEEFGEDRVLDTPLAESAIAGVAIGAAMYGKRPIAEMQFADFIMPAVNQIISEAAKIRYRSNNDWSAPLTVRAPYGGGVHGALYHSQSVEAVFANQPGLKIVMPSTPYDAKGLLKAAIRDNDPVLFFEHKRAYRLLKEEVPEDDYVLPIGKADVKREGEDITVITYGLCVHFALQAAEKLAEEGIDVHILDLRTVYPLDKEAIREAASKTGKVLLITEDNKEGSIIGEVAAIISESCLFDLDAPIQRLAGPDIPAMPYAPTMEKYFMVNPDKVEKAMRELAEY

SEQ ID NO: 1932 - protein, 442 aa, Guillardia theta
EREKWRTKRNKRGQLEGGREEEIEGRETSSIMPCATHRGCLWSCRSSWSCFLVSRSLLVVAVVALASTAFALEDGSPSKPKKALKSQTPVNYFANFLKPSKSEVAVDFGAFNIPGKAAWSIKAGSYFGLWYFFNIFYNVANKKALNALNLPWLQSLACVGVGIPYIALIWALGVRDTPKIDNKLLPSIIQQSSLHAAGNVGGNVAFGAGALGFAHVLKSCEPAFTAIFSGLINGKWQHPFVYATLIPIMGGVAYASASEVNFNMLQFVSAMVSNVAFSLRAVLGKKTMSDRSIREVAKLDGPNTFSVLQIGATLLTIPFVVAVEGWRTLAPWTHPSWKAAIGKLDHAGAMITEGYLWKQLILSGLMFQLYYESAFLALDAVSPVTHSIGNNIKRVVIVITSVIIFGQKMSTQSMIGSSIAIAGVFLYAQVSEMYSNIANRAK

SEQ ID NO: 1933 - protein, 473 aa, Oceanobacillus iheyensis HTE831
MATEYDLVILGGGTGGYVAAIRASQLKMKVAIVEKAELGGTCLHRGCIPSKALLRSAEVYQQTTRADEFGIQVAKPVLDFSKVQQRKQKIIDQLHQGVQGLMKKGKIDVYQGFGRILGPSIFSPMPGTISVEYSDGKENDMLLPKNVLIATGSRPNQLPGFEFDHNYILSSDDALALETLPDSIVIIGGGVIGIEWASMLNDFEVDVTILENQDRILSTEDAEISKEMSKLLSQKGINIITNANVKADSVKKDQGVSLQVDVDGEIQTHQAEKVLMSVGRKGNIENIGLENTDIVTDRNLIMTNEFYQTKESHIYAIGDVIGGLQLAHVASHEGIKAVEHMAGHTVEKIKANAIPSCIYSSPEAASIGLTEAQAKEKDYEVKVGKFPFKAVGKALVYGESEGFVKIVSDKNTNDLLGVHMIGPHVTDMIAEASLAKFLDATPWEISESIHPHPTLSEVIGEAALAVEGNQIHG

SEQ ID NO: 1934 - protein, 162 aa, Arabidopsis thaliana
MGWWWRKKNKNKKLILERGANLLEELIEFGHGKSNPIKFFSADEILKTTNNFSASNRVSRLFYPFKWYSGENENHPMILIRNGISWWNGRRVNLVCRDIAVSSMVSGHKNFLKLVGCCLESQFPDLVYHGVKKHFKLEISEQPWKRRMKIAEDIATALAYLH

SEQ ID NO: 1935 - protein, 393 aa, Anthoceros formosae
MTMLAAKADPMTLSMGPHHPSMHGVLRLIVTLDGENVTDCEPILGYLHRGMEKIAENRTIVQYLPYVTRWDYLATMFTEAITVNAPEKLTNIQVPKRASYIRIIMLELSRIASHLLWLGPFMADIGAQTPFFYILREREMIYDLFEAATGMRMMHNFFRIGGVAVDLPYGWVDKCLDFCDYFSLKVDEYERLITYNSIFLKRVEGVGTISREEAINWGLSGLMLRASGVQWDLRKVDHYECYDELDWQVQSQTEGDSLARYLVRIGEMRESVKIIQQALKVIPGGPYENLEARRLNQGKDSEWNDFEYQFISKKPSPTFKLPKQEHYIRVEAPKGELGIYLIGDDSVFPWRWKIRPPGFINLQILPQLVKGMKLADIMTILGSIDIIMGEVDC

SEQ ID NO: 1936 - protein, 364 aa, Oceanobacillus iheyensis HTE831
MEIFTSLQKYDYEQLLFCQDKNSGLKAIIAIHDTTLGPALGGTRMWTYKTEDDAIVDALRLAKGMTYKNAAAGLNLGGGKTVIIGDPKKDKNPEMFRAFGRYIQGLNGRYITAEDVGTTEMDMDLIHLETDYVTGTSSYSGASGNPSPITALGLYHGMKATAKEAFGTESLEGKTVAVQGVGNVAYHLCEFLHKEGANLIVTDINKESVKRAVEDFGAKAVDPDEIYGVECDIYAPCALGATINDETLDKLKAKAVAGSANNQLMSTKHGDILHERGIVYAPDYVINAGGVINVADELVGYNRERAMKKVEMVYDNVEKVFEISKRDNIPTHVAADRMAEERIQSVRNSRSQFLRNEKHILNFN

SEQ ID NO: 1937 - protein, 431 aa, Clostridium perfringens SM101
MKLFGSMKVEGNELYVGGVKASDLSKEYGTPLYVIDEELVRGNCRRYYNAMKCEERGNRVTYAGKAFINMSMCNLVNEENLYLDVVSGGELYTAYKAGFPLERIYFHGNNKSDYEIDLGVRLGIGRFIVDNIHELEVLNSIAQEYGRVQKVYLRITPGVEAHTHEYIKTGQLDSKFGFPVIGDTVYDAIKRAMELEYIELNGLHCHIGSQIFDLEPFEDTTEIMLNLINDIKETLGYEIKELDLGGGFGIYYTEGDKPKEIEEYCSVIINKADEICRKLNMNVPILSIEPGRSIVGNAGLTLYTVGAIKEIPNIRKYVSVDGGMSDNIRPALYSANYESIIANRVFDNSKEIVTVAGKCCESGDVLLNSIEMPRMETGDILAIISTGAYGHSMANNYNRIPKAAVVSVSNGISKVMCKRETYEDLLRNECF

SEQ ID NO: 1938 - protein, 314 aa, Guillardia theta
AFQPTLRSGAPAKVNQRATCAVSMSAQSNVKVAAAGLAALPLIIGGADAANALTSKDINNLTYEEVKGTGIANRCPEVESNGEDIVLQQNTKYKITDLCIEPKSFQIETEVQKKRGESRREFVDTKLVTRATYSLAGVEGPLFYDKDGSLTFQEKEGLDYAATTVQLPGGERVPFFFTIKELVAKATAPKGISPGTEFGGTFTVPSYRSGLFLDPKGRGATTGYDMAQALPAFEADGNEGQAELFKENNKVFQVTDGSMEFAVNKVDGQTGEFSGVFVSEQLSDTDMGSKAPKKVLIKGIVYGKVSTASGDEGY

SEQ ID NO: 1939 - protein, 434 aa, Mycobacterium sp. MCS
MADNPSSATEHAKLSYPGGELELDIVPATDGADGIALGSLLAKTGYTTFDGGFVNTASTKSAITYIDGDAGILRYRGYPIEQLAEKSTFIEVSYLLIYGELPTADQLEDFTTKIQRHTLLHEDLKRFFDGFPRNAHPMPVLSSAVNALSAYYQDSLDPMDKNQVELSTIRLLAKLPTIAAYAYKKSEGQPFLYPDNSLTLVENFLRMTFGFPAEPYEVDPEIVRALDMLLILHADHEQNCSTSTVRLVGSSQANLFTSISGGINALWGPLHGGANQAVLEMLTKIQKSDGDVREFVRKVKDREDGVKLMGFGHRVYKNYDPRARIVKEQADKILGKMGVEDELLDIAKSLEEVALTDDFFVERKLYPNVDFYTGVIYRAMGFPTRMFTVLFALGRLPGWIAHWREMHSEPGKIGRPRQIYTGYTERDYIDTDKR

SEQ ID NO: 1940 - protein, 526 aa, Oryza sativa (indica cultivar-group)
MAGSDEVNRNECKTVVPLHTWVLISNFKLSYNILRRADGTFERDLGEYLDRRVPANARPLEGVSSFDHIIDQSVGLEVRIYRAAAEGDAEEGAAAVTRPILEFLTDAPATEPFPVIIFFHGGSFVHSSASSTIYDSLCRRFVKLSKGVVVSVNYRRAPEHRYPCAYDDGWTALKWVMSQPFMRSGGDAQARVFLSGDSSGGNIAHHVAVRAADEGVKTVVPLHTWVLISNFKLSYNILRRADGTFERDLGEYLDRRVPANARPLEGVSSFDHIIDQSVGLEVRIYRAAAEGDAEEGAAAVTRPILEFLTDAPATEPFPVIIFFHGGSFVHSSASSTIYDSLCRRFVKLSKGVVVSVNYRRAPEHRYPCAYDDGWTALKWVMSQPFMRSGGDAQARVFLSGDSSGGNIGHHVAVRADDEGVKDRYWYWKAYLPEDADRDHPACNPFGPNARRLGGLPFAKSLIIVSGLDLTCDRQLAYADALREDGHHVKVVQCENATVGFYLLPNTVHYHEVMEEISDFLNANLYY

SEQ ID NO: 1941 - protein, 127 aa, Shewanella sp. MR-4
MKSIIHAERAPAAIGPYSHGTSYGNLIFTSGQLPVCKENGGVVDGGISEQSVQCLENLKYVIEAGGGSLETVLKTTCYLSEISDFAAFNEVYKSYFKTDCPARSCFAVKDLPLGVKVEVEAIAHIHA

SEQ ID NO: 1942 - protein, 367 aa, Prunus avium
MTFSLRKEEILIDILVRLPAKSLVRFLCTCKSWSDLVGSSSFVSTHLHRNITKHAHVHLLCLHHPNVRRQVNPDDPYVTQEFQWSLFPNETFEECSKLSHPLGSTEHYGIYGSSNGLVCISDEILNFDSPILMWNPSVRKFRTAPTSTNINLKFAYVALQFGFHHAVNDYKVVRMMRTNKDALAVEVYSLRTDSWKMIEAIPPWLKCTWQHHRGTFFNGVAYHIIQKGPIFSIMSFDSGSEEFEEFIAPDAVCSSWGLCIDVYNDQICLLSGFYGCEDEGLDKIDLWVLQEKQWKELCPVIFPPLGDCDRIIGISIGIELLMEKKDFDKGVGELYLCNYESKQVLQTGIKLAVMKYDEIEFVFAITY

SEQ ID NO: 1943 - protein, 365 aa, Prunus avium
MTFTLRKKDILIDILVRLPAKSLVRFLCTCKSWIDLIGSSSFISTHLHRNATKHTHVYLLCLHHPNFERNDDPDDPYVEQEFQWSLFSNETFEECSKLSHPSGSTKHYVIYGSSNGLVCISEEILNFDSPIHIWNPSVKKFRTPPMSTNINIKFSHVALQFGFHPGVNDYKAVRMMRTNKNALAVEVYSLKTDSWKMIEAIPPWLKCTWQHHKGTFFNGVAYHIIEKGPICSIMSFDSGSDEFEEFIAPDAICSPSELCIDIYKERVCLLFSFYSCDEEGMVPNDLWVLQEKRWKQLCPFIYPAGSYGTIGITIDNKLLMVRRDFLRGAGDLCLCNYESKQVFETGIELAVMKYGEIELLFAITY

SEQ ID NO: 1944 - protein, 450 aa, Arabidopsis thaliana
MDLTDPDPDRWFTDPADPDSCFTDHAVLDLGLAFLQVMKLFGQHQPLALDLYIPSSRDCCENSSFNPLPSKIFESKALVWLKIQFQDGVSIDVKRGVSLPKLKTLHLDYFKIEPSKFNKLLSGCHALEELVLINLMWADSSGYKVCPVTVSIPTLKRLKFCRSEDFYEGKFHEYEDYDEENIKKGVSLSFDNPNLVYLEYSDVIVDKYKQVRFDSLVEANLGLRKNQAEPDKINVTKLLMGLHNVKILYLSNDILEVLACCRERIPVFDNLLELTIKTTPYVGWKSLQPLLKSYPSLETLVFEVLYTAFRSTVETFLSIQFDYETDSVMFQGLHHKYTKKCGDKDGCLCKYENDLGAKKKNVRTCLTSSPVKVLKILKFGETFEDEDEDGLDVDHDDYDDEDDVSCDEDVMKVFKKLQKLPRVASAKCEVQIKSKNLSLSSTSTKRGTLL

SEQ ID NO: 1945 - protein, 192 aa, Staphylococcus aureus subsp. aureus MRSA252
MIYQKQRNTAETQLNISISDDQSPSHINTGVGFLNHMLTLFTFHSGLSLNIEAQGDIDVDDHHVTEDIGIVIGQLLLEMIKDKKHFVRYGTMYISMDETLARVVVDISGRPYLSFNATLSKEKVGTFDTELVEEFFRAVVINARLTTHIDLIRGGNTHHEIEAIFKAFSRALGIALTATDDQRVPSSKGVIE

SEQ ID NO: 1946 - protein, 396 aa, Robiginitalea biformata HTCC2501
MFKKSGPGMLIAAAFIGPGTVTTCLRAGVEMGYALLWALLLSVVATIVLQEMAGRLGLVTRRGLPSLIRKRVTLPWLRILMVGLILVAIVAGNAAYEAGNIAGGVLGLEALLGSGAFGVYPWICGSLAFILLWLGSYKALERVFTGLVLLMSLSFLITAFLVQPDIPALFRGLVTPNLDGDSIFTVLALIGTTVVPYNLFLYTALVTEKWENSGAVQSMRRDIFWSVAIGGVVSMSIVVTAAGSGMGVVADVLDLAAALEPIYGKAARFGLGVGLFAAGISSAITAPLAAAYVSRQTFDWPADRKDWRFRSVWVGVLIIGVLSLSLEYRPLEIIYVAQIANAIVLPVIAAFLWWMIRSRQLMGDQRNTVARDLVALVIIGIVTLLAAKTIYSILIE

SEQ ID NO: 1947 - protein, 459 aa, Listeria monocytogenes str. 4b H7858
MKHIVIIGGGLSGLAAAYELQKTHPNYTWELVEKDKKLGGKFETVKRDGFLIEKGPDSFLARKPAGVGLVKDLGLEDKLIANATGRSYIYHQKALHPIPEGSVMGIPTDKEALLASTLVSEIGKARALQEPTMERNNQEQDQALGEFFEARFGKELVKTIIEPLLSGIYAGDIYKMSLRATFPQFEQAVKKYGNLMDGLKESSMQTTGTKATIGAFRTLEGGLDALPKAIAAALPKENLHTAKQATNITKKNSSYEISFVDGDKMEADGVIIAATHDALIHLLAEKTTEPFAGQPLTTLATVSLAYNEQDVPILPDGTGYLVARTAPYKTTACTWVQKKWPHMVPENKMLLRGFVGKAGETWLEQASDEAIVSAVLRDYAEMMDLHAAPLFYEVSRMKSAMPQYLVNHQDRLKQLKKNIKADYPGVYFAGMSYEGVGIPDCIAGAQTAAKELVDYLEEV

SEQ ID NO: 1948 - protein, 332 aa, Neisseria meningitidis FAM18
MSRPVPAVFGSVFHSQMPVLAYREGKWQPTEWQSSQDLSLAPGAHALHYGSECFEGLKAFRQADGKIVLFRPTANIARMRQSADILHLPRPETEAYLDALVELVKRAADEIPDAPSALYLRPTLIGTDPVIGKAGSPSETALLYILASPVGDYFKVGSPVKILVETEHIRCAPHMGRVKCGGNYASAMHWVLKAKAEYGANQVLFCPNGDVQETGASNFILINGDEIITKPLTDEFLHGVTRDSVLTVAKDLGYTVSERNFTVDELKAAVENGAEAILTGTAAVISPVTSFVIGGKEIEVKSQERGYAIRKAITDIQYGLAEDKYGWLVEVC

SEQ ID NO: 1949 - protein, 789 aa, Shewanella sp. MR-4
MQQYVLWYQELGMGDVNLVGGKNASLGEMISNLANAGVQVPGGFATTSYAFNEFLEQSGVNQKIYDILATLDVDDVNALAQVGAQIRQWVIDTPFQPALEQAIREAYDKLAAETSDASFAVRSSATAEDMPDASFAGQQETFLNVKGFDSVLVAIKHVFASLFNDRAISYRVHQGYEHHGVALSAGVQRMVRSDKAASGVMFTMDTESGNNDVVFITSSFGLGEMVVQGAVNPDEFYVHKPILTQGHKAVVRRNIGSKLIQMVYSDDASHGKQVKIEDVAAEKRRQFSINDAEVMELAKQAMVIEKHYGRPMDIEWAKDGNDGKLYIVQARPETVRSREDVQLIERYHLKSRGAVISEGRAIGHKVGSGVAKVLTSIADMDQIQPGDVLVTDMTDPDWEPIMKRASAIVTNRGGRTCHAAIIARELGVPAVVGCGDVTDRIKNGQLVTVSCAEGDTGYIYEGKQEFEVVSNRVDALPELPMKIMMNVGNPDRAFDFARLPNEGVGLARLEFIINRMIGIHPKALLEFNQQDAALQEEINEMIAGYDSPVEFYIARLVEGIASIGSAFYPKKVIVRMSDFKSNEYANLVGGDRYEPEEENPMLGFRGASRYISESFRDCFALECEAIKRVRNEMGLKNVEVMIPFVRTVKEAEQVIGLLKEQGLERGKDGLRVIMMCEVPSNALLADQFLEHFDGFSIGSNDLTQLSLGLDRDSGIISHLFDERNEAVKILLSMAIKAAKAKGAYIGICGQGPSDHADFAAWLVEQGIDTVSLNPDTVIDTWLYLAEAHA

SEQ ID NO: 1950 - protein, 468 aa, Solanum tuberosum
MAASRRLRDLQAQPGNKICVDCSQKNPQWASVSYGVFMCLECSGKHRGLGVHISFVRSVTMDSWSEIQIRKMELGGNESFNKFVLQYGIPKETDIVTKYNTKAATVYRDRIQSLAEGKPWRDPPVVKEVLRGSASNNGSRPPLSSGASGGGGSRNGGWDSWDNNDDGGFSGSNTKDIRRNQTVGDFRSGGSSGGAPARSRSTADISKEQYEASAANKDNFFARRMAENESRPDGLPPSQGGKYVGFGSNPAPMPRNNMNQQGDVFSAVTQGFGRLSMIAATAAQSAASVVQVGTKELTSKVKEGGYDTKVNETVNVVTAKTSEIGQKSWGIMKGVLAMASQKVEEYTKESPAWKNDSWQRGESDKNGYYQDFNQDSKGWNASGGAQSSGRNANSVSSGSWDDWDNEDKSKVNPTKAAAAPNNKNDDWAGWDDGQDDGFDNHYQSASNNKHAAVHAGKSDSKWTDGGFL

SEQ ID NO: 1951 - protein, 403 aa, Sulfolobus tokodaii str. 7
MWRKRITTSEKTINFLKVFGPAWLVMMADMDASSIIGAAQTGAVYNYGFVWILLLLVIPLYIIQETSGRIGVATGKGLGEVIRENYSKRVAAIMALPMAITDAFTYAIEYMGIAIGFEVLGIPLIISIPAIFIIHILIVTKQKYVEAERVLLGISLALIVGLTATLFLRGVKDYSPIYFKPSPLFFFLIAANVGAVIMPFMLYFQASATAIKLKEIDAIEYKSQVIKHMRKETLLGAIATEILMVIVEMTFAGIKNASDPSVFASASQLATVMTPIAGDLSPIFFSIGLISAGFLALVVISLGSAWGVVEALGIPKRSAWKIYVIESIPAVLVTLLLPPSMLINTILDLLVFFVYALIGPIVILGIISRNKKIMGEYYSSGIRLVAYWISAIIILSIAIIATF

SEQ ID NO: 1952 - protein, 66 aa, Aspergillus nidulans FGSC A4
MFLKSGGGVIISVKASCIDSTAKPEVVFAREVQKMRDEKIKPKEQLTLEPFERDHCIVSGIYNRSS

SEQ ID NO: 1953 - protein, 180 aa, Magnaporthe grisea 70-15
MPLVLCSHDENFAWLNRVDDGKTAVRIANPKSAEYQVVRTSLLPGLLKTVRENKSVKLPLMIMETSDVVVKDEALERKARNVRHWAAAYCGTTSGFEVVHGLLDRIMSMLRVPVGTYYIAEIDEPTFFGGRAAAVFLRQGGEKGEAVRIGELGVLHPTVLDKFDLRYPVSTLEINLEVLL

SEQ ID NO: 1954 - protein, 344 aa, Shewanella sp. MR-4
MAVFNHVSFDEHEQVVFCHDKESGLKAIVAIHNTNLGPAVGGCRMWNYQSDDEALTDVLRLSRGMTYKNALAGLTMGGGKSVIIADPKRPDREALFRAFGRFINSLGGRYYSAEDVGTTTADIMIAHQETPYMAGLEGKSGDPSPFTALGTYLGIKAAVKHKLGLDSLKGLKIAVQGVGHVGYYLCKHLHEEGAELIVTDIHQASLDKVATDFGAIVVAPQDIYAQDVDVYAPCALGATLNDVTLPQLKAKIVAGCANNQLAEVRHGEQLKEMGILYAPDYVINAGGIINVSFEKDYDAAKSEAKVREIYNTLLKIFTKADAENRTTAAVADEMARAIYQAAKD

SEQ ID NO: 1955 - protein, 428 aa, Nitrosomonas europaea ATCC 19718 [sequence omitted]

SEQ ID NO: 1956 - protein, 180 aa, Guillardia theta
CSAPPAVTRLLPSSCSTGPRTTALVACDDGVYEFTCGAGNKWIASREKIQIKKDSKIFSPANLRCCQEDAGYDALVKHWMEKRYTLRYSGGLVPDVYQHFTKEMGVFANPTSPKSPAKLRVAFEIAPFSLLVEKAGGKTSDGVTGNSCLDIKIEAVDQRTPACLGSANEVDLFNKMVLGK

SEQ ID NO: 1957 - protein, 523 aa, Nocardia farcinica IFM 10152
MTTGAQALDEPIRSRRNHWNNQLATHALMRPDAVALRFKGVDTTWKQLHERSEKFADALARRGVGFGDRVLILALNYPEYIEAVFGINALGAIAVPVNFRLTPPEVAYIVSDSGAKAIVTDTMLQPLAAAVRADAPALETLVVIGGRSDEGVLGYDDALAEDGAPHAPLDIPEDTPSLIMYTSGTTGSPKGAVLTHANMNAQALTCIRAMEITPESVGFCTSPLFHIAGLGSLAPYFMLGAKTVLHPLGAFNPTEFLDAVEAEQATTAFCVPAQWQAICAEPTVKQRKLALKMLSWGAAPASDSVLRAMAECFPEAQNVAVFGQTEMSPITCVLEGKDALRKLGSVGKPIPTIQVRIVDDEMNDVAPGEVGEIVYRGPTLMQGYWNKPEATADAFEGGWFHSGDLVRTDEEGFVWVVDRKKDMIISGGENIYCAEVENVLFSHPKIREAAVIGRSHDKWGEVPVAIVALNNPDDELTLDELEPFLNENLARYKHPKDLVVVAELPRNASGKVVKVQLRKDYSS

SEQ ID NO: 1958 - protein, 374 aa, Guillardia theta
GHTSNFTSIILSGVHAADLLHCLQELNFGVSAHVERASVAVARHSTMAVPSLSLMEIGARPSDPKPHILVVVLDPLGDVMRAQLLNVIGKLFAIAEVMAAAGAEAAGFYSSPVMQLRGGGDRRFLIAGNWKMNPETMDEAKALASSVVESAKSVKKGVDICICCPHPFLATCAQICKDSEVKIGAQDIFTEEKGAFTGGVSIKQVESIGCKYVLIGHSERRHGNIASESNAMINKKVKMTIDSGLVACLCIGETKAEFEAKKNKEVCAKQLAEGLAGVTKEQLANVVLAYEPVWAIGTGYTASPEIAQDVHNYVRQWLEQNYDKATAESVRILYGGSVTPDNVDQLMACPDIDGALVGGASLVGEKFARIMNFK

SEQ ID NO: 1959 - protein, 211 aa, Oryza sativa (indica cultivar-group)
MLRRRGFCCCSGAPTAAAAALLLLAVAAAAPRAAGFHLGGDESVLVRGMLAAIRREQAEAEDAARFAVAEYNKNQGAELEFARIVKAKRQVVTGTLHDLMLEVVDSGKKSLYSAKVWVKPWLDFKAVVEFRHVGDSQSQSATDADGNAGQDTADPTVASRNDLHNTENNKVSVDLSTFSQFNSYLLSDILGVNLAPWRGYGRLELLRASCQ

SEQ ID NO: 1960 - protein, 403 aa, Oryza sativa (japonica cultivar-group)
MDWAAAGYTAAALVCAAAATVIALVHIYRHLLHYAEPIYQRFIVRLIFMVPVYAVMSFLSLILPDNSIYFNSIREIYDAWVIYNFFSLCLAWVGGPGAVVVSLNGRTLKPSWFLMTCCFPAIPLDGRFIRRCKQGCLQFVILKPILVVITFILYAKGKYADGNFSVKQSYLYITIIYTVSYSMALYALAVFYAACRDLLRPYNPVPKFIMIKSVVFLTYWQGVLVFLAAKSRFIKNAEKAADLQNFVLCVEMLIAAIGHLFAFPYNEYAGPNGRPSGDFKGSLLHALKFNDFYHDTVHQFAPTYNEYVLYNHNEGDSTQRKYPSVSTVPSGRDVELSGISVMPANSAVTSSVSSNQADQEETMSTPIKDRVDNVGLYDLTDLLDVDLSNYPAKVPAISDVRKQ

SEQ ID NO: 1961 - protein, 378 aa, Zea mays
MSRLLLRHRSFLLPGARSDASHPFTAASSSSRSSYTSRFSPLAYHASAAATAAGAQSEGAAAESTPAAGDQPSSTPPPAARGRWGLLKFGALAAVAGAIGGVGYVTYAYSLNEVEEKTREFRKNPRLLIPEDASTFEKYKAMVYSTAMKVPVSAIELYLDIRSTIEDHVRGFTEPTSDKLLPDLLPQDQHVFTLVLDLNETLVYSDWQRERGWRTFKRPGVDAFLEHMSKLYEVVVYSDQPPMYVEPVFERLNSRGTISHRLSRPATKYVDGKHYRDLSKLNRNPAQVIYLSAHALESCLQHENCVEIKPFKLEDKNDTQLLDLIPFLEYVAMARPSDIRTVLASYQGHDVAAKFIERSKEHQRRVQEQSKLGRLWRR

SEQ ID NO: 1962 - protein, 364 aa, Shewanella oneidensis MR-1
MSYQIAVLAGDGIGPEVMAEARKVLKAVEARFGLNIEYTEYDVGGIAIDNHGCPLPEATLKGCEAADAILFGSVGGPKWEKLPPNEQPERGALLPLRGHFELFCNLRPAKLHDGLEHMSPLRSDISARGFDVLCVRELTGGIYFGKPKGRQGEGESEEAFDTMRYSRREISRIARIAFEAARGRRKKVTSVDKANVLACSVLWRQVVEEVAVDFPDVELEHIYIDNATMQLLRRPDEFDVMLCSNLFGDILSDEIAMLTGSMGLLSSASMNSTGFGLFEPAGGSAPDIAGKGIANPIAQILSAALMLRHSLKQEEAASAIERAVTKALNSGYLTGELLSSDQRHKAKTTVQMGDFIADAVKAGV

SEQ ID NO: 1963 - protein, 373 aa, Prunus avium
MAFTLRKKEIMIDILVRLPAKSLVRFLCTCKSWSELIGSSSFVSTHLHRNVTKHAHVYLLCLHHPNFERNEDPDDPYVEQEFQWSLFSNETFEECSKLSHPLGSTEHYVIYGSSNGLVCISDEILNFDSPIHIWNPSVKKVRTPPMSTNINMKFSHVALQFGFHPGVNDYKAVRMMRTNKNALVVEVYSLKTDSWKMIEAIPPWIKCPWQHYKGTFFNGVAYHILQKGPIFSIMSFDSGSEEFQEFIAPDAICSPSELCMDVYKEQICLLFSFYSCEEEGMTKKDLWVMQEKRWKQLCPFIHPFDCDGTIGISIDNELLIERRDFDRGVAVLNLCNYESKQALETGIELAVIKYGEIEFFFVMTYIETLPFLN

SEQ ID NO: 1964 - protein, 182 aa, Triticum aestivum
  misc_feature (82)..(82): Xaa can be any naturally occurring amino acid
  misc_feature (133)..(133): Xaa can be any naturally occurring amino acid
  misc_feature (161)..(161): Xaa can be any naturally occurring amino acid
  unsure (1)..(182): unsure at all Xaa locations
MDSEHWISRLAAAKRFYAAQLGHADRAGMDELDMDGDENAGRPDFACPYCYEDHDVASLVAHLEEDHPFEPHAAPCPICSEXVSKDMLNHITMQHGYLFKNRRRLRRFAVPGSQSLSLLSRDLREAHLQVLLXGGGGLRSKQHNATNISADPLLSSFGLSXPTLDGEETSKLSTLVRGKDQW

SEQ ID NO: 1965 - protein, 517 aa, Robiginitalea biformata HTCC2501
MEEPIAQRTYLVGGELLNWDGPVTEVYSTISGPGQYKPTHLGSIPDMGEKEALEALDAAMGAYARGQGAWPTMKVRDRIECMEKFVRQMEGKRERIVQLLMWEIGKSLPDSEKEFDRTVEYIYDTIEEYRELDRNSAKFDKHQGVYAHIRRGPLGVVLCLGPYNYPLNETFALLIPAIIMGNTTIFKPAKHGVLLITPLLEAFQNSFPRGVVNILFGRGRAVAAPIMQTGKVDVLALIGNSKSANALQEQHPKSNRLRLVLGLEAKNPAIVLPDADLDLSIQECLAGTLSFNGQRCTALKVVYVHEDIREEFLERFASAVDALPFGNPWDPGVKLTPLPEPGKPDYIRELIDDALEKGARILNEKGGEQTDNYIWPAVLYPVTRDMRVYREEQFGPVIPVLSFREIEEPLDDMAESNYGQQVSLFGKDVYTLAPLIDTLANLVCRVNLNSSCQRGPDVYPFTGRKDSAQSTLSVHDALRSFSIRTFVAFKDNPINVETVEQLLDTKASNFISTDYIL

SEQ ID NO: 1966 - protein, 584 aa, Neisseria meningitidis FAM18
MLLDAAGGVPEIRQSRCRLLNYILLHFNPVLKNQGKQMNAFTRAWYALERHYQDTRHVLLRDRFACEPDRFERMHERLDGMLFDYSKNRLGEDTLQLLCRLAETADLEGKMRALRTGAKVNGSEGRAALHTALRLPDGADAVYVDGRDVLPEIRRELNRALEFAHSLDDGSYQGITGKRITDFVHIGIGGSDLGPAMCVQALEPFRRHIAVHFAANADPACLDAVLCRLNPETTVFCVASKSFKTPETLLNAQAVKAWYRGAGFSESETACHFCAVSADTAAAAAFGIAAERVFAMYDWVGGRYSVWSSVGLPVMVAVGGARFRELLAGAHAMDSHFFHTPPRRNIPVLMALIAVWYNNFQHADGQTAVPYSHNLRLLPVWLNQLDMESLGKSRASDGSPAVCKTGGIVFGGEGVNCQHAYFQLLHQGTRLIPCDFIVPMTAQGVEDGRSRFTVANAFAQAEALMKGKTLDEARAELADLPEAERERLAPHKEFPGNRPSNSILLDRLTPYNLGMLMAAYEHKTFVQGTIWNVNPFDQWGVEYGKQLAKTIIGELEGGTSVHDASTEGLMAFYRECRLKGGGAA

SEQ ID NO: 1967 - protein, 401 aa, Rickettsia rickettsii
MSIISTRLSSIKPSPTLAVVKKTLELKKAGVDIITLGAGEPDFDTPYNIKEAAIKAIKDGFTKYTNVEGMPLLKQAIKDKFKRENNINYELDEIIVSTGGKQVIYNLFMASLNQGDEVIIPAPYWVSYPDMVALSTGTPVFVNCGIENNFKLSAEALERSITDKTKWLIINSPSNPTGASYNFEELENIAKVLRKYSHVNVMSDDIYEHITFDDFKFYTLAQIAPDLKKRIFTVNGVSKAYSMTGWRIGYGAGSKALIKAMTIIQSQSTSNPCSISQMAAIEALNGPQDYIKPNALNCQKKRDLALSILKRVKYFECYKPEGAFYLFVKCDKIFGHKTKSGTIIANSNDFAEYLLEEAKVAVVPGIAFGLEGYFRISYATSMEELEKACIRIERTIDVIPA

SEQ ID NO: 1968 - protein, 324 aa, Neisseria meningitidis FAM18
MLENLPYFQRHLPEDLAKVNEVINRAVQSDVALISQIGTYIISAGGKRLRPIMTILAGKAVGYDDGKLYSLAAMVEFIHTSTLLHDDVVDESDLRRGRATANNLFGNAAAVLVGDFLYTRAFQLMVDSDSMRVLEVMADATNIIAEGEVMQLMNIGNTDITEEQYIQVIQYKTAKLFEAAAQVGAILGKASPEHERALKDYGMYVGTAFQIIDDVLDYSGETEETGKNVGDDLAEGKPTLPLIYLMRQGSEQVANDVRTALENADRSYFEKIHDYVVRSDALAYSIGEARKAVDCAVAALDALPDSEVKDAMIQLAKESLVRVS

SEQ ID NO: 1969 - protein, 479 aa, Magnaporthe grisea 70-15
MPEIPPGRPGNLTPEQDELLRKLWSRLFEVCGVIQPEAPARAPETADADADSTKKKTRTGFFSRRKTDASTTNGPTQEGDPEDKYGQNKIFQDTLANMPPDEIRKTIWSMVKFDHPDALVLRFLRARKWDVEKALVMLVSSMYWRCKEVKVDSNIMSRGEGGMSQDEKEAPEGSDEQKMGKGFMAQLRMGKSLAHGEDKLGRPVVYVKVRLHKAADQTPESIERYTIFLIETTRALIKPPIDTATLVFDMTDFSMANMDYSPVKFMIKCFEANYPESLGAVVVHKAPWVFQGIWRIIRGWLDPVVAAKVNFTNDITALQEYVSIDKIPVELEGKEQWEYKYTEPIPGENDRMKDTATRDRLLAERAKLYTAFEEATLKMLRNPTDQAVRKERSEIASTLRSQHWQLDPYIRARSWYDRTGVLREDGTINYYPPKDFKYVVNGGGQQKQEDNGIKKVDSAHEKASIQDSAPPAVSLNGTA

SEQ ID NO: 1970 - protein, 480 aa, Oryza sativa (japonica cultivar-group)
MVLSVRAVSGKSDLDFSDPSWKEKYQEDWNRRFSLPHITDIYDLKPRLTTFSLKKNRTDGGSLSADKWNGYVNKDDRALLKVIKYASPTSAGAECVDPDCSWVEHWIHRAGPRKEIYYEPAEVKAAIVTCGGLCPGLNDVIRQIVFTLEIYGVKNIVGIQFGYRGFFEKGLKEMPLSRKVVENINLSGGSFLGVSRGGAKTSEIVDSIQARRIDMLFVIGGNGSHAGANAIHEECRKRKLKVSVVAVPKTIDNDILFMDKTFGFDTAVEEAQRAINSAYIEARSAYHGIGLVKLMGRSSGFIAMQASLSSGQIDVCLIPEVSFTLDGEHGVMRHLEHLLEKKGFCVVCVAEGAGQDLLQKSNATDASGNVILSDFGVHMQQKIKSHFKDIGVPADVKYIDPTYMVRACRANASDAILCTVLGQNAVHGAFAGFSGITSGICNTHYAFLPITEVITKPKRVNPNSRMWHRCLTSTGQPDFH

SEQ ID NO: 1971 - protein, 281 aa, Candida albicans SC5314
MSDYMDDPFQMDEEIPSKKDPIPSKERSLPIPENATIDRDITPSYPTPPNIHYDNNKIIRSKLDQLKLEENTGGTNTTTEEEGEKYEEDIDDKLDMSLQAKLRLEYENCLDYDKPLTPPENFAPVINKIYRSSFPQPNNFAFLKKLKLKSILCLIPEDYPHLQQEFIKNENIKLFQLGMSGNKEPFVKISADLITEAVKIVLNPENQPILIHCNRGKHRTGCLVGVIRKLQNWSLTLIFDEYRKFACPKERPMDQQFIELYDDTEILEYCYEYDLLPLKWD

SEQ ID NO: 1972 - protein, 458 aa, Arabidopsis thaliana
MEFTEAYKQTGPCCFSPNSRYVAVANDYRLVIRDTFSFQVVQLFSCLDKISYIEWALDSEYILCGLYKKPMIQAWSLTQPEWTCKIDEGPAGISYARWSPDSRHILTTSEFQLRLTVWSLLNTACVHVQWPKHGSKGVSFNQDGKFAAICTRRDCKDYVNLLSCQSWEIMGSFAVDTLDLADLEWSPDDSSIVVWDSPLEYKVLIYSPDGRCLFKYQAYECGLGVKTVSWSPCGQFLAIGSYDQMLRVLNHLTWKTFAEFLHLSTVRAPCSAAIFKEIDEPLQLDMSELSLDENFMPSNYDASEGYISVRYEVMELPVAFPFQKPPADKPNPKQGVGLLAWSKDSQYICTRNDSMPTALWIWDMRLLEVAAILVQKEPIRAAVWDPTCTRLLLCTGSSHLYMWTPSGAFCVCNPLPGFSISDLKWNIDGSCLLLKDKDAFCCATVPSLPESSDYSSDD

SEQ ID NO: 1973 - protein, 433 aa, Shewanella sp. MR-4
MRFESFSFCPEILRAISDCGYQKMTPIQQQAIPAIRRGQDVLASAQTGTGKTAAFALPILQKMAENPSETLKSNARVLILTPTRELAAQVADNVEAYSKYLNFSVLTIYGGVKVETQAQKLKRGADIIVATPGRLLEHLTACNLSLSSIDFLVLDEADRMLDMGFNADIQKILQAVNKKRQNLLFSATFSSAVKKLANEMMVKPQVISADKQNTTADTVSQVVYPVEQRRKRELLSELIGKKNWQQVLVFTATRDAADTLVKELNLDGIPSEVVHGEKAQGSRRRALREFMSGKVRVLVATEVAARGLDIPSLEYVVNFDLPFLAEDYVHRIGRTGRAGKSGVAISFVSREEERTLADIEKLIGQKIRRITVPGYEVGSRDLLLKQLQTRRSFAKKQQRLDNVSEQIVAEKSMQGRRVKMKVGQAPSKAKKLK

SEQ ID NO: 1974 - protein, 143 aa, Hordeum vulgare subsp. vulgare
MEYQGQTGHATTDKVEDYGQPVAGHGGATGGPTGTHGAAAAAAGTGQLQPTRDDHKTDGVLRRSGSSSSSSSEDDGVGGRRKKGMKEKIKEKLPGGAHKDAAGQQHTPAAGEYAGTGTHGAEATGEKKGVMDKIKEKLPGGQH

SEQ ID NO: 1975 - protein, 327 aa, Oceanobacillus iheyensis HTE831
MDKILRLFPIHLQQRIKEKIIHNEEKLQEIRIRIGRPIELIFDKEAIWLKDTIPQKNDGNYLLNQISEYSLYRMEDELRSGYITIEGGHRVGIAGRVNTSGKDVKALQHISCFNIRIAKEKRNAAIDVFAYINYNNYYFNTMVIGPPQSGKTTIIRDLTRMIATIDQPMNRSKKVGIVDERSEIAASLQGIPQHDVGTRTDIMDACPKAEGMMMLVRSMSPDIIVVDEIGTDHDVEALLEAIHTGVTIICTAHANQWDDLNKRPSMKRLIEQQVFERYVLLGKGPDIGKIQKVYDSAGDEIKLSKRSPIHEVDWSTAFNRDSNHHRV

SEQ ID NO: 1976 - protein, 459 aa, Geobacillus kaustophilus HTA426
MAYSYEQLEQWDKQYVWHPFTQMKQYAKERPLIIERGQGSYLYDVDGNRYLDGYASLWVNVHGHNDPELNAALREQLEKIAHSTLLGSANVPSILLAKRLLEYWPHMSKVFYSDTGAAAVEIALKIAYQYWKNIDPVQYAKKNKFVSLKEAYHGDTVGAVSVGGMETFHRIFAPLLFERIEVPSPYVYRMDEYGSEQEIVGYCLRELERVLEEQHDQIAAVVIEPLVQGAAGIIVHPRGFLKGVERLCRRYGVLFICDEVAVGFGRTGTMFACEQEEVKPDLVCLGKGITGGYLPLAATLVTEEIYAAFLGDVDEDKTFYHGHTYTGNQLTCSVALKNIELIEKRSLIDSVKRKARRLAEWLERLYEIPIVGDIRQKGLMCGIEIVKDRRTKEVFPRAAMVEHRIILEARRRGLVIRPLGPVLTFIPVLSMSEDEMAEAVRILFDSLACLYEQARAELL

SEQ ID NO: 1977 - protein, 901 aa, Ostreococcus tauri
MPKCRVKFPSDLAKGTEVDAETIEDALQAFITKKPELKEILSSEKFRDFILVLSENQPENRDVIVPLDGKMSIAKDATYQAHLSRSYDLRSMTHPTRGYVVGRFRGERVPTFVAGEDAPVEWQMRRMKSEVNGTSMTLTGGKKSHRGTFVGTRDAQGASYFVLMSRGKEFVAMPCEEWYTFSHRAPRRVLTLEEAEAKMEAGKRAVGEAWGRMDKSAEPGGGRRRDLPGVDSIATTKTRGRSLVRLEERARKTRRERTGSTTRNGTTMRTSDAEDEGLDKEGLAVKKLLGKQEKMDGTQFSDSDSDSELEEDFNPDKDDIGVNVVGSFVKQSKKLEAEETKAATSPPAMMKSASVSSIGVKRSASDAAVDTAPPAYSNRSHHHRYRSQESGQHHGETHHQDVSQEGTAEQHRRRRGAQGGDQKLARHEKATKRRPSLSVEVIGLSSFTALARNRRPPMNSPTRHRESLRPRRSCRLKTFFARSPRRRRCTSLLPSYSSSLPDSEEEDFPAPQPAGDLTKRELATFDGKDPTKPILLAAKGVIYDVTRGRDFYGAGASYNAFAGKDCSRALGKVSLDAENLSANVRDFAASERDTLNGWVAKFQDKYPVVGKVKDGDYNGTLVANASIQLSTFGLARLLRELTKSETRHFDALSRHRGVALDAPRQTSVQLIGAGPGGADSLTLGAAKALARCDVVVHDDLGASSSSVLALATKPNVEFVSVGKRGGAARSWTQKDICALLVELGKSGKTVVRLKGGCPSTFARVSEEIKALRDAGVSYAMLPGVSSALSAPLSVGIPLTDRELGRHYSVCGAHDPSSIDFSAFSRIDTCVFLMVGRTLPLVVEALQGDARKAPSTPCCVIRNGMQPDERSWFGSLCDIVDKTTGESLSPCVLIVGEVVTLA

SEQ ID NO: 1978 - protein, 769 aa, Oryza sativa (japonica cultivar-group)
MENGRLYPERPRTFSTVRTKSSLPPIFRVLMRINPRAFIVLLLLVFSGVLYVGASTSPIVLFVFCICTLSLFFSLYLTKWVLAKDEGPPEMSEIYAVFFIGCLLDVQISDAIRDGAEGFFRTQYGTISKMACILALVILGIYLFRSTTPQQEASGVGRTTSAYITVASFLLGALCSGIAGFVGMWVSVRANVRVSSAARRSAREALQIAVRAGGFSAIVVVGMAVFGVAILYATFYVWLEVDSPGSMKVTDLPLLLVGYGFGASFVALFAQLGGGIYTKAADVGADLVGKVEQGIPEDDPRNPAVIADLASLFCLSCNIIDKNAKLSSDNSYPSGFILFPLVVHSFDLVISSVGILSIRGTRDSGLISPIEDPMAIMQKGYSITILLAVVTFGVSTRWLLYTEQAPSAWLNFALCGLVGIITAYAFVWISKYYTDYKHEPVRLLALSSSTGHGTNIIAGVSLGLESTALPVLVISVAIISAFWLGHTSGLVDESGNPTGGLFGTAVATMGMLSTAAYVLTMDMFGPIADNAGGIVEMSQQPESVREITDILDAVGNTTKATTKGFAIGSAALASFLLFSAYMDEVAAFAQLPFKEVDIAIPEVFVGGLLGSMLIFLFSAWACSAVGRTAQEVVNEVRRQFIERPGIMDYNEKPDYGRCVAIVASASLREMIRPGALAIISPMAVGIIFRMLGHATGRPLLGAKVVAAMLMFATVSGILMALFLNTAGGAWDNAKKYIETGALGGKGSESHKAAVTGDTGKQVRKYGFRK

SEQ ID NO: 1979 - protein, 193 aa, Zea mays
MGSASNPLVTSSVVDDSPLPSNLNQDDLKKLAAYKAVEYVKSGMVVGLGTGSTAKHAVARISELLRQGKLRDIIGIPTSTTTHEQAVSLGIPLSDLDSHPVVDLSIDGADEVDPALNLVKGRGGSLLREKMVEGASKKFVVIVDESKLVKHLGGSGLAVPVEVVPFCCDFTRGKLEELFREAGCKAKLRVKSG

SEQ ID NO: 1980 - protein, 641 aa, Ostreococcus tauri
MRAAVLFVLALVSRPCDGASARGVTSRFERPPASRDYYASLDSVRSGRALTETTRSSRAHLTPIGRGAVAVTWTTREALTSGTELEFADAGGRKRRAAIKSASWTEQLCLGSPNGFNPKMGPKPAIDAEALATIANTSSWADADASNYRVIGSFEDVVPSAFWSSAPWDKSACLDYSNPDAMYQSPIVHTAVLTGLKADERYSYSTPGGVGTKRTFKAPKAPKRGGRETTKIAVVGDTGQTEVTREVLTHVKEQLGDSEVLVHTGDLSYADGFAPRWDSFEAMSEFVLSEMPMLTVPGNHDVAQNGMELVSYLSRYPSPYVASKSPSQLFWSYEVGQAHIIGLNSYANTEVGIFDGADSPQIAWLKQDLAAINREYTPWVIVVFHVPWYNSNHAHFKEAERMRKALERILFDAGVDLILNGHVHSYERSHPVLNYDTQQCGPVHIVVGDGGNYEGPYGHGWIEPQPSYSAFREGSFGAGSLVIHDETRATWEWRRTTCVENTTSNESYFVKTGNAQTCRSIPDISAQAMEPVDSIELRRDTGACPNKMVGSAARSSASESPYTPRAASTASLYSAIVLLIILWVATTVALVRSLKMIRDMKARMYRSPALLSEGEFDDQFEASDDSAIALKNFARSENLNI

SEQ ID NO: 1981 - protein, 376 aa, Arabidopsis thaliana
MDDLLHQRVEQSQVTPPHDDSNIHGDFDNEATDESRSETCSVVIEGNCDMVIELGLESGSVIVENLGDSDIDVSNDFDEPDDDDFFVGRTDFGLEFRDIASSGNDIRLITVESGSDDDDGVENERELWGIDLNEEDVYVNDDDEYEDDDVSVTIPLCWDSLQLEDREVTADEFDWEEVGGGGGGGVDDEREIRSGFAQIDMNDESLISASPIISLEGLVTRERAEGSGNLGWEVLLNHTLEINFDVDNRELYIGGDHDDYVQDYDMLFEQFADAEVSVIGLPPTSKSFLNNLPVVLLEGENDDDGGLVCAVCKDEMNIGNKAVQLPCNHKYHSECIVPWLKVRNTCPVCRYELPTDDAEYEQRKTQRTTNTFGMVL

SEQ ID NO: 1982 - protein, 253 aa, Triticum aestivum
MADKENAAPAAAAGPRLTRAAAKRAATCSAGPSGGAKRKRVALSELPIVSNAGIVLRQPSKPAKPAAAAEGEEQHGGLSRCASTSPTPVGEEVSGGGGITQLSGSYASDIYTYLRTMEVEAPRRPAADYIEAVQTDVTANMRAILIDWLVEVAEEYKLVADTLYLTVSYVDRFLSANPLGRNRLQLLGVAAMLIASKYEEISPPHVEDFCYITDNTYTRQELLTMESDILKLLNFEIGSPTIKTFLRRFTRSG

SEQ ID NO: 1983 - protein, 331 aa, Oryza sativa
MASESDSFVRMMSEETHVEAYSLPMQNEDLHTSTNGAKGRAKRSSNFNRTEDVQLCISWQSISSDSIIGNEQPRKAYWQRIAEHYHANRDFESDRNANSLEHRWGNIQKEVRKFQGCYDQIERRHPSGIPHQELVLEVEALYSSNAPKNRAFQFNHCWLKLRNSPKFQTLESHKRPRSRKSSTPIEIAGEEDEEGDDARKSTTPDLSQPSAKKRPIGRKQAKEKLKNGGEDGPYKEAMKDLLDAKEKEAKVKEERWKETKEIQEHKLLFAERKLVWDQEQKIMFCDVSTLEPDVRTYVLAMRAQIAASKVAALNGGFDGSSGFGGEFGGGN

SEQ ID NO: 1984 - protein, 241 aa, Zea mays
IPLDPASVFLATEGTDIAVELYKLSISTLDLLKLASKEEQGDYVGAWYSMLLSCAQELKHGVALWQEFYHANVCDRVVSEGGHYFIALGEIYRVAQILYLSLQRFKPWVLADPGMLSKMLSCLDSCTYAWTSGLETALKMVIDSSHIDSSLAKALMESIKNITKLEVPNLQKNIPNNEMQCRLTLLPSSLLPGLNLVIWNGGHYFVKVANLWANRISPDPPLLPSNPTSSMNNAATHSQSC

SEQ ID NO: 1985 - protein, 377 aa, Kineococcus radiotolerans SRS30216
MSTASTATTTATTPAAPAVGSKQYSLAVLHGDGIGPEIVPASVKILDAAVAAAGATPIAWTELPLGRSAIDEYGEHTPTKTLDALDEVDGWLLGPHDSAAYPEPYRSQLNPSGTIRKHFGLFANIRPAKAFRGGNAIVEGTDLVIVRENTEGFYADRNTFAGTGEMMPTPDVAIMHGIITRAATERIAHEAFQLARTRDKRVTIVHKANVLKMTTGLFRDVCREVGKQYPDVAINDFHIDAATVHLVRRADKFDVIVTENMFGDILSDLAGEVAGSLGIAPSINSSATHAMAQASHGSAPDIAGRDIANPIAMILSSAMLLRWLAAKFDDEKIARAADIVEAAVDLTVAEGATTPDMGGTSSCSGFADAVVAATARV

SEQ ID NO: 1986 - protein, 257 aa, Arabidopsis thaliana
MSMSQSRAVQRSSSPNEDRGENQLVVYDLKGNDDTEEEVLPVQSQPLSSRTQCPSIGAFTVQCASCFKWRLMPSMQKYEEIREQLLENPFFCDTAREWKPDISCDVPADIYQDGTRLWAIDKPNISRPPAGWQRLLRIRGEGGTRFADVYYVAPSGKKLRSTVEVQKYLNDNSEYIGEGVKLSQFSFQIPKPLQDDYVRKRPARLLDSIDNTNTPVAKEANPLAWISPDDHISLQLGTPTESGLNNSHYQPSKKKKK

SEQ ID NO: 1987 - protein, 502 aa, Oryza sativa (indica cultivar-group)
MLAAVRRRRLLLLPLPLRFFSAAAAAAASTTTDPKVVSYLISSCGLTPAAAARAAATSPWLPLASPDFASNADAVVALLRRYGFTDADISATVRAFSRILASDPARTLQPKLDYLRSVGITAPLLPRVVSLSPVILHRSIESHLAPLIASLREVLGSDSRIVTALRQMPFAMRCSPKATFLRTLPVLRDVHGLTPSELSKLVASQPGVILLGPGRAGEIVQAVKDAGVEPGSPMFVYIFAAFSKLKAPTLENKFAIYRSLGFGKDDIAVMLRRLPNAAGISEERLKRTVGFLTGKAGLRREDIVAYPNLLSRSLDSHARRCAVLAVLRREGKPEGQHRVPHVLVASLARFMKAYVRRYEGEVPDVLRAINGEIPFEGFGLGELEKKKPQRQEKIRRALFFFPKNKSSIREKTSNLDKWGMAMLGGAAEHKNMHVSSPRRPRLPHGAGIGTWTDGLMVLIDSVDQRILCLVSLYAVCSICYRELNGFLNFRLLVFHILLRQKE

SEQ ID NO: 1988 - protein, 513 aa, Mannheimia succiniciproducens MBEL55E
MEIFKILTALADFRKEGIPSCLPVTLAGKSACSYIGKNMSKEIKTQVVVLGAGPAGYSAAFRCADLGLETVLVERYSTLGGVCLNVGCIPSKALLHVAKVIEDAKHVEHHGIVFGEPTIDLDKVREGKNAVVGRLTGGLAGMAKMRKVTVVEGLAEFADSHTLVAKDREGNPTTIKFDNAIIAAGSRPVQLPFIPHEDPRVWDSTDALALREVPKNLLVMGGGIIGLEMGTVYSALGSQIDVVEMFDQVIPAADKDIVKIFTKRIEQKFNLLLETKVTTVEAKEDGIHVSMEAKDGKVETRVYDAVLVAIGRTPNGKLIGAEKAGIEVTDRGFINVDKQMRTNVPHIFAIGDIVGQPMLAHKGVHEGHVAAEVIAGKKHYFDPKVIPSIAYTEPEVAWVGKTEKECKAENLNYEVATFPWAASGRAIASDCADGMTKLIFDKDSHRILGGAIVGTNAGELLGEIGLAIEMGCDAEDIALTIHAHPTLHESVGLAAEVFEGSVTDLPNPKAKKK

SEQ ID NO: 1989 - protein, 255 aa, Hordeum vulgare subsp. vulgare
MEDERSTQSYQGAEADQVEVTDRGLLGNLLGKKKEEEDKKKEEELVTGMEKVSVEEPEVKEDGEKKETLFSKLHRSSSSSSSSSDEEEEEEVIDENGEVIKRKKKKGLKEKLKEKLPGHKDNEAEHVTGLPAPMAPASVQTHHDTDVVVEKIDGDAKTEATPAVPEEEKKGFLEKIKEKLPGGHKKPEDAAAVPVTHAAPAPVHAPAPAAEEVSSPDAKEKKGLLGKIMDKLPGYHKTGEEDKAAAPSGEHKPRA

SEQ ID NO: 1990 - protein, 251 aa, Iris tectorum
MVNSWYQPQRGGVVAGLLVLLLPVIFPDLFAPLGHASPSTFSEWNAPKSRHLSLLKGALQREISEEQKAELWSPLKAQGWKPCIRSASNALLPTKSGGYVQVFLDGGLNQQRMGICDAVAVAKILNATLVIPHLEVNPVWKDTSSFDEVFDVEHFIQILKYDISIVRDLPSEYSWSTREYYATAIRATRIKTAPVHASANWYLENVVPVLQSYGIAAIAPFSHRLAFDNMTKDIQRLRCKVNFQAIKNLIH

SEQ ID NO: 1991 - protein, 445 aa, Arabidopsis thaliana; identical to SEQ ID NO: 875

SEQ ID NO: 1992 - protein, 347 aa, Salmonella enterica subsp. enterica serovar Typhi str. CT18
MKLALVNRQVILPESGTESFQCHASTLVRLPCGTLVAAWFAGLCEGSEDTAIWLSRYEHNIWTTPQRVAAREGEAHWNPVLFYPSDKLWLFYKVGSGVHVWKTWFITSSDRGFTWSTPAPLVNDDILPRSPVKNKLLLASNGAWIAPGSIESPERWRAFVDRSSDEGKHWNISFVPLEPDNAISGTNVALWDGVKKGMLWECCLENLLRWDGVIQPTLWESSPGHIHMLLRSTRGAIFRSDSIDYGATWSVARATFLPNNNSGIDLVSMQDGTLILALNPVNGNWGKRYPLSLIASQDNGESWLPLLDLESDHGEYSYPAIISKGGVVHITYTWNRKNIVYCRLQTV

SEQ ID NO: 1993 - protein, 503 aa, Geobacillus kaustophilus HTA426
MAVQPKVLHYINGQFVEGAAGAYFDNINPFTNGTINQIAEGRKEDIDAAVRAAKEAFDHGPWRTMPVERRLRYLFRIADLIEQYADDIAYLEALDTGIPISQAKKQAARAAENFRFYAEMVKTRLVGEAYHVNGQFLNYTVYKPVGVAGLITPWNTPFMLETWKVAPALATGNTVVLKPAEWSPLTANKLAEIIDEAGLPRGVFNVVHGFGETAGAALVAHPDVRLISFTGETTTGMEIIRNSAATLKKTSMELGGKSPLIVFADADLERALDAAVWGVFSLNGERCTANSRLLLEQSIYDEFVARLKERVDRIVIGDPMAPATELGPLIHRAHWERVNRYIDIAKQEGADVYAPSVPTGLEKGNFVPPTLLLGCHNGMRVAQEEIFGPVMAVMSFADEEEAIRLANDVKYGLAAYVWTNDMKRGHRVAQAIESGMAWVNSPNVRDLRIPFGGTKYSGIGREGGHYSFDFYTEVQVVHVAVGDPPIPSFGKAKPPSALSAEQK

SEQ ID NO: 1994 - protein, 318 aa, Vibrio vulnificus YJ016
MNKAHSRAEEYPMNKLVVLGSVNADHVLQVPSFPRPGETLHGRNYQVIPGGKGANQAVAAARLGADTGFIACVGDDSFGINIRENFKLDGIQIDGVKMQPNCPTGIAMIQVSDSGENSICISAEANAKLTEAAIESDLPRIRDARFLLMQLETPICGIELAAREAKAAKTNVILNPAPARTLSDELLACIDVITPNETEAQVLTGIEVVDNESAQQAANVLHQKGIEIVMITLGSKGVWLSENGRGQRICGFKVDVTDTTAAGDTFNGALVTGLLEDMPLESAIKFAHAAAAISVTRFGAQTSIPTRKEVDEFLAAHS

SEQ ID NO: 1995 - protein, 505 aa, Saccharomyces cerevisiae
SHGDMVQCDGCDTWQHIKCMTDGKDTIDGLMSEDSKYYCELCDPSLYAHLETSKEAEVSEDEDYHDDVYKPVNDHDDNDADVFLDEESPRKRKRSPDSAKGIHIKSKQVKKSNGSKKRNKSIDAAKSDTAENEMPTRKDFESEKEHKLRYNAEKMFSTLFSKFIVPETIEAKLYELPDGKDVISISQEFAHNLEEELYKACLNVEFGTLDKIYTEKVRSLYSNLKDKKNLELKAHVVEGKLPLNKLVNMNASELANPDLQEFKEKRDKIILENFIVEVPDKPMYVKTHKGDELIEDIAEPQEDILYSKDSIRLHNIDSIDSDKSKIEQTHAISKEPSPSTIINEESLNCAFLYPGLGLEFTGYLNYIGASQKLRRDIFKEAIGDGKLYVEGRLPTTTAAPYLKEISCSRAILVYQLFPSNDSESKTTFADVVDSLENKGRIAGIKPKTRYEKDFYIVPSKGGEIPEILKDILGSHNDERSERFSRMKSDERTLFAFVVVKQEFIH

SEQ ID NO: 1996 - protein, 230 aa, Ostreococcus tauri
MASTMDDGEARRGGEATTSASSGLPVRVLVEAAMLAAMTGLSFHISSLFRFDAYFGALFPLPVVIACARWGSAAARRTLVVATLARPKTTMSSNELAPRRLAPCTLAHADRALWSSGASWWVTVPASALTRTFGIVCSLSVSSLLYRENVMKLLVTQMYALLDQFAANVGATFAPDITWVWATAMVLILVNSLSYTLILHMVYTIVLNAVTRRNFANAPAKVCRALGVPF

SEQ ID NO: 1997 - protein, 313 aa, Geobacillus kaustophilus HTA426
MAYHEAKERLRGSIAPVVTPFDEEGNVDFAALAALIDWHIESGTHGISVTGTSGEPSSLTLEERKQVMETAKKAVAGRVPFVPGTGSTNHAETIELTKFAQEIGADAAMVIVPYYNRPSQQALYKHFKAVAEAVDIPIIVYNIPGRTAVNLEVKTLARLAEDCPNIIGVKESNKDFEHVNRVLWHCGRDFLLFSGIELLCYPMLAIGGAGSISATANVVPHKVAELHDAWFEGDIKRAQDLHFELMELNDVLFIETNPGPVKAALGMMGKITPKLRLPLDLPSEEHQQQIRRTLVKYGLLAEETQDEEMQKAT

SEQ ID NO: 1998 - protein, 378 aa, Vibrio vulnificus YJ016
MRSILQQQKPPFIWLNIVIFVTSLILALVVTPWYGIKEGFGFEHLIWLLVTFSFTNLSITAGYHRLWSHKTYEAHPLLRVVFAIGGAFSLQNSALHWSSDHRMHHKFVDHHDKDPYSASRGFWFSHIGWMLRDYNQSTYNDYTNCRDLRKDPVIMWQHKYYVPLAIATNLGIPLLLGWYYQDIIGMLLVVGALRLTLSHHSTFFINSLAHIWGKQTFTDKNSARDNGFLAVLTFGEGYHNFHHIFENDYRNGIYWWQYDPTKWLIKSCSWLGLTRNLRLTPQMKIDKARAATRLKNALNQLAQRGEQESLKQQLQLEFDGLVATMKDYYDAKKQLLECKKQTALKKYEVALVKIRYQQAKEDLLSRYKRWHALTAHYA

SEQ ID NO: 1999 - protein, 438 aa, Cryphonectria parasitica
MPISKIHARYVYDSRGNPTVEVDLVTETGLHRAIVPSGASTGQHEACELRDGDKSKWLGKGVLKAVENVNTVLGPELIKAGLDVKDQTAVDEFLIKLDGTANKTKLGANAILGVSLAVAKAGAAEKGVPLYAHVSDLAGTKKPYVLPVPFQNVLNGGSHAGGRLAFQEFMIVPSAAPSFSEGLRWGAETYHQLKSLAKKKYGQSAGNVGDEGGVAPDIQTAEEALELISEAIEKAGYTGKMKIAMDVASSEFYKEDVKKYDLDFKNPDSDPSNWLTYEQLAALYADLTKKYPIVSIEDPFAEDDWEAWSYFYKTQDIQLVADDLTVTNPIRIKKAIELKAANALLLKVNQIGTLTESIQAAKDSYADGWGVMVSHRSGETEDVTIADIVVGIRAGQIKTGAPARSERLAKLNQILRIEEELGSNAIYAGEDFRKSVTL

SEQ ID NO: 2000 - protein, 397 aa, Bacillus halodurans C-125
MANPNLKEEAIALHQKHSGKLEIVGKMEITDEKDLSLVYTPGVADVCKQIAEQPDKVNSLTSRGNMVAIVTDGTAVLGLGNIGPKAAMPVMEGKALLFKKFANIDGFPVCLNTQDTDEIVQIIKALSPTFAGINLEDIAAPRCFEIEERLKEELDIPVFHDDQHGTAIVVLAALTNALKVVNKLNQPIKMVINGAGAAGTAIANLLLHAGFKDITLVSLEGVVAKGEAWLNPMQAKMAEVTNLAGVKGTLKDAITDADVFIGVSGPGAMKKEHIQAMAKDPIVLALANPIPEIYPEEAIEAGAAVVGTGRSDYPNQVNNLLAFPGIFRGALDAGAKTITMEMKIAAAYAIADVLSDKEVNANMIIPDALDARVAQRVAEAVATTALQRERVAALSAN

SEQ ID NO: 2001 - protein, 311 aa, Solanum tuberosum
MATDFKFIPVIDVSPLLEKWDHPNIAQDEGVAQVVKQLDQACRDAGFFYVKGHGIPVSLMKEIKNIAREYFHQPYEEKIEIKLSAETGYRGYQRIGENITKGKPDIHEAIDCYREVKHGMYGGLGDVMQGSNIWPTNPPNFKQLMEEYIDRCTDLSRKIMRGIALALGGSADEMEGDIGGDPFWVLRIIGYPAASISNGHDKAHDDVGCGAHTDYGLLTLVNQDDDIVALQVRNKSGEWISAPPIPGTFVCNIGDMLKILSNGIYESTLHRVINNSPKYRVCVAYFYEPNFDAGSRATGCVFTEDWWHQEF

SEQ ID NO: 2002 - protein, 883 aa, Mannheimia succiniciproducens MBEL55E
MSQMINDVDPIETSDWLLAIDSIIREEGVERAQFIIEELMQHARSKSVALPTGATTEYVNTIPPSEQPPYPGNLSIERRVRSAIRWNALMMVLRAQKKDLELGGHISTYQSAASIYEVCFNHFFKAATEKNGGDLVFFQGHAAPGIYARAFVEGRISQEQMDNFRQEAKANGLSSYPHPKLMPDFWQFSTVSMGLGPVNAIYNARFLKYLNNRGLKDTTDQTVYAFLGDGEMDEIESKGALTLAAREGLDNLIFVISCNLQRLDGPVNGNGKIVQELEGLFFGAGWEVIKVMWATGWDKLFAKDTSGKLTKLMMEVVDGDYLTFKSKNGAYIREHFFGRYPETAALVADMTDDEIWALRRGGHDTEKMFAALARAKKSDKPVVILAQMVKGYKIPEAESKNTAHQTKKMSHASLKSFRNHFDLPLTDEQIDNYEYITFAPDSEESKYLHERRAALNGYVPARLPKFTTEFKVPALEDFSQLLEEQPRAISTTMAFVRVLNTLLKNKDIGKQIVPIIADEARTFGMEGLFRQVGIYNPHGQNYVPSDKELVAYYREAKDGQVLQEGINELGATASWLAAATSYSVNNLPMIPFFIYYSMFGFQRVGDMMWAAGDQLARGFMIGGTSGRTTLNGEGLQHEDGHSHIQAGVIPNCVSYDPAFAFEVAVIMQDGINRMYGEKQEDVFYYITTLNETYDQPAMPAGVEDGIRKGIYKFETVGKGEAAIQLMGSGAILRHVRQAAQILADDYGIASDVFSVPSFTEVAREGADVARWNLLHPTETQRVPYIAQVMSDKPAVAATDYMKLYAEQVRAFIPAQSYHVLGTDGFGRSDSRENLREHFEVDAHYVVVAALNELAKQGKLEKQVVADAIAKFGLDVDRINPLYA

SEQ ID NO: 2003 - protein, 249 aa, Brassica napus
MNGFSDLNSSESKPSLSHLAPLEAILFDVDGTLCDSDPIHLIAFQELLQQIGFNNGVPIDEKFFIKNIGGKHNSQIALALFPNDVTRGLEFCEEKEALYRKLVAEKIKPLDGLIKLTKWIEERGLKRAAVTNAPKENAELMISKLGLTDFFQAVILGSECEYPKPHPGPYLKALEVLNVSKEHTLVFEDSVSGIKAGVAAGMPVVGLTTGNPASMLMQAKPAFLIENYADPKLWAVLEELDNKGTFQKS

SEQ ID NO: 2004 - protein, 186 aa, Magnaporthe grisea 70-15
MRVIIDEIGVDVLTGVVKSESWLALKTRNFYSLSVLWGILGPKVFFSSGSDYAWIYWAFLIGPALVLMVYIVHRWRPSWDMEKMCNPVVIMHGATWFPVYQTTNLMTSALVAFFFMGYMLRYRPVWFRKYNYLLGVGLDCGTQLCQTVIMLGLDLSGSKFPNWWGKDLEYVERCFPPADLPANALN

SEQ ID NO: 2005 - protein, 498 aa, Oryza sativa (indica cultivar-group)
MASKPSSRAESNQAAAAVPSLYGRALPSPPAVEFASAEGRRLFAEALQGGTMQGFFSLVSVFQTQSEPAFCGLATLAVVLNALRIDPGRRWKGPWRWFDESMLDCCERLDTVRAEGITFGKVACLAHCSGADVRTFRAAQATLADLRRHLLRCASSQDCHLVASYHRKLLGQTGTGHFSPIGGYHAGQDMALILDVARFKYPPHWIPLPLLWEAMNTIDEATGLLRGFMLISRNTEAPLLIRAVNCRDESWQSMAKYCIEVVPNLLRDNSVDNVLTILSRLVNHLPPNAGNFIKWVIEVRRQEEGGSSPSKEANEMPFLKEKILQQIRDTKLFQLVHKLQCSKQPCFSCSSLTDEDSISQIAASVCCEATALLSGNLSSRDGLFFSETCSGCTQVNDEGLKNGITGKVVSEGNGHVDKLSPISSTETCFCNSTLSNETVNYPSNTDILTVLLLSLHPSTWLCIEDEKLKAEFQSLVSTDDLPDPLKLEVCCLTPRTLH

SEQ ID NO: 2006 - protein, 396 aa, Zea mays
  misc_feature (162)..(162): Xaa can be any naturally occurring amino acid
  unsure (1)..(396): unsure at all Xaa locations
MDFSTGGSVSGGGGGASDGPAQAERWLEIAEKLLAARDLVGCKRFAERSVEANPLLAGVDELLAVADVLLASQFMGTSGQPDPLAILQLPPGVSPDQAAVSRAFRRLALLLGPSNPHPGAEMALRLVNDAYAFLSDPSRRPPPPADPATGTPYSSQYPAGPXPAPDPREFWTACPFCCYVHQYPRGLVGRALKCPNAGCRRGFVASEIPTPPTVVPGTDMYHCAWGFFPLGFPNAADLGANWKPFYKAFPWNTAPSGQGGGGRSHGNRGGRQAQNDSARGGSSRGRIKKTTARKKVGVGLRRRSLGVESGIDSSMLGQEGWAGDENAGDGRAEEVRRININEAAHATDGTGRVNVSGAGGVEDIGNFHIDVDASEDILGNLHNMHFLRVDNLGRMI

SEQ ID NO: 2007 - protein, 484 aa, Burkholderia mallei ATCC 23344
MTTMPLRDHAAYRRETLRWCGQRAARARTLDVFDPYSGLRVGTVPLATVDDVRRAFDYAVAYRPALSRYERSQILERAAARLTARAEEASTLISLESGLSKQDSRYEIGRVADVFKFASIEALRDDAQSYSCDLTPHGKSRRVFSQRQPLDGVIVAITPFNHPMNQVAHKIAPAIATNNRVIVKPSEKVPLSALYLADVLYEAGLPEPMLQVLTGDPREIADELLTHPSATLITFTGGVAIGKSIAAKAGYRRIVLELGGNDPLIVLDDADLERAAALAAQGSYKNSGQRCTAVKRILVHKRVAPRFTELLVEHTRAWTYGDPFDPANRMGTVIDEAAAALFEARVDEAVAQGARLLTGNARRGALYAPTVLDRVDASMTLVREETFGPVSPIIAFDTIDDAIRISNGTAFGLSSGVCTDRADAIVRFVNELNVGTVNVWEVPGYRLELTPFGGIKDSGLGYKEGVQEAMKSFTNLKTFSLPWA

SEQ ID NO: 2008 - protein, 336 aa, Bacteroides thetaiotaomicron VPI-5482
MRIGILTSGGDCPGINATIRGVCKTAINHYGMEVIGIHSGFQGLLTKDIESFTDKSLSGLLNQGGTMLGTSREKPFKKGGVVSDVDKPALILQNIQEMGLDCVVCIGGNGTQKTAAKFAAMGVNIVSVPKTIDNDIWGTDISFGFDSAVSIATDAIDRLHSTASSHKRVMVIEVMGHKAGWIALYSGMAGGGDVILVPEIPYNIKNIGNTILERLKKGKPYSIVVVAEGILTDGRKRAAEYIAQEIEYETGIETRETVLGYIQRGGSPTPFDRNLSTRMGGHATELIANGQFGRMIALKGDDISSIPLEEVAGKLKLVTEDHDLVIQGRRMGICFG

SEQ ID NO: 2009 - protein, 497 aa, Arabidopsis thaliana
MEMTLMVSLCLTTLLTLLLLKKFLKRTAKKVNLPPSPWRIPVIGNLHQLSLHPHRSLHSLSLRYGPLMLLHFGRVPILVVSSSEAAHEILKTHDLKFANRPKSKAVHGLMNGGRDVVFGPYGEYWRQMKSVCILNLLTNKMVASFEKVREEEVNAMMEKLEKASCSSSAENLSELFVTLTSDVTSRVSLGKKYWEDETAGGLKKRVRQIMELLREFPIGDYVPALAWIDRINGFNSKIVEVSRAYSDLMEKVVQEHLEAGEHKADFVNILLSIEKEKNNGFKVQRNDIKFMILDMFIGGISTSSTLLEWIMTELIRNPECMKKLQNEIRSTIRPHGSYIKEKEVENMRYLKAVIKEVFRVHPPLPLILPRLLTEDVKVKGYDIAAGTEVLINAWSIHRDPAIWGPDAEEFKPERHLDSTLDYHGQDLKYIPFGSGRRICPGINLAMGLVEVTLANLVGRFDWSVDPGPNGDQPDLAEDFGLDVCRKNPLIAFPSSVA

SEQ ID NO: 2010 - protein, 262 aa, Triticum aestivum
MAQPAELSREENVYMAKLAEQAERYEEMVEFMEKVAKTVDSEELTVEERNLLSVAYKNVIGARRASWRIISSIEQKEESRGNEDRVTLIKDYRGKIEVELTKICDGILKLLDSHLVPSSTAPESKVFYLKMKGDYYRYLAEFKSGTERKDAAENTMVAYKAAQEIALKELPPTHPIRLGLALNFSVFYYEILNSPDRACDLAKQAFDEAISELDSLSEESYKDSTLIMQLLRDNLTLWTSDISEDAAEEMKDAPKGESGDGQ

SEQ ID NO: 2011 - protein, 340 aa, Zea mays
MEKKTKQNGQWKPPCRAEADGQSDTVRGSQEGYPPAPTPPRRNAATTSAAAAAVTGAGWCFCSGGGGDDGGRSERVKAAIFSARASALAAVRAQGRHHGSGLLIHRNLLLTTHGNLPSAAAAEDADALLGQGRLVARLEPHSLRSACGREGMTGRCRAGPPPRCGIPHSSGLSVVDFVFDELDDVLRYYPQGYHGVDRESQPVYIEKLGKVDPNKLMQITSVDRYIKYHVQEFERAFRERFTACTLAAKRNIDSTTTILDVQGAGFKNFSKTARKLVHRMQKIDSDYYPEVLGSNYQSRLLEVIDSSELPEFLGGSCTCSDEGGCPGSNKGPWNDPYILK

SEQ ID NO: 2012 - protein, 1045 aa, Saccharomyces cerevisiae
MSLPLKTIVHLVKPFACTARFSARYPIHVIVVAVLLSAAAYLSVTQSYLNEWKLDSNQYSTYLSIKPDELFEKCTHYYRSPVSDTWKLLSSKEAADIYTPFHYYLSTISFQSKDNSTTLPSLDDVIYSVDHTRYLLSEEPKIPTELVSENGTKWRLRNNSNFILDLHNIYRNMVKQFSNKTSEFDQFDLFIILAAYLTLFYTLCCLFNDMRKIGSKFWLSFSALSNSACALYLSLYTTHSLLKKPASLLSLVIGLPFIVVIIGFKHKVRLAAFSLQKFHRISIDKKITVSNIIYEAMFQEGAYLIRDYLFYISSFIGCAIYARHLPGLVNFCILSTFMLVFDLLLSATFYSAILSMKLEINIIHRSTVIRQTLEEDGVVPTTADIIYKDETASEPHFLRSNVAIILGKASVIGLLLLINLYVFTDKLNATILNTVYFDSTIYSLPNFINYKDIGNLSNQVIISVLPKQYYTPLKKYHQIEDSVLLIIDSVSNAIRDQFISKLLFFAFAVSISINVYLLNAAKIHTGYMNFQPQSNKIDDLVVQQKSATIEFSETRSMPASSGLETPVTAKDIIISEEIQNNECVYALSSQDEPIRPLSNLVELMEKEQLKNMNNTEVSNLVVNGKLPLYSLEKKLEDTTRAVLVRRKALSTLAESPILVSEKLPFRNYDYDRVFGACCENVIGYMPIPVGVIGPLIIDGTSYHIPMATTEGCLVASAMRGCKAINAGGGATTVLTKDGMTRGPVVRFPTLIRSGACKIWLDSEEGQNSIKKAFNSTSRFARLQHIQTCLAGDLLFMRFRTTTGDAMGMNMISKGVEYSLKQMVEEYGWEDMEVVSVSGNYCTDKKPAAINWIEGRGKSVVAEATIPGDVVKSVLKSDVSALVELNISKNLVGSAMAGSVGGFNAHAANLVTALFLALGQDPAQNVESSNCITLMKEVDGDLRISVSMPSIEVGTIGGGTVLEPQGAMLDLLGVRGPHPTEPGANARQLARIIACAVLAGELSLCSALAAGHLVQSHMTHNRKTNKANELPQPSNKGPPCKTSALL

SEQ ID NO: 2013 - protein, 646 aa, Mesorhizobium sp. BNC1
MCGFGGYFGAGVSEAEPLLRRMASAIAHRGPDERGTAVLDGAGLCHTRLSIVGLADGQQPMSLDGGRLTIAFNGEIFNYVELREALIARGRTFRTASDTEVILHLYDEKGPDCLADLNGDFAFAIWDAPRRRMFLARDRMGVRPLFYTSVGDRLFFASEVKTLLQVPGVEAEMDPFALDQMFTLWAPIAPRTAFKNIHELEPGHMMLVEEGRQAIRPYWSLSFPEHGAPSRHTDERAVAEELRALLTDATRLRMRADVPVGSYLSGGLDSSVISALAAGMTPEILRTFSVAFESAEHDESAFQNEVAAALGTMHASVNCGDGDIAAVFPDVIRFTERPILRTAPAPLFKLSALVRERGLKVVLTGEGADEVFAGYDIFKEARVRRFCARQPGSRMRPHLFRKLYPYLPGLKQQSAEYLAAFFGAGADSLDDPLFSHKPRMRATGAAKLFFSAQLRETLAGYDAAEELASRLPQEFPRWHPLHQAQYLESRFLLPGYILSSQGDRMAMAHGIEGRFPFLDHRLVEFATTLPPEMKLKGLVEKHILREATKGLLPESILRRTKQPYRAPDSASFRGAGEKDYVREAMSAEKLADCGLFNPASVSKLFAKSRQQPLSGFRDNAAFVGILSSQLWLETFTGSRIRAVEAA

SEQ ID NO: 2014 - protein, 58 aa, Zea mays
  misc_feature (32)..(32): Xaa can be any naturally occurring amino acid
  unsure (1)..(58): unsure at all Xaa locations
AGIIDNTRAPAFAMDYWPLPAEAKLNDLLTVXRADKAHHLDVKHSGSDILYQGMNLKD

SEQ ID NO: 2015 - protein, 389 aa, Mycobacterium sp. MCS
MTVSRLRPYAVTVFAEMSALAARIGAVNLGQGFPDEDGPASMLEVARQAIADGVNQYPPGLGIAPLREAIAAQRKRVHGVDYDPDTEVLVTNGATEAIAAAVLGLVEPGSEVLLVEPFYDSYSPVLAMAGCHRVAVPMVEHGRGFAIDVDGLRRAITPRTSALIVNSPHNPTGMVASDAELAAIAELAVEHDLLVITDEVYEHLVFDGYEHRPLAAYPGMSGRTVTISSAAKMFNVTGWKIGWACGAADLIAGVRAAKQYLTYVGGAPFQPAVAHALDHEDAWVAALRDSFQHKRDRLGSALAELGFAVHDSAGTYFLCADPRPLGYDDSTTFCADLPERAGVAAIPMSAFCDPHSPHIDRWNHLVRFAFCKRDDTLDEAIRRLQVLRR

SEQ ID NO: 2016 - protein, 257 aa, Solanum tuberosum
MARKFFVGGNWKCNGTVEEVKKIVTTLSEAEVPSEDVVEVVISPPFVFLPLVKTLLRRDFSIAAQNCWVRKGGAFTGEVSAEMLVNLGIPWVILGHSERRLLLNESNDFVADKVAYALSQGLKVIACVGETLEQRESGSTMAVVAAQTKAIAEQVMHWSNVVLAYEPVWAIGTGKVATPAQAQEVHFELRKWLHVNVGAEVAASTRIIYGGSVNGANCKELAAQPDVDGFLVGGASLKPEFIDIIKSATVKTTAKSE

SEQ ID NO: 2017 - protein, 299 aa, Lactobacillus paracasei
MAQKTMIQAITDALDVELANDPKTLVFGEDVGKNGGVFRATDGLQAKYGEDRVFDTPLAESGIGGLSIGLALTGWRPIPEIQFFGFVFETMDSIGGQMSRMRYRMGGTRSMPITIRAPFGGGVHTPEMHSDNFEGLIAQFPGMRVVIPSNPYDAKGLLISSIRSNDPVLFLEHMKLYRSFRADVPEGTYTVPLDKAAVTREGSDVSIITYGAMVREALKAADNLAKDGIQAEIVDLRTIAPLDVETIINSVKKTHKVVVVQEAQRMAGVASTVISEISERAILSLEAPIGRVAAPDTRA

SEQ ID NO: 2018 - protein, 602 aa, Oryza sativa
MDSDYGVPRELSALQKARALYRPDLPPCLQGTTVKVEYGDAAIAADVAGAHVISHAFPHTYGQPLAHFLRKTAAVPDATVITEHPVVRVGVVFSGRQSPGGHNVIWGLHDAIKAHNANSKLIGFLGGTDGLFAQKTLEISDEVLSSYKNQGGYDLLGRTRDQIRTTEQVNAAMTACQALKLDALVIIGGVTSNTDAAQLAETFAESKCSTKVVGVPVTLNGDLKNQFVETTVGFDTICKVNSQLISNVCTDALSAEKYYYFVRLMGRKASHVALECALQSHPNMVILGEEVAASKLTIFDITKQICDAVQARAEKDKNHGVVLIPEGLVESIPELYALLQEIHGLHDKGVSVENISSHLSPWASALFEFLPPFIRKQIETEKLLAQLVEAEMNKRLKEGTYKGKKFNAICHFFGYQARGALPSKFDCDYAYVLGHVCYHILAAGLNGYMATVTNLRSPVNKWKCGAAPITSMMTVKRWSRGPAASQIGKPAVHMASIDLKGKPYELLRQNSSSFLMEDIYRNPGPLQFEGPGGETKPISLCVEDRDYMGRIKQLQEYLEKVKSIVKPGCSQDVLKAALSAMASVTEMLTIMSSPSFSGQATI

SEQ ID NO: 2019 - protein, 118 aa, Brassica napus
  misc_feature (16)..(16): Xaa can be any naturally occurring amino acid
  misc_feature (21)..(21): Xaa can be any naturally occurring amino acid
  misc_feature (39)..(39): Xaa can be any naturally occurring amino acid
  misc_feature (42)..(42): Xaa can be any naturally occurring amino acid
  misc_feature (53)..(53): Xaa can be any naturally occurring amino acid
  misc_feature (56)..(56): Xaa can be any naturally occurring amino acid
  misc_feature (60)..(60): Xaa can be any naturally occurring amino acid
  misc_feature (64)..(64): Xaa can be any naturally occurring amino acid
  misc_feature (67)..(67): Xaa can be any naturally occurring amino acid
  misc_feature (82)..(82): Xaa can be any naturally occurring amino acid
  misc_feature (84)..(85): Xaa can be any naturally occurring amino acid
  misc_feature (89)..(89): Xaa can be any naturally occurring amino acid
  misc_feature (93)..(95): Xaa can be any naturally occurring amino acid
  misc_feature (97)..(97): Xaa can be any naturally occurring amino acid
  misc_feature (99)..(99): Xaa can be any naturally occurring amino acid
  unsure (1)..(118): unsure at all Xaa locations
MASSMLSSAAVVTSPXQATMXAPFTGLKSSAAFPVTRKXNNXITSIASNGGRXSCXKVWXTSWXRRXLRPSSYLPDLTEVQXVXXKVDXLPPXXXGXPXVPVGTGFFGTSPTVYALLF

SEQ ID NO: 2020 - protein, 298 aa, Ostreococcus tauri
MRATSSVTRGTFVPRARTLGKGRGGARRTRSRVMSTRAAMTQDELKKLVGYKSVDDHVESGMVVGLGTGSTAYFAVERVGQKLASGELKNVICIPTSERTREQAESLKIPLCTLNEKSELDVAIDGADEVDPALALVKGGGGALLREKMVEVMAKKFVVIVDESKLCKGLGPGFPLPVEITPFCHMHTLRTIAKLPALAGCEAILRMGSSSNNKIDGDNIAVTDNGNYIVDLHFKSPIKDPVAAASQLKNCVGVVDHGLFVDMAYQVIVAGSDGIRVAGTDGEKPWCLLIRNNDESTS

SEQ ID NO: 2021 - protein, 430 aa, Geobacillus kaustophilus HTA426
MSAIIDVYAREVLDSRGNPTVEVEVYTEDGGFGRALVPSGASTGEYEAVELRDGDKNRYLGKGVLKAVENVNEIIAPEIIGLEVADQVAIDRKLIELDGTENKSKLGANAILGVSLAVARAAADELGLPLYQYLGGFNAKTLPVPMMNILNGGAHADNNVDIQEFMIMPVGAESFREALRMGAEIFHSLKAVLKAKGYNTAVGDEGGFAPNLKSNEEALQTIIEAIEKAGYKPGEQVMLAMDVASSELYNKEDGKYHLEGEGVVKTSEEMVAWYEELVSKYPIISIEDGLDENDWEGHKLLTERLGKKVQLVGDDLFVTNTKKLAEGIEKGVGNSILIKVNQIGTLTETFDAIEMAKRAGYTAVVSHRSGETEDSTIADIAVATNAGQIKTGAPSRTDRVAKYNQLLRIEDELGHTAIYQGIRSFYNLKK

SEQ ID NO: 2022 - protein, 160 aa, Myrica gale
MSTVEGREFSEDQEALVVKSWTVMKLNAGELALKFFLKIFEIAPTAQKLFSYLKDSNVPLERNSKLKSHATNVFMMTCESAVQLRKAGKVTVTESSLKRIGDVHFKLQVVDEHYEVTRFALLETIKEAVPEMWSPEMKNAWGEAYDQLVSAIKTEMKPPS

SEQ ID NO: 2023 - protein, 394 aa, Anabaena variabilis ATCC 29413
MARIETRTEPMVLNMGPHHPSMHGVLRLIVTLDGEDVVDCEPVIGYLHRGMEKIAENRTTVMYVPYVSRWDYAAGMFNEAVTVNAPEKLAGVAVPKRASYIRVIMLELNRIANHLLWFGPFLADVGAQTPFFYQFREREMIYDLWEAATGYRMVNNNYFRVGGVAADLPYGWVDKCLEFCDYFLPVVDEYEKLVTNNPIFRRRIEGIGTISREEAINWGLSGPMLRASGVKWDLRKVDHYESYDDFDWDVQWETAGDCLARYTVRMREMRESVKIIKQAIKGLPGGPYENLEAKRLIAGKKSEWDAFDYQYIGKKVSPTFKMPKGEIYARVESGKGELGIYLIGDDNVFPWRWKIRPADFNNLQILPHLLRGMKVADIVVILGSIDVIMGSVDR

SEQ ID NO: 2024 - protein, 232 aa, Methanosarcina barkeri str. Fusaro
MTERNISTDSPEKRAAGIAASRMVESGMVVGLGTGSTVAYTIKELGRRVRDEGLEILGVVTSYQSETLAIEAGIPLTTLAQHSELDIAIDGADQVDSKLHAIKGGGAAHTREKIVSASARRFLVVADESKTSTQLDKPIPVEVLPFAKTLVIKKIKQLGGKPEPRLALRKDGPVITDNGNFVLDANFGVINDPEGLALQLSSIPGVVEHGIFSNVDELYIGKKDGSVEIVKK

SEQ ID NO: 2025 - protein, 1499 aa, Aspergillus nidulans FGSC A4
MSSFLGTGTFNTSVSPSQAVESRGIENHGNAITETETLHNESHAESPGEKLASSSNSILSSTETAREKDERDYELDAEEEVTRLAQQLTHQSTKYSTHNIENPFLEVGEDSTLNPHSPNFKAKNWMKNLLALSSRDPERYLPRQAGVSFTNLSVHGYGSPTDYQKDVFNSVLQIGGLVRSMMGHGKQKIEILRNFDGLVKAGEMLVVLGRPGSGCSTFLKTIAGEMNGIFMDEKSQLNYQGIPAKQMRKQFRGEAIYTAETDVHFPQLSVGDTLKFAALARCPRNRLPGVSREQYAVHMRDVVMAMLGLSHTINTRVGNDFVRGVSGGERKRVSIAEATLSASPLQCWDNSTRGLDSANALEFCRTLNLMAKYSGATMAVAIYQASQSAYDVFDKVTVLYEGRQIYFGRTDDAKQFFIDMGFECPERQTTADFLTSLTSPAERIVRKGYEGRVPQTPDEFAAAWKNSDAYAQLMREIEEYNQEFPLGGESVNKFIESRRAMQSKNQRVKSPYTMSVMEQVNLCMIRGFQRLKGDASLTLSQLIGNFIMALVIGSVFYDLDNDTGSFYSRGALLFFAVLLNAFGSALEILTLYAQRPIVEKQARYAMYHPFAEAIASMLCDMPYKITNTFTFNIPLYFMTNLRREPGAFFIFLLFSFVTTLTMSMLFRTMAATSRTLSQALVPAAILILGLVIYTGFTIPTRNMLGWSRWMNYIDPIAYGFESLMVNEFHGRLFPCSESELVPSYGDTANRVCAVVGATPGELMVNGTTYLRESYQYTKSHEWRNLGIMFAFMAFFLFTYLTATEYISEAKSKGEVLLFRRGQAPPSVNDVETHSPATAGEKVDQSTQDVANIQRQTAIFHWKDVCYDIKIKNEPRRILDHVDGWVKPGTCTALMGVSGAGKTTLLDVLATRVTMGVVTGEMLVDGRPRDQSFQRKTGYVQQQDLHLHTTTVREALRFSALLRQPAKTPRQEKLDYVEEVIKLLGMEAYADAVVGVPGEGLNVEQRKRLTIGVELAAKPQLLLFLDEPTSGLDSQTSWSILDLIDTLTQHGQAILCTIHQPSAMLFQRFDRLLFLAKGGKTVYFGEIGEKSSTLASYFERNGAPKLPADANPAEWMLEVIGAAPGSHSDIDWPAVWRESPERQAVHQHLAELKETLSQKPTETSASDPSEYNEFAAPFSVQLWECLVRVFSQYWRSPVYIYSKAALSILTSLYIGFSFFQAQNTRQGLQNQMFSIFMLMTIFGNLVQQIMPNFVTQRALYEVRERPSKAYSWKAFMTANILVELPWNTLMAVIMYFCWYYPVGLYRNAEPTDSVHERGALMFLLILAFLLFTSTFAHMIIAGIETAETGGNIAQLLFSLCLIFCGVLAGPDVLPGFWIFMYRVSPFTYLVSAMLSTGVSGTTAYCEQVEYLTLYPPSNTTCSEYMDPYISQVGGYLQNPDATSECTFCQISSTDTFLSAVYSNYDDAWRNFGLMWAYIAFNIAAAVFIYWLARVPKGKKN

SEQ ID NO: 2026 - protein, 259 aa, Coccidioides immitis RS
MASPMERLITSLTKGASVETIWTNITGSFSPAGIEFFGTLSVQLVTFWLPSLFFLSLDIWAPSFSNRHKLQPIPKQPTSKEIKSCVLLVLRNQIINSILHIILIFISPQRPYRIEPSLPSLPEIARDFIICLLIREALFYYSHRLLHHRIFYARIHKLHHRFTAPVALAAQYAHPIEHIVANVLPITLPPALLKSHILTFWTFLAYELSNTALVHSGYDFFSGIAKMHDLHHEKFNLNYGSIGLLDWFHGTDKLHKRTE

SEQ ID NO: 2027 - protein, 511 aa, Geobacillus kaustophilus HTA426
MSKQPVALIILDGFALRDETYGNAVAQANKPNFDRYWNEYPHTMLKACGEAVGLPEGQMGNSEVGHLNIGAGRIVYQSLTRVNIAIREGEFDRNETFLAAMNHVKQHGTSLHLFGLLSDGGVHSHIHHLYALLRLAAKEGVKRVYIHGFLDGRDVGPQTAPQYIKELQEKIKEYGVGEIATLSGRYYSMDRDKRWDRVEKAYRAMVYGEGPTYRDPLECIEDSYKHGIYDEFVLPSVIVREDGRPVATIQDNDAIIFYNFRPDRAIQISNTFTNEDFREFDRGPKHPKHLFFVCLTHFSETVKGYVAFKPTNLDNTLGEVLSQHGLRQLRIAETEKYPHVTFFMSGGREEKFPGEDRILINSPKVPTYDLKPEMSAYEVTDALLKEIEADKYDAIILNYANPDMVGHSGKLEPTIKAVEAVDECLGKVVDAILAKGGIAIITADHGNADEVLTPDGKPQTAHTTNPVPVIVTKKGIKLRDGGILGDLAPTMLDLLGLPQPKEMTGKSLIVK

SEQ ID NO: 2028 - protein, 253 aa, Geobacillus kaustophilus HTA426
MRKRIIAGNWKMHKTLAEAVQFVENVKGHVPPADEVDSVVCAPFLFLDRLVQAADGTDLKIGAQTMHFADQGAYTGEVSPVMLKDLGVTYVILGHSERRQMFAETDETVNKKVLAAFTRGLIPIICCGESLEEREAGQTNAVVASQVEKALAGLTPEQVKQAVIAYEPIWAIGTGKSSTPEDANSVCGHIRSVVSRLFGPEAAEAIRIQYGGSVKPDNIRDFLAQEQIDGALVGGASLEPASFLQLVEAGRHE

SEQ ID NO: 2029 - protein, 394 aa, Geobacillus kaustophilus HTA426
MNKKTIRDVEVRGKRVFCRVDFNVPMEQGAITDDTRIRAALPTIRYLIEHGAKVILASHLGRPKGKVVEELRLDAVAKRLGELLERPVAKTNEAVGDEVKAAVDRLNEGDVLLLENVRFYPGEEKNDPELAKAFAELADLYVNDAFGAAHRAHASTEGIAHYLPAVAGFLMEKELEVLGKALSNPDRPFTAIIGGAKVKDKIGVIDNLLEKVDNLIIGGGLAYTFVKALGHDVGKSLLEEDKIELAKSFMEKAKEKGVRFYMPVDVVVADRFANDANTKVVAIDAIPSDWEALDIGPKTRELYRDVIRQSKLVVWNGPMGVFEMEAFAHGTKAIAEALAEAPDTYSVIGGGDSAAAVEKFGLADKMDHISTGGGASLEFMEGKQLPGVVALEDK

SEQ ID NO: 2030 - protein, 335 aa, Geobacillus kaustophilus HTA426
MAVKVGINGFGRIGRNVFRAALKNPDIEVVAVNDLTDANTLAHLLKYDSVHGRLDAEVSVNGNNLVVNGKEIIVKAERDPANLAWGEIGVDIVVESTGRFTKREDAAKHLEAGAKKVIISAPAKDEDITIVMGVNQDKYDPKAHHVISNASCTTNCLAPFAKVLHEKFGIVRGMMTTVHSYTNDQQILDLPHKDLRRARAAAESIIPTTTGAAKAVALVLPELKGKLNGMAMRVPTPNVSVVDLVAELEKEVTVEEVNAALKAAAEGELKGILAYSEEPLVSRDYNGSTASSTIDALSTMVIEGKMVKVVSWYDNETGYSHRVVDLAAYIASKGL

SEQ ID NO: 2031 - protein, 386 aa, Bacteroides thetaiotaomicron VPI-5482
MIQLSEITNSISPSLTRRLFNLAQKYDNVIDFTLGDPDIHPHDKIKEAGCKAILEGRTRYSPNAGLLELREIISSRYKLQYNIEYNPTNEIMVTVGGMEGLYLTLLAILNRGDEVIIPAPYWINYVQMVCMCSGEPIITAPVSTNDLSISIENIRKAITPKTKAIILNTPSNPSGRIISDDSIQQIAQIAIENDLIVITDEVYKTLLYDNAHFKSIVTCDKMKERTVVINSLSKEFCMTGWRLGYIAAPSELISVMTMFQENIAACAPLPSQYAAIEALRNSEKYSAGMIEEFTLRRNVLLEEVAKIKTITVDAPQGTFYAMLNIKSTGLKSEEFAYALLEKEQVAVVPGITYGDCCEDFIRIAFTLDIYKIKEGIQRLKRFVESL

SEQ ID NO: 2032 - protein, 43 aa, Hevea brasiliensis
EQCGRQAGGKLCPNNLCCSQWGWCGSTDEYCSPDHNCQSNCKD

SEQ ID NO: 2033 - protein, 331 aa, Robiginitalea biformata HTCC2501
MAYYFINFGPVKTQPMNQIPSADLRDFISGDPQRKNAFVEQLGGAFEDIGFVALSGHFLSEELVEELYSQVKNFFNLPQEVKAKYEIEGIGGQRGYTSFGKEHAKGRKAGDLKEFWHFGQYVEDDPELEAEYPDNVLVEELPEFNKVGREAYKMLEKTAQYVLRALALRLELPENYFDEFIHNGNSILRPIHYPPITEEPKDAVRAAAHGDINLITLLMGAHGKGLQVQNHKGEWIDAIAAPDQLMINVGDMLSRLTNNRLKSTIHRVVNPPRELWGTSRYSIPFFMHPISTMPLDCLEHCIDEENPKRFEDITAGEFLHERLVELGLVKK

SEQ ID NO: 2034 - protein, 373 aa, Rickettsia rickettsii
MSQNYYQILGVSKTASQADLKKAYLKLAKQYHPDTTDAKDAEKKFKAINAAYDVLKDEQKRAAYDRLGHDAFQNQQSRGGGGNHGGFHPDINDIFGDFFSDFMGGSRRSSRPTSAKVRGSDLKYNLTINLEEAFHGIEKNINFSSAVKCNTCHGSGSEKGETVTTCDACSGVGATRMQQGFFTIEQACHKCQGNGHIIKNPCKKCHGMGRYHKQRNLSVNIPAGVENGTRIRHTGEGEAGIRGGNSGDLYVDITIKPHDIYKVDGANLHCKLPISFVNAALGGEIEVPVIEGGKVSLTIPAGTQNGDQLRLRSKGMSKMRSTIRGDMLTHIHVEVPKNLSKRQRELLEEFKKESINEKENDGSFFNKMKSLWS

SEQ ID NO: 2035 - protein, 442 aa, Polaromonas sp. JS666
MEPQNIKPHTPELSRNTALFERAKKLIPGGVNSPVRAFKAVGGTPRFVQRAQGAYFWDADDQRYIDYIGSWGPMILGHGHPAVLASVQKALLDGFSYGAPTEREVELAEELVRLVPSLEMVRLVSSGTEAAMSAIRLARGATGRSKIIKFEGCYHGHADALLVKAGSGLATFGNPTSAGVPPEVVQHTLVLEYNHLAQLEEAFALHGSAIACLMIEPIAGNMNFVRASIPFMQRCRELCTQYGALLVFDEVMTGFRVALGGAQSVYAKSIPGFKPDMTVLGKVIGGGMPLAAFGGTRAVMEQLAPLGPVYQAGTLSGNPVATACGLATLREIQKPGFYEALGERTRGLVAGLTQAANKAGVPFCGDSEGGMFGFFLLGQLPQNYATVMTTDGPAFNRFFHAMLASGVYYAPALYEAGFVSSAHSAADIEATVDAAAKFFAGA

SEQ ID NO: 2036 - protein, 380 aa, Candidatus Kuenenia stuttgartiensis
MKKRIAVLAGDGIGPEIMKEGLKVLDAIAKQFNHIFDYKEALVGGCAYDKYGHPLPDETKEVCNNSDAIYFGAVGGPKWENLPPELTPERGALLPLRGTYNLFANLRPAIIFGPLADAASLKSERLEGGLDILIVRELTGGIYFGRNKVKTLTLHEGALQGNYAVDYMIYSVPEIERIAAVACDAAMKRNKKLTSVDKANVLESSKLWRKVVTDYVQSHFPQIQLNHMYVDNAAMQLATNPKQFDVIVTENMFGDILSDLASAITGSIGMLPSASLAKTGFGLFEPIHGSAPDIAGLNKANPLAQILSGAMLLKYAFGLNRESKAIEEAIMKALENGYRTADLANKTTQEGKILLTSQMGDKVVEYLMVKSETNSNEKMI

SEQ ID NO: 2037 - protein, 971 aa, Arabidopsis thaliana
MADHSWDKTVEEAVNVLESRQILRSLRPICMSRQNEEEIVKSRANGGDGYEVFDGLCQWDRTSVEVSVSIPTFQKWLHDEPSNGEEIFSGDALAECRKGRFKKLLLFSGNDYLGLSSHPTISNAAANAVKEYGMGPKGSALICGYTTYHRLLESSLAQLKKKEDCLVCPTGFAANMAAMVAIGSVASLLAASGKPLKNEKVAIFSDALNHASIIDGVRLAERQGNVEVFVYRHCDMYHLNSLLSNCKMKRKVVVTDSLFSMDGDFAPMEELSQLRKKYGFLLVIDDAHGTFVCGENGGGVAEEFNCEADVDLCVGTLSKAAGCHGGFIACSKKWKQLIQSRGRSFIFSTAIPVPMAAAAYAAVVVARKEIWRRKAIWERVKEFKELSGVDISSPIISLVVGNQEKALKASRYLLKSGFHVMAIRPPTVPPNSCRLRVTLSAAHTTEDVKKLITALSSSSRPKMLDISNYVFFFFTLVTILLSCLVYILTRHSHNPKCANLPPGPKGWPVVGNLLQFARSGKQFFEYVDEMRNIYGPIFTLKMGIRTMIIISDANLAHQALIERGAQFATRPAETPTRKIFSSSDITVHSAMYGPVWRSLRRNMVQNMLCSNRLKEFGSIRKSAIDKLVEKIKSEAKENDGLVWVLRNARFAAFCILLDMCFGVKMEEESIEKMDQMMTEILTAVDPRIHDYLPILTPFYFKERKNSLELRRKLVQFVVGFIEKRRLAIRNLGSDKTASSFAYLDTLFDLRVDGRETSPSDEDLVTLCSEFLNAGTDTTGTAIEWGIAELISNPKIQSRLYDEIKSTVGDDRTVEEKDLNKMVFLQAFVKELLRRHPPTYFTLTHGVTEPTNLAGYDIPVGANVEFYLPGISEDPKIWSKPEKFDPDRFITGGEDADLTGVAGVKMMPFGIGRRICPGLGMAVVHVELMLSRMVQEFEWSSYPPESQVDFTGKLVFAVVMKNPLRARVKARV

SEQ ID NO: 2038 - protein, 665 aa, Robiginitalea biformata HTCC2501
MEKTPLAFDYETFQVPREMQLRLYREMLRPRLIEEKMLILLRQGKISKWFSGIGQEAIAVGVAASLKPEEFILPMHRNLGAFTFRDVPLNRLFAQWQGKANGFTKGRDRSFHFGSMEHRIVGMISHLGPQLGVADGIALSDLLQGRSRVTAVFTGEGATSEGDFHEALNIASVWGLPVLFCIENNGYGLSTPVSEQYNCENLADRGAGYGMESHILDGNNIQEVYARISELCASMRKEPRPVLVEFKTFRMRGHEEASGTRYVPEEMMEHWGKRDPLENYAAFLRESGVLSEVREVRIKKEIQEEIDNALDEAFAEPAVEFNESIELNDVFKPFVFKQVEKGLNANNIRLVDAVSQGLRQSMQRHDNLVLLGQDIAEYGGVFKVTEGFAEEFGTDRVRNTPICESGIVSTAMGLSLGGMKAVVEMQFSDFVTSGFNPIVNYLAKVHYRWGEPADVVIRMPCGAGVGAGPFHSQTNEAWFTKVPGLKVAYPAFPADAKGLLATAIEDPNPVLFFEHKGLYRSLYGDVPQDYFTIPFGQAARLREGEGLSVITYGAGVHWAIEALDALGVTDADLIDLRTLCPLDTGTVFESVRRTGKVLLLQEDTLFGGVCSDLAAMIGEHCFEYLDAPVRRVASLETPVPFARNLEAGFLPKKRLRRALEELIAY

SEQ ID NO: 2039 - protein, 400 aa, Aspergillus nidulans FGSC A4
MATCQALVLHGAKDLRLEPRPVSSPSDGEVQIAIRSTGICGSDLHYYSHGRNGDFVVREPMCLGHESSGIVTAIGPNVHNLKVGDRVALEVGLPCRKCALCLSNPSRYNLCPEMKFRSSAKIFPHLDGTLMQLTTHPENMCHKLPDTVSYAGGALVEPLAVCLHAIRRSNPPAQSSLPPNYKSTALIFGAGAIGLLLAGALAAQETFAHIVIADIDDSRLKIASTMSLPNLSTFQIPKPSTPPPPRDAPHAEQTAFALSNAQATASSLKSAISSLDPSGLGFTRVYDCTGVPACVQTGIYAASPGSVLVQIGMGNPVQTLPVGAAALREVDIIGVFRYDGHAYPAAIELMASGKMDVVEKSVVTHRLGLQDGIRAFDIAGKGVDEGGRPVVKVLIESESP

SEQ ID NO: 2040 - protein, 390 aa, Mycobacterium smegmatis str. MC2 155
MTVRRLQPFAVTIFAEMSALATRLGAVNLGQGFPDEDGPVEMLKVAQNAIADGINQYPPGLGVPELRQAIAAQRKRVHGVQYDPDTEVLVTVGATEAIAASVIGLVEPGSEVLVIEPFYDSYSPVIAMAGCERRAVPLVPSGRGFAIDVDALRAAVTPQTKALILNSPHNPTGAVASDAELRAVAALAVEHDLLVITDEVYEALVFDGHRHLTLASYPGMRDRTVTISSAAKMFNATGWKIGWACGAPELIAGVRAAKQYLTYVGGAPFQPAVAHALNHEDGWVADLRDSFQSKRDRLGSALAEIGFEVHDSRGTYFLCADPRPLGYDDSTAFCAELPTRAGVAAIPMSAFCDPDAPHADVWNHLVRFAFCKRDDTLDEAIRRLQALRRC

SEQ ID NO: 2041 - protein, 331 aa, Zea mays
MATSTSQHALSSIKLLSTGCLHPDKRNCRVLSVSVGRRCPSARNLGLLCASNSQSSVIEPVQLPRSPKSGVTPKKSGESALILIRHGESLWNEKNLFTGCVDVPLTPKGVDEAIEAGKRICNIPVDVIYTSSLIRAQMTAMLAMMQHRRKKVPIILHNESEQAHMWSQIYSEETKKQSIPVITAWQLNERMYGELQGLNKQETADRFGKEQVHEWRRSYDIPPPNGESLEMCAERAVAYFKDQIIPKLVDGKHVMIAAHGNSLRSIIMHLDKLTSQEVISLELSTGIPMLYIFKEGKFIRRGSPAGPSEAGVYAYTKNLAQYRQKLDGIVQ

SEQ ID NO: 2042 - protein, 314 aa, Dunaliella tertiolecta
MDAYEKLEKIGEGTYGKVYKARDINTGKLVALKKTRLEMEEEGVPSTTLREVSLLLMLSESNHVVKLIAVEHVEENGKPCLYLVFEYLSTDMKKWMDRNGRGPAHPLPKPAIKSLTYQLIKGLAHCHKHGVMHRDLKPQNLLVDDSIMCCKIADLGLGRAFSIPIKSYTHEIVTLWYRAPEVLLGSTHYSTPVDMWSVGCIFAELVRKTPLFPGDCELQQLLHIFKLLGTPNEEVWPGVSKLRDWHEFPQWHPQDLSRIFPTLEPEGVDLLKRMIEYDPAKRISAKEALKHPYFDDPMIREVDQQENPEVRARD

SEQ ID NO: 2043 - protein, 144 aa, Glycine max
  misc_feature (109)..(109): Xaa can be any naturally occurring amino acid
  unsure (1)..(144): unsure at all Xaa locations
NVTYVRSYLSSGFYSGTLRHCCRSFCRRVLFRKITSLVPAVLTKGSCFELEERACSYAMLVMRTETCTVDRVAKERMERYEIVDNVVAAIAGIVDAVPNKWCTVRSLHXQLLESLAVPVYQTVPDVKLKIDGSKAEAKKNENDT

SEQ ID NO: 2044 - protein, 744 aa, Shewanella sp. MR-4
MLNTLRDITQAVASAHSLETALEVLVSSTKAAMETQCCSVYILDQQELVLSATDGLEKSAVGRVRMPLTQGLVGLAAEREEAVNLADARLHPRFKLFPEVAEEEYRAFLAVPIIYQKAVVGVIVVQQASARQFSEGEEAFLMTLAAQLAMAIRGLKQKAQVSSLHQQILFQGTSASSGIAIAHALVLGGEISLEQPDVRCEDIALESSRLVAAMGRCKEAIGALSQRFDREQDEEVASIFNALQLLLDDASLGGEYAREVQQGWEAESAVSRVSLRYIQQFLAMEDPYLKERASDIRDLGQKVLRQLIEPERLELEPDKPVILVTREADATLLAEFPRQKLAGIVTELGGVNSHAAILARALGVPAITGVEQLLSADIDQKLLVVNASRGQLMVSPSPAIVSEYRSLISAQKALQRQYAQELALPSVMLDGTRIRLYLNAGLLSGVASEIAEGADGIGLYRTEIPFMLQQRFPSESEQVKVYQQVLSAASARPVVMRTLDVGGDKPLPYFPIKEDNPFLGWRGIRLSLDHPELFLVQLRAMLQAGGEGKQLSILLPMVSNLDEIDQSLAYLEQAYVELKNDVNSQIEMPRIGIMLEVPALLYQLDEVAKRVDFVSVGSNDLTQYLLAVDRNNPRVSSLFDSYHPGILRALHQARLDCDYHELDISICGELAGEPMGAILLVAMGYQHLSMNQGSLARINYLLRRVSRADLTQLLSQALSLSNGFQVRELVKEYLTQQGLATILN

SEQ ID NO: 2045 - protein, 389 aa, Salmonella enterica subsp. enterica serovar Typhi str. CT18
MDTLRHPKRALIVDIPVQMDDGTIRHFEGYRVQHNLSRGPGKGGVRYHPDVDLNEVMALSAWMTIKCAALNLPYGGAKGGIRVDPFSLSEGELERLTRRYTSEIGIIIGPQKDIPAPDVGTNGKVMAWMMDTYSMNHGTTVTGVVTGKPIHLGGSLGREKATGRGVFVSGLEAARRANIAVEGARVAVQGFGNVGSEAARLFAGAGARVVAIQDHTATLFNATGIDMKALTAWQTEHKQIAGFPGAETIASDAFWRLEMDILIPAALEGQITRQRAEALTCKLVLEGANGPTYPDADDVLASRGILVVPDVVCNAGGVTVSYFEWVQDMASFFWSEEEINARMDKIMTDAIVHVWEKAAEKSCSLRTAAYIVACERILLARKDRGIYPG

SEQ ID NO: 2046 - protein, 326 aa, Marinobacter sp. ELB17
MTDPVPKDFRESALNTIRIERDAITSLEQRIGESFTSACQTIMACRGRVVVTGMGKSGHIGNKIAATLASTGTPAFFVHPGEASHGDLGMITSQDVVIAISNSGNTNEVVTLLPLLKRMGTPLISMTGDPQSLLAQEALANLDVSVLKEACPLGLAPTSSTTATLVMGDALAVALLEARGFSAEDFAFSHPGGRLGRRLLLRVLDIMHSGHSVPIVSEGTTLSGALLEISRKGLGMTTVVDSNGALIGVFTDGDLRRSLDKNVDVHTTAIEQLMTRNGKTIRADQLAVEALNIMEEMKISALPVVGEHGELVGALNMHDLLRAGVI

SEQ ID NO: 2047 - protein, 123 aa, Oryza sativa
  misc_feature (39)..(39): Xaa can be any naturally occurring amino acid
  misc_feature (79)..(79): Xaa can be any naturally occurring amino acid
  unsure (1)..(123): unsure at all Xaa locations
SKPVVVMLIDEWMRTPLAAALAEELSSHPAPSPSTVAPXPSSSGANSSVEDLLALIYFGSLFDVKLHTEFVATMLERAXEWDCCITYDYIRPCRLMPCCGPASHPVAYRSRHSSDHSGRGIFL

SEQ ID NO: 2048 - protein, 320 aa, Vibrio sp. Ex25
MIKKIGVLTSGGDAPGMNAAIRGVVRTALSEGLEVFGVYDGYLGLYEGRIEKLDRSSVSDVINKGGTFLGSARFPEFKEVEVREKAIENLKKHGIDALVVIGGDGSYMGAKKLTEMGYPCIGLPGTIDNDIAGTDYTVGYLSALNTVIDAIDRLRDTSSSHQRISIVEIMGRHCGDLTLMSAIAGGCEYIITPETGLDKDKLISNIQDGIAKGKKHAIIALTELMMDANELARDIEAATGRETRATVLGHIQRGGRPTAFDRVLASRMGNYAVHLLIEGHGGRCVGIVKEQLVHHDIIDAIENMKRPVRNDLYKVAEELF

SEQ ID NO: 2049 - protein, 727 aa, Saccharophagus degradans 2-40
MLFGRRKKNPIVIRDKGVTEWKYATCGYCSVGCSIEIGVNKEGTPVTTRGVGGADVNRGKLCIKGLTEAQIFQAAGRGAEPKIRNKTFEDWQITDWDTALDKTAAEFKRIQEKYGRDSVAVISTGQIMTEEFYTLGKLVRGVIGTNNYDGNTTLCMASAVSGYKRSFGSDGPPGCYEDFEHTDCLLAFGSNLCEQHPIIYWRLKEALEKRKFPVIVVDPRVTMFAQFADIHLPITPGTDLVLLNSLAHVILKEGLADQEYIERCCSGYEDFAAEVEKFDPTSAAKICGIDEDTIRHVARLYAKAGAAMSIWTMGINQSTHGSDGVCGINNLNLITGNIGKPGGTSLSITGQCNAMGTREWSSCSGLPGYRALENAEHREEIGKFWGVDPEFFPKKRGLFQTDIFPAIETGQIKALWVVATNPMTSMPNSARIRKTMEKLEFCVVQDSYEDVETAQYAHVYLPGSVWAEKKGCFTNTERRVNITTPVMAPYGNSKPDVWIFSQMAKRWEQGAKMSFPLDTADVFDEMKQLSKGDHRILDISGMSHELIEQKRGIQWPMREGDSEGTQRLYADGKFCYPDGKAKLMAMPWVDNNEVPDEDYPFWMNSGRVVEHFHTRTKTGKVGNCNKFSPTPYMEMNPDAAEELGIKHMSYVRLVSRRGDAVVMVQLTHRVAFNAVFIPFHFHDCVNRLSLGLLDPYSRQPAFKQCTVRIEHVDQKEAAKLNVEMRAF

SEQ ID NO: 2050 - protein, 525 aa, Physcomitrella patens
MVFAGGGLQQGSLEENIDVEHIASMSLFSDFFSYVSSTVGSWSVHSIQPLKRLTSKKRVSESAAVQCISAEVQRNSSTQGTAEALAESVVKPTRRRSSQWKKSTHPLSEVAVHNKPSDCWIVVKNKVYDVSNFADEHPGGSVISTYFGRDGTDVFSSFHAASTWKILQDFYIGDVERVEPTPELLKDFREMRALFLREQLFKSSKLYYVMKLLTNVAIFAASIAIICWSKTISAVLASACMMALCFQQCGWLSHDFLHNQVFETRWLNEVVGYVIGNAVLGFSTGWWKEKHNLHHAAPNECDQTYQPIDEDIDTLPLIAWSKDILATVENKTFLRILQYQHLFFMGLLFFARGSWLFWSWRYTSTAVLSPVDRLLEKGTVLFHYFWFVGTACYLLPGWKPLVWMAVTELMSGMLLGFVFVLSHNGMEVYNSSKEFVSAQIVSTRDIKGNIFNDWFTGGLNRQIEHHLFPTMPRHNLNKIAPRVEVFCKKHGLVYEDVSIATGTCKVLKALKEVAEAAAEQHATTS

SEQ ID NO: 2051 - protein, 341 aa, Mycobacterium smegmatis str. MC2 155
MPIRTLAVAGRLPDDGGVTALSTALPVVDLGDDAAVVTDQLRRVAHEVGFFYLVGHGVPQDLVDRVLTAARRLFALPQADKDAIAMVNSPHFRGYTRLGGELTGGQVDWREQIDIGPEREPLDDPAEPYLRLQGPNQWPAALPELPAVIAEWDAALAQVGRALLRHWAVALGNPADVFDEAFADTPATLIKIVRYPAQAETSQGVGAHRDAGVLTLLLAEPGSRGLQVRGPDGVFIDVDPLPGAFIVNIGEMLEIASGGYLRATEHRVQVSASERISVPYFFNPRLDAAIPVLALPDELAAQARGVTADPSNDRIYSVYGRNAWKSRVRAHPDVAAAHGYV

SEQ ID NO: 2052 - protein, 344 aa, Sulfolobus tokodaii str. 7
MEAVILHGGQGTRLRPLTHTGPKQLIKVAGKPVSQWVLEQIRDSGIRDVVIVLGDNTPKRVVDYYGDGSKFGVNITYVYQGKARGLADAVYKVKDVVSKKFLVYLGDNLVPYDLRKFMSFKGSASILLAKVDNPNRFGVAVIKENKVVKLVEKPKEPISDLALVGVYAFTDEIFEVIESLRPSWRGELEITDAIQGLIDEGKEVNYEIVQGWWKDTGTPRDILEANSFLLDRYTERRIEGDVDNSTIDGRVIVEKGTVIKNSVIRGPVYIGRDSKIVNSYVGPFTSIGDSSQVVDSEVEYSVILDNVRIKGVSLMDSLIGNNSVVEKGNRWQRLIIGENSSVIL

SEQ ID NO: 2053 - protein, 190 aa, Oryza sativa (indica cultivar-group)
MAAAAATPRHHHRLLLLLFILFLAAGAAAPVSGAWDAKGKTMCSGRLLGVADCGDEEPSAYEMLERFGFPRGILPEGVTGYTLRPSDGEFAVYLGTGECEFEVDGGYRLTYQGRITGRVAGGSITGLRGVTVRVFMMNWGIDRVVVADADHLVFYVGPLSQAFPVDGFEESPQCRCRHGGGAAVSGVAAM

SEQ ID NO: 2054 - protein, 149 aa, Glycine max
  misc_feature (106)..(106): Xaa can be any naturally occurring amino acid
  unsure (1)..(149): unsure at all Xaa locations
MAHDTTVGLSMAGVVAPFTGLKCMAGFPTRKTNNDITSIASNGGRVQCMQVWPPVGKKKFETLSYLPDLDDAQLAKEVEYLLRKGWIPCLGFELEPRFVYREHNRXPGYYDGRYWTMWKLAMFGWPGASQEWNELKELPLYTGAGYCYH

SEQ ID NO: 2055 - protein, 405 aa, Triticum aestivum
  misc_feature (320)..(320): Xaa can be any naturally occurring amino acid
  unsure (1)..(405): unsure at all Xaa locations
NKFVQKSRLVPVRNSRDIVDPRVRLFTPKEGHGYSEDEDHLALMMEVLGKMPRKIATMGTKSKEYFDRHGDLKRIRRLKFSSIERVLVDKYKIPQSDAREFAEFLCPLLDFAPEKRPTAAHCLKNKWLQRDDGKNVTNFASKSIDVTCNFGSMPDSCAQRIDAKGNTKSSINSNTENADVVRPTERISNSNAKSTCVNPNTGTIMYKDGNNSDVKPHSGSIITNKNAKSSDEKPFTGSISNKDDKTVDTKPITWSSTSTDDKSVDTKSSIGSVTNRDAKSIEGKRNIRSVVNSYMKNFDAKRNTGSIANSEVKDLDVKPXSGDIVSVDTNSTSAKPNTGSVENSDVTGTSVMANTGPANSGAKLQTNTDSVDQDDTDSKPNVGRVAASIQRLESSMSKVQIGRYR

SEQ ID NO: 2056 - protein, 419 aa, Vibrio vulnificus YJ016
MPVKTTQNKNIHTALRCLDSAQQIEQKLNPNYAPPKRTLPKSPFISDKTLKKRWDVVNCHATQDQLLDQHTLEHMALYQKNIEHFVGTVKVPVGLAGPLRVNGLFASDDYLIPLATTEAALVASYSRGANLITAAGGATAMLVNEGVTRTPVFAFTNLVSAGQFVAWVTTHYERFKQIAESTTSHGTLSDININMEGNHVYLMFEYQTGDASGQNMVTIATNAVFQSILETSPIDIKEAFLDGNLSGDKKANSKTLTSVRGKKVIAEVTLSREMVEKYLHTTPEKMVKFGQMTTTGAALSGGIGVNAHYANALTALYLACGQDAACVAESAIGITRMELTADGHLYASVTLPNLMVGTVGGGTGLPSQKACLDILGLYGQGNARALAEVCAALCLAGELSIVGAFAAGHFSRAHHKLAR

SEQ ID NO: 2057 - protein, 461 aa, Burkholderia mallei ATCC 23344
MATDQDNDGLKRGLKNRHIQLIALGGAIGTGLFLGIAQTIRMAGPSVLLGYALAGVVAFFIMRQLGEMVVDEPVAGSFSYFASKYCGHFTGFLSGWNYWVLYVLVSMAELSAVGIYVQYWWPGVPTWISALVFFVVINAVNLASVKSYGETEFWFSIVKVAAIIGMIGFGGYLLLSGHAGPDAGVANLWRHGGFFPNGIGGLAMAMAVIMFSFGGLELVGITAAEADDPSHSIPRATNQVIYRILIFYIGALGVLLSLYPWQKVVTGGSPFVLIFHALSSDIAANVLNLVVLTAALSVYNSCVYCNSRMLYGLAQQGNAPQALARVNRRGIPIAALGVSAFATALCVVINYFMPGKAFELLMGLVVSAIIINWAMISVIHLRFRQAKRAAGETTRFRSLGYPLTNYFCLAFMAAILVVMFRTPELRLSVYLIPVWLVVLALGYRFRQRGAGYALGGGVSAR

SEQ ID NO: 2058 - protein, 702 aa, Oryza sativa (japonica cultivar-group)
MDAAAAGGGGAAKRKRSFSEDDAYLILHRYQPATILTMLQEMGKQVGAGKGIDWRALVRRTSTGITSAREYQMLWRHLAYGHEFVESVEPASLPLDDGSDLECEIEIVPAPGNEALAEATSFAKTIITGSSREQTSGQRVNSEAAALNTPNEKIVRVPSDKQLVPGHRLTNGTGPVSSSKQPSHTGSSPDPLDPNGHPKKKKKPKPWSREEDMELGAGVQKHGEGNWMEILHKYKFDSSRTHLQLQQRWALICKRQGSTKPATPKIPNVMSEELKAAQKAFSLAIGTTRSSTLRPGGVPHHNPMVTTTNPEVKSVTAPSPLPVPVHVVPVPVPVQPVQVQLPPPQLHQAPAQSAPPPPKVSNASNKSRNNSKKQVAQSIPVNGPLSIQEAALAAGGRIAEPSVATNFLKAAQSTKAVHIRSRGTGSSKSSTGSKTPTVAGEPGTQLGSDQHLELQSTGGPSQVLTAHATEQVHNVSEVAGVNPLGQSAGVHLSETKKALNTTPVSGSSDKMEIDDNSNYFAVTMEDLFPEDVKQEDVQDPKIEEAIDPKDADMLEFDRFVAQGCLNKDNVDKSKAAKIAPEAQSVIGSQKKQLKTLPTVGKSNPVFAGPPATAKKTKAPVPQGGMSSGIVGVLNRSLGGKAPAPATTGTQSTVQKQQSMSSKGNLLVPKNVAPGTVTPANNRANTAVNGASKVNPPASQKPA

SEQ ID NO: 2059 - protein, 470 aa, Arabidopsis thaliana
MGDGSSSRSNSSNSTSEKPEWLQQYNLVGKIGEGTYGLVFLARTKTPPKRPIAIKKFKQSKDGDGVSPTAIREIMLLREISHENVVKLVNVHINFADMSLYLAFDYAEYDLYEIIRHHRDKVGHSLNTYTVKSLLWQLLNGLNYLHSNWIIHRDLKPSNILVMGDAEEHGIVKIADFGLARIYQAPLKPLSDNGVVVTIWYRAPELLLGSKHYTSAVDMWAVGCIFAELLTLKPLFQGAEAKSSQNPFQLDQLDKIFKILGHPTMDKWPTLVNLPHWQNDVQHIQAHKYDSVGLHNVVHLNQKSPAYDLLSKMLEYDPLKRITASQALEHEYFRMDPLPGRNAFVASQPMEKNVNYPTRPVDTNTDFEGTTSINPPQAVAAGNVAGNMAGAHGMGSRSMPRPMVAHNMQRMQQSQGMMAYNFPAQAGLNPSVPLQQQRGMAQPHQQQQLRREDPGMGMSGYAPPNKSRRL

SEQ ID NO: 2060 - protein, 497 aa, Marinobacter sp. ELB17
MIDTIMQRLGVATEQYQQGSVEVITPIDGSIIGKVAVEDVDAIDARIARAEQAFEQWRRVPAPRRGELVRLLGEQLRRHKDDLGALVTYECGKILPEGLGEVQEMIDICDLAVGQSRQLFGLTIASERPGHHMRETWHPLGPIGLITAFNFPVAPWAWNAALALVCGNSLIWKPSEKTPLTALACQALLERAMAEFGDDAPEHLSQVIIGGRDAGERLADDPRIPLISATGSTRMGRDVGPRVAARFGRSTLELGGNNAMILAPSADLDMAVRAILFSAVGTAGQRCTSLRRLLVHESIKDEVVERLKKAYAGVSIGNPMEGNLVGPLIDGQAFDQMRNALDQARQEGAKIFGGERQQIDQAAGGYYVTPAIVEVDQQNELVKRETFAPILYVMSYGEFDEAIALHNDVPQGLSSCIFTSDVREAETFTSDVGSDCGIANVNIGPSGAEIGGAFGGEKETGGGRESGSDVWKSYMRRQTNTINYSRELPLAQGIKFD

SEQ ID NO: 2061 - protein, 366 aa, Arabidopsis thaliana
MMTKNSIEFDPYIERKAFDETKQGVKGLVDAKITEVPRIFHHRQDILTNKKPSASVSDLEIPIIDFASVHADTASREAIVEKVKYAVENWGFFQVINHSIPLNVLEEIKDGVRRFHEEDPEVKKSFFSRDAGNKKFVYNSNFDLYSSSPSVNWRDSFSCYIAPDPPAPEEIPETCRDAMFEYSKHVLSFGGLLFELLSEALGLKSQTLESMDCVKTLLMICHYYPPCPQPDLTLGITKHSDNSFLTLLLQDNIGGLQILHQDSWVDVSPIHGALVVNIGDFLQLITNDKFVSVEHRVLANRQGPRISVASFFSSSMRPNSRVYGPMKELVSEENPPKYRDITIKEYSKIFFEKGLDGTSHLSNIRI

SEQ ID NO: 2062 - protein, 166 aa, Nicotiana tabacum
MASMIESAWTYLITNFSDFQLTCLGGFVLHESVFFLSGLPFLLFERAGWFGKYKIQKENNSPAAQEKCITRLLLYHFCVNLPILIGSYPVFKFMGTRSSLPLPSWKVISTQIIFYFILEDFAFYWGHRILHTKWLYKHVHSVHHEYATPFGLTSEYAHPAEILFLV

SEQ ID NO: 2063 - protein, 392 aa, Barnebya dispar
DLEPVNPADVPVTAAGALKSYKFAAKAISRLQSLPSGNIFLLCDVLVKEVRDLTGYDRVMVYKFHEDEHGEVVSECRRSDLESYLGLHYPATDIPQASRFLFMKNKLRMICDCLAPPVKVIQDENLPQPLSLCGSTLRSPHGCHAQYMTNMGTIASLVMSVTINEDDDMKDCEQPQMPRKLWGLVVCHHTSPRFIPFPLRYACEFLIQVFGVQINKEVELAAQVREKHILRIQTLLCDMLLRDAPVAIITQSPNVMDLVRCDGAALYYKNKFWLLGVTPTEAQIRDIAEWLLECHSGNTGLSTDSLMEAGYPGASVLGDAVCGMAAISITSRDFLFWFRSHTAKEIKWGGAKHDPDDKDDGRKMHPRSSFKAFLEVVKWRSLPWEDVEMDAI

SEQ ID NO: 2064 - protein, 129 aa, Nicotiana tabacum
TSLPLPSLWEILLQLGTYFIVEDYFNYWIHRFLHCKWGYENIHKVHHEYTAPIGFAAPYAHWLEILILGIPSAIGPAIAPGHMVTFWLWIALRQIGAIETHSGYDLPWTITKYIPFMSGPDYHDYHHYV

SEQ ID NO: 2065 - protein, 641 aa, Oryza sativa (indica cultivar-group)
MPSLLLLRAVAMALLLLLARSMEGVDGAGGGGNATCPLDLSYVTTFPWDADLCAGGAGNMTRCCNTLLSVLAIGLAEQVRATGHFRIPSVGESAACLKDYGAKLSAAPLSLPGASLVQTCFPSPEQFVSSPSFCAGVTTAAEYRAVVGNDSVAALDSACGDLSSTPHCLRCLDAGIAATSRLKAAANISANATTDGAATTRNCFYLTVTYAAGISNVAGPTNPPTAACTLGLALSTPPAAPPKSHDTVIYATAIPVAFLLLASLLAFLVWRRHDKKKKIHEISKEGSAERRSHPRPNTGSILYDIAELSKATDAFADRNLVGRGGFGAVYRGVLADGSVVAVKKMLDPDVEGGDEEFTNEVEIISHLRHRNLVPLRGCCIVDDDAEEGKQKFLVYDFMPNGALEDFIFRDGKRPALTWAQRRSIIMDVAKGLEYLHYGVKPAIYHRDIKATNILLDGDMRARVADFGLARRSREGQSHLTTRVAGTHGYLAPEYALYGQLTEKSDVYSFGVLVLEVLSARRVLDMSAPSGPVLITDWAWAHVKAGQAREVLDGALSTADSPRGGAMERFVLVGILCAHVMVALRPTITEAVKMLEGDMDIPELPDRPLPYGHSAMFSEAGSNFSASPAFSGPFIDNGDMLR

SEQ ID NO: 2066 - protein, 392 aa, Blepharandra heteropetala
DLEPVNPADVPVTAAGALKSYKLAARAISRLQSLPSGNISLLCDVLVKEVRDLTGYDRVMVYKFHEDEHGEVISECRRPDLEAYLGLHYPATDIPQASRFLFMKNKVRMICDCLAPAVKVIQDERLPQALSLCGSTLRSPHGCHAQYMANMGTIASLVMSVIINEDNDMMDGDQQHIARKLWGLVVCHHTSPRFVPFPLRYACEFLIQVFGVQINKEVELAAQVREKHILRTQTLLCDMLLRDAPVAIITQSPNVMDLVKCDGAALYYRKKFWLLGVTPTEVQIRDIAEWLLEYHGGNAGLSTDSLMEAGYPGASDLGNAVCGMAAVRITSRDFLFWFRSHTAKEIKWGGAKHHPNDKDDVRKMHPRSSFKAFLEVVKWRSLPWEDIEMDAI

SEQ ID NO: 2067 - protein, 392 aa, Blepharandra heteropetala
DLEPVNPADVPVTAAGALKSYKLAARAISRLQSLPSGNISLLCDVLVKEVRDLTGYDRVMVYKFHEDEHGEVISECCRPDLEAYLGLHYPATDIPQASRFLFMKNKVRMICDCLAPAVKVIQDERLPQALSLCGSTLRSPHGCHAQYMANMGTIASLVMSVIINEDNDMMDGDQQHIARKLWGLVVCHHTSPRFVPFPLRYACEFLIQVFGVQINKEVELAAQVREKHILRTQTLLCDMLLRDAPVAIITQSPNVMDLVKCDGAALYYRKKFWLLGVTPTEVQIRDIAEWLLEYHGGNAGLSTDSLMEAGYPGASDLGNAVCGMAAVRITSRDFLFWFRSHTAKEIKWGGAKHHPNDKDDVRKMHPRSSFKAFLEEVKWRSLPWEDIEMDAI

SEQ ID NO: 2068 - protein, 414 aa, Shewanella oneidensis MR-1
MDHFLYQDNTLYAEGCRVNDLAQTYGTPLYIYSRATLERHWHAFNNAVAGHPHLVCYAVKANSNLAVLNVLARLGSGFDIVSGGELARVIEAGGDPAKVVFSGVGKTVAEMEQALNLGIYCFNVESSAELEQLNLVAGRLGKVAPVSLRVNPDVDAGTHPYISTGLKENKFGIAMDEAEAVFARAHALPHLQVKGVDCHIGSQLTEIQPFLDAMDRMLSLIDRLAEQGIVIEHFDVGGGLGVTYDDETPPHPDVYAAALLKRLGHRKLKLIFEPGRAIAANAGIFVTEVLYLKENSDKRFAIVDGAMNDLIRPALYSAWQKIIPVTPRDDQAHVFDIVGPVCETGDFLGKDREFAIAPGDLLVVRSSGAYGFAMASNYNTRPRAAEVMVDGDKAYLVREREKLPQLWQGEQLLP

SEQ ID NO: 2069 - protein, 222 aa, Brassica napus
MSSLRPPPETLYLTINIIDRFLSLKPVPRRELQLVGVSALLIASKYEEIWPPQVNDLVYVTDNSYQSKQILVMEKTILGNLEWYLTVPTQYVFLARFIKAAVPDPEMENMVHFLAELGLMHYDALKFCPSMLAATAVYTARCFLSKTPAWTETLTFHTGYSEHELMDCSKLLAFIHSRVGESKLRAVFKKYSKAERCAVALVSSPAKSPLLSSSASCSLEKS

SEQ ID NO: 2070 - protein, 392 aa, Blepharandra heteropetala
DLEPVNPADVPVTAAGALKSYKLAARAISRLQSLPSGNISLLCDVLVKEVRDLTGYDRVMVYKFHEDEHGEVISECCRPDLEAYLGLHYPATDIPQASRFLFMKNKVRMICDCLAPAVKVIQDERLPQALSLCGPTLRSPHGCHAQYMANMGTIASLVMSVIINEDNDMMDGDQQHIARKLWGLVVCHHTSPRFVPFPLRYACEFLIQVFGVQINKEVELAAQVREKHILRTQTLLCDMLLSDAPVAIITQSPNVMDLVKCDGAALYYRKKFWLLGVTPTEVQIRDIAEWLLEYHGGNAGLSTDSLMEAGYPGASDLGNAVCGMAAVRITSRDFLFWFRSHTAKEIKWGGAKHHPNDKDDVRKMHPRSSFKAFLEVVKWRSLPWKDVEMDAI

SEQ ID NO: 2071 - protein, 392 aa, Caucanthus auriculatus
DLEPVNPADVPVTAAGALKSYKLAAKAISRLQSLPSGNISLLCDVLVKEVRDLTGYDRVMVYKFHEDEHGEVVSECHRSDLESYLGLHYPATDIPQASRFLFMKNKVRMICDCVAPPVKVIQEERLPQPLSPCGSTLRSPHGCHAQYMTNMGIIASLVMSVTVNEEDDMVDGDQPQMARKLWGLVVCHHTSTRFVPFPLRYACEFLIQVFGVQINKEVELAAQVREKHILQIQTMLCDMLLRDAPVAIITQSPNVMDLVKCDGAALYFKNKTWLLGVTPTEEQIRDIAEWLPEYHSGNTGLSTDSLMEAGYPGASALGDAVCGMAAVSITSRDFLLWFRSHTAKEIKWGGAKHDPDDKDDGRKMHPRSSFKAFLEVVKWRSMPWEDVEMDAI

SEQ ID NO: 2072 - protein, 332 aa, Triticum aestivum
MSAANRSQPIKLNRPVVGKARKLKDLMLKSDNRVCADCSAPDPKWASSNIGVFLCLKCGDVHRALGQDISNVLSLTLDDWSDSDIDSMIEVGGNSYANSIYEAFLPKDHPKPKPDSPMEYRTKFIRAKYETQDFLKPSLRISSKAGLESTNSLNSVDNSFSSTSRKHAPEDTREFVGQLNVTVVKGSGLAVRDMLTSDPYVVLSLGEQKAQTTVKASDLNPVWNEVLNLSVPRNYGPLKLEVYDHDTFSADDIMGEAEIDLKPMITAAMAFGDPSRHADMQIGRWFMTRDNCLLSDSIVNISSGKVKQEVYLKLQNVESGEMELELEWARLD

SEQ ID NO: 2073 - protein, 172 aa, Oryza sativa
SLYTQDFPRPRRWRDGDGDGEEGPTTAGGGGGVGCRCRSCAAVMLADCIALGCCPCALVSMLSLALVKAPLAVGRRCVGRLRSRRRTLLHNKRVRDVAATSAAAAGEKKAIAKPEEELEAADIVANDDDTASAAAATAGAGAPTDEDLAWLEEMYQMGHWGFGRVSISGKTP

SEQ ID NO: 2074 - protein, 486 aa, Candida albicans SC5314
MRSYKSSITDENELTKQRLRAKSIANLSSNHTTAGQPSTSSQHREALTDLTSQENKNHPRVKLTQTNTNHHRNSSSSSNKIQIYQQIEQKKTDIHQFKKPRLEKVLLNDDDDETDDEFDDEEDKENRYHDLELNEDDSKHQLISEAFETIDDRGISEGENDTAQEARERLEEETQSHTQDMRSIYGVHVPMQPMWNNAIINELKYVIQKYSRNTLDENDEDTYDTTMVAEYSPEIFNYLHELENKFTPDPNYMDFQDDLKWEMRAVLIDWVVQVHARFNLFSETLYLTVNYIDRFLSKRRVSLSRFQLVGAVALFIAAKYEEINCPTVQEIAYMADNAYSIDEFLKAERFMIDVLEFDLGWPGPMSFLRRISKADDYDYETRTLAKYFLEITIMDSKFVASPPSWLAAGAHYISRILLGRGEWTELHVFYSGYTEKQLQPLADVLLENCRHAEINHKAIFEKYKERRYRKSSLFVQEYFRHIMSQS

SEQ ID NO: 2075 - protein, 447 aa, Acinetobacter sp. ADP1
MKYSKMSDFLDYVKTRDQYQPEFLQAVEEVMISLWPFIEKHPEYADYGLLERLIEPERVIQFRVAWMDDQGHTQVNRAFRVQYNSAIGPYKGGMRFHPSVNLSILKFLGFEQTFKNALTTLPMGGGKGGSDFNPKNKSEAEIMRFCQALMLELHRHLGADTDIPAGDIGVGAREVGYMAGMMKKLSNDTAAVFTGKGVSFGGSLMRPEATGYGTVYFAEEMLKTRGQNFLGKTVSISGSGNVAQYAAEKAMFLGAKVVTLSDSNGTVYLENGFTEVLLAELMELKNKKRGRISEFASKHGFEYFEGQTPWHIPVDIALPCATQNELNGDDAETLIKNGVICVAEGANMPSTLEAVEKFLHAKILYAPGKASNAGGVATSGLEMSQNSIRLNWSHAEVDERLHAIMKDIHANCVKYGTKQDGSINYVDGANIAGFVKVADAMLAQGIY

SEQ ID NO: 2076 - protein, 171 aa, Glycine max
MAMRGGRKNLKRATEEKHITLQDGQGIMQVVSLRGANIIEVMDASGNKLLALFPAKIQKSMWIKRGSFVVVDESGKEKALESGSKVACLVSQVLFSKQVRELEKSPEWPESFKSAMVDDSIESTTSQQEHELEGSDDDGLPPLEANTNRIRPAELQADDEDSESSSDTDDD

SEQ ID NO: 2077 - protein, 430 aa, Oryza sativa (japonica cultivar-group)
MDMIEGSRFQNMLGGAGIGGGIGCRGRQENEMNGFHNMPYYHKVGESSHMSVDNADNLNMMNFVGGSVAMSVDNSSVGSNESRTVMLKHPGLRDMPAPSYSVHNSVIHPNRAMAPTLNEDALARVLMDPSHPTEILSNYEEWTIDLGKLDMGAPFAQGAFGKLYRGTYNGEDVAIKLLEKPENDPERAQLMEQQFVQEVMMLSTLRHPNIVRFIGACRKSIVWCIITEYAKGGSVRQFLARRQNKSVPLGLAVKQALDVARGMAYVHALRFIHRDLKSDNLLISADKSIKIADFGVARIEVQTEGMTPETGTYRWMAPEMIQHRPYDHKVDVYSFGIVLWELITGMLPFTNMTAVQAAFAVVNRGSRPAIPQDCVDSLSKIMTCCWDANPEVRPSFAEIVVMLENAEIEVMRNVRRARFRCCIAGPMTTD

SEQ ID NO: 2078 - protein, 392 aa, Caucanthus auriculatus
DLEPVNPADVPVTAAGALKSYKLAAKAISRLQSLPSGNISLLCDVLVKEVRDLTGYDRVMVYKFHEDEHGEVVSECHRSDLESYLGLHYPATDIPQASRFLFMKNKVRMICDCVAPPVKVIQEERLPQPLSLCGSTLRSPHGCHAQYMTNMGIIASLVMSVTVNEEDDMVDGDQPQMARKLWGLVVCHHTSTRFVPFPLRYACEFLIQVFGVQINKEVELAAQVREKHILQIQTMLCDMLLRDAPVAIITQSPNVMDLVKCDGAALYFKNKTWLLGVTPTEEQIRDITEWLLEYHSGNTGLSTDSLMEAGYPGASALGDAVCGMAAVSITSRDFLLWFRSHTAKEIKWGGAKHDPDDKDDGRKMHPRSSFKAFLEVVKWRSMPWEDMEMDAI

SEQ ID NO: 2079 - protein, 474 aa, Vigna radiata
MVSLPTLLLLFAASAAAIFLHRAFSRRKFRLPPGSYGLPFIGETLQLISAYKSSNPEPFMDERVRRYGSIFMTHVFGEPTVFSADPELNRFILQNEGKLLDCSYPGSISNLLGKHSLLLMKGALHKRMHSLTMSFANSSIIKDHLLHHIDRLIGLNLDTWSDRVTLMDQAKKITFELTVKQLMSFDPDEWTESLRKEYVLVIEGFFTLPLPLFSTTYRRAIKARTKVAEALTLVVRQRREEYNQGKEKKSDMLGALLASGDHFSDDQIVDFLLALLVAGYETTSTIMTLAVKFLTETPLALAQLKEEHDQIRARSDPGAPLEWTDYKSMVFTQHVVNETLRVANIIGGIFRRATTDIDIKGYTIPKGWKVFASFRAVHLNPEYYKDARTFNPWRWQSNSSEAANPANVYTPFGGGPRLCPGYELARVVLSVFLHRIVTRFSWVPAEEDKLVFFPTTRTQKRYPIIVKRRNANHV

SEQ ID NO: 2080 - protein, 392 aa, Caucanthus auriculatus
DLEPVNPADVPVTAAGALKSYKLAAKAISRLQSLPSGNISLLCDVLVKEVRDLTGYDRVMVYKFHEDEHGEVVSECHRSDLESYLGLHYPATDIPQASRFLFMKNKVRMICDCVAPPVKVIQEERLPQPLSLCGSTLRSPHGCHAQYMTNMGIIASLVMSVTVNEEDDMVDGDQPQMARKLWGLVVCHHTSTRFVPFPLRYACEFLIQVFGVQINKEVELAAQVREKHILQIQTMLCDMLLRDAPVAIITQSPNVMDLVKCDGAALYFKNKTWLLGVTPTEEQIRDIAEWLLEYHSGNTGLSTDSLMEAGYPGASALGDAVCGMAAVSITSRDFLLWFRSHTAKEIKWGGAKHDPDDKDDGRKMHPRSSFKAFLEVVKWRSMPWEDVEMDAI

SEQ ID NO: 2081 - protein, 548 aa, Photorhabdus luminescens subsp. laumondii TTO1
MKNINPSQTSAWKALEQHFAQIKDIHLRELFEQDPDRFAKFSATFDDQILVDFSKNRITTETLKKLQALAKETDVAGAMRSLFSGEKINCTENRAVLHIALRNRSNTPMMVDGEDVMQQVNAVLAKMKDFSERVIHGEWKGYTGKGITDVVNIGIGGSDLGPYMVTEALKPYKNHLNMHFVSNVDGTHIAETLKALNPETTLFLIASKTFTTQETMTNAHSARDWFLKSAGDEGHIAKHFAALSTNGQEVKQFGIDTKNMFEFWDWVGGRYSLWSAIGLSIALSIGFENFEQLLSGAHAMDQHVANTPFEQNIPVLLALIGIWYNNFFGAETEAILPYDQYMHRFAAYFQQGNMESNGKYIDRNGHPVDYQTGPIIWGEPGTNGQHAFYQLIHQGTKLIPCDFIAPAISHNPLSDHHSKLLSNFFAQTEALAFGKSREQVDAEFATSGKTVVEVEHVAPFKVFEGNRPTNSILLREITPFSLGALIAMYEHKIFVQGAILNIFTFDQWGVELGKQLANRILPELKDDNRVVSHDSSTNGLINRFKAWR

SEQ ID NO: 2082 - protein, 392 aa, Diacidia ferruginea
DLEPVNPADVPVTAAGALKSYKLAARAISRLQSLPSGNISLLCDVLVKEVRDLTDYDRVMVYKFHEDEHGEVISECCRPDMEAYLGLHYPATDIPQASRFLFMKNKVRMICDCLATPVKVIQDERLPQPLSLCGSTLRSPHGCHAQYMANMGAIASLVMSVTINEDDDMMDGDRQHRARKLWGLVVCHHTSPRFLPFPLRYACEFLIQVFGVQINKEVELAAQVREKHILRTQTLLCDMLLRDAPVAIITQSPNVMDLVKCNGAALYYKKKFWLVGLTPTEAQIRDIAEWLLEYHNGNTGLSTDSLMEAGYPGASELGDTVCGMAVVKITSRDFLFWFRSHTAKEIKWGGAKHDPDDKDDGRKMHPRSSFKAFLEVVKWRSLPWEDIEMDAI

SEQ ID NO: 2083 - protein, 392 aa, Dinemandra ericoides
DLEPVNPADVPVTAAGALKSYKLAAKAISRLQSLPSGNIPLLCDVLVKEVRDLTGYDRVMVYKFHEDEHGEVVSECRRSDMESYLGLHYPATDIPQASRFLFMKNKVRMICDCLSPPVEVIQDERLPQPLSLCGSTLRSPHGCHAQYMANMGTIASLVMSVTVNEDDDMMDGDQQRMARKLWGLVVCHHTSPRFVPFPLRYACEFLIQVFGVQINKEVDLAAQVREKHILRIQTMLCDMLLRDAPVAIITQSPNVMDLVKCDGAALYYKNKFWLLGVTPTEAQIRDIAEWLLEYHRGNTGLSTDSLMEAGYPGASVLGDAVCGMAAVSITSRDFLFWFRSHTAKEIKWGGAKHDPGDKDDGRKMHPRSSFKAFLEVVKWRSLPWKDVEMDAI

SEQ ID NO: 2084 - protein, 548 aa, Nicotiana tabacum
MTTTPIANHPNIFTHQSSSSPLAFLNRTSFIPFSSISKRNSVNCNGWRTRCSVAKDYTVPSSAVDGGPAAELDCVIVGAGISGLCIAQVMSANYPNLMVTEARDRAGGNITTVERDGYLWEEGPNSFQPSDPMLTMAVDCGLKDDLVLGDPNAPRFVLWKGKLRPVPSKLTDLPFFDLMSIPGKLRAGFGAIGLRPSPPGHEESVEQFVRRNLGGEVFERLIEPFCSGVYAGDPSKLSMKAAFGKVWKLEETGGSIIGGTFKAIKERSSTPKAPRDPRLPKPKGQTVGSFRKGLRMLPDAISARLGSKLKLSWKLSSITKSEKGGYHLTYETPEGVVSLQSRSIVMTVPSYVASNILRPLSVAAADALSNFYYPPVGAVTISYPQEAIRDERLVDGELKGFGQLHPRTQGVETLGTIYSSSLFPNRAPKGRVLLLNYIGGAKNPEILSKTESQLVEVVDRDLRKMLIKPKAQDPLVVGVRVWPQAIPQFLVGHLDTLSTAKAAMNDNGLEGLFLGGNYVSGVALGRCVEGAYEVASEVTGFLSRYAYK

SEQ ID NO: 2085 - protein, 392 aa, Dinemandra ericoides
DLEPVNPADVPVTAAGALKSYKLAAKAISRLQSLPSGNIPLPCDVLVKEVRDLTGYDRVMVYKFHEDEHGEVVSECRRSDMESYLGLHYPATDIPQASRFLFMKNKVRMICDCLSPPVEVIQDERLPQPLSLCGSTLRSPHGLHAQYMANMGTIASLVMSVTVNEDDDMMDGDQQRMARKLWGLVVCHHTSPRFVPFPLRYACEFLIQVFGVQIHKEVDLAAQVREKHILRIQTMLCDMLLRDAPVAIITQSPNVMDLVKCDGAALYYKNKFWLLGVTPTEAQIRDIAEWLLEYHRGNTGLSTDSLMEAGYPGASVLGDAVCGMAAVSITSRDFLFWFRSHTAKEIKWGGAKHDPGDKDDGRKMHPRSSFKAFLEVVKWRSLPWEDVEMDAI

SEQ ID NO: 2086 - protein, 246 aa, Zea mays
  misc_feature (38)..(38): Xaa can be any naturally occurring amino acid
  unsure (1)..(246): unsure at all Xaa locations
MRVAATRAAAAAHPPSAFLLLLLLLGCASLAIGGAAMXAGHVLGGVKENPAAANSAESDGLGRFAVDEHNRRENALLEFVRVVEAKEQVVAGTLHHLTLEAVEAGRKKLYEAKVWVKPWLDFKELQEFSHKGDATAFTNADLGAKQGGHEPGWREVPVEDPVVKDAAHHAVKSIQERSNSLFPYELLEILRAHAQVVEDFAKFDILMKLKRGSKEEKIKAEVHKSLEGAFVLNQHQPAEHDESSSQ

SEQ ID NO: 2087 - protein, 158 aa, Triticum aestivum
  misc_feature (84)..(84): Xaa can be any naturally occurring amino acid
  misc_feature (94)..(94): Xaa can be any naturally occurring amino acid
  misc_feature (105)..(105): Xaa can be any naturally occurring amino acid
  misc_feature (121)..(121): Xaa can be any naturally occurring amino acid
  misc_feature (123)..(123): Xaa can be any naturally occurring amino acid
  misc_feature (127)..(129): Xaa can be any naturally occurring amino acid
  unsure (1)..(158): unsure at all Xaa locations
MAPAVMASSATTVAPFQGLKSTAGLPVSRRSSGSLGSVSNGGRIRCMQVWPIEGIKKFETLSYLPPLSTEALLKQVDYLIRSKXWVPCLEFSKXVASVFREHNSXPGYYDGRYWTMWNCYXRXNDAXXXNEVRVRRVPDAMSRMVHNCAVSRIMQRFK

SEQ ID NO: 2088 - protein, 172 aa, Nostoc sp. PCC 7120
MDLKSLIRDIPDFPKPGILFRDITTLLRDRQGLRYTIDFLAEKCSEANLNIDYVIGMESRGFIFGTPLAYKLGAGFIPVRKKGKLPAAVHSIEYELEYGTDCLEVHRDALHPDSRVLIVDDLIATGGTASATAKLVQQIGCELVGFGFIIELRDLQGRKHLPDVPIISLVEY

SEQ ID NO: 2089 - protein, 1132 aa, Anabaena variabilis ATCC 29413
MNRASKVEAILNAWLEFMALVDLNNAKIPGNEAVLSGVELDGNLVKINQSNFAEIKRQVSEETGQEDSIWVLSFPQLSTVNQGKSEYYPLFSLDVTSILKGEYQEDGWNLDNLELVEAGENLATFLKLDDEQREQLNSQDGFAQFLKSTFGIEFDTYESWMNQLQLHPYNYNIKRKPYLFKFTGSNFHINLKPDLKNIKSSAKNCLKSKHPAYEYLFGKPQLPAHKVTYTGAFPTHPPTDSQLQALKHSQTEPITAVQGPPGSGKTTLILHVIAQQVVKRALTLLETKEDINNLTVVSSTVNKAVENVIEKLDEYLKEKPLEDKFFYLKGGSKINIKAEGGAKDAIQLAITELLDKQSFDENIYNSLAEETKTIVANLKTQENNYLNLRRQRDADEIQQPQLQRKIQQIELEIESLKITQVQSERKVQELDLYEKLPIDVYKKIQIIFDNAKSNLPESNLPWWRKIILLLTRGTEKQILKKTASKCEEYILKTVDTPFPVKNPKTRSILLEQLSFINTRIERAEELQRVKNKLIEVSENIYILNNKLNSITSELASLEIRLEIKLKNFYDYFHVDYHEENKRLFELSRQLLKQEALRNKEDVKKSLTAYSNFITGTERTRRYFSQNSEKLEENLKAISLIFPVITSTLLSVKNMLPCVTNCVDRIIVDEAGMIPQHQTFPLLFRCRNAIIVGDPLQIEPIINLTNQRRKQYHDSAFIERGLSELDYHLYSPEETELATTYHRAAGVSGEDGDTGQGIKLVEHYRCQPSIIQFCDRIVGYGLQVKTKPVSSLLTTNLVAYHVEGSIDKDNVNTEEEAVVSEVIKHLISQGYSPEDIGVISPFSIHAQALRRNLPKQKELSGLQKEAIGTIHQFQGSQKRVIILSTKVCRPQDNRSCDWLNSKPNLLNVAVSRAEELFILVGNLYRLEKAQGYTRKLVEHIREHGEIFEYKSKDDFPEQRTGATLVLDCDHLDILKTAIDEADEEITIVTPWIRGLHNNSEPERFAREIVSALQRGVKIAVIYGYMGADGIDNNDIKAENHLRKLVPQYPGLTLHSLGKEQYKRSKGTNQRILICDSKFAVVGSWNWLSHLYRDYCIKNRGNTKAQIRQETSIKILESTLISEIKNQVKKYLKF

SEQ ID NO: 2090 - protein, 353 aa, Oryza sativa (japonica cultivar-group)
MAAATAAAETPPTLLEYMGQAGAADDLVVLVAHVQSACKRIAALVASPGNAELSRGKAGGGLAVAAGRDAPQAARRIVVMASEENHLPIWVSNDSPYVVVTDPLDGSRNIEVSIPTGTIFGIYNRLAELDHLPEEERAQLNSLQSGTHLVASGFGAGTHGFTLDHLTGEFVLTHPSIQIPPRGQIYSVNDARYFDWPEGLRKYIDTIRQGKGQHPKKYSARYVCSLVADFHRTLIYGGVAMNPRDHLRLVYEANPLSFLAEQAGGRGSDGKSRILSIQPVKLHQRLPLFLGGMEDMLELESYGDVQQKVNPGYESVHFSAMWSGRLADGTIKTRGHFRTCDCDETCCNIQTSG

SEQ ID NO: 2091 - protein, 392 aa, Dinemandra ericoides
DLEPVNPADVPVTAAGALKSYKLAAKAISRLQSLPSGNIPLLCDVLVKEVRDLTGYDRVMVYKFHEDEHGEVVSECRRSDMESYLGLHYPATDIPQASRFLFMKNKVRMICDCLSPPVEVIQDERLPQPLSLCGSTLRSPHGCHAQYMANMGTIASLVMSVTVNEDDDMMDGDQQRMARKLWGLVVCHHTSPRFVPFPLRYACEFLIQVFGVQINKEVDLAAQVREKHILRIQTMLCDMLLRDAPVAIITQSPNVMDLVKCDGAALYYKNKFWLLGVTPTEAQIRDIAEWLLEYHRGNTGLSTDSLMEAGYPGASVLGDAVCGMAAVSITSRDFLFWFRSHTAKEIKWGGAKHDPGDKDDGRKMHPRSSFKAFLEVVKWRSLPWKDMEMDAI

SEQ ID NO: 2092 - protein, 392 aa, Dinemandra ericoides
DLEPVNPADVPVTAAGALKSYKLAAKAISRLQSLPSGNIPLLCDVLVKEVRDLTGYDRVMVYKFHEDEHGEVVSECRRSDMESYLGLHYPATDIPQASRFLFMKNKVRMICDCLSPPVEVIQDERLPQPLSLCGSTLRSPHGCHAQYMANMGTIASLVMSVTVNEDDDMMDGDQQRMARKLWGLVVCHHTSPRFVPFPLRNACEFLIQVFGVQINKEVDLAAQVREKHILRIQTMLCDMLLRDAPVAIITQSPNVMDLVKCDGAALYYKNKFWLLGVTPTEAQIRDIAEWLPEYHRGNTGLSTDSLMEAGYPGASVLGDAVCGMAAVSITSRDFLFWFRSHTAKEIKWGGAKHDPGDKDDGRKMHPRSSFKAFLEVVKWRSLPWEDIEMDAI

SEQ ID NO: 2093 - protein, 68 aa, Glycine max
ALSPYNPFKSKFFEPFPSPFPKRGLFPKFLFLGGGSPLAYFSSPVSGAFFPIKKGPHLPPKLGPRGKI

SEQ ID NO: 2094 - protein, 392 aa, Hiraea fagifolia
DLEPVNPADVPVTAAGALKSYKLAAKAISRLQSLPSGNISLLCDVLVKEVRDLTGYDRVMVYKFHEDEHGEVVSECRRPDLESYLGLHYPATDIPQASRFLFMKNKVRMICDCLAPPVKVIQDKRLPQPLSLCGSTLRSPHGCHAQYMTNMRTIASLVMSVTINEDDDTMDGDQQQMTRKLWGLVVCHHTSPRFVPFPLRYACEFLIQVFGVQINKEVELAAQVREKHILQIQTMLCDMLLRDAPVAIITQSPNVMDLVKCDGAALYFKNKIWLLGVTPKEEQIRDIAEWLLEYHSGNTGLSTDSLMEAGYPGASVLGDAICGMAAASITSRDFLFWFRSHTAKEIKWGGAKHEPGDKDDGRKMHPRSSFKAFLEVVKWGSMPWEDIEMDAI

SEQ ID NO: 2095 - protein, 392 aa, Hiraea fagifolia
DLEPVNPADVPVTAAGALKSYKLAAKAISRLQSLPSGNISLLCDVLVKEVRDLTGYDRVMVYKFHEDEHGEVVSECRRPDLEPYLGLHYPATDIPQASRFLFMKNKVRMICDCLAPPVKVIQDKRLPQPLSLCGSTLRSPHGCHAQYMTNMRTIASLVMSVTINEDDDTMDGDQQQMTRKLWGLGCCHHTSPRFVPFPLRYACEFLIQVFGVQINKEVELAAQVREKHILQIQTMLCDMLLRDAPVAIITQSPNVMDLVKCDGAALYFKNKIWLLGVTPKEEQIRDIAEWLLEYHSGNTGLSTDSLMEAGYPGASVLGDAVCGMAAASITSGDFLFWFRSHTAKEIKWGGAKHEPGDKDDGRKMHPRSSFKAFLEVVKWRSMPWEDVEMDAI

SEQ ID NO: 2096 - protein, 392 aa, Hiraea fagifolia
DLEPVNPADVPVTAVGALKSYKLAAKAISRLQSLPSGNISLLCDVLVKEVRDLTGYDRVMVYKFHEDEHGEVVSECRRPDLESYLGLHYPATDIPQASRFLFMKNKVRMICDCLAPPVKVIQDKRLPQPLSLCGSTLRSPHGCHAQYMTNMRTIASLVMSVTINEDDDTMDGDRQQMTRKLWGLVVCHHASPRFVPFPLRYACEFLIQVFGVQINKEVELAAQVREKHILQIQTMLCDMLLRDAPVAIITQSPNVMDLVKCDGAALYFKNKIWLLGVTPKEEQIRDIAEWLLEYHSGNTGLSTDSLMEAGYPGASVLGDAVCGMAAVSITSRDFLFWFRSHTAKEIKWGGAKHDPGDKDDGRKMHPRSSFKAFLEVVKWRSMPWEDIEMDAI

SEQ ID NO: 2097 - protein, 395 aa, Legionella pneumophila str. Lens
MVFGFLNLSFWGYVLATFILTQITIASVTIYLHRNQTHRALTLHPVVSHFFRFWLWLTTGMVTADWVAIHRKHHATTDVEGDPHSPVVEGIRKVFWQGAELYREARKDRDMVAKYSHGTPTDWIERNVYSRHSSKGILLMLLLDLFFFGIPGMTVWAIQMMWIPLFAAGVINGIGHYWGYRNFECPDAATNIIPWGFWIGGEELHNNHHTFASSAKFSVKWWEFDIGWMYIRILSFFGLAKVKKLPPKLAMDEGKFHVDLDTVRAVISNRFQVMSDYYKNVIRPILKYEKNTGIETKEDKKLFQRAGRLLRREDKLLSTKAKTRLQKLLDAREQLRVVYSYKQSLQNVWLKTATTQKELVEALQQWCRQAEESGLDVLKQFAQQLKGYVPVYTRE

SEQ ID NO: 2098 - protein, 539 aa, Solanum tuberosum
MAVSSYARAFPSFECRSEPDFSGSLPHPKAGVRFSGKYNSGSNRSQVYGLSSLIFRFPPNFVRQLSIKARRNCSNIGVAQVVAASWSNNQAGPEFTPAANAVDSSASAAVTSIGITAGDEEVAVVENADCNDQNVQITGTGVKYASFLNSDGSVAIHAGERLGRGIVTDAITTPVVNTSAYFFNKTSDLIDFKEKRRASFEYGRYGNPTTVVLEEKISALEGAESTLIVASGMCASTVMFLALVPAGGHIVTTTDCYRKTRVFIETILPKMGITATVIDPADMGALELTLNQKKVDLFFTESPTNPFLRCVDIELVSKLCREKGALVCIDGTFATPLNQKALALGADLVVHSATKFLGGHNDVLAGCISGPEKLVSVIRNLHHILGGALNPNAAYLIIRGMKTLHLRVQQQNSTALRMAEILEAHPKVKHVYYPGLPSHPEYHLAKKQMTGFGGVVSFEVDGDLLTTAKFVDALRIPYIAPSFGGCESIVDQPAIMSYWDLSQSDRAKYGILDNLVRFSFGVEDFEDVKADVLQALDSI

SEQ ID NO: 2099 - protein, 1049 aa, Oryza sativa (japonica cultivar-group)
MVAARRSAASSSFFLLLLVLAVRVRASSDRVQERDRSALLELRGAAGLLGRWPTGSAVADHCSWPGVTCDASRRVVAVAVAAPPASGSSELAGELSPAVGLLTELRELSLPSRGLRGEIPAEIWRLEKLEVVNLAGNSLHGALPLAFPPRMRVLDLASNRLHGEIQGTLSDCKSLMRLNLSGNRLTGSVPGVLGSLPKLKLLDLSRNLLTGRIPSELGDCRELRSLQLFSNLLEGSIPPEIGRLRRLQVLDISSNRLNGPVPMELGNCMDLSVLVLTSQFDAVNLSEFNMFIGGIPESVTALPKLRMLWAPRAGFEGNIPSNWGRCHSLEMVNLAENLLSGVIPRELGQCSNLKFLNLSSNKLSGSIDNGLCPHCIAVFDVSRNELSGTIPACANKGCTPQLLDDMPSRYPSFFMSKALAQPSSGYCKSGNCSVVYHNFANNNLGGHLTSLPFSADRFGNKILYAFHVDYNNFTGSLHEILLAQCNNVEGLIVSFRDNKISGGLTEEMSTKCSAIRALDLAGNRITGVMPGNIGLLSALVKMDISRNLLEGQIPSSFKELKSLKFLSLAENNLSGTIPSCLGKLRSLEVLDLSSNSLSGKIPRNLVTLTYLTSLLLNNNKLSGNIPDIAPSASLSIFNISFNNLSGPLPLNMHSLACNSIQGNPSLQPCGLSTLANTVMKARSLAEGDVPPSDSATVDSGGGFSKIEIASITSASAIVAVLLALIILYIYTRKCASRQSRRSIRRREVTVFVDIGAPLTYETVVRATGSFNASNCIGSGGFGATYKAEIAPGVLVAIKRLAIGRFQGIQQFQAEVKTLGRCRHPNLVTLIGYHLSDSEMFLIYNFLPGGNLERFIQERAKRPIDWRMLHKIALDIARALGFLHDSCVPRILHRDVKPSNILLDNEYNAYLSDFGLARLLGNSETHATTGVAGTFGYVAPEYAMTCRVSDKADVYSYGVVLLELISDKKALDPSFSPYGNGFNIVAWACMLLQKGRAREFFIEGLWDVAPHDDLVEILHLGIKCTVDSLSSRPTMKQVVRRLKELRPPSY

SEQ ID NO: 2100 - protein, 540 aa, Solanum tuberosum
MAVPSSARAFPSFQCRSDPDFSGGVPRHDLPNAGVRFSVKVKSLSRGSSVHGMSSLILRFPPNFVRQLSVKARRNCSNIGLAQVVAASWSNNHASPDFTPAAKAVDAASIAPFDITTGDEEGAVVEDSPRADRNVQIEDLTDVKYSSFLSSDGSIAIHAGERLGRGIVTDAITTPVVNTSAYFFKKTSDLIDFKEKKRASFEYGRYGNPTSIVAEEKISALEGADATLLMASGMCASTVLLLALVPAGGHIVTTTDCYRKTRIFIETILPKMGITATVIDPADIGALESVLNQKKVTLFFTESPTNPFLRCVDIELVSKLCHEKGALVCIDGTFATPLNQKVLALGADLVVHSATKYLGGHNDVLGGCISGPDKLVSAVRTLHHILGGAINPNAAYLIIRGMKTLHLRVQQQNSTAQRIAEILEAHPKVRCVYYPGLPSHPEYHLAKRQMTGFGGVVSFEVDGDLLTTAKFVDALKIPYIAPSFGGCESIVDQPAIMSYWDLKESERAKYGIMDNLVRFSFGVEDFEDLKADILQALESM

SEQ ID NO: 2101 - protein, 175 aa, Triticum aestivum
MPPTVMPSSATSVAPFQGFKSTAAFPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPACEESGKA

SEQ ID NO: 2102 - protein, 463 aa, Nostoc sp. PCC 7120
MADLTPNSSFSVTLRLQIPNRVGMLASITQAIASSGGNLGQIDLIEQTRQVSLRDLTVDAASTEHAETIVQAVKAIPDIKLVSVYDRTFNLHRGGKISITSRIPLKSVSDLAMAYTPGVGRVCTAIAQDPSQVYNLTIKQNTVAIVTDGSAVLGLGNLGPHAALPVMEGKAMLFKEFAGLDAFPICLATQDTEEIIQAVKNIAPVFGGVNLEDIAAPRCFEIEKRLRDELDIPVFHDDQHGTAIVTLAALFNSLKLVQKSLADIRIVINGAGAAGVAIARLLRKAGAEKIWMCDSKGIISTTRTDLNEEKQEFAVKAQGTLAGAVQGADVFIGVSAPGVLTPEMVKSMAKDAIVFAMANPIPEIQPELISKDVAVIATGRSDYPNQINNVLAFPGVFRGALDCRAQTITTTMYLEAASAIASLVNPSDLSREHIIPSVFDERVVTAVAAAVQRAAREEGIARG

SEQ ID NO: 2103 - protein, 278 aa, Glycine max
MGELYALDFDGVICDSCGESSLSALKAAKVRWPGLFDGVDSTTENWIIDQMHTVRPVVETGYENVLLVRLLLESRTPTIRKSSVAEGLTVEGILENWSKLKPIIMEEWDEKRDDLIDLFGKVRDEWLEQDFATWIGANRLYPGVSDALKFASSRVYIVTTKQYPNPLFLLFQSRFADALLRELAGVTIPPERIYGLGTGPKVEVLKQLQKKPEHQGLTLHFVEDRLATLKNVIKEPELDQWNLYLGNWGYNTQKEREEAAAIPRIHVLELSDFSKKLK

SEQ ID NO: 2104 - protein, 171 aa, Frankia sp. R2
FFIHDPITKEQYSRDPRNIAKKAEAYLRGTGIADTAYFGPEAEFYIFDDVRYDYNPYGSMHAVDSVEAAWNTARKEEGGNLGYKPRFKGGYFPVPPTDHFTDLRSEMTRVLFEVGITVEMQHHEVGTAGQAEIDIRYDTLLKTADNLMLYKYVIRNVARSRGKTVTFMPKP

SEQ ID NO: 2105 - protein, 323 aa, Gluconobacter oxydans 621H
MTQTAAPAWSTDSLERLDGKTALITGSTGGLGFEVACGLAKQGAAILLSGRNHNKGQAALARLHERVPFVKARFELLDLASLAGIEAFASAMRSRGEPIHLLANNAGVMGPATRLTTKDGFELQFGTNHLGHFALTGRLLPLLAAGNATVMTVASLAALKGEIPFGDLNARHSYNPMVRYRQSKLCNLLFALELNRRALKAPWPIHSRAAHPGWAASDIVANNGSLDQSANKAARFMRGLARRVAGPVFHAMGQTVEEGAWPLLYALASPEARDGGYYGPQGPGERRGVPGIAGLPALAHVPELAERLWTVSEQMTGVKYGLV

SEQ ID NO: 2106 - protein, 177 aa, Brassica napus
MGGGFFVTDSSHREEYEEGGVTSFVVIACIVAAMGGLLFGYDIGISGGVTSMEEFLTRFFPDMQRQMQNETGRETEYCKYDNELLTLFTSSLYLAALFASFLASSITRLFGRKVSMTIGGLAFLSGALLNGFAISLEMLIIGRLLLGVGVGFVNQAVPLYLSEMAPAKIRGALNMAF

SEQ ID NO: 2107 - protein, 658 aa, Oryza sativa (japonica cultivar-group)
MATLARRSMVALGRRALCSGSDLEAAAREVVCSGAGSLDEVGGALDRLGVAVSPAMVARVIDACSERMGSGRRLLRFLSWCRSKDAGGIGDEALDSAIAALARMGDLTAMRIAVADAEKDGRRMSPETFTVVVEALVKLGKEDEAVRLFRGLERQRLLPRRDAGDGGEGVWSSSLAMVQALCMKGHAREAQGVVWHHKSELSVEPMVSIVQRSLLHGWCVHGNAKEARRVLDDIKSSCTPLGLPSFNDYLHCLCHRNLKFNPSALVTEAMDVLSEMRSYGVTPDASSLNILLSCLGRARRVKESYRILYLMREGKAGCSPDWVSYYLVVRVLYLTGRIIRGKRLVDDMLESGVLPTAKFFHGLIGVLCGTEKVDHGLDMFRLMKRCQLVDTHTYDLLIEKLCRNGRFENGKELWDDAKKNGFMLGCSEDLLDPLKTEEQQQDFGVLLKQGAEGRVFVSTFVGRKCVIKERFSKKYRHPLLDSKLTLKRLNAEARCMTKARKLGVPTPVLYAVDPLLHTLTFEYVDGLSVKDILLGFGSNGINEEQLIDIATQIGNAVGKLHDGGLVHGDLTTSNMIIKNNTNQLVLIDFGLSFISTIPEDKAVDLYVLERALISMHSSCGDVMEKILTAYRKASKQWCATTNKLAQVRQRGRKRTMIG

SEQ ID NO: 2108 - protein, 392 aa, Hiraea fagifolia
DLEPVNPADVPVTAAGALKSYKLAVKAISRLQSLPSGNISLLCDVLVKEVRDLTGYDRVMVYKFHEDEHGEVVSECRRPDLESYLGLHYPATDIPQASRFLFMKNKVRMICDCLAPPVKVIQDKRLPQPLSLCGSTLRSPHGCHAQYMTNMRTIASLVMSVAINEDDDTMDGDQQQMTRKLWGLVVCHHASPRFVPFPLRYACEFLIQVFGVQINKEVELAAQVREKHILQIQTMLCDMLLRDAPVAIITQSPNVMDLVKCDGAALYFKNKIWLLGVTPKEEQIRDIAEWLLEYHSGNTGLSTDSLMEAGYPGASVLGDAVCGMAAVSITSRDFLFWFRSHTAKEIKWGGAKHDPGDKDDGRKMHPRSSFKAFLEVVKWRSMPWEDVEMDAI

SEQ ID NO: 2109 - protein, 302 aa, Brassica napus
MTLYIRREASKLWKRVCSEIATEIGLLADNWKYLLAGLLCQYIHGLAARGVHYIHRPGPTLQDLGYILLPELGQDKSYISETVFTCVFLSFVLWTFHPFIIKSKKIYTVLIWCRVLAFLVACQFLRVITFYSTQLPGPNYHCREGSELARLPRPHSVLEVLLLNFPRGVIYGCGDLIFSSHMIFTLVFVLTYQKYGSKRFIKLLGWIIAILQSLLIIASRKHYTVDVVVAWYTVNLVVFFLDKKLPELPDRTTVLLPVSSKDRTKEENHKLLNGNGVDPADRRPRAQVNGNGGHTDNATNGA

SEQ ID NO: 2110 - protein, 392 aa, Janusia californica
DLEPVNPADVPVTAAGALKSYKLASKAISRLQSLPSGNISLLCDVLVKEVRDLTGYDRVMVYKFHEDEHGEVVSECRRSDLESYLGLHYPATDIPQASRFLFMKNKVRMICDCLAPPVKVIQDERLPQPLSLCGSTLRSPHGCHAQYMTNMGTIASLVMSVTVNEGDDTMDGDQQRMTRKLWGLVVCHHTSPQFVPFPLRYACEFLIQVFGVQINKEVELAAQVREKHILQIQTMLCDMLLRDAPVAIITQSPNVMDLVKCDGAALYFKNKTWLLGVTPTEEQIRGIAEWLLKYHSGNTGLSTDSLMEAGYPGASGLGDAVCGMAAVSITSRDFLFWFRSHTAKEIKWGGAKHDPDDKDDLRKMHPRSSFKAFLEVVKWRSMPWEDVEMDAI

SEQ ID NO: 2111 - protein, 392 aa, Janusia californica
DLEPVNPADVPVTAAGALKSYKLASKAISRLQSLPSGNISLLCDVLVKEVRDLTGYDRVMVYKFHEDEHGEVVSECRRSDLESYLGLHYPATDIPQASRFLFMKNKVRMICDCLAPPVKVIQDERLPQPLSLCGSTLRSPHGCHAQYMTNMGTIASLVMSVTVNEDDDTMDGDQQQMTRKLWGLVVCHHTSPQFVPFPLRYACEFLIQVFGVQINKEVELAAQVREKHILQIQTMLCDMLLRDAPVAIITQSPNVMDLVKCDGAALYFKNKTWLLGVTPTEEQIRGIAEWLLKYHSGNTGLSTDSLMEAGYPGASGLGDAVCGMAAVSITSRDFLFWFRSHTAKEIKWGGAKHDPDDKDDLRKMHPRSSFKAFLEVVKWRSMPWEDVEMDAI

SEQ ID NO: 2112 - protein, 120 aa, Oryza sativa
SPSSRRAVDRPCPGILILLMVMLLLGVWGIFTYEDFMEEAAEQLRWALVLAPVEVVLLIRWMSFVDTFDGYFSLYPTERLWNRYYQNPDERSYPWGVAMDVLLILVLDYLHYTLQDMWKP

SEQ ID NO: 2113 - protein, 392 aa, Janusia californica
DLEPVNLADVPVTAAGALKSYKLASKAISRLQSLPSGNISLLCDVLVKEVRDLTGYDRVMVYKFHEDEHGEVVFECRRSDLESYLGLHYPATDIPQASRFLFMKNKVRMICDCLAPPVKVIQDERLPQPLSLCGSTLRSPHGCHAQYMTNMGTIASLVMSVTVNEDDDTMDGDQQQMTRKLWGLVVCHHTSPQFVPFPLRYACEFLIQVFGVQINKEVELAAQVREKHILQIQTMLCDMLLRDAPVAIITQSPNVMDLVKCDGAALYFKNKTWLLGVTPTEEQIRGIAEWLLKYHSGNTGLSTDSLMEAGYPGASGLGDAVCGMAAVSITSRDFLFWFRSHTAKEIKWGGAKHDPDDKDDLRKMHPRSSFKAFLEVVKWRKMPWEDIEMDAI

SEQ ID NO: 2114 - protein, 211 aa, Carica papaya
MSYDYLFKYIIIGDTGVGKSCLLLQFTDKRFQPVHDLTIGVEFGARMVAIDGRPIKLQIRDTAGQESFRSITRSYYRGAAGALLVYDITRRETFNHLASWLEDARQHANPNMSIMLIGNKSDLSHRRAVSKEEGEQFAKEHGLLFLEASARTAQNVEEAFIRTAAKILQNIQEGVIDVSNESSGIKFGYGRPQGTAGARDGAVAQRSGCCG

SEQ ID NO: 2115 - protein, 392 aa, Mascagnia chasei
DLEPVNPADVPVTAAGALKSYKLASKAISRLQSLPSGNISLLCDVLVKEVRDLTGYDRVMVYKFHEDEHGEVVSECRRSDLESYLGLHYPATDIPQASRFLFMKNKVRMICDCLAPPVEVIQDERLAQPLSLCGSTLRSPHGCHAQYMTNMGTIASLVMAVTINEDDDMMDGDQQQMTRKLWGLVVCHHTSPRFVPFPLRYACEFLIQVFGVQINKEVELAAQVREKHILQIQTMLCDMLLRDAPVAIIMQSPNVMDLVKCDGAALYFKNKTWLLGVTPTEEQIRDIAEWLLEYHSGNTGLSTDSLMEAGYPGASALGDAVCGMAAVSITSRDFLFWFRSHTAKEIKWGGAKHDPDVKDDGRKMHPRSSFKAFLEVVKWRKMPWENIEMDAI

SEQ ID NO: 2116 - protein, 554 aa, Hypocrea jecorina
MAPTNTLPAWSELQAHRDDIAKNFVLKEAFASDADRFNKFSRTFKSDGVSADILFDFSKNFLTNETLDLLVKLADEAGVERKRDAMFRGDKINFTENRAVYHTALRNVGGWEMKVEGQDVMNGPNGVNSVLQHMKEFSEQVRSGEWVGYTGKKLTNIVNVGIGGSDLGPVMVTEALKHYGAPDMTLHFVSNIDGTHMAEALKASDPETTLFLIASKTFTTAETITNANTAKAWFIEKTGGKGDVAKHFVALSTNEEEVTKFGIDKANMFGFESWVGGRYSVWSAIGLSVALYVGYDNFHKFLAGAHAMDKHFRETPLRDNIPVIGGLLGVWYADFFQAQTRLVAPSFDQYLHRFAAYLQQLSMESNGKAITSDGSSAKYTTGSILFGEPCTNAQHSFFQLVHQGTKLIPADFILAAKSHNPIHDNLHQKMLASNYFAQAEALMVGKTDDQLRAEGTPEELIPHKRFLGNRPTTSILVGDVIGPAELGALIAYYEHLTFVEGAVWDINSFDQWGVELGKVLAKKILKELDEPGNGEGHDASTGGLIGAFKSFAKI

SEQ ID NO: 2117 - protein, 171 aa, Frankia sp. PtI6
FFIHDPITKEQYSRDPRNIANKAEAYLRGTGIADTAYFGPEAEFYIFDDVRYDYNPYGSMHAVDSVEAAWNTARKEEGGNLGYKPRFKGGYFPVPPTDHFTDLRSEMTRVLFEVGITVEMQHHEVGTAGQAEIDIRYDTLLKTADNLMLYKYVIRNVARRPRKTVTFMPKP

SEQ ID NO: 2118 - protein, 326 aa, Ralstonia metallidurans CH34
MAELHMVEAVNLALAHALANDPDVVLLGEDIGVNGGVFRSTVGLQSRFGEARVIDTPLAEGAIVGAAIGMAAMGLKPVAEIQFAGFIYPAIDNILNHAGHMRHRTRGRITCPMVVRAPSGAGIHAPEHHSESPEALFAQMPGIRVVMPSSPARAYGLLLAAIRDPDPVIFLEPTRLYRLFRQEVADDGQALPLDACFTLREGTDLTLVSWGAMLRETLAAADVLADDGVSAAVIDVATLKPLDMETILESVAQSGRCVIVHEAPRTAGLGAEIAANLADAGLYSLSAPVQRVTAPDTVVPLARLEHSYMPSVARIVDAARRALEAA

SEQ ID NO: 2119 - protein, 171 aa, Acidothermus cellulolyticus
FFIHDPLTGEAYSRDPRNVARKAEAYLVSTGIADTAYFGPEAEFYIFDEVRFETSAHQSYYHIDSVAGAWNTGRIEDNGNRGYKVRYKGGYFPVPPTDHFADLRAEMARELIRAGILVEKQHHEVGTAGQAEINYKFNTLLRAADDMQLFKYIVKNVAWRAGKTVTFMPKP

SEQ ID NO: 2120 - protein, 156 aa, Candidatus Kuenenia stuttgartiensis
MEKTLIILKPDAIQRRLLGKIISRFEEKGLQITGMKMMMIPGSLARAHYVSHKGKDFFEPLVSYTTSSPVVVIVVKGKNAIEIARKMMGVTFGSKAEPGTIRGDYAVSNRFNLIHGSDSPSSAEKEIAAFFTKEEIVDYQPIDLSWVYDISEGGMV

SEQ ID NO: 2121 - protein, 427 aa, Oryza sativa
  misc_feature (231)..(231): Xaa can be any naturally occurring amino acid
  unsure (1)..(427): unsure at all Xaa locations
MSKAAAAASLPPPPPEVAHLVDQLQRHHLAPDASLLSSCAHSDLLQAREEVASERARYLEALAVYAEAIAMVEEYQHAISTGVANAGKKLNCSPQVYESLEHHLAVAEAAQRLRLPLLSQDGDVHEEEIEKLSTLSRSSFDSTMTSAAPSSSSISTSYNNYSSTASAATVAAAPGTGGSEPVEPGVGGVPDRFLGITSDYLYQVQQEQPAMTDMVDYQRTLAREIEGPLRXKCDALADLFAMDERDSSSISQISSARLPERVKLIIEEIEKEEALLLDDLASMDRKFAEHYNVLEQILAVLIQFVKDKKLEHQHQYDDLKKTWLIKRCRTMNAKLSYLEHHLLRDTYTKETVPALHRIRKYLVEATKEASNSYTEAVSRLREYQGVDPHFDVIARQYHEIVKKLEGMQWTIHQVEMDLKPHHDHADV

SEQ ID NO: 2122 - protein, 535 aa, Oryza sativa
MAATPTLSGSLRALACGVTRDSTPACYSFSRVLIMDPTSVPWSSMVYGLLGLALLWQVHRLLVRLWWQPRRLERALRAQGVRGTSYRFLTGDLKDYGRLSKEAWARPLPLRCHDIAPRVAPFVHRTIAEHGKACLSWFGPIPKVTIADAEIAKDVLSNKMGHFEKLKFPVLSKLLADGVANYEGEKWAKHRRILNPAFHLEKLKLMLPAFSACCEELVGRWAASLGSDGSNEIDVWPEMQSLTGDVISRTAFGSSYLEGRRIFQLQAEQQELFMGAIQKISIPGYMSLPTKNNRRMYQIKNEVESIIRDLVQKRMHAMKDGERTKDDLLGILLESSTRHADENGHSGPGMTIEEVMEECKVFYFAGMETTAILLTWTMVVLSMHPEWQHRAREEVTMILYEVLRLYPPGIGFVRQTYKEMEIGGVKYPAGVMIELPLLFIHHDPDIWGSDVNEFKPERFAEGISRASNDHGAFFPFGWGPRICMGQNFALLEAKMALCMILQRFEFELAPSYTHAPHIVLMLRPMHGAPIKLRAI

SEQ ID NO: 2123 - protein, 379 aa, Glycine max
MATQGQVITCKAAVAWEPNKPLTVQDVQVAPPQAGEVRVQILFTALCHTDAYTWGGKDPEGLFPCILGHEAAGIVESVGEGVTNVQPGDHVIPCYQAECGECKTCKSGKTNLCGKVRSATGVGVMLNDGKSRFSINGKPIYHFMGTSTFSQYTVVHDVSVAKIDPKAPLEKVCLLGCGVSTGLGAVWNTAKVESGSIVAIFGLGTVGLAVAEGAKTAGASRVIGIDIDSKKFDVAKNFGVTEFINPNEHDKPIQQVIIDRTDGGVDYSFECIGNVSVMRAALECCHKGWGTSVIVGVAASGQEISTRPFQLVSGRVWKGTAFGGFKSRSQVPWLVDKYLKKEIKVDEYITHTLTLSEINKAFDLLHEGGCLRCVLSTQE

SEQ ID NO: 2124 - protein, 680 aa, Mycobacterium smegmatis str. MC2 155
MDFFSAYRHGFARLAACTHHTSLADPPANAESVLRLAQACHDDGVAVAVFPELTLSGYSIEDILLQDTLLESVQEALTELVAATSVLTPVLVIGAPLRHRHRIYNTAVVIHRGAVLGVVPKSYLPTYREFYERRQMAAGDQTRGTIRVAGAEVPFGPDLLFAASDVPGLVLHVEICEDMFVPIPPSAQAALAGATVLANLSGSPITVGRAEDRCLLARSASARCLAAYVYAAAGEGESTTDLAWDGQTMIWENGNLLAESERFPRGERRAVADVDLELIRNERVRMGTFDDNARHHGAAVDAFRRIEFQLDPPTGDIGLLREIERFPFVPSNYERLQQDCYEAYNIQVSGLEQRLRALNYPKIVLGVSGGLDSTHALIVAARAMDREGRPRSDILAFTLPGFATGDRTKNNAVRLSRALGVTFEEIDIKQTAQLMLTEMGHPFGRGEKVYDVTFENVQAGLRTDYLFRLANQRGGIVLGTGDLSEIALGWSTYGVGDQMSHYNVNGGVPKTLIQHLIRWVISSGEFNDEVNEVLQSVLDTEITPELVPTGEDEEIQSSEAKVGPYALQDFSLFQVLRFGFRPSKVAFLAWHAWHDVGAGDWPPGFPEHERPSYSLKEIRHWLQVFAQRFYSFSQFKRSAMPNGPKVSHGGALSPRGDWRAPSDMSARIWLDEIEREIPES

SEQ ID NO: 2125 - protein, 392 aa, Peixotoa glabra
DLEPVNPSDVPVTAAGALKSYKLAAKAISRLQSLPSGNISLLCDVLVKEVRDLTGYDRVMVYKFHEDEHGEVVSECRRSDLESYLGLHYPATDIPQASRFLFMKNKVRMICDCLAPPVQVIQDERLPQPLSLCGSTLRSPHGCHAQYMTNMGTIASLVKSVTVNEDDDTMDGDQQQMTRKLWGLVVCHHTSPRFVPFPLRYACEFLIQVFGVQINKEVELAAQVREKHILQIQTMLCDMLLRDAPVAIITQSPNVMDLVKCDGAALYFKNKTWLLGVTPTEEQIRDIAEWLLKYHSGNTGLSTDSLMEAGYPGASTLGDAVCGMAAVSITSRDFLFWFRSHTAKEIKWGGAKHDPDDKDDLRKMHPRSSFKAFLEVVKWRSMPWEDVEMDAI

SEQ ID NO: 2126 - protein, 277 aa, Cyanothece sp. ATCC 51142
MIMRFRTLLIAFLALCLGLITACSEGPANAVNPQDLTYDEILNTGLANKCPQISEFTRGSIPIEPGQTYFVDDLCLEPQEYFVKEEPVNKRQEAEYVPGKLLTRYTTSLEQISGKITVDEDGVVTFYEEGGIDFQPVTVQLPGGEQVPFFFTIKNLVGKTEPGFSSINSSIDFEGDFRVPSYRGATFLDPKGRGLATGYDNAVALPATADKEDYANVKQTPIGKGSISLQVTKVDQATGEIAGVFDSEQPSDTDLGAKEPVEVKIRGIFYARVTPEA

SEQ ID NO: 2127 - protein, 478 aa, Candidatus Pelagibacter ubique HTCC1002
MLDKKKFYINGEWVSPKKPNDFKVTDPSTEEECAVISLGGVEDVNDAVSAATKAFETWAFSTKEERLKYLEALYAVYKKRWADMAKAITLEMGAPIDFSTQLQAGTGASHIKSYIKVLKEYTFEAKLGEHALNNNILHEPKGVCALITPWNWPMNQTCLKVIPAIAAGCTMVLKPSEIAPLSSMILAEMIDEIKLPKGVFNLVNGDGAVTGNALTSHPDVNMVSFTGSTRAGALISQNAANDFKRVSLELGGKGANIIFKDADAEAVERGALRCFRNSGQSCNAPTRMLVEKSIYDETVERVKNFANSMKVDIATKEGDHIGPVVSKAQFDKIQALIQVGIDEGAKLVAGGTGKPDGLDKGYFVKPTAFADVNNQMQIARTEIFGPVLSIIPFETEEEAIAIANDTPYGLLNFIQTQDQEKANRVARKLRSGMVDINGAGLAPDAPFGGYKHSGIGREAGKLGLEEYLEVKVVSGWND

SEQ ID NO: 2128 - protein, 392 aa, Tetrapterys discolor
DLEPVNPADVPVTAAGALKSYKLAAKAISRLQSLPSGNISLLCDVLVKEVRDLTGYDRVMVYKFHEDEHGEVVSECRRSDLESYLGLHYPATDIPQASRFLFMKNKVRMICDCLAPPVKVIQDERLPQPLSLCGSTLRSPHGCHAQYMTNMGTIASLVMSVTVNDDDDMMDGDQQQMTRKLWGLVVCHHTSPRFVPFPLRYACEFLIQVFGVQINKEVELTAQVREKHILQIQTMLCDMLLRDAPVAIITQSPNVMDLVKCDGAALYFKKKTWLLGVTPMEEQVRDIAEWLLEYHSGSTGLSTDSLMEAGYPGASDLGDAVCGMAAVSITSRDFLFWFRSHTAKEIKWGGAKHDPDDKDDGRKMHPRSSFKAFLEVVKWRSVPWEDIEMDAI

SEQ ID NO: 2129 - protein, 392 aa, Tristellateia madagascariensis
DLEPVNPADVPVTAAGALKSYKLAAKAISRLQSLPSGNISLLCDVLVKEVRDLTGYDRVMVYKFHEDEHGEVVSECRRSDLESYLGLHYPATDIPQASRFLFMKNKVRMICDCLAPPVKVIQDERLPQPLSLCGSTLRSPHGCHAQYMANMGTIASLVMSVTINEDDDTMDGDQQQMARKLWGLVVCHHTSPRFVPFPLRYACEFLIQVFGVQINKELELAAQVREKHILRIQTMLCDMLLRDAPVGIITQSPNVMDLVKCDGAALFYKNKFWLLGITPTEAQIRDIAEWLLEYHSGNTGLSTDSLMEAGYPGASVLGDAVCGMASVSITSRDFLFWFRSHTAKEIKWGGAKHDPDDKDDGRKMHPRSSFKAFLEVVKWRSLPWKDMEMDAI

SEQ ID NO: 2130 - protein, 545 aa, Photorhabdus luminescens subsp. laumondii TTO1
MTPGELRRLYLIIRVFLSYGLDELIPRIRLTWPLRFGRYLLFWIPNRHKDKSLGERLRLALQELGPVWIKFGQMLSTRRDLFPPAIADQLALLQDRVASFDGALARQYIETALGGALETWFDDFEPIALASASIAQVHTARLKENGQEIVIKVIRPDILPIIKADIRLMYRLANWVPMLLPDGRRLRPREVVREYEKTLIDELNLLREAANAIQLRRNFENSSTLYVPEIYSDYCRENVLVMERVYGIPVSDIEALEAQNTNMRLLAERGVQVFFTQVFRDSFFHADMHPGNIFVSYEHPEDPFYIGIDYGIVGSLNKDDKRYLAENFIAFFNRDYRKVAELHVDSGWVPSDTNVEDFEFAIRTVCEPIFEKPLAEISFGHVLLNLFNTARRFNMAVQPQLVLLQKTLLYVEGLGRQLYPQLDLWKTAKPFLEEWLHSQVGLPAVIRALKEKVPYWAEKLPELPELVYDSLQQHKHLQVSIEKLSGHLRGQQIKQRQSQYLLGVGATLFLCGSLFLLSGLANIPWLFIGAGTVSWLFGWCRLCKI

SEQ ID NO: 2131 - protein, 452 aa, Legionella pneumophila str. Lens
MKTKHFDLIVLGGGSGGIASAVRAAQYGAKVAVIEQNHLGGTCVNLGCVPKKIMYNASSIAETLHKSPDYGFFLENNAKLDWKRLVNKRNAYIERLRENYAQRFSQHKITLIQGKGIFHDQSSITIDHTIYQAEHIIIATGGEPALPAINGIKHAIDSDGFFSLTKLPAKVAVIGSGYIGVELAGILNSLGSETHLLMRGTRPLSRFDHMIGDTLMEIMQKQGICIHQNHKAQAIHLHSDGRKSILCQSGSIIGNIDVIISAVGRKPRTGNLNLDKINVITDDKGLILVDAFQNTSVKGVYAIGDVTNAPALTPVAIAAGRRLADRIFGNQPDACLNYDNICSVVFSHPPSGSVGLTEYEAIEKYGKNKIKIYQTRFIPMYDALSIDKTPTAMKLVTLGKKEKIIGLHVVGYSADEMLQGFGVAIKMGACKKDFDNTIAIHPTSAEEFVTMV

SEQ ID NO: 2132 - protein, 392 aa, Tristellateia madagascariensis
DLEPVNPADVPLTAAGALKSYKLAAKAISRLQSLPSGNISLLCDVLVKEVRDLTGYDRVMVYKFHEDEHGEVVSECRRSDLESYLGLHYPATDIPQASRFLFMKNKVRMICDCLAPPVKVIQDERLPQPLSLCGSTLRSPHGCHAQYMANMGTIASLVMSVTINEDDDTMDGDQQQMARKLWGLIVCHHTSPRFVPFPLRYACEFLIQVFGVQINKELELAAQVREKHILRIQTMLCDMLLRDAPVGIITQSPNVMDLVKCDGAALFYKNKFWLLGITPTEAQIRDIAEWLLEYHSGNTGLSTDSLMEAGYPGASVLGDAVCGMASVSITSRDFLFWFRSHTAKEIKWGGAKHDPDDKDDGRKMHPRSSFKAFLEVVKWRSLPWEDVEMDAI

SEQ ID NO: 2133 - protein, 392 aa, Tristellateia madagascariensis
DLEPVNPADVPLTAAGALKSYKLAAKAISRLQSLPSGNISLLCDVLVKEVRDLTGYDRVMVYKFHEDEHGEVVSECRRSDLESYLGLHYPATDIPQASRFLFMKNKVRMICDCLAPPVKVIQDERLPQPLSLCGSTLRSPHGCHAQYMANMGTIASLVMSVTINEDDDTMDGDQQQMARKLWGLVVCHHTSPRFVPFPLRYACEFLIQVFGVQITKELELAAQVREKHILRIQTMLCDMLLRDAPVGIITQSPNVMDLVKCDGAALFYKNKFWLLGITPTEAQIRDIAEWLLEYHSGNTGLSTDSLMEAGYPGASVLGDAVCGMASVSITSRDFLFWFRSHTAKEIKWGGAKRDPDDKDDGRKMHPRSSFKAFLEVVKWRSLPWEDVEMDAI

SEQ ID NO: 2134 - protein, 318 aa, Oceanobacter sp. RED65
MNQLMNNAEIEALISSNLLPKNYQEGIRRYLIPLAQSICQHHEQFYKGKTWYIGLQGTQGSGKSTTAEFLRALIEQYPLSVTLVSIDDFYLTHQERTELSESVHPLLKTRGVPGTHDVQLAMDTLTGLSQEKITNVPHFDKAMDDRSSKTYWEKVHGAVDIVIFEGWCVGLPAQSDSELKTDVNELEAKEDTDHQWRQYVNEKLASEYQALYALLEDLIVLQAPDFDCVYEWRLLQEEKLKKAAIAESRSLDRIQSPEQIKRFISHYQRLTEHGLQNLKDYARWILKLNNQHEFTELVDQKPKKVLGQSQQEKGGEHE

SEQ ID NO: 2135 - protein, 384 aa, Haloarcula marismortui ATCC 43049
MSQDFYEILGVSRDASEDEIQEAYREKAREYHPDVSDDPDAEEKFKQAKKAKEVLTDEEKRQMYDQMGHERFEQAEKRGGAGGGGGRGGMGGDPFGGGAGGFDMQDIFDQFFGGGGRGGRGGSRRRQGQDLQTRLEIDLEEAYNGATKQLNVTRPEACDDCDGAGHPPGADSETCPECNGQGQTTQVQQTPMGRVQQRTTCRRCDGEGTLYDETCSTCRGNGVVQNDASLEVEIPSGIADGQTLRMEREGAPGENGGPNGDLLIEVQVRDHPDFERDGDSLQHQQAISFPQAVFGDTITVPTLDGEVEVDVPSGTQSGEVFRLEGKGMPRLRRRGHGDLYVQVQVVTPDSLNAEQKEALEQFAEAGGEEVDVDEGFFEKLKNSL

SEQ ID NO: 2136 - protein, 463 aa, Acinetobacter sp. ADP1
MLDSAAPLKRAMSTRHLVMLSLGGAIGTGLFLGSGEVITQTGPIGAVIAYMLGGLIAYMVMLCLGELAVHMPVSGSFGAYAKKYIGPGTGYMISWVYWLTWTATLGTEFTAAALLMQEWFPHTSMWIWTIIFALTIFGLNLSSTHIFAESEFWLSLVKVLTVISFIILGLLAIFGIIHFEGHASAPLFSNLTSHGWFPQGLMPIFATMLIVNFAFSGTELIGVAAGETKDPSINVPKAINAAIWRLLIFFVGTIVVISALLPYDQTGLGGHNVSNSPFVTVFQYIGIPYADHIIRFVIITALLSAANSGLYAASRMMWSLSNQRQLPSVFSKLTASGTPIIALVVTMFGAIPGLLSEQFAPETIFKNLLGVAAFTMVIVWMSICLSQFNFRRHWYKQGYHAKDLKFAAPLFPILPILGFLFCLITGLSMAKDPEMLPGFIGCLIFVACCYLSHYIFYREKSKL

SEQ ID NO: 2137 - protein, 150 aa, Capsicum annuum
MADQLTDDQISEFKEAFSLFDKDGDGCITTKELGTVMRSLGQNPTEAELQDMINEVDADGNGTIDFPEFLNLMARKMKDTDSEEELKEAFRVFDKDQNGFISAAELRHVMTNLGEKLTDEEEVDEMIREADVDGDGQIQYDEFVKVMMAK

SEQ ID NO: 2138 - protein, 458 aa, Triticum aestivum
  misc_feature (254)..(254): Xaa can be any naturally occurring amino acid
  unsure (1)..(458): unsure at all Xaa locations
MAVVDKAVAGGGEAQQREPEPEPAAEASTFAELGICRELVEACDAMGWKQPTKIQAGAIPHALQGRDVIGLGQTGSGKTGAFALPIIQALLEHRQPFFACIMSPTRELAIQIAEQFEALGSAIGLVCSVLVGGVDRMQQVLSIAKRPHIVVGTPGRLLDHLKDTKGFSLTKVKYLVLDEADKLLNLEFKESLDDILKVIPKERRTYLFSATMTKKVSKLQRACLRNPVKVEVSSKYSTVDTLKQEWYFVPADYXDCYLVHVLNELPGSMIMIFVRTCESTRLLALTLRNLGFKALSISGQMSQDKRLGALNKFKAKDFNILICTDVASRGLDIQGVDVVMNYDIPMNSKDYVHRVGRTARAGQSGYAVSFVNQYEAEWFKLIEQLLGREIPDRKVDMDEILILREHISDSKRIALTKLREDGGHKKRRKVAEDDDDEEEEAPRGHRQKPRSFKKSSRR

SEQ ID NO: 2139 - protein, 357 aa, Euglena gracilis
MDYYTVAHIDEPCSQPWYKSRVAAFFGGCLLATCMSLRFKGTVQENYAVGTKPAVHSLPLAALGTWGRSQVPQNPPQNGFNNFGRRSSALQMTVGGWAPSAKMPRKFIVGGNWKCNGDRASIKALIQALNAGESTIGSGVDVVVAPPMLYGDYARGLLRSDFGVAFQNCWVGGNGAFTGEVSADMIKDAGFDWVILGHSERRSLPEIKETDETVATKTAYALEAGLKVMLCIGETLDARQSGKTDEVNARQLAAVAEKVSDWSNIVIAYEPAWAIGTGVVATPEQAQETHTQIRKWLAENISPQVAQQMRIMYGGSANAANADSLARQPDIDGFLVGGASLRPEFLRIVESWKRKVE

SEQ ID NO: 2140 - protein, 450 aa, Bacillus clausii KSM-K16
MNTGMEPTLAKKDGQYVWHAMQRPGAAPLIADSGEGSWFTDTNGNRYMDGVSGLWCLNLGHGQTEIIEAATEQMNKLAYFPLSLGHQPAIALAEKLAALLGGGFRTFFANGGSDANETAFKIARQYHKQTGSPEKQKIISRYRGYHGNSLGALAATAQANRKIKYDAALPGFLHIPPPYAYRSSFGSAAEDDQQAADFLEQTILWEGPETIAAFIMEPIISGGGVIYPQSNDYYKRVRDICDRYQVLLILDEVVSGFGRTGKLFGFMHGDDDFKPDIITLAKGLTSGYLPLGATCVAENVYQAFDGKGETSHFRHISTYGGHPASCAVALKAIDIIEREQIVNRVETLGHTVLGKLKQLEQLSIVGEVRGIGFLYGIELVQDKQTKEPADDDTMKAVVTACQKQGLIIGKNSDTIPGGGNVLIIAPPLTSSEEDLAFLVDTVSSVLRTFA

SEQ ID NO: 2141 - protein, 453 aa, Blastopirellula marina DSM 3645
MNLTHQQLRDWDRSAHWHSFTQMAEYEPLIIERGEGCMLYDIDGNAYLDGVSSLWCNTFGHRHPKIDQAIRDQLDKVAHVTNLGCSSVPAVELTKRIVDLTPGELNHVFYACDGSSAVEVALKMAFQYWRQRDDPRPKKTSYIAFHEAYHGDTLGAVSVGGVEMFHDMFRPLLFSVHRLPSPDRDHLPAGVTSETACRYYLDQLEAVLKEHHETIAALVIEPLVQGAAGMLMQPEGYLRGLRELTTKYDVLLIFDEIAVGMGRTGTMFACQQEAVTPDFLCLGKGLTGGYLPLSVTVATTEVWNAFLGAYAERKTFFHGHTFSGNPLLCAAALATLDIFAEEKILDQLPAKIAHLEMRLAELIDHPHVASVRQCGLIAGVELVADKESGQAYPWTERRGWRACRHATQNGVWLRPLGNVIVIMPPLSITLAEIDRICDAAKAGIGHAVAPCGE

SEQ ID NO: 2142 - protein, 208 aa, Brassica napus
  misc_feature (177)..(177): Xaa can be any naturally occurring amino acid
  misc_feature (197)..(197): Xaa can be any naturally occurring amino acid
  unsure (1)..(208): unsure at all Xaa locations
NPPATQTQSTVMSGIDRISELPESLLTQILSFLPSKQSVQTSVLSTRWKNLYLNVPGLDLNLSAIPYDADEMLLSFLSFIDKLLESSPESKLFKVKVKCRDTMIDGFRDRIGIMIDRGTQHLDVESSTYDIEDDSFHHPCVDFMPMNLYTSKTLVYLKLTSSGLDDPGFVFMPCLKXMHLEEVKWRVHLEKLLSGCXVLEELAGERSG

SEQ ID NO: 2143 - protein, 316 aa, Mycobacterium smegmatis str. MC2 155
MSGLDPQIADIIEALDSGFPPVHTMTGAQARAAIKARFRPAAHPQPMAAVEDATATGSSGDVAVRIYRPATPARPLPTLVWAHGGGWVFCDLDSHDELCRDIATRVPAVIVSVDYRRAPDEGQWPAAADDMFTATRWAAAHAADLGGAENLLLVGGDSAGGNLAAVTALMARDRGGPDLAGQVLLYPVIAADFDNESYRRFGAGHYNPRPALQWYWDQYVPAAADRVHPYASPLHADLSGLPPAITVVAGHDPLRDEGLAYAEALELAGVPTVTRYFEGGIHGFMTMPSLDLCRQARAQACSDISALVESIGIAAP

SEQ ID NO: 2144 - protein, 391 aa, Androstachys johnsonii
DLEPVNPADVPVTAAGALKSYKLAAKAISRLQSLPSGNISLLCDVLVKEVSDLTGYDRVMVYKFHEDEHGEVVAECRRPDLEPYLGLHYPATDIPQASRFLFMKNKVRMICDCLAPPVEVVQDGKLSQPLGLCGSTLRSPHGCHSQYMRNMGTIASLVMSVTINENDDEMEGDQQKGRKLWGLVVCHHTSPRFVPFPLRYACEFLIQVFGVQINKEVELAAQMREKHILRTQTLLCDMLLRNAPVAIITQSPNVMDLVKCDGAALYYRKKFWLLGITPTEAQIRDIAEWLLEYHSGTTGLSTDSLMEAGYPGASILGDAVCGMAAVRITSKDFLFWFRSHTAKEIKWGGAKHDPNDKEDGRKMHPRSSFKAFLEVVKRRSLPWEDMEMDAI

SEQ ID NO: 2145 - protein, 128 aa, Coprinellus disseminatus
MAKSPITCHILDAALGKPAPGVHIHLRKSEPSTNAEGPTAFREIATGVTNEDGRCLDLLPPTGTEGSTALQAGEAYKIVFKTKEYFEKTGRSTFYPWVEIPFTIQNPQEHYHIPLLISPFSFTTYRGS

SEQ ID NO: 2146 - protein, 392 aa, Blepharandra heteropetala
DLEPVNPADVPVTAAGALKSYKLAARAISRLQSLPSGNISLLCDVLVKEVRDLTGYDRVMVYKFHEDEHGEVISECCRPDLEAYLGLHYPATDIPQASRFLFMKNKVRMICDCLAPAVKVIQDERLPQALSLCGSTLRSPHGCHAQYMANMGTIASLVMSVIINEDNDMMDGDQQHIARKLWGLVVCHHTSPRFVPFPLRYACEFLIQVFGVQINKEVELAAQVREKHILRTQTLLCDMLLRDAPVAIITQSPNVMDLVKCDGAALYYRKKFWLLGVTPTEVQIRDTAEWLLEYHGGNAGLSTDSLMEAGYPGASDLGNAVCGMAAVRITSRDFLFWFRSHTAKEIKWGGAKHHPNDKDDVRKMHPRSSFKAFLEVVKWRSLPWEDIEMDAI

SEQ ID NO: 2147 - protein, 392 aa, Lophanthera lactescens
DLEPVNPADVPVTAAGALKSYKLAARAISRLQSLPSGNISLPSDVLVKEVRDLTGYDRVMVYKFHEDEHGEVVSECCRPDLEAYLGLHYPATDIPQASRFLFMKNKVRMICDCLAPPVKVIQDERLPQPLSLCGSTLRSPHGCHAQYMANMGSIASLVMSVTVNEDDDMVDGDQQQMARKLWGLVVCHHTSPRFVPFPLRYACEFLIQVFGVQINKKVELAAQVREKHILRTQTLLCDMLLRDAPVAIVIQSPNVMDLVKCDGAALYYRKKFWLLGVTPTEAQIRDIAEWLLEYHSGNTGLSTDSLMEAGYPGTSVLGNAVCGMAAVKITSRDFLFWFRSHTAKEIKWGGAKHDPGDKDDIRKMHPRSSFKAFLEVVKWRSLPWEDIEMDAI

SEQ ID NO: 2148 - protein, 452 aa, Mycoplasma hyopneumoniae 232
MSKITKVFAREILDSRGNPTIQVDVYTLAGGFGSAIVPSGASTGSREALELRDTNTKYADNWYGQKGVMTAVDNVNNIIAPEIIGLCCKNQRLIDQKMIELDGTPNKEKLGANAILGVSLAVAKAAANELRMPLFRYLGGTNPTLMPVPMLNVINGGEHASNTLDFQEFMIMPLGFRTFKEALQAANKVFHNLAKLLKKSGFETQVGDEGGFAPNFNSHEQALDFLVDAIKESGFNPGFKGENAVAIAIDAAASEFYNGQKYVFKKLKAASLSKNQADLDEKFEFSSEELLNYYGQLLAKYPIISIEDGFAESDWQGFIAFNQKYGNNHQIVGDDLTVTNVEILKKAINLKAINSILIKLNQIGTLSETLDAIHLAQKSGMTAVISHRSGESEDTTIADLAVAVSSGQIKTGSLSRTDRIAKYNRLLVIEEYLNSYAKADYIGREVFYNLKK

SEQ ID NO: 2149 - protein, 181 aa, Coffea arabica
MASSMISSAAVATTTRASPAQASMVAPFNGLKAASSFPISKKSVDITSLATNGGRVQCMQVWPPRGLKKYETLSYLPDLTDEQLLKEIDYLIRSGWVPCLEFELEKGFVYREYHRSPGYYDGRYWTMWKLPMYGCTDATQVLNEVGECLKEYPNCWVRIIGFDNVRQVQCISFIAAKPKGF

SEQ ID NO: 2150 - protein, 380 aa, Diacidia ferruginea
ETPAGALKSYKLAARAISRLQSLPSGIISLLCDVLVKEVRDLTDYDRVMVYKFHEDEHGEVISECCRPDMEAYLGLHYPATDIPQASRFLFMKNKVRMICDCLATPVKVIQDERLPQPLSLCGSTLRSPHGCHAQYMANMGAIASLVMSVTINEDDDVMDGDRQHRARKLWGLVVCHHTSPRFLPFPLRYACEFLIQVFGVQINKEVELAAQVREKHILRTQTLLCDMLLRDAPVAIITQSPNVMDLVKCNGAALYYKKKFWLVGLTPTEAQIRDIAEWLLEYHNGNTGLSTDSLMEAGYPGASELGDTVCGMAVVKITSRDFLFWFRSHTAKEIKWGGAKHDPDDKDDGRKMHPRSSFKAFLEVVKWRSLPWEDVEMDA

SEQ ID NO: 2151 - protein, 388 aa, Oceanobacter sp. RED65
MKVPVKALSKRYALLPIIVLGVWLSLNKQQYSEPSFYFPEQVSAEADQPKLIETTATDGGTASVHSATAIELDNGNLLAMWYGGTREGHTDVSLYKAVFDQSKQAWIGHEKVLDRYDISQQLNRYIKKVGNPVLVKHPAGPVVLFYVTVSLGGWATSQVNMAVSYDDGQSWHSSKRLVTSPFINISTLVKNDAVIYQDGTIGITGYHELFGEFSEMIRVNLQGEVINKYRITDGDYTIQPTVIVQDPDHAVALIRDSSRHTEKVHYSKTSDGGKTWSDYEKLAVDNPNSAVYGFKDNKDRLWMLFNEATRQVEFPRNTMALAVSTDNGKTWTTKHYFENPGKDLNLNATYGYPWVTVTTSGDYHVFYTRDRESIVHHQFNQAWLEALL

SEQ ID NO: 2152 - protein, 392 aa, Byrsonima crassifolia
DLEPVNPADVPVTAAGALKSYKLAARAISRLQSLPSGNISLLCDVLVKEVRDLTGYDRVMVYKFHEDEHGEVISECRRPDLEAYLGLHYPATDIPQASRFLFMKNKVRMICDCLAPPVKVIQDERLLQPLSLCGSTLRSPHGCHAQYMANMGTIASLVMSVTINEDDDMMDMDQQHMAGKLWGLVVCHHTSPRFVPFPLRYACEFLIQVFGVQINKEVELAAQVREKHILRTQTLLCDMLLRDAPVAIITQSPNVMDLVKCNGAALYYRKKFWLLGVTPTEAQIRDIAEWLLEYHSGNTGLSTDSLMEAGYPGASDLGHAVCGMAAVKITSRDFLFWFRSHTAKEIKWGGAKHDPDDKDDGRKMHPRSSFKAFLEVVKWRSLPWEDMEMDAI

SEQ ID NO: 2153 - protein, 792 aa, Pseudomonas aeruginosa UCBPP-PA14
MKFSEKWLRSWANPQVSHDELVARLSMVGLEVDADLPVAGAFSGVVVGEVLSTEQHPDADKLRVCQVSNGSETFQVVCGAPNVRAGLKIPFAMIGAELPGDFKIKKAKLRGVESFGMLCSAKELQISEENAGLLELPADAPVGQDVRTYLELDDYTIEVGLTPNRGDCLSLAGLAREVSAIYDVPLAPVAVDAVAAQHDETRPVELDAPAACPRYLGRVIRNVDLSRPTPLWMVERLRRSDIRSIDPVVDVTNYVMIELGQPMHAFDLAEINGGVRVRMAEDGEKLVLLDGQEITLRADTLVIADHQRALAIAGVMGGEHSGVSDSTRDLFLEAAFFDTIALAGKARSYGLHTDSSHRFERGVDSQLARKAMERATRLILDIVGGEPGPIVEQVSEAHLPKVAPITLRAERVTQMLGMPLDAAEIVRLLQALELTVVADGEGQWSVGVPSHRFDISLEVDLIEELARLYGYNRLPVRYPQARLAPNNKPEARAALPLLRRLLVARGYQEAITFSFIDPALFELFDPGTQPLTLANPISADMAAMRSSLWPGLVKALQHNLNRQQSRVRLFESGLRFVGQLESLKQEAMLAGAICGKRLPEGWANGRDGVDFFDAKADVEAVLASAGALGDFSFVPGEHPALHPGQTARIEREGRLVGYLGALHPELAKKLDLEQPVFLFELLLAEVVDGHLPKFRELSRFPEVRRDLALLVDQDVPAQDILTQIRAAAGEWLTDLRLFDVYHGKGIDPHRKSLAVGLTWQHPSRTLNDDEVNSTTQNIVTSLEERFNATLRK

SEQ ID NO: 2154 - protein, 647 aa, Candida albicans SC5314
MSELTELHPHHHVQIKESILVGKALLNFTTFFVTLGILVMGFEQSVYAPIITNKYFKQYYHNPSPTEIGFMIAILEIGALFSSIIAGKIGDLVGRKRATRYGAVFFYIGGFIQCISPNMFILCIGRLLGGFGIGFLTTIVPMFQSEISPAEARGFYACVEFTGNILGYAIGIWLDYAFSYLENDYSWKAPLIVQFLLGVVLWLGTFIVVETPRWLLNHDHDLEGMIVIADLYADGDVEDDHAMSEYRNIKESVLIDRIEGGERSYEYLFKRYAKRLSVACFGLMFAQLNGINLISYYAPMIFEEAGWVGRQAVFMTGINGIIYVISTIPPWYLVDSWGRKPLLMSGALIMGIPFCIAGYSLSLNNEYTSTIVVTSIIISNFGFGFSWGGIGWLLPAEVLPLSVRSKGAALATATNWFSNFVVGLASPILLDQIKWKTYFIPAISCFISFFAVWYLFPETKGLSLEEMGSVFDDKSSIFSHHASGSVGGSSSSIFNYGATNDLNRRTSMTNDSTPSIAGALPGAVPGAIDSIHQSAASMARNPTSNNNQQLDGIITGAAPPPMPINTNNNNIIKPVKSDNAADTLSLDSGFGGSQSDIVQEIEPPSLEEILKYKIQKQIEPNAFIATFHWLFSKKGQPNDEESRLLQQ

SEQ ID NO: 2155 - protein, 234 aa, Anabaena variabilis ATCC 29413
MIFSPLFPYMPSPQSPIPNPQSLVPMQISDYPQLNLSSVPRIASVHRITGETNVQVTVNLDGTGICTAATGIPFLDHMLHQISSHGLIDLDVQAKGDWEIDDHHTNEDVGITLGQALAKALGDRKGIVRFGNFLAPLDEALVQVALDFSGRPHLSYGLQIPTERVGTYDTQLVREFFVALVNHSQMTLHIRQLDGINSHHIIEATFKAFARAARMAIEADPRRAGTIPSSKGVL

SEQ ID NO: 2156 - protein, 416 aa, Haloarcula marismortui ATCC 43049
MSTSHVIIGDGIAGASAAETIREADPDASVTVLTDEGEALYNRILIKEFAKGKLPEAPISIHEPEWYDERDIDLQLNTHVTDIDPDAHEIQTHEGDTYEYDKLLVATGGTPAQVPVENSDADGIHHFWTFQDARGIREHADEADQGIIVGAGLLGIDLAAVCAAQEIDAKYLMRGNRWWRYALSEEGAEIIHEALEENGVEPVFESGVDHFEVDDDGHVTGAVDPDGNHYEGEWAGVAIGLDFNTEFLNGTGLELDDGVVVDEYMQTNVEDIYAAGDLTQFYDTILDSQAQNGAWGSAKEQGSVAGTNMVADAEEKEFRWVSSYSITHFDFPFLSFGHPTRGDDEAERKYSDSEWRRLAFEDGQLVGGVLIGDLSQQSAFKQLIREERQVADKKELLLEKEVDLEEVKAQTPAPAE

SEQ ID NO: 2157 - protein, 117 aa, Neorickettsia sennetsu str. Miyayama
MSMYDQQNVFARILRRELPSRVVYEDDGVLAFYDAFPKAPVHVLVIPKGQFVSFSDFISTAPIEVASFFSKVGHVIDLLGVKEAGYRLITNHGEDGGQIVKHFHVHILAGKKMSDIA

SEQ ID NO: 2158 - protein, 490 aa, Gibberella zeae PH-1
MSKRTAEADHGDALKGGDRPEKMDIDDNNREMGEFEDEFEDEFESEDEILEAGVDGRPDAEREAEEKDAMEVDQDQGTFIVGRSKLEPGQTLAPDLTTYEMLHNLNTPWPCLSFDIVRDNLGDNRKAYPATMYTVSGTQAETGKDADNQIMVMKFSGLSKMDRGDEGSDSEDDDDDEDADPILESKSIPLNSTTNRIRAHQIPGQEAGRPGTTLTATMTESSNVFIHDITPHLASFDNPGTTISAQQNKPISTIRAHKAEGYALDWSPLVPSGKLLTGDNDGLIYATTRTDGGGWVTDNRPFQGHQSSVEELQWSPSEASVFASASSDGTIRIWDVRSKSRKAAITMQVSDVDVNVMSWSRQQTHLLASGDDNGTWAVWDLRQWKASSEKPQPIASFNFHKEQITSVEWHPTDDSIVAVAAGDNTVTLWDLAVELDDEESKDTAGVKDVPPQLLFVHYLKDAKEVHWHPQITGSLVATGEEFSVFRTISV

SEQ ID NO: 2159 - protein, 241 aa, Anabaena variabilis ATCC 29413
MRKIVIAGNWKMFKTQAESQEFLKEFLPALEETPQEREVLLCVPFTDLAILSQSLHGSLVQLGAQNVHWAENGAYTGEISGPMLTEIGVRYVIVGHSERRQFFGETDETVNLRLQAAQKYGLTPILCVGETKQQRDSGETESLIVSQLDKDLINVDQTNLVIAYEPIWAIGTGDTCETTEANRVIGLIRSQLKNPDVPIQYGGSVKPNNIDEIMAQPEIDGVLVGGASLEAASFARIVNYQ

SEQ ID NO: 2160 - protein, 550 aa, Ustilago maydis 521
MPEPVCTPAAHAATTRTAKSVSEPTTVASVFASLGLPAPGSKIPGVFDGCSWQHGACASSALTSVNPATGETLGTVSCATAAQVSSVIAAAQAAQRMFATVPAATRGGVMKDICAAYMEHKHALGALISYEMGKVLSEGRGEVQEVIDVADMAVGLSRSIAGSVLPSERPGHVIYEIANPLGLVGVITAFNFPVAVHGWNFCLSFICGNATIWKPSPTTPLTAIATTKLLIKVLEKHQLPTALAALVCGDVETGQTLTRDARIQLTSFTGSEHIGKLVAQDVAGRLGKILLELGGNNAAIVLDDADLDLAVPAVAFAAVGTAGQRCTTTRRLLLQRRVAQTFLDRLVKFYASLQEKHLIGDPTDPNILCGPLHSRGAVEKYWKTLDTIRSTGGKILFGPESSSNPGLDKHLVQGKGNYVLPAIAMPASCTDQVFQEEVFAPILNVALFDTLDEAIALNNGVRQGLSSSLFTTKLTNIGDWQGALGSDCGIVNVNVSTSGAEVGAAFGGNKATGWGRECGGDAWKQYCRWATSTVNYSSKVALAQGVVFDA

SEQ ID NO: 2161 - protein, 460 aa, Acinetobacter sp. ADP1
MSQHSTLQRGLNTRHIRFLALGSAIGTGLFYGSATAIKMAGPSVLLAYMVAGIAIYIVMRALGEMAVHNPVSGSFSHYASQYIGLLAGFTTGWTYVFEMIIVALADVTAFGIYMGFWYPDVPRWIWILSLIMFLGAINLIHVKVFGELEFWLSMVKVTAIVAMILGGLGLMFYGFHTDHASFTPGIQNLWIHDGFMPNGIAGLVACLSVVVFAFGGIEIIGITAGESQDPKTTLPKAINAVPVRILLFYVLTIFVLMSIFPWNQIGSQGSPFVQIFENLGIGSAATVLNIVVITAAISAINSDVFGAGRMLYGMSNRGQAPQIFQKLSKNGVPWMTIVVMAGVLLVGVVLNYLIPENVFIIIASIATFATVWVWLMILVSQVAMRRKLSKAEIKALDFPVVGWPYAPAFAIVFMLFILAMMGYFPDSRPAIYVGAIWLILLWIAYMVWVKPNTIKTDMEL

SEQ ID NO: 2162 - protein, 441 aa, Candidatus Pelagibacter ubique HTCC1002
MPINLSKIAKAKKIKYFLISFVDFFGVLRSKLVPAQAIADMQKNGAGFAGFATWLDMSPADGDMFALPDPKSLIQLPWNKEIGWLASDLYMYGKPVKASPRVMLKEQINKLHKKDLVMKSGVECEYFLISEDGSKIADARDTQSKPCYDQSALMRRYDLIKEICDSMITMGWNPYQNDHEDANGQFEMNWDYTDCLTTADRHVFFKYMVKSLAEKHGLRATFMPKPFSNLTGNGCHAHISLWNGKINKFLDNGDKLGLSKLAYNFLGGIMKLTQPLTAFFNPTINSYRRINAPPTKSGATWSPSSISYTGNNRTHMIRIPDKGRFELRLMDGAVNPYLLQAGVIAAGLHGINNKIDPGEPLSCNMYTDHKNYPHLKKLPDIIEDALDQLENSKEIKEAFGGDTIKSYLKLKRSEINDFNQEEKFDKKSSVTHWEKNSTLDC

SEQ ID NO: 2163 - protein, 392 aa, Coleostachys genipifolia
DLEPVNPADVPVTAAGALKSYKLAARAISRLQSLPSGNISLLCDVLVKEVRDLTGYDRVMVYKFHEDEHGEVVSECRRPDLEAYLGLHYPATDIPQASRFLFMKNKVRMICDCLAPPVKVIQDKRLVQPLSLCGSTLRSPHGCHAQYMANMGAIASLVMSVTINEGDDTMDGDQQQMARKLWGLVVCHHTSPRFVPFPLRYACEFLIQVFGVQINKEVELAAQVREKHILRTQTLLCDMLLRDAPVAIITQSPNVMDLVKCDGAALYYRKKFWLLGVTPTEAQIKEIAQWLIEYHSGDTGLSTDSLMEAGYPSASVLGDAVCGMAAVKITSRDFLFWFRSHTAKEIKWGGAKHDPDDKDDGRKMHPRSSFKAFLEVVKWRSLPWEDVEMDAI

SEQ ID NO: 2164 - protein, 217 aa, Ipomoea trifida
MSIQVQSLYSIYNKKREKLNIDEIHDIRGLRFKALRVIHQLWHEVPGRFKDYIMHPKFNGYQSLHIIFIGGGMVPLEVQIRTKEMHLQTEYVALLLIGDTRKMLVQEFATIPDKSLTDYRVEIQPKHLVLKWHVVATLRWEVMSSSLSGGDLEIDSLCFNRLRKSIDEHYYYNDCSFRGGWKGIGGKTGRSSRVSFSKDGKEGIQAVRGLSTRVFSV

SEQ ID NO: 2165 - protein, 392 aa, Acmanthera latifolia
DLEPVNPADVPVTAAGALKSYKLAARAISRLQSLPSGNISLLCDVLVKEVRDLTGYDRVMVYKFHEDEHGEVVSECRRPDLEAYLGLHYPATDIPQASRFLFMKNKVRMICDCLAPPVKVFQDKRLAQPLGLCGSTLRSPHGCHAQYMANMGAIASLVMSVTINEGDDMIDGDQQQMARKLWGLVVCHHTSPRFVPFPLRYACEFLIQVFGVQINKEVELAAQVREKHILRTQTLLCDMLLRDAPVAIVTQSPNVMDLVKCDGAALYYRKKFWLLGVTPTEVQIKEIAEWLIEYHSGNTGLSTDSLMEAGYPGASVLGDAVCGMAAVKITSKDFLFWFRSHTAKEIKWGGAKHDPDDKDDGRKMHPRSSFKAFLEVVKWRSLPWEDMEMDAI

SEQ ID NO: 2166 - protein, 592 aa, Arabidopsis thaliana
  misc_feature (45)..(45): Xaa can be any naturally occurring amino acid
  misc_feature (52)..(52): Xaa can be any naturally occurring amino acid
  misc_feature (69)..(69): Xaa can be any naturally occurring amino acid
  misc_feature (93)..(93): Xaa can be any naturally occurring amino acid
  unsure (1)..(592): unsure at all Xaa locations
MVARTPQKQRKVAMVVPPLNSDLLKETINKVDKCMERLQELQYTXIAGGTKXVVSGVNLSPRSTRIYLXKTSLRCKQETLRIKNATNKKSPVXGKFPASSPGDWRKMSLPAMLLGETVNEILQASQVTRDIVDAIAPKKSRKSRRLTMSQEDDGPKTPETQQKSREQNPETVSSNIKARRKKEKQNRRSESDSPPSLQRARSRIAFRTISPQVKGNNGENSFRHLANRVSPKHKPWVKKAVLFPNPLFISGTATQQAKFSRTMSPVIARNEISSIKNNKETPYKFLIKSPPTSASKFQVKIRSPPKVLVSPTRNGSNSVRKSPRGSRSPTRTVNLGKKSASISPIRNTGKRSPKLSTAAKLRRSFTPTRNGSNLARKSSISPKRVTLQAFLSPTRNGNFCKKSPKASISPTRVCNKSQKLSTAAKFRRSFSPSRLAMRADEITMFHGSKAPSLSIYRYTERIHRYAQCSPVCFVAAFAYILRYLQRPEATSTARRLTSLNVHRLLITSLLVAAKFLERQCYNNAYYAKIGGVSTEEMNRLERTFLVDVDFRLYITTETFEKHCLMLQKETVPCDSRKLRTVLGEIACSCQAI

SEQ ID NO: 2167 - protein, 392 aa, Pterandra arborea
DLEPVNPADVPVTAAGALKSYKLAARAISRLQSLPSGDISLLCDVLVKEVRDLTGYDRVMVYKFHEDEHGEVVSECRRPDLEAYFGLHYPATDIPQASRFLFMKNKVRMICDCLAPPVQVIQDKRLAQPLSLCGSTLRSPHGCHAQYMANMGAIASLVISVTINEGDDMMDGDQQQMARKLWGLVVCHHTSPRFVPFPLRYACEFLIQVFGVQITKEVELAAQVREKHILRTQTLLCDMLLRDAPVAIITQSPNVMDLVKCDGAALYYRKKFWLLGVTPTEAQIKEIAEWLLEYHSGNMGLSTDSLMEAGYPGASVLGNAVCGMAAVKITSRDLLFWFRSHTAKEIKWGGAKHDPDDKDDGRKMHPRSSFKAFLEVVKWRSLPWEDVEMDAI

SEQ ID NO: 2168 - protein, 392 aa, Galphimia gracilis
DLEPVNPADVPVTAAGALKSYKLAARAISRLQSLPSGNISLLCDVLVKEVRDLTGYDRVMVYRFHDDEHGEVVSECCGPDLEAYLGLHYPATDIPQASRFLFMKNKVRMICDCLAPPVKVLQDERLPQPLSLCGSTLRSPHGCHAQYMANMGTMASLVMSVTINEDDNMLDGDQQHMARKLWGLVVCHHTSPRFVPFPLRYACEFLIQVFGVQINKEVELAAQMTEEHILRTQTLLCDMLLRDAPVAIITQSPNVMDLVKCDGAALYYRKKFWLLGVTPTEAQIRGIAEWLLEYHGGNTGLSTDSLMEAGYPGASVLGDAVCGMAAVKITSRDFLFWFRSNTAKEIKWSGAKHDPGDKDDIKKMHPRSSFKAFLEVVKWRSLPWEDVEMDAI

SEQ ID NO: 2169 - protein, 392 aa, Acridocarpus natalitius
DLEPVNPADVPVTAAGALKSYKLAAKAISRLQSLPSGNISLLCDVLVKEVRDLTGYDRVMVYKFHEDEHGEVVSECRRSDLEAYLGLHYPATDIPQASRFLFMKNKVRMICDCLAPPIKVIQDERLPQPLSLGGSTLRSPHGCHAQYMANMGTIASLVMSVTINEDDDMMDGDQQQMARKLWGLVVCHHTSPRFVPFPLRYACEFLIQVFGVQINKEVELAAQVREKHILQIQTLLCDMLLRDAPVAIITQSPNVMDLVKCDGAALYYKKKFWLLGITPTEAQIRDIVEWLLEFHSGNTGLSTDSLMEAGYPGASVLGDAVCGMAAVSITSKDFLFWFRSHTAKEIKWGGAKHDPDVKDDGRKMHPRSSFKAFLEVVKWRSLPWEDVEMDAI

SEQ ID NO: 2170 - protein, 671 aa, Candida albicans SC5314
MGFLTNFTNFKTIVASIKKYMRFIGPGLMVSVAYMDPGNYSTAVAAGSAYKYNLLFSILLSNCLAIFLQILAAKLGAVTGLDLAANCKAHFGYKTNLILYALTEIAIIATDLAEVVGTAIALNILFHLPLFVGVIVTVIDVLIVLMAYRPRGPLLFIRIFESFVSVLVAATVVCFGIELYQVSHDSSIHFSVAEVMKGFLPNEDVVDMSDREGGNGLFLSLAILGATVMPHSLYLGSGLVQARLKDYDIKNGFHKPWGKHSIEEPIQEDITVHEEDDNLTPIATPLIQHQEQPGFEKDDESTFDGDDEEDDHYRPSIHAIKDTMSYTIVELVISLFTVALFVNAAILIVAGATLRSGDSKFARDDDNGHESDSDSDDDYQNADLFTIYHLLSKHLSPTAGFVFALALLCSGQSAGVVCTLAGQMVSEGFLSWSLPPVTRRLITRALAIAPCLLVVSFSGREGLAKILNASQVVLSILLPVVSAPLIWFTCNKHTMRVPIFVRDGDEEIDMEYDGEQSTSVATSRFKSSEPAIRLQNLRNSHPCANWEDDDDEQLQQLHLQNEENRLLIGENTTNLVYSSPPTSNLMSRSNSVSATNGVPDSSSSSSSTTIAAQLPLEVYEDLNQDIFRIKGYKDFSNSLATSFVAVLVWVFVASLNLYLIGSMLLGYDVPL

SEQ ID NO: 2171 - protein, 398 aa, Neorickettsia sennetsu str. Miyayama
MNSEKVKVNVEEFLKSTAGPFGVSASLEPKGFFYDPGYAKTAPCKSSITFIDGENGILLHRGYPIEELAQTSDFLQVGYLLIDGKLPDSAATREFEERIKHVPQLPECVLKNIRSFPTSAHPMAVLISALASLASVYGEMDFNQKKLLLVAYTPWLIAHIYRHINSLEFVEPDIRLPYTENFLYMMFGEKKPKDAEILDKIFILHADHGQTASTSVARMVVSSGASPIAACSAATASLWGPLHGGANERVLEMLRGIVESGEKVENFIERVKRKEERLMGFGHRVYKNYDPRAAILKQKAHDVLKADSPILKTAGELETITAREEYFLSRKLYPNVDFYSGIVLDALGISSCMFTPIFALARTVGWVAQITEFLSDSEQKLCRPRQIYVGEPRRNVHG

SEQ ID NO: 2172 - protein, 368 aa, Synechococcus elongatus PCC 6301
MSLPIRNVAIIAHVDHGKTTLVDALLKQSGIFREGEDVPDCVMDSNDLERERGITILSKNTAVKYKDTLINIVDTPGHADFGGEVERVLGMVDGCILIVDANEGPMPQTRFVLKKALEKGLRPIVVVNKIDRPRAEPMVAVDKVLDLFLELGADDDQCEFPYLFASGLSGFAKESLEDESKDMQPLFDAILRHVPPPIGDVSKPLQLQVTTLDYSDFLGRIVIGKIHNGTINMGQPTALLKEDGSVVRGKVTKLLGFEGLKRIEIEQATAGMIVAVAGFADANIGETLACPNEPLALPLIKVDEPTLQMTFCVNDSPFAGKEGKFVTSRQVRDRLLRELETNVALRVEETDSPDRFMVSGRGELHSAF

SEQ ID NO: 2173 - protein, 1122 aa, Stellaria longipes
MASRAQSQSSTNSGRSKHSARIIAQTIQDAKFHAEFEESSNEFDYSSSVRGSTSGVNQLPKSDKVTSSYLLQIQKGKFIQPFGCLLALDDKTFRVIAFSENAPEMLTMVSHAVPSVGDLPVIGIGTDIRTIFTGPSASALQKALGFTDVSLLNPILVHCKNSGKPFYAIVHRVTRSLVIDFEPVKPYEVPMTAAGALQSYKLAAKAITRLQSLPSGNMVRLVDTMVQEVFELTGYDRVMAYKFHDDDHGEVVSEVTKPNLDSYLGLHYPATDIPQAARFLFMKNKVRLICDCRAKNVRVVQDEKLSVDLTLCGSTLRAPHGCHAQYMENMNSIGSLVMAVVVNDEDDEDGGSAPAQPHKRKRLWGLVVCHHTSPRFVPFPLRYACEFLAQVFAIHVNKELELENQFLEKKILRTQTLLCDMLIRDAPLGIVTHSPNIMDLVKCDGAALLYNNKVWRLGSTPTDYQLQEIGGWLSRDHMDSTGLSTDSLYDAGYPAALELGDSVCGMAAVSITVNDMLFWFTSHTAAEIKWGGAKHEAGEKDDGSKMHPRSSFKAFLEVVKRRSVPWKDYEMDAIHSLQLILRNAFKDGEAADLNTSVIHSKISDLQISGLKELEAVTSEMVRLIETATVPIFAVDSDGLVNGWNTKIYELTGIPVEEAVGKHIAALVEDSSIDNVKQMLQSALQGEEKKNVQFEVKRHHSIPDSGPISLIVNACASKDVNGNVVGVCLIAQDITGQKTVMDKFLRIEGDYKAIIQSPNPLIPPIFGTDEFGWCSEWNPAMAKLTGWTREEVIDKMLLGEVFGMHKSCCRLKNQEAFVNLGVLLNGAMSGQNIEKLSIGFFTRSGKYIECLLCVNKKLNGEGDVTGVFCFLQLASHDLQHALHIQRLAEQAATKRANVLAYMKRQIKNPLAGIIFSGKILDGTNVDEKQRLVLQTSARCQGQLNKILDDSDLDSIIDGYCELEMVEFAVQDILVASISQVMAKSSEKGIQMSNNCTEHGFKETLYGDSLRLQQILADFLSISVNFTSPGGHIGVTVRLTKDKIGESVQLANLEFRIMHTGGGISEELLSEMFESRGNASEDGISLLISRKLVKLMNGDIQYLRSAGTSTFIISVELAVAGNSS

SEQ ID NO: 2174 - protein, 696 aa, Ustilago maydis 521
MVVARALSTLPPRARVRVSNSSVRSFASSAATRSNPTPLNQAAQTAQAAQAAQAALPKKAGLLRKTLRFTGYTIGSIVFGITATTVIILAHDALTYREAHADKVPLHPLALSPERGGPKNLPILSSYAEDEQDEISKKLANKERLVIVGGGWAAVGLLKSLDPEKYNVTLISPNNYYLFNPLLPSAAVGTVEPRSLIEPIRKLLARVHGHYIQGFATDVVMGEDKPVYHGGAQRLLEVNVISGDDWDGEALCAGGFTNNERKETKGKSIYVPYDRLIIAVGSVTANHGVPGLENCFHLKTIGDARKIRSHILDNLEVASLPTTTEEERKRLLSFVVCGGGPTGVETAAEISDMINEDVFDYFPKVLRAQAQVHLIQSREHILNTYSEKISEYAEAKFARDAVDVIVNARVKRVEPDRVLYTVKDPKTAKVQELSVPSGFTLWSTGIAMSPFTKRVTEILPNQSHLKALQIDSHLRVKGAPLGSMYALGDASTIDTRLIDQLYDFVDRYDKDKDGKLSYSEFETFAQAIRRKFPIASKHFIKLREVFDQYDVDQDGQLNLNEIANVLIETGNKMTALPATAQVAAQQGHYLGNKLNKLANHRDQGADMHPHTLEEVQDVDEEVYKPFTYRNFGSLAYIGNAAAFDLPIPGGSFAGGLIAMYAWRSFYLSESVSMRTRALLLGDYIKRGIWGRDLSRI

SEQ ID NO: 2175 - protein, 394 aa, Prochlorococcus marinus str. MIT 9303
MSQLETRTEPMVVNFGPHHPSMHGVLRLVVTLDGEDVVDCEPVIGYLHRGMEKIAENRTSVMFVPYVSRMDYAAGMFYEAIVVNAPERLANISVPKRASYIRVVMLELNRIANHLLWLGPFLADVGAQTPFFYIFREREMIYDLWEAATGQRLINNNYFRIGGVACDLPWGWLEKCQDFCDWFGPKIDEYEKLITNNPIFRRRIEGLGAIGRDEAINWSLSGPMLRASGVPWDLRKVDHYECYDDFDWDVAWEKEGDCYARYRVRIEEMRQSLKILRQACEMIPGGPTENLEAQRMAEGKKSPFTGFDYQYVSKKVAPTFKIPNGELYTRLESGKGEIGVFLQGNNDVTPWRFKIRAADLNNLQILPHILKGAKVADIMAILGSIDVIMGSVDR

SEQ ID NO: 2176 - protein, 1128 aa, Stellaria longipes
MESRNEGSRTNNNNNSNNPSDTMSRAIAQYTIDARLHAVFEQSGESGKSFDYSQSVKTYTSAESVPEQQITAYLSKIQRGGLIQPFGCMLAIDDLTYRIIAYSQNSVELLGFITTTTTTAVPSLEAVQQRIIAVGTDIRSLFMSSSCVLLEKAFSAREITLLNPVWIHSKANGKPFYAILHRIDVGIVIDLEPARTEDPALSIAGAVQSQKLAVRAISQLQSLPGGDVKLLCDTVVESVRQLAAYDRVMVYKFHEDEHGEVVAESKRADLEPYLGLHYPATDIPQASRFLFKQNRVRMIVDCHADSVSVVQDERLRQPLCLVGSTLRAPHGCHSQYMANMGSIASLVMAVIINGNDDEGSTRNAMRLWGLVVCHHTSPRSIPFPLRYACEFLMQAFGLQLNMELQLSAQVLEKRVLRTQTLLCDMILRESPTGIVTQSPSIMDLVKCDGAALLFCGKYYPLGVTPTELQLKDIVQWLLSNHGDSTGLSTDSLADAGYPGALALADAVCGMAVAFITRSDFLFWFRSHPAKEIKWGGAKHHPEDKDDVQRMNPRSSFKAFLEVVKSRSLPWENAEMDAIHSLQLILRDSFKDEETTHSKAIVHDQAGDVAMQGIDELSSVAKEMVRLIETAMAPIFAVDADGCINGWNAKASELIGLSVEEAMGKSLVHDLVCEDSKNVTQELLLHALQGDEDKNVEIKLKAFGSQQHKKAVYVVVNACCSKDYTNKIVGVCFVGHDVTGQKNVMDKFVNIQGDYKAIVHSPSPLIPPIFASDENSCCTEWNTAMEILTGYGKEDVIGKTLVGEIFGSICRLKGHDSLTKFMVVLHNAIGGQDSDKFPFSFYNRGGRYVQGLLTANKRTNIDGHITGAFCFLQIASSDLQQALEIQRQQENVCFERMKELAYLCQEIKNPLNGIRFANSLLEATSLGEDQKQFIETSNACEKQIKKILGDIHLESVDESPFELVKTEFMLGNIINAVVSQVMIPLRERELQLIRDIPEEIKTLAVCGDQIRIQQILAEFLVNMVRYAPSPDGWVEIHVLPRLKQVADGATVAYIEYRLVSPGEGLPPDLVQDMFHNSRWTTQEGLGLSMCRKILKLMNGEVQYIRESERSYFFVILELRMPPKQLMNVE

SEQ ID NO: 2177 - protein, 959 aa, Vibrio vulnificus CMCP6
MSTAFEVDTNTIATIFSSQVPVVEGIYDLTPDQVLLDQAEHESEVRSYPRRLPIAIKQAYGCLVEDTRGQIFLDCLAGAGTLALGYNHPEINQALKEQLDSGLPYQTLDIATTAKTNFIKSVKAFLPEELGNNCVIQFCGPSGADAVEAAIKLAKQTTGRNTMFAFRGAYHGMTNGTMGMMGNLNTKARRTGLMSDVHFMPFPYSLRCPFGLGGDEGAKASIRYIERLLNDDEAGIMKPAAIIVEPVQGEGGVIPAPAFWLRELRRICDEHGMLLIFDEIQCGVGKSGYNFAFEEAGIVPDVLCLSKAIGGGLPMSLLVINKKHDTWRPGEHTGTFRGNQLAMVSGAKALEIITRDNLVEHANVAGQYLRHGLEKIQQRVDCIAEVRGKGLMLGVEIRKPGSELNKFGEPVSDGQLTLAIQRAALERGLMVEKGGRDGSVIRFLPPLIISFEQIDFALRILEEAILAAGGNLKAVEENAEWKKHFIHTGVNGSKEFASVMNHTTAALKNAFEEVDAPYSGMDPKALESAIYAVDLDNKNAPLKEIIDETTELVVKNSIFTQHPDCIAHLHTPPLMPAVAAEAMIAALNQSMDSWDQSSSATYVEQKVINWLCDKYELGAKADGIFTSGGTQSNQMGLMLARDWIADKLSGHSIQKLGLPDYADKLRIICSKKSHFTVQKSASWMGLGEKAVLTIDAHANGTMDVTKLEAAVEQAKAEGLIPFAVVGTAGTTDHGAIDDLNTIADVAEKHDLWMHVDGAYGGALILSSQKARLKGVERAQSVSVDFHKLFYQTISCGAVLVNDKQNFKFLLHHADYLNREHDELPNLVDKSIATTKRFDALKVFMTMQNVGPKALGAMYDHILGQTLEVADLVRNTEGFELLAEPSLSTVLFRSTLGSDLDELNKTLRLEALTRGVAVLGETIVDGKTALKFTILNPCLKMSDFESLLSKINTLAAELAQ

SEQ ID NO: 2178 - protein, 309 aa, Escherichia coli O157:H7 EDL933
MQNAGSLVVLGSINADHILNLQSFPTPGETVTGNHYQVAFGGKGANQAVAAGRSGANIAFIACTGDDSIGESVRQQLATDNIDITPVSVIKGESTGVALIFVNGEGENVIGIHAGANAALSPALVEAQRERIANASALLMQLESPLESVMAAAKIAHQNKTIVALNPAPARELPDELLALVDIITPNETEAEKLTGIRVENDEDAAKAAQVLHEKGIRTVLITLGSRGVWASVNGEGQRVPGFRVQAVDTIAAGDTFNGALITALLEEKPLPEAIRFAHAAAAIAVTRKGAQPSVPWREEIDAFLDRQR

SEQ ID NO: 2179 - protein, 186 aa, Zea mays
MEDERSTQSYQGGEAAEQVEVTDRGLLGNLLGKKKAEEDKEKQEELVTGMEKVSVEEPEVKKEEHEDGEKKETLFSKLHRSSSSSSSSSDEEEEEVIDDNGEVIKRKNKKGLKEKLKEKLPGHKDTEGEHVTGLPAPAAPASVQTHHDTDVVVEKIDGDVKTEAAPAVPEEEKKGFLEKIKEKLPG

SEQ ID NO: 2180 - protein, 350 aa, Mycoplasma hyopneumoniae 232
MKPGRQTGLNVIMKKEFDFILIGRITIDFNPMDYYNNLENSSLFKKYIGGSAANIAIGLSRLKNKVGFFGSVSDDQFGNFVLNVFEKEKIDISHIKKTKDHKLGLTFTEMLSEEKSTILMYRDNVADLQIDVSDIDLDYILRTKILVISGTSLAKSPSREAVLKALFLAKNNGIKVVFDIDYRPYSWKNLDEVSLYYQIVAQNSDLIIGSYEEIQLTSRFCLENPENLIDDDYAKYWLKFVDLIIIKNGKKGSKLYQKDKKLVAKVVPVKMLKGYGGGDAYASLFLDHYLKNESDLENGLALATSAASIMVQSHSSFDLPDYQKILEFKDNALKSDPDLVQKKEWNAFKK

SEQ ID NO: 2181 - protein, 474 aa, Rhodococcus ruber
MTAGHFTELYINGSWVASTSKTVIEVLNPATEEVIGTVPDGTAADVDAAVAAARAAFDGWASTPVDKRAQYLRAIAAGIADRSDELARTISAEMGAPLSFAQAMQVPLPINSFSHAAAVAESFPFERTEGSSVIVREPIGVVGAITPWNYPLHQIAAKVAYALAAGNTIVVKPSEVAPLNAWMLAEIIDAAGVPAGVFNLVSGTGPVVGEALASHHEVDMISFTGSTNAGKRVSELAAQTVKRVALELGGKSANIVLDDADIDELMPNAVQWAMINSGQTCSALTRLLVPRAILTEAETAAKTIAEAYTVGAPDDPDTTLGPLVSATQLKRVRGYIDRGVQEGATLITGGSEPVEGLAVGYYVKPTIFSEVTPDMTIHREEIFGPVLSIAPYDTEEDAVRIANDSEYGLRGGVWSRDVDRARAVAARMRTGQVMINGGEFNPNAPFGGYKQSGTGREFGTHGLEEFLEIKSLQF

SEQ ID NO: 2182 - protein, 392 aa, Acridocarpus macrocalyx
DLEPVNPADVPVTAAGALKSYKLAAKAISRLQSLPSGNISLLCDVLVKEVRDLTGYDRVMVYKFHEDEHGEVVSECRRSDLEAYLGLHYPATDIPQASRFLFMKNKVRMICDCLAPPVKVIQDERLPQPLSLCGSTLRSPHGCHAQYMANMGTIASLVMSVTVNEDDDMMDGDQQQMARKLWGLVVCHHTSPRFVPFPLRYACEFLIQVFGVQINKEVELAAQVREKHILQIQTLLCDMLLRDAPVAIITQSPNVMDLVKCDGAALYYKKKFWLLGITPTEAQIRDIVEWLLEYHSGNTGLSTDSLMEAGYPGVSVLGDAVCGMAAVSITSKDFLFWFRSHTAKEIKWGGAKHDPDDKDDGRKMHPRSSFKAFLEVVKWRSLPWEDMEMDAI

SEQ ID NO: 2183 - protein, 389 aa, Mycoplasma genitalium G37
MAAGKRDYYEVLGISKNASSQDIKRAFRKLAMQYHPDRHKAENETTQKQNEEKFKEVNEAYEVLSDEEKRKLYDQFGHEGLNASGFHEAGFNPFDIFNSVFGEGFSFGMDGDSPFDFIFNRSKKRQQQIVVPYNLDIALVIEINFFEMTNGCNKTIKYERKVSCHSCNGFGAEGGESGLDLCKDCNGNGFVIKNQRSIFGTIQSQVLCSTCNGQGKQIKVKCKTCRSNKYTVTNQIKEINIPAGMYSGEALVDESGGNEFKGHYGKLIIQVNVLASKIFKRSDNNVIANVLVDPMVAIVGGVIELPTLEGIKEFNIRPGTKSGEQIVIPNGGIKFSKSFKRKAGDLIIIISYARPCEYTNLELKKLREFIKPNQEVKQYLNTLKNEYKT

SEQ ID NO: 2184 - protein, 392 aa, Triaspis hypericoides
DLEPVNPADVPVTAAGALKSYKLAAKAISRLQSLPSGNISLLCDVLVKEVRDLTGYDRVMVYKFHEDEHGEVVSECRRSDLESYLGLHYPATDIPQASRFLFMKNKVRMICDCVAPPVKVIQDKRLPQPLSLCGSTLRSPHGCHAQYMTNMGIIASLVMSVTVNEEDDMVDGDQLQMARKLWGLVVCHHTSTRFVPFPLRYACEFLIQVFGVQINKEVELAAQVREKHILQIQTMLCDMLLRDAPVAIITQSPNVMDLVKCDGAALYFKNKTWLLGVTPTEEQIRDIAEWLLEYHSGNTGLSTDSLMEAGYPGASALGDAVCGMAAVSITSTDFLLWFRSHTAKEIKWGGAKHDPDDKDDGRKMHPRSSFKAFLEVVKWRSMPWEDVEMDAI

SEQ ID NO: 2185 - protein, 392 aa, Triopterys rigida
DLEPVNPADVPVTAAGALKSYKLAAKAISRLQSLPSGNISLLCDVLVKEVRDLTGYDRVMVYKFHEDEHGEVVSESRRSDLESYLGLHYPATDIPQASRFLFMKNKVRMICDCLAPPVKVIQDERLSQPLSLCGSTLRSPHGCHAQHMTNMGTIASLVMSVTVNEDDDMVDGDQPQMTRKLWGLVVCHHTSPRFVPFPLRYACEFLIQVFGLQINKEVELAAQVREKHILQIQTMLCDMLLRDAPVAIITQSPNVMDLVKCDGAALYFKNKTWLLGVTPTEEQIRDIAEWLLEYHSGNTGLSTDSLMEAGYPGASAVGDAVCGMAAVSITSRDFLFWFRSHTAKEIKWGGAKHDPDDKDDGRKMHPRSSFKAFLEVVKWRSMPWEDVEMDAI

SEQ ID NO: 2186 - protein, 364 aa, Zygoascus ofunaensis
MMKALCYLGSKTIKWQTVAKPTLKSPTDVIGKLSALTLCGSDLHIIAGHVKESTDIAESQPGRGLILGHEGIIKVEEVGDAVKNFKRGDVCIVSCITSCGECYYCKRDLQSHCNRTEGTSGWILGHEIDGTQAEYVRIPYADQSLYKAPENVPIESLLMLSDILPTAYEVGVVSGNVKKGDTVAIVGLGPVGLSALLSAKALDPAKIIAIDMDDSRLEVARRLGAHETINPGKQDAAKLVHELTASEGKSSGVDVAIECVGVPATFEMCEDLLCPGGHLSNVGVHGSSVELKLQELWIKNISISTGLVSAYSTETLLQKVIDKKLDPTPLATHHFKLSEIEKAYDVFSHAADNQAIKMVITCDE

SEQ ID NO: 2187 - protein, 555 aa, Ipomoea trifida
MAETDDRRGDDQSETSDYTSEDEGTEDYRRGGYHAVRIGDTFKHGRYIVQSKLGWGHFSTVWLAWDTQKSKYVALKVQKSAQHYTEAAMDEITILKQIAEGDSDDQKCVVKLLDNFKHSGPNGQHVCMVFEYLGDNLLTLIKYSDYRGIPLHKVKEICVHILVGLDYLHRQLSIIHTDLKPENILLLSMIDPAKDPRRSGAPLVLPSSKTKIVSETGSSKDAKSSNGDLTKNQKKKIRRKAKRAAQRCAGKEASEEIEPDNEVCTPEDSNHDEKPDGDSVDDQTESKVQEDVSNKPSEAIDGHQEIQRHKRGSRSTRKKLLAEVDLKCKLVDFGNACWTYKQFTSDIQTRQYRCPEVLLGSKYSTPADLWSLACICFELATGDVLFDPHSGDNYDRDELLIIPSPYFTGSLGLNDGAPGDDATQGGRYSREFFNRYGDLRHIRRLRFWPLNKVLMEKYEFSEQDASEMADFLVPILDFVPEKRPTAAQCLTHPWIMGGPRNLVPSAINNSPPHGPENGKCIEKDERETMEARVGNIAIDGTPKSGKASQSTVNTT

SEQ ID NO: 2188 - protein, 292 aa, Triticum aestivum
MFRRKHASHFNSDDAEQRQAKINELRAALGSMSARGEKYCSEACLARYLEARNWNIDKSRKMLEESLKWRAVSRPEDIRWPDVSVEAETGKMYRATFTDREGRTVVIMRPAKQNTSSHEGQLRYLIYTLENAVLSLPQGLDKMVWLIDFTGWTLANATPIKTARDSANILQNHYPERLSVAFLFNPPKVFEAFFKVVKVFLDPKSIQKVNFVYKDNEESMKTMYKHIDPEVLPVEFGGKNIVVYNHEDYSKLMTKDDTKTTSFWAADGSHAVNGGSVPQVIPQSSPIVAKAS

SEQ ID NO: 2189 - protein, 392 aa, Janusia linearifolia
DLEPVNPADVPVTAAGALKSYKLAAKAISRLQSLPSGNISLLCDVLVREVRDLTGYDRVMVYKFHEDEHGEVVSECRRSDLESYLGLHYPATDIPQASRFLFMKNKVRMICDCLAPPVKVIQHERLPQPLSLCGSTLRSPHGCHAQYMTNMATIASLVMSVTVNEDDETMDGDQQQMTRKLWGLVVCHHTSPRFVPFPLRYACEFLIQVFGVQINKEVELAAQVREKHILQIQTMLCDMLLRDAPVAIITQSPNVMDLVKCDGAALYFKNKTWLLGVTPTEEQIRGIAEWLLEYHSGNTGLSTDSLMEAGYPGASGLGDAVCGMAAVSITSRDFLFWFRSHTAKEIKWGGAKHDPDDKDDLRKMHPRSSFKAFLEVVKWRSMPWEDMEMDAI

SEQ ID NO: 2190 - protein, 392 aa, Janusia anisandra
DLEPVNPADVPVTAAGALKSYKLAAKAISRLQSLPSGNISLLCDVLVKEVRDLTGYDRVMVYKFHEDEHGEVVSECRRSDLESYLGLHYPATDIPQASRFLFMKNKVRMICDCLAPPVKVIQDERLPQPLSLCGSTLRSPHGCHAQYMTNMGTIASLVMSVTVNEDDDTMDGDQQQMARKLWGLVVCHHSSPQFVPFPLRYACEFLIQVFGVQINKEVELAAQVREKHILQIQTMLCDMLLRDAPVAIITQSPNVMDLVKCDGAALYFKNKTWFLGVTPTEEQIRGIAEWLLKYHSGNTGLSTDSLMEAGYPGASGLGDAVCGMAAVSITSRDFLFWFRSHTAKEIKWGGAKHDPDDKDDLRKMHPRSSFKAFLEVVKWRSVPWEDVEMDAI

SEQ ID NO: 2191 - protein, 225 aa, Synechococcus elongatus PCC 6301
MRREGYEFQVSQPQVIFREVNGQPGEPFETLVMDVPDDAVGSVIERLGTRKAEMQNMEAVGNGRTILEFVIPARGLIGFRGDFIRLTRGEGIMNHSFLEYRPFCGDLEMRRNGVLIAFEEGTATFYALKNAEDRDAFFIEPGTKVYKGMIVGEHNRPQDLELNVCKTKALTNHRSATGDELVQLQTPIQMTLERALEYIGSDELLEVTPESIRLRKLLAKKLAKR

SEQ ID NO: 2192 - protein, 159 aa, Schizosaccharomyces pombe
MSTLDLNHLADLYDRKDWNACKKELLKLKVELAKQNLFVPTSDKEKASFARNVFEYGVLVSIQTCDIESFARYASQVIPFYHDSLVPSSRMGLVTGLNLLYLLSENRIAEFHTALESVPDKSLFERDPYVEWVISLEQNVMEGAFDKVASMIRSCNFPE

SEQ ID NO: 2193 - protein, 480 aa, Medicago sativa
MSLPPPIPPPSLATPPKARPTELPIRQIPGSHGWPLLGPLSDRLDYFWFQKPENFFRTRMEKYKSTVFRTNVPPTFPFFTNVNPNIIAVLDCKSFSHLFDMDLVDKRDVLVGDFVPSVEFTGNIRVGVYQDVSEPQHAKAKNFSMNILKQSSSIWVPELISNLDIFLDQIEATLSNSSSASYFSPLQKFLFTFLSKVLARADPSLDPKIAESGSSMLNKWLAVQLLPTVSVGTIQPLEEIFLHSFSYPYALVSGDYKNLYNFIKQHGKEVIKNGTEFGLSEDEAIHNLLFVLGFNSYGGFSIFLPKLIESITNGPTGLQEKLRKEAREKGGSTLGFDSLKELELINSVVYETLRMNPPVPLQFGRARKDFQLSSYDSAFNVKKGELLCGFQKLVMRDPVVFDEPEQFKPERFTKEKGAELLNYLYWSNGPQTGSPTVSNKQCAGKDIVTFTAALIVAHLLRRYDLIKGDGSSITALQKAK

SEQ ID NO: 2194 - protein, 480 aa, Medicago sativa
MSLPPPIPPPSLTTPPKARPTELPIRQIPGSYGWPLLGPLSDRLDYFWFQKPENFFRTRMDKYKSTVFRTNIPPTFPFFTNVNPNIIAVLDCKSFSHLFDMDLVDKRDVLVGDFVPSVEFTGNIRVGVYQDVSEPQHAKAKNFSMNILKQSSSIWVPELISNLDIFLDQIEATLSKSSSASYFSPLQQFLFTFLSKVLARADPSLDSKIAESGSSMLNKWLAVQLLPTVSVGTIQPLEEIFLHSFSYPYALVSGDYNNLYNFIKQHGKEVIKSGTEFGLSEDEAIHNLLFVLGFNSYGGFSIFLPKLIESIANGPTGLQEKLRKEAREKGGSTLGFDSLKELELINSVVYETLRMNPPVPLQFGRARKDFQLSSYDSAFNVKKGELLCGFQKLIMRDPVVFDEPEQFKPERFTKEKGAELLNYLYWSNGPQTGSPTVSNKQCAGKDIVTFTAALIVAHLLRRYDLIKGDGSSITALRKAK

SEQ ID NO: 2195 - protein, 480 aa, Xylella fastidiosa 9a5c
MSFLPSFLKRKSIDLITVHEEGRRLVPTLSWPHLIALGIGAIVGTGIYTLIGVGAEKAGPAILLSFVIAGVICACAALAYAEMATMMPVAGSTYTYSYVALGEGIAWIVGWSLILEYSLVVSTVAVGWSGYMSGFLKSVGVDMPLALTAGPYAGGIINLPAVVITCVVAGLLIVGTKESTTLNAVLVVVKIIALSVFVVIALPHFDMAHLKPFMPYGFTKSIDTGGVERGVMAAAAIIFFAFYGFDAISTAAEETKNPSRDLSIGIIGSMIGCTLIYVLVALAAIGAMHYTVFGPSTEPLALILRQLDQGNTARLIGAAAIIALPTVLLAFLYGQSRILFVMSRDGLLPRGLSTVNARTGTPIATTLFTAILVATAAGLVPLGEIAALANAGTLTAFIAVALCLLVLRVREPQRVRAFRTPLAWVVGPIAIAGCLYLFWSLPKMTQSLFLLWNALGLCVYLVYGRHTSLLSKAVSIDTPR

SEQ ID NO: 2196 - protein, 469 aa, Clostridium acetobutylicum ATCC 824
MGENNSHKHSLLFIVLISCAAGLGGLLYGYDTAVISGAIGFLKKLYNLSPAMQGFVISSIMVGGVLGVGFSGFLGDAIGRRKVLMLAAALFAISAVISSISTSAFMLIFARIVGGLGIGMASALSVTYITECAPPSIRGRLSSLYQLFTILGISITFFVNLGIVNMGSETWRVSTGWRYMLACGTVPAIVFLITLFFVPESPRFLVKSGNIKKAAAVLTKINGAEIAKQELDSISKSLATENDSSLGQLLQPGLRRALLIGIFLAIFNQAIGMNSITYYGPEIFQMIGFKNNSSFLATSVIGVVEVFSTILAMFLIDKLGRKKLMEIGSAAMAVFMLLIGTSFYIKLSNGFVILIFIICFVVSFCISMGPIPWIMIPEIFPNHLRARATGIATIFLWGANWAIGQFTPMLLNGIGGAYTFWIFCGINVICFLVVTTKVPETKNKSLEEIEKFWIPKSKQNAKGSSVGAK

SEQ ID NO: 2197 - protein, 480 aa, Medicago sativa
MSLPPPIPPPSLATPPKARPTELPIRQIPGSHGWPLLGPLSDRLDYFWFQKPENFFRTRMDKYKSTVFRTNVPPTFPFFTNVNPNIIAVLDCKSFSHLFDMDLVDKRDVLVGDFVPSVEFTGNIRVGVYQDVSEPQHAKAKNFSMNILKQSSSIWVPELISNLDIFLDQIEATLSNSSSASYFSPLQKFLFTFLSKVLARADPSLDPKIAESGSSMLNKWLAVQLLPTVSVGTIQPLEEIFLHSFSYPYALVSGDYKNLYNFIKQHGKEVIKSGTEFGLSEDEAIHNLLFVLGFNSYGGFSIFLPKLIESIANGPTGLQEKLRKEAREKGGSTLGFDSLKELELINSVVYETLRMNPPVPLQFGRARKDFQLSSYDFAFNVKKGELLCGFQKLVMRDPVVFDEPEQFKPERFTKEKGAELLNYLYWSNGPQTGSPTVSNKQCAGKDIVTFTAALIVAHLLRRYDLIKGDGSSITALRKAK

SEQ ID NO: 2198 - protein, 1114 aa, Stellaria longipes
MSSSTSRNSSVRSRHDAHVVIQTPVDAQLASDFEQSERVFNYTSSVDLNLLASSSDVPSSTVKSYLQKVQRGGLIQSFGCLIAIDEKNFKVIAYSENAPEMLDLTPHTVPNIEQLEALTFGTDVATLFTSSGVSALQKAVNYSELNLLNPILVHSKNSGKPFYAILHRIKVGLVLDLETVNLAETLVGVSGALMSYKLAAKAISKLQSLPSQNIPLLCDVLVKEVRELTGYDRVMVYKFHDDQHGEVIGESHSPSLDSYLGLHYPATDIPQASRFLFLKNKVRMICDCRSPSVKVIQDEALTQPLSLGGSTLRAPHGCHAQYMANMGSIASLVMAVTINNEEDEVSDRHRTRKLWGLVVCHHTSSRFVPYPLRYACEFLVQVFGIHINKEVELAAQVREKHILKIQSMLCDMLMRDSPITIITQSPNVMDLVKCDGAALLYQSKLWVLGITPKSNQIKDISQWLFEYHGNTKGLITDSLKEAGYPGALELGDAVCGMAAVRISSEEMLFWFRSHTAKEIKWGGAKHEPGQNDERGIMHPRSSFNAFLDVVKWRSVPWEDMEMDSIYSLQLIFIKCLVKNKTMSDTSKMIVNVPGVGVGGPLSSALKVEPLTGEVIRLIETAAVPIFSVDVTGAINGWNFKVAELTGVPMEQVIGSQLVDVVVEGTVEVLKNILSSALQGTEEKNVEIRLRTLGSHGKTSYVVLVVNACCSRDVDENVTGICFVGQDVTEEKRIVDQITELQGDYSGIMRNPCHLIPPIFLIDDQGVGLEWNDAMAKISGLSKEYTVGRMLIGEVFTNGNDGCQVKDYETLLRLKIFLSKMIDGEESDKVLFGFFDHRKKCIDALLCATPRFNADRNITGVLCFLHLPSPELQYSIHMQKVSEKAATSTLKKLTYFREQVRSPIKGMAFTRNLLESSELNIEQKQILTTISLCESQLMKIIEDTDIPSIEEGYLETSSDDFNLLEALDAVVSQVMPLSQESQVHIKHDFPSDLSPVCLFGDNVRLQQILSNFLTIAVRFTPPSTGSSVKFAVSSRTEHVGSKMQMFHVEFRITHPLPGVPENLIREMFQRSPGMSRGGLSLYISHKLVKIMNGTLQYLRGEDYSSFIVFLEFPVA

SEQ ID NO: 2199 - protein, 383 aa, Glycine max
SARDFALCGLIGIITAYIFVWIAKYYTDYKHEPVRILALSSSTGHGTNIIAGVSLGLESTALPVLVISVSIISAFWLGHTCGLVDETGNPTGGLFGTAVATMGMLSTAAYILTMDMFGPIADNAGGIVEMSQQPESVREITDVLDAVGNTTKATTKGFAIGSAALASFLLFSAYMDEVSAFAHEPFKQVDIAIPEVFVGGLLGSMLIFVFSAWACAAVGRTAQEVVNEVRRQFIERPGIMDYKEKPDYGRCVAIVASASLREMIKPGALAIISPIVVGILFRILGYYTGQPLLGAKVVAALLMFATVSGILMALFLNTAGGAWDNAKKYIETGALGGKGSEAHKAAITGDTVGDPFKDTAGPSIHVLIKMLATITLVMAPVFL

SEQ ID NO: 2200 - protein, 454 aa, Stellaria longipes
ALGFTDVFLLNPILVHCKNSGKPFYAIVHRVTRSLVIDFEPVKPYEVPMTAAGALQSYKLAAKAITRLQSLPSGNMDRLVDTMVQEVFELTGYDRVMAYKFHDDDHGEVVSEVTKPNLDSYLGLHYPATDIPQAAKFLFMKNKVRLICDCRAKNVRVVQDEKLSVDLTLCGSTLRAPHGCHAQYMENMNSIGSLVMAVVVNDEDDEDGGSAPAQPHKRKRLWGLVVCHHTSPRFVPFPLRYACEFLAQVFAIHVNKELELENQFLEKKILRTQTLLCDMLMRDAPLGIVTQSPNIMDLVKCDGAALLYNNKVWRLGSTPTDYQLQEIGRWLSRDHMDSTGLSTDSLYDAGYPAALELGDSVCGMAAVRITVNDMLFWFRSHTAAEIKWGGAKHEAGEKDDGSKMHPRSSFKAFLEVVKRRSVPWKDYEMDAIHSLQLILRNAFKDGEAADLNTS

SEQ ID NO: 2201 - protein, 398 aa, Dictyota dichotoma
MILKNKKQKKNLQHFTINFGPQHPAAHGVLRLILELNGEVVQRADPHIGLLHRGTEKLIESKTYLQALPYFDRLDYVSMMCQEHTYALAVENLLNVSIPRRAQYIRVIFAEITRILNHLLAVGCHAMDVGAMTPFLWAFEEREKLMEFYERVSGARMHASYFRPGGVSQDLSLGILNDIYSFCNQFGHRLDEIEEMLTSNPIWKLRLVDIGVVTAREAVDWGFSGVMLRGSGLIWDLRKNQPYEVYPEIKFDIPVGVNGDCFDRYTIRIQEMRQSLNILYQCLNKMPQGSVKVDDYKISPPSRVELKQNMEALIHHFKLYTEGVLVPVGETYIATEAPKGEFGVYLISNGTNRPYRCKIKAPGFSHLQALNLMSSSHMLADVVTIIGTQDIVFGEVDR

SEQ ID NO: 2202 - protein, 424 aa, Stellaria longipes
VWIHSKANEKPFYAILHRIDVGIVIDLEPARIEDPALSIAGAVQSQKLAVRAISQLQSLPGGDVKLLCDTVVESVRQLTAYDRVMVYKFHEDEHGEVVAESKRADLEPYLGLHYPSTDIPQASRFLFKQNRVRMIVDCHADSVSVVQDERLRQPLCLVGSTLRAPHGCHSQYMANMGSIASLVMAVIINGNDDEGSTRNAMRLWGLVVCHHTSPRSIPFPLRYACEFLMQAFGLQLNMELQLSAQVLEKRVLRTQTLLCDMILRESPTGIVTQSPSIMDLVKCDGAALLFRGKYYPLGVTPTELQLKDIVQWLLSNHGDSTGLSTDSLADAGYPGALALADAVCGMAVAFITRSDFLFWFRSHTAKEVKWGGAKHHPEDKDDVQRMHPRSSFKAFLEVVKSRSLPWENAEMDAIHSLQLILRDS

SEQ ID NO: 2203 - protein, 197 aa, Blastopirellula marina DSM 3645
MSRTAKISRQTAETQIELELNLDGEGKSEIATGVGFFDHMLELFTRHGCFDLKVKANGDLHVDQHHTVEDVGICLGQAIRQAIGDKKGIRRYGHFTLPMEETLCTTAIDLSGRYFLVFNAQFHSSKIGEFDSELVEDFWQSTAANALCNLHVNVFYSRNSHHVAEAIFKSAARALRMAVERDPRMPGVPSTKGTLSE

SEQ ID NO: 2204 - protein, 431 aa, Blastopirellula marina DSM 3645
MPNTLARPPKKQHNFRRVAILFAGGPAPAANAVISTAAVSFLRNDVEVLGIKHGYSNLMQFGPDRPMELGRDYIMLDHQALSRSRAQQGIMIGTARANPGKQVSHPDHLKDPERSAPLQTTYDALCSLGVDALISIGGDDTLKTANKFKLFQETLPEGSQKIPVVHLPKTIDNDYMGIDFTFGYFTAVDFLAGEVRNLLYDAEAGQAYFLVECMGRSAGWLPYGTAIAGEASLVISVEDIIGDYVGKEEEVDGRTKKVMNVDKVVDRIVKTMLAREAEGKKFGVIILAEGLAEMLPPEYLEGIKRDDHGHISITEVSLGRQFAKWISKRYEEQTGRSRKVTGLQLGYEARCSKPHAFDVMLGSQLGVGAYRALVEEGLNGVMVSVSGQLNLHYVAFENLVDPETLVTVVRYINPMSDFHRLARFLETYIND

SEQ ID NO: 2205 - protein, 626 aa, Yarrowia lipolytica CLIB122
MAARKLQQEMDRVFKRVAEGVATFDSIYDKVQQSTNQSQKEKLEQDLKREIKKLQRLRDQIKTWMGSNDIKDKKTLTDQRKLIETEMERFKACEREMKTKAFSKEGLSPGAGKQLDPREQQRQEACAFVQNTIDELSEQLETLEAEEEQLHGTVRKGRKDNSVKSERLSEIADASDRHKWHIGRLEVIARLLENGSLAPQQVMDLQEDIQYYVESNQDVDFAEDVEIYDELNLDQEEDEFTIDEQYLRDEPTSTLEDLAVESAKEREREAAKEKEEAAKAAQAQKEAAAQAAADAQNSSRRPAATNTPPPIGSNMKPAPLPTRNESLKYASAAAAAAGSSVGSSPSALPQGLAPLPAPKEEIRAAAPVPVAVSATPAPWAEGGGPAPGGANVSIPTGPAAASTPIAASSTPVAAPAIPTGPAASATIASTSSAGNTTSTAPSPPPLSTSTTLSDDSIIYTLPPGLQDLVSSLDVAKKRVGTPPPIGSIAKLLETSYFSCPDSGDAEKPQMYHPESPFPTLPFYPQDPLAVFEDGGIFAKMDIDTLFYIFYYRQGTYHQYLAAKELKSRSWRFHKRFLTWFQRHEEPKMINNEFEQGTYRYFDFEGVWLQRRKSNFQFEYHFLEDEI

SEQ ID NO: 2206 - protein, 452 aa, Stellaria longipes
AVNYSELNLLNPILVHSKNSGKPFYAILHRIEVGLVVDLETVNLAETLVGASGALMSYKLAAKAISKLQSLPSQNIPLLCDVLVKEVRELTGYDRVMVYKFHDDEHGGVIAESHSPSLDSYLGLHYPATDIPQASRFLFLKNKVRMICDCRSPSVKVIQDETLTQPLSLGSSTLRAPHGCHAQYMANMGSIASLVMAVTITNEEDEVSDRHRTRKLWGLVVCHHTSSRFVPYPLRYACEFLVQVFGIHINKEVELAAQVREKHILKIQSMLCDMLMRDSPITIMTQSPNVMDLVKCDGAALLYQSKLWVLGITPKSNQIKDISQWLFEYHGNAKGLITDSLKEAGYPGALELGDAVCGMAAVRISSEEMLFWFRSHTAKEIKWGGAKHEPGQNDEQGIMHPRSSFNAFLDVVKWRSVPWEDMEMDSIYSLQLIFIKCLVKNKTMSDTSKMIV

SEQ ID NO: 2207 - protein, 241 aa, Neorickettsia sennetsu str. Miyayama
METCVQRFVVANWKMNGSQQLCDVFVNRFSAFAFNPEVEIVIAPPAVYLGQMRAAVMSSDLPLALGAQDCASGDNTPSTGDISSRMFKEVGARYVLVGHSERRTLHCESSKVVGMKANAGLRSRLIPIICVGQNNRPINRESLTKQCRDSIPMNSHDFIVAYEPVYAIGTGIVPSNEEIEEAVCLIKDAVGDAVPVLYGGSVSPVNCSEIFAVKNLGGVLVGGASLDPDSFIKICEVANRF

SEQ ID NO: 2208 - protein, 454 aa, Stellaria longipes
ALGFTDVSLLNPILVHCKNSGKPFYAIVHRVTRSLVIDFEPVKPYEVPMTAAGALQSYKLAAKAITRLQSLPSGNMDRLVDTMVQEVFELTGYDRVMAYKFHDDDHGEVVSEVTKPNLDSYLGLHYPATDIPQAARFLFMKNKVRLICDCRAKNVQVVQDEKLSVDLTLCGSTLRAPHGCHAQYMENMNSIGSLVMAVVVNDEDDEDGGSAPAQPHKRKRLWGLVVCHHTSPRFVPFPLRYACEFLAQVFAIHVNKELELENQFLEKKILRTQTLLCDMLMRDAPLGTVTQSPNIMDLVKCDGAALLYNNKVWRLGSTPTDYQLQEIGRWLSRDHMDSTGLSTDSLYDAGYPAALELGDSVCGMAAVRITVNDMLFWFRSHTAAEIKWGGAKHEAGEKDDGSKMHPRSSFKAFLEVVKRRSVPWKDYEMDAIHSLQLILRNAFKDGEAADLNTS

SEQ ID NO: 2209 - protein, 132 aa, Acinetobacter sp. ADP1
MLKILLPLVGLGFSTFCLAQNPLSVHVLSLETGLPSANVNVTLEAQQKDKWVEINHGTTDDNGRIAALYPEDKPLDKGIYRVTFKTGEWFRQKNQRSFFPEVPVVFVIDGSLEHYHIPLLISPYGYSTYRGN

SEQ ID NO: 2210 - protein, 694 aa, Yarrowia lipolytica CLIB122
MAPQFSKTDETAINTIRTLAIDAVAKANSGHPGAPMGLAPVAHVLWNYYMNFTSSNPEWINRDRFILSNGHACMLHYSLLHLFGYDITIDDLKNFRQLNSKTPGHPEAETPGIEVTTGPLGQGVSNAVGFAIAQAHLGATYNKPGYDIINNYTYCIFGDGCMMEGVASEAMSLAGHLQLGNLITFYDDNHISIDGDTNVAFTEDVSQRLEAYGWEVIWVKDGNNDLAGMAAAIEQAKKSKDKPTCIRLTTIIGYGSLQQGTHGVHGSPLKPDDIKQFKEKVGFNPEETFAVPKETTDLYAKTIDRGANAEKEWNELFAKYGKEYPKEHSEIIRRFKRELPEGWEKALPTYTPADNAVASRKLSEIVLTKIHEVLPELVGGSADLTGSNLTRWKDAVDFQPPVTHLGDYSGRYIRYGVREHGMGAIMNGMNAYGGIIPYGGTFLNFVSYAAGAVRLSALSGHHVIWVATHDSIGLGEDGPTHQPIETVAWLRATPNLSVWRPADGNETSAAYYKAITNYHTPSVLSLTRQNLPQLEGSSIEKASKGGYQLISEDKGDIYLVSTGSEVAICVAAAKLLKEKKGITAGVISLPDWFTFEQQSLEYRKSVFPDGIPMLSVEVYSDFGWSRYSHQQFGLDRFGASAPFQQVYDAFEFNAEGVAKRAEATINYYKGQTVKSPIQRAFDPIDVNTRPGHGV

SEQ ID NO: 2211 - protein, 437 aa, Oryza sativa
  misc_feature (380)..(380): Xaa can be any naturally occurring amino acid
  unsure (1)..(437): unsure at all Xaa locations
MARGAAGGEVGRSMPAVHDAHDDSENFLELLNSRTLAPELFAEPPACDYLKKMEYGGGGGGGGGGWPEHQFTAAAALEKHLSSAAAAGYGGALAHHHHAAGAPERLTANLSDLVSNWSIAPPNHGHHVGGAAACDNPAVAAAMAAAHGGGNVKQSGSSFLDSGGGGGGAMLQQESSSSTGTGGGGQDFLRPMGLAAGSSSYSSMLGLSSRMYGGGGTATMDVPWGSSNAGAARSLSDLISFGGGAMDKPPPPPPSSAPARTSSADYKKQQGQQEISSPVKTSSSGGGGKEGKKKRSEEAAGSEGSTKKSKHEATSPTSSLKSQVPKVKLGDKITALQQIVSPFGKTDTASVLYEAINYIKWLHEQVQLLSDPYMKSSSSXKDYNAWGGLDRKEKADAEVDLRSRGLCLVPVSCTPQVYRDNNGPDYWTPPYRSCLYR

SEQ ID NO: 2212 - protein, 512 aa, Mycoplasma genitalium G37
MKRCYITTPIYYASGKPHIGHAFTTILADVIKRFKIQNGYEAFLLVGSDEHGNKIESKAKSLNLDPKTFVDINAQAFKLMWKTLNISFDHFIRTTDEIHKQQVQKTFQDLYDKKLIYQSEWKGAYCVECEQNYFTFNKQTMLCEIGHNLSLVQEPCWFISFSSTKNWIETTIGKNQLNIIPKSRASELKNNFINNGLNDLALTRKNVTWGIKVPFDPNQTIYVWFDALFSYITNLGFRNGDPNFIKWWNNDNKEREVIHLISREITRFHCIYWPIFLHLLDIKLPTQFLSHGWIVDGEGRKMSKSLNNVISPEQLIDQFGVDGTRYCLLKEMRLDKDNRCSVSILKEIYNADLANSFGNHVSRTFGMIKKYLNGKLEYQIITDNALQKIMILIDESIVQFDHYFNSYEFYRAINLLLKIVFELSKLIDDFKPWELFKNQEFSLLKQLLFTCVRCVQVCYVLLTPILVNTASKVFHLFNFADDACRKDQLRDATLLKKIIISNSMEVLFKRVD

SEQ ID NO: 2213 - protein, 432 aa, Saccharomyces cerevisiae
MTVNDKKRLAIIGGGPGGLAAARVFSQSLPNFEIEIFVKDYDIGGVWHYPEQKSDGRVMYDHLETNISKKLMQFSGFPFEENVPLYPSRRNIWEYLKAYYKTFIANKDAISIHFSTEVTYLKKKNSQWEITSKDELRTTKSDFDFVIVASGHYSVPKLPTNIAGLDLWFDNKGAFHSKDFKNCEFAREKVVIVVGNGSSGQDIANQLTTVAKKVYNSIKEPASNQLKAKLIETVQTIDSADWKNRSVTLSDGRVLQNIDYIIFATGYYYSFPFIEPSVRLEVLGEGVTGDKHSSVNLHNLWEHMIYVKDPTLSFILTPQLVIPFPLSELQAAIMVEVFCKSLPITTTFDSNACGTHNFPKGKDLEYYAELQELLNSIPRRVGHFEPVVWDDRLIDLRNSSYTDKEERNVLLAEHAQALKKKKAPYFLPAPHT

SEQ ID NO: 2214 - protein, 313 aa, Oryza sativa (japonica cultivar-group)
MGKGKVHPSPSPAAGAGEETAEAVLMRLLPAAVVAMAAGLGAEGKEVLAYLVLASMRSSSAARWGQAEVGKGGGGGGSGRVGHHAPELGCGCFGCYTAYWSRWDGSPERDRDAIHRAIEAFEDHLSRKEEEEVVGGGKGASSRRRKKRSGKDKAKAKVPPAASAGQPPPPPPNQEETSAAAAAASPPKSILDGEEEEEEEMKNTAAAAVAGAGDGGVVEEERRRRGWGVLSWKVWNLWGSHYALKLKLKLVRNARIMEPEEGLLLLAHENNRYVASRDQISNGDGRGRGGGGACGIGGWTGRTLMGTARRSHR

SEQ ID NO: 2215 - protein, 484 aa, Erwinia carotovora subsp. atroseptica SCRI1043
MSGNHLQDHELFKTGYFVAGKWQQGAATFEVVNPATGESIARVAKAGKKETQAAIDAAHAAFPAWKRKTAKERSEILYRWYELILENKRYLAELMTAEQGKPVQEAEGEVVYAANFIQWFAEQGKRVNGEIIPPAKPGSKIYATREPVGVVVAITPWNFPLAMLTRKLGPALAAGCTGVIKPANNTPLSAFALLALAQQAGVPDGVLNGVAGDTQAISDTVMASDKVRKISFTGSTAVGKTLVRNAADTMKKVSMELGGNAPYIVFDDADIQAAVKGAIANRFRNAGQVCVSANRFYIQDGVYDEFVSLLAEEVKKLKVGNGMDDGVVLGPLIDEAAVEKVEKHVNDAVEKGGKALVGGKRHKLGHSFFEPTVIVDANEAMLLAQEETFGPVAPCFRFKTEEEVIQRANNTPFGLAAYFYSQNLQRVFRVAEALESGMIGINECAVSTELAPFGGVKESGLGREGSVLGLDEFLEVKTWHVGGL

SEQ ID NO: 2216 - protein, 443 aa, Candidatus Pelagibacter ubique HTCC1002
MTKVAIIGAGPCGLSALRSFEQAEKNGEKIPEIVCFDKQEDWGGLWNYSWRTGSDQYGDPVPNSMYRYLWSNGPKECLEFADYSFDEHFGKPIPSFPPREVLYNYILGRVKKGNLKSKIKFNTTVTNVSYDNENFEVTYRDKKNDKISKDIFDYVIVSTGHFSVPFIPEYPGMKAFPGRIMHSHDFRDAEEFRGKNVVVLGSSYSAEDVALQCHKYGAKSVTIGYRHNPMGFKWPEGMKEVFHLDRLEGNKAIFKDGHVQETDAVILCTGYLHHFPFMSEDLKLKTGNRLYPPMLYKGVVWQNNHKLMYLGMQDQFHTFNMFDCQAWFARDVIMGKIKTPNDSEIEKDINKWVSMEEKLENADQMIDFQTEYTKELHELSDYPKIDFELIRKTFKEWEHHKVENIMTYRNKSFASPVTGSVGPIHHTPWEEAMDDSLKTFLNK

SEQ ID NO: 2217 - protein, 202 aa, Oryza sativa
MQATWSKASLIVAAIFLVAGLLLSSATVVHGGGGGRRFFRSYNEPCKEMRLYFHDILYDFSNSTANSTSAVVASPAALLRAAKNTTIFGTTVVFNDPMTEGTSALPPSLEETAVRAQGLYLYDGKAASTLNAWLAFSVVFNSTARRGTLSLMGAEPRNATRDTSGVEGPGNSQVPGRCQDPGPNREGFTNPGADGHTPRMQP

SEQ ID NO: 2218 - protein, 561 aa, Candidatus Pelagibacter ubique HTCC1002
MSEVKSDIQIAREAKMQPINDILAKINVPDESSAFSPMGRHIAKINLEYLDTLKDKPNGKLVLVTAITPTPAGEGKTTTSVGLNDGLNKIGKKSIVCLREPSLGPSFGMKGGAAGGGYAQVVPMEQINLHFTGDFHAITSAHNLLSALIDNHIYWGNKLDIDVRRIVWKRVIDMNDRSLRSININLGGVANGFPREDGFDITVASEIMAIFCLSNDLEDLEKRIGNITIAYTRDKKPVYAKDLKAQGPMTVLLKDAIRPNVTQTLENNPAIIHGGPFANIAHGCNSVIATKTGLKLADYVVTEAGFGADLGAEKFLDIKCRKSDLKPSCVVIVATIRALKMHGGVAKDDLKTENVEALKKGLVNLQRHVENVKKFGLPVAVAVNHFIKDTENEVKALIEFCDTIGVKASLCTHWANGGEGTKELASHVAELCEKNEDKFKFLYESKTPLFKKIETIAKEIYRADEVIADTKIRDQLKSFEEAGYGDFPICIAKTQYSFSTDPSLKGAPTGHSLPIREIKLSSGAEFIVVICGAVMTMPGLPRVPAADSIKLNKDGEIEGLF

SEQ ID NO: 2219 - protein, 575 aa, Ipomoea trifida
MEITSMTQAMQLHARILKSGAYDSNHGQDFHKLFTFSALSPSGDLNYARHILRTLHTPNSFYYNTMIRAYSDSTDPTRAFTLFLYMQNPDDASVAVPRPDHFTYPFVLKACSKSGHARFGKQIHGLVFKSGVGSDRYINNALIHLYSVSGEPNLAYKVFDKMPDRDVVSWTSIIDGFVDNDRPIEAIRLFTHMIENGIEPNEVTVASVLRACADTGALNTGERIHSFVKEKNFSSNANVSTALIDMYAKCGCIDGALEVFDETLEKDVYVWTAIIAGLASHGLCMKAIEFFENMKKSDVKMDERAITAVLSAYRNAGLVSEGLLFFRRLKKHKIKPTIQHYGCVVDMLTRAGRLKDAEEFIRKMPIEPDAVLWRTLIWGCKILGDVERSERLVRELELLNMDSRDTGSYVLLENVYAATGKWEEKAKTRELMYQRGLMKPPACSRIEIDGVVHEFTAGDSRHDEATAVYEKLEDVEERLRGEGYNPIVSEVLLEIDDDEKASQLLHHSEKLAVSFGLVKSSPGSVIRIVKNLRSCEDCHSFMKLISKVYQRDIIVRDRIRFHHFSGGNCSCGDRW

SEQ ID NO: 2220 - protein, 455 aa, Clostridium acetobutylicum ATCC 824
MNKKISPALIYFFGAFGGFMFGYDIGIINGALPGINATWHVSSWLEGFITSGLFVGAMIGASLMASLADRFGRRRMIMWSAIVFALGALGSAVSTSTNLLIGARVILGVAVGGASALVPMYMGEISPAETRGKLSGLNQLMITVGMLFSYGVNFAFAGAFEGWRWMLGGAMVPAMVLLIGTFILPESPRFLARIGKTELAKQVLQTLRSKEEAETEYQEIINSKHTETGSFGDLFAKQALPAVIAGCGLTLLQQIQGANTIFYYSSQILSNVFGSANGGTISTVGIGVVLVLATIVTLLVVDKFKRRTLFMTGSIGMGASLLLVGLIYPYSEAKHAWATWLVFFFICLYVVFYAYSWAATTWIVVGELFPSNVRGLATGIASAVNWFGNILVALFFPVLLETVGLSVIFFGFAAICIIGFLFAKYVLYETKGKSLEEIETYLYNRSIGKVRGLNE

SEQ ID NO: 2221 - protein, 168 aa, Brassica napus
  misc_feature (135)..(135): Xaa can be any naturally occurring amino acid
  unsure (1)..(168): unsure at all Xaa locations
MDEVMTVADAGGVNRALYGSSPPSQNLLPHNLPIFSAFLALALAQFLKVFTNWYKEKRWDSKRMLSSGGMPSSHSATVTTLALSIALEEGAGAPAFAIAPVLACVVMYDASGVRLHAGRQAELLNQIVCEFPPEXPLSTVKPLRELLGHTPIQVAAGAILGCVVAYLM

SEQ ID NO: 2222 - protein, 172 aa, Arabidopsis thaliana
  misc_feature (124)..(124): Xaa can be any naturally occurring amino acid
  unsure (1)..(172): unsure at all Xaa locations
MSVASPIQCIRILNPSSSSSSSTASSSFRFSTTTKPCVFIIRCSQTEGPLRRPSAPPALREPQKPVPASQPSSSPPPPPPQKSVAIDGKSVTTVEFQRQKAKELQEYFKQKKLEAAGQGPFFGXFQPKNEISNGRWAMFGFAVGMLTEYATGSDLVDQVKILLSNFGILDLE

SEQ ID NO: 2223 - protein, 105 aa, Triticum aestivum
PRGRLLQSVMEAGPLLQNLLVAGPLPRWRNPPPVHALDTLPVGGGGVYMNTTPLHAANAGAALGYGPNANSVCTKRPMAAMPAMPMAATSCSPSPGFVAKRHRLH

SEQ ID NO: 2224 - protein, 663 aa, Clostridium acetobutylicum ATCC 824
MNIDNLAINTIRILSAEAIQKAKSGHPGLPMGCAPMAYTLWSRHLKHNPNNSKWKDRDRFVLSAGHGSMLLYSLLNIFGYDVSVEEIKNFRQFKSKTPGHPEYRWTDGVETTTGPLGQGICNAVGMAIAETYLANKFNKESYNIVDHYTYALVGDGCLMEGISGEASSLAGTLGLGKLIVLYDSNNISIEGSTDIAFRENVALRYEAYGWQVIKVDDGTNLEKIDLAIKEAKVEKNKPTIIIVKNVIGYGCPSKQGKAAAHGEPLGEENLKLTKENLNWNYEPFTVPEEVRAYTKEFKVRAQRQEDKWNSMFEEYKKEYPKLYKEWEVWFSEKTPMKLLDNGEFWKFDKNMATRQSSGVLINRLAKLIPNLIGGSADLAPSNKTHMDDRGDFSAENRSGSNMHFGVREHAMAAIANGMYLHGGLKVFVATFFVFSDYMKGAMRLSSIMKLPIVYVLTHDSIGVGEDGPTHEPIEQLAALRSMPNMTVFRPADSNETAAAWYSALNTKNGPTALVLTRQALPLYDSSGKNALKGGYILKDSKNKENPDVILMASGSEVELILNAAKELQNENIDARVVSMPSFEVFEEQSEDYKNSILPRNIRARVAVEAASPFGWHKYVGLDGEVIAMESFGASGKSDILFKEFGFTVENVVEKVKNVLKNLK

SEQ ID NO: 2225 - protein, 896 aa, Xylella fastidiosa 9a5c
MNRLKEALHNDPNPLETQEWLESIKAVIDIAGPERAHQLLEGVAEQIHRTGTNLPFSPITEYVNTIPTADEAKNPGDPALERSIRSIIRWNAMATVVRANRKPGDLGGHIASFASSATLYDVGFNHFWRAPSPQHPGDLLYIQGHSSPGIYARAFLEGRISESQLDHFRMEVDGKGISSYPHPWLMPQFWQTPTVSMGLGPLSAIYQAQFMKYLEHRGLIAPSDRKVWCFIGDGESDEPETLGAIALAGREGLDNLIFVVNCNLQRLDGPVRGNGKIIQELEGVFRGGGWNVIKLLWGAHWDPLLAQDTQGVLRKLMMETVDGEYQNCKAFGGEYTRKHFFDKYPETAAMVAHLSDNDIWRLNRGGHDPHKIYAAYHRAVNTQGMPTVILAKTVKGYGMGTAGESLNPTHQTKKLDHDAIKHFRDRFNIPISDQQLDAADHIPFYHPGPDSPEIKYMLARREALGGFLPQRRTKSSKSFIVPGLDKYERLLTSSGERTYSTTMAFVQSLNITLRDKALGPHIVPIVADEARTFGMEGLFRQIGIYAPFGQKYKPVDADQLMYYREDESGQVLQQGITEPGAIASWMAAGTSYSVSDVPMLPFYIYYSMFGFQRIGDIAWQAADMRTRGFLLGGTAGRTTLNGEGLQHEDGHSHLMAGAIPNVRSYDPTFGYEVTVILQHGMKAMMQDQIDEYYYLTLMNENYAHPDMPAGAEQGIIKGMYLLKDAGKPKKGELRVQLLGSGAILREAIAAAELLHQDFGITADLWSCPSFSELRKDGFDTERWNRLHPDSEPRTPYVTQQLENRQGPAIAATDYVRLFADQIRAFVPMHYTVLGTDGFGRSDTRSNLRRFFEVDRYFIAHAAIAALAKEGKMTGKDVARAIEQYNINPEKPNPVDI

SEQ ID NO: 2226 - protein, 530 aa, Oryza sativa (japonica cultivar-group)
VHQSHRNTSHIRELSLAMDNAYIIAILSVAILFLLHYYLLGRGNGGAARLPPGPPAVPILGHLHLVKKPMHATMSRLAERYGPVFSLRLGSRRAVVVSSPGCARECFTEHDVTFANRPRFESQLLVSFNGAALATASYGAHWRNLRRIVAVQLLSAHRVGLMSGLIAGEVRAMVRRMYRAAAASPAGAARIQLKRRLFEVSLSVLMETIAHTKATRPETDPDTDMSVEAQEFKQVVDEIIPHIGAANLWDYLPALRWFDVFGVRRKILAAVSRRDAFLRRLIDAERRRLDDGDEGEKKSMIAVLLTLQKTEPEVYTDNMITALTANLFGAGTETTSTTSEWAMSLLLNHPDTLKKAQAEIDASVGNSRLITADDVTRLGYLQCIVRETLRLYPAAPMLLPHESSADCKVGGYNIPRGSMLLINAYAIHRDPAVWEEPEKFMPERFEDGGCDGNLLMPFGMGRRRCPGETLALRTVGLVLGTLIQCFDWERVDGVEVDMTEGGGLTIPKVVPLEAMCRPRDAMGGVLRELV

SEQ ID NO: 2227 - protein, 424 aa, Stellaria longipes
VWIHSKANEKPFYAILHRIDVGIVIDLEPARTEDPALSIAGAVQSQKLAVRAISQLQSLPGGDVKLLCDTVVESVRQLAAYDRVMVYKFHEDEHGEVVAESKRADLEPYLGLHYPSTDIPQASRFLFKQNRVRMIVDCHADSVSVVQDERLRQPLCLVGSTLRAPHGCHSQYMANMGSIASLVMAVIINGNDDEGSTRNAMRLWGLVVCHHTSPRSIPFPLRYACEFLMQAFGLQLNMELQLSAQVLEKRVLRTQTLLCDMILRESPTGIVTQSPSIMDLVKCDGAALLFRGKYYPLGVTPTELQLKDIVQWLLSNHGDSTGLSTDSLADAGYPGALALADAVCGMAVAFITRSDFLFWFRSHTAKEVKWGGAKHHPEDKDDVQRMHPRSSFKAFLEVVKSRSLPWENAEMDAIHSLQLILRDS

SEQ ID NO: 2228 - protein, 496 aa, Xylella fastidiosa 9a5c
MSAPFALYDTAAAAALDARLAAHLGDDGDLLMQRAGRAAWDLLRQRWPDARQVLVACGTGNNGGDGYVLACLAHRAGWQVQVVHLPGRGPASLLAQRAYDAYLAAGGQVMLFSGGLETADVLVDALFGIGLNRPLDVPTQGLINALNAAGRPVLALDVPSGVDAERGAVFGTPVYAHVTLQFIVPHVGLYTGPALEAVGERVLAALDVPPALRDALAPCAERWGSQRLASRFRPRRRNSHKGEFGRVLCVGGNWGSGGAIMLSAEAALRSGAGVVHVATREAHVAPLLARCPETMPRGVAGSAELMPLLAAADVVALGPGLGQDPWGQALLAATLDSGCALVIDADALNVLAAAPRPLPPGAILTPHPGEAGRLLGCTTAQVQADRRAAAQALAARFAAVVVLKGAGSLIAAPGCLPCVIDAGNPGMAVAGMGDVLTGVIAALRAQGDSVFDAALFGALLHAAAGDLVARDGGERGLLPSDVLPVLRRLINPDPAL

SEQ ID NO: 2229 - protein, 452 aa, Stellaria longipes
AVNYSELNLLNPILVHSKNSGKPFYAILHRIEVGLVVDLEIVNLAETLVGASGALMSYKLAAKAISKLQSLPSQNIPLLCDVLVKEVRELTGYDRVMVYKFHDDEHGEVIAESHSPSLDSYLGLHYPATDIPQASRFLFLKNKVRMICDCRSPSVKVIQDETLTQPLSLGGSTLRAPHGCHAQYMANMGSIASLVMAVTINNEEDEVSDRHRTRKLWGLVVCHHTSSRFVPYPLRYACEFLVQVFGIHINKEVELAAQVREKHILKIQSMLCDMLMRDSPITIMTQSPNVMDLVKCDGAALLYQSKLWVLGITPKSNQIKDISQWLFEYHGNTKGLITDSLKEAGYPGALELGDAVCGMAAVRISSEEMLFWFRSHTAKEIKWGGAKHEPGQNDEQGIMHPRSSFNAFLDVVRWRSVPWEDMEMDSIYSLQLIFIKCLVKNKTMSDTSKMIV

SEQ ID NO: 2230 - protein, 367 aa, Lentinula edodes
MDDRTTAFIVGSSYQPLDIIGEGAYGVVCSAVHIQSQRKVAIKRITPFDHSMFCLRTLREIKLLRHFQHENIIGILDILKPNLGPDGSLDGMTEVYLVQELMETDLHRVIKTQELSDDHCQYFIYQTLRALKALHSADVLHRDLKPSNLLLNANCDLKLCDFGLARSASPLPDHPVDASTFMTEYVATRWYRAPEVMLTFKQYTKAIDKWSLGCVLAEMLSGKPLFPGRDYHHQLSLILDVLGTPTLDDFYAISSSRSREYIRALPFRKKKVFGKPVHEGGVKGFEGKNPLAIDLMEKCLSFNPKRRIDVEGALAHPYLAPYHDPSDEPGAERIDSEFWSFDTFNNGKGLSKEELKVLIYEEVMRGA

SEQ ID NO: 2231 - protein, 329 aa, Clostridium perfringens str. 13
MCKTLNRKYIYKYGEKKEDVEIVENMLNRMRNSGTFKGENFANIYYEKYIVEESDKAIVICHGFSECIEKYHEIIYYFLNEGFSVYIMEHRGHGRSGCLSKSCNTQVEVESFDYYVKDLKTFLNEVVLKDKRFNNNLYLFAHSMGGAIGTIFLENNHGYFKKVILNSPMFRINTREYSHIKCKLIAKFLILMGKGENFIFGQKPFEEEENLEASGTSDKLRHGLYHKFLLENPILRRGGGSIHWYKEAARATDCLMKKRNIERIDTPILLFKSEFDSYVDTKFHDEFKKVAKYCELIEVKGSKHEGFFEKDEILYDYLDKIFKFLEENN

SEQ ID NO: 2232 - protein, 518 aa, Oryza sativa (japonica cultivar-group)
MVKAYIAIFSIAVLLLIHFLFRRRGRSNGMPLPPSPPAIPFFGHLHLIDKPFHAALSRLAERHGPVFSLRLGSRNAVVVSSPECARECFTDNDVCFANRPRFPSQMLATFNGTSLGSANYGPHWRNLRRIATVHLLSSHRVSGMSGIISGQARHMVRRMYRAATASAAGVARVQLNRRLFELSLSVLMEAIAQSKTTRREAPDADTDMSMEAQELRHVLDELNPLIGAANLWDYLPALRWFDVFGVKRKIVAAVNRRNAFMRRLIDAERQRMDNNDVDGGDDGEKKSMISVLLTLQKTQPEVYTDTLIMTLCAPLFGAGTETTSTTIEWAMSLLLNHPEILKKAQAEIDMSVGNSRLISVVDVHRLGYLQCIINETLRMYPAAPLLLPHESSADCKVGGYHIPSGAMLLVNVAAIQRDPVIWKEPSEFKPERFENGRFEGLFMIPFGMGRRRCPGEMLALQTIGLVLGTMIQCFDWGRVDDAMVDMTQSNGLTSLKVIPLEAMCKPREAMCDVLRKFM

SEQ ID NO: 2233 - protein, 322 aa, Leptospira interrogans serovar Copenhageni str. Fiocruz L1-130
MDPIFEKIEKAIDTEIESILYFRKNLDPSIKQAIELILECKGKLIVTGVGKSGDVGKKISSTLSSTGTPSVFLHPADAAHGDAGIISCEDIIIAIGKSGESEELLNLIPTIKNIGAKLVSMTANVDSKLAKESDVVLITPVLKEACPLELAPTSSTTIALILGDAIAMCLMELKNFKRENFALYHPAGRLGKRLSLKIDDVMRKDKDLAKVLPDTKLENILTEITVKRQGATGVTDLNGTLLGIITDFDIRKKLKEGKLDSSISAEQLMNPSPTMFLSGSNAYDVLKQMESRPNPISVAPIVDNSKRLIGIVSIHDLLQKGL

SEQ ID NO: 2234 - protein, 604 aa, Francisella tularensis subsp. tularensis SCHU S4
MERREKRIRKLRNKSGKVFAIETNLTGRQLLNNRVLNKDVAFSQEERVAFDLIGYLPEKVESLEEQAIRVRRQLDLKPNSLEKYVFLNRLHDLNTTLFYHFVRENLEEIMPIIYTPTVGEAVQKYSSSFRKQSGLFISISHKKHIARILERYEYNSIDLVLVTDGEAVLGIGDQGIGGMNISIGKIMVYVAASGIDPARVLPVQLDMGTNNDALLNAPGYLGVRLPRVSGETYDEFIEEFVTQVKARFPNVFLHWEDLGRDNATRILEKYKDKLCTFNDDIEGTGIVATANCIAGVKTASTIRINAGEITVEEALSGICDIKVVIFGAGSAGCGIARQLADVIADRAGVSIEKARSSIYLVDRYGLVCDRLRAKRITPEQKLFVKTREEIDKWKVEDFNYITLEETVKNTKCDILIGTSGQPGSFTKEIIKTMAKNNNYPIIMPLSNPTSLCEALPEDIIKWTNGKALIAAGSPFPDVTYNGRDYRISQGNNAFIFPGLGLGSVAVHARVLTKGMIRAASYRLSELSPMVINEDITQPLLARITDLVDVTKEITKAVAKQAILEGVHGVDIDLEDLTETELDEEIERLINLSSWTPTYAPYMPI

SEQ ID NO: 2235 - protein, 331 aa, Glycine max
MEFSFDEKDFASCCGSTKFAKEMASASPFRSFQDAVSVAKGVWFNSVDVNGWLQAFSAHPQIGQTHAPSVASEASAQWSKGEQSTALATATGSSLQELSEWNARYREKFGFVFLICAAGRSTDEILAELKRRYTNRPIVEFEIAAREQMKITELRLAKLFSSRENISSTADKNSTARKAEDRISIISSHMTATSESSTGKSIQHPARTRPPITTHVLDVSRGAPAAGIDVLLEVWRGTQSQPTFGATGGGSWVFQGSSKTDSDGRSGQLLSIVDEASPGIYRISFNTGKYIPNGFFPYVSIVFEIKESQKREHFHVPLLLSPFSFSTYRGS

SEQ ID NO: 2236 - protein, 634 aa, Ipomoea trifida
MHLIANSTIQHTPSNPHMQATLLSFEVSSRAPIGIFYTSQLDHLKVKGKNSRVKCFKDLGTITSSSKLCAVRDFYGLEKPNLLRCYCQPAERGNERIFEDEQGRSVHSIAPNGQTSDAAQQFKNDNGTVPSSKTVNNALPKSSTNSIEEEAWNLLRASMVYYCGNPIGTIAANDPSDSSILNYDQVFIRDFIPSGIAFLLKGEYDIVRNFLLHTLQLQSWEKTMDCYSPGQGLMPASFKVRTVPLDNDENATEDVLDPDFGEAAIGRVAPVDSGLWWIILLRAYGKCSGDLSLLERIDVQTGMKMILKLCLADGFDMFPTLLVTDGSCMIDRRMGIHGHPLEIQALFYSALLCAREMLAPEEASIDLITALNNRLLALSFHIREYYWIDVKKLNEIYRYKTEEYSYEAINKFNIYPDQIPPWLVEWMPSKGGYLIGNLQPAHMDFRFFSLGNLWSIVSSLATTDQSHAILDLIETKWEDLVANMPLKICYPALEGQEWRIITGGDPKNTPWSYHNAGSWPTLLWQLAVACVKMKRPEIAENAIKVAERRIAGDKWPEYYDTKRGGFIGKQARLFQTWSIAGYLVAKLLVANPEAAKMLITIEDTELLSAFSSILSSNPRRKRSRKGAVKQSYIV

SEQ ID NO: 2237 - protein, 357 aa, Erwinia carotovora subsp. atroseptica SCRI1043
MSQFEQDAHLKQQSDRALSDHELQADHTRQKTHELPAHFDFQQAGKQVLSIERDGLAQLDQYIDDNFTLACKNIFHCKGKVVVMGMGKSGHIGCKIAATFASTGTPAFFVHPGEASHGDLGMVTPHDIVIAISNSGESHEILSLIPVLKRQKVFLICMTSAPESTMGKAADIHLCVHVPQEACPLGLAPTTSTTATLVMGDALAVALLQARGFTAEDFALSHPGGALGRKLLLRVSDIMHSGDEIPHVPHDASLRDALVEITRKNLGMTVICEADMKIQGIFTDGDLRRIFDMNIDLNSARIADVMTAGGIRVAPQTLAVDALNLMQSRHITSVLVAENDRLVGIVHMHDMLRAGVV

SEQ ID NO: 2238 - protein, 286 aa, Ipomoea trifida
FYVAEVLLALEYLHMLGVVYRDLKPENILVREDGHIMLSDFDLSLRCAVNPKLLKSSSPVGQPPKKMSSPCSDSSCIEPFCLHPSWQVSCFTPRFLSAAAKTRKLKADIAAQVTPLPQLVVEPTSARSNSFVGTHEYLAPEIIKGEGHGSAVDWWTFGIFMYELLYGRTPFKGTTNEDTLGNVVSQCLKFPETPMISSHARDLIRRLLQKEPENRLGSSKGATEIKNHSFFEGLNWALIRCATPPEMPRIFDLGNLISDTNSQKKQGGKCQKEGTSGEENIEFEMF

SEQ ID NO: 2239 - protein, 492 aa, Burkholderia xenovorans LB400
MDSFNPDDVAIRSGHYIGGEYVEAGGRRIEVARPSDGVVYATVPLADAGMVDRAVENAWQAFRHSGWARMAPRERAKILRRFAELVEADAPTLGRLEALGSTRPIAQAIGWDVPFTAEGIRFYAEFADKLGGDVAATDHDHLGMTIAEPYGVIGAIAPWNFPLVMASWKIAPALAAGNAVVLKPSEMTPFSVLRLAELAVQAGVPAGIFNVIQGDGRVTGDELVRHPKISKVTFTGSTRTGASIMAACANSGTRPVTLELGGKSPQIVFADAPRLDDVARRIAGAITGNAGQVCVAGSRLLVERSLAEPLAERIGKIFAELKPGATWAAGTTLSPIISAPQAARIEGIVGRTLEAGATLRYGGVRADVGSNGAFYTPTLLTNVTAHSEAVREEIFGPVLTLQTFDTEEEALALAQHPEYGLAAGVHTADLGRALRFVRGLEAGTVWVNRYGRTSDFMIPTGGYKRSGIGKDLGRQAYEANLRFKSVLIDLRP

SEQ ID NO: 2240 - protein, 465 aa, Burkholderia xenovorans LB400
MPIQSLIEADRKHLIHPVINYRVHEARGVTVLESASGAFLRDAAGNELLDAFSGLWCVNVGYGQQSIVEAATAQMQKLPYATGYFHFGSEPAIELAQKLVEVSPASLQHVYFTLGGSDAVDSALRFITHYFNATGRPSKKHVIALQRGYHGSSSTGAGITALPAFHRNFDLPLPNQHHLPSPYAYRSHFPDDAALIAASVAALEAKVAELGANNVAAFFCEPIQGSGGVIVPPAGWLKAMRESCRKLGILFVADEVITGFGRTGPLFACQGENVEPDLMTVAKGLTAGYAPMGAVLMSDEIYQGIADGDAEAVVGHGHTYSAHPVSAAIGLEVLRLYHEGGLLANGVARAPRFARGLDALLAHPLVGDSRHRGLLGALELVADKDSKAGFDPALKLSDRIAAAAYENRLIFRAFGDNILGFAPALSYTEGEFDLMFERLEKTLDDVLAQADVRAALKLRTHAAAC

SEQ ID NO: 2241 - protein, 615 aa, Aspergillus oryzae
MTSRKTQQEIDKTFKKVAEGIQSFEGIYEKIRSTSNPTQRDKLEENLKREIKKLQRYRDQIKSWASGNEVKDKGPLLEQRRAIETCMEQFKAVEKEMKTKAYSKEGLSAASRLDPREKEKVETSDFLSSMVDELQQKIEAMEAEEETLHMQMKKGKKDVARANRLADLQRITERHKWHVNKLELLLRSLQNGNVEVNQVLDLKESIKYYVEDGHNVDYSGEDETLYDDLNLDGETEAQFGMTGDNDRVSSQDTQSVQEEDLDLRPKPIKSESTAPRRPSAQMKSPLPVLATLHPSTSTSGTSGMKPAPPPTRLPGETLKYASAAAAAAASDKNGVGIAPLPPPPGASPAFPAASLASRPSSTASPSIASVQPVSKPTATTSIASEERSKTPALSPNVTAASASNTVQSTPATKKAEASATKEPQPTVNGEASKEESREEESIYHLPPGLQDLIHSFEVTKSRAAAQSSTNPPPSVQRLLTASLNTCPEPADAEKPRHYKPQNPYNTPLYYPQEPLAIFDDPRLYDTGRIDTDTLFYLFYYRQGTYQQFLAAKALKNQSWRFHKQYQTWFQRHEEPKTITEEFEQGTYRFFDYESTWMNRRKADFKFVYKYLEDEL

SEQ ID NO: 2242 - protein, 391 aa, Xylella fastidiosa 9a5c
MSIVRMTDLALSGKRVLIRQDLNVPIDQGRITSEQRIIASLPTIRVALERGAAVMVTSHLGRPKEGVWSEEDSLAPVAKRLSQLLGIEVPLRRDWVDGVQVAPGQLVLLENCRMNVGEAENDEALARKYAALCDVFVMDAFGTAHRAQASTHGVICCAAIAAGGPLLMAELDALSRGLEHPVKPLLAIVGGSKVSTKLELLSNLVNNVEQLITGGGIANTFLAAAGYSIGKSLYEGDLIETAREIITAAKARGAEIPLPTDVVVAKQFLPGVTATVKTVDAIVADDLILDIGPQTARHYAALIETAATVVWNGPVGVFEFDAFSKGTEVLARAVAASSAFSIAGGGDTLAAIDKYGVADQISYISTGGGAFLEFLEGKTLPAVAALQARSG

SEQ ID NO: 2243 - protein, 432 aa, Acinetobacter sp. ADP1
MSLSPKQVQLFEQASKHIPGGVNSPVRAFNGVGGTPVFIKKAQGAYLWDEDDKRYVDYVGSWGPMILGHAHPDIIQAVQTAAVDGLSFGAPTVHETTLADIICDIMPSIEMVRMTNSGTEATMTAIRLARGYTGRDKIVKFEGCYHGHSDSLLVKAGSGLLTLGEGEPTSKGVPVDFAKHTLTLPYNNIEALKECFAKFGHEIAGVIVEPVAGNMNLVTPIDGFLQAIRDVCDEYGSVFIIDEVMTGFRVALGGAQSVYQVKPDLTTLGKIIGAGLPVGAFGGKREIMECIAPLGGVYQAGTLSGNPLAMRAGITMFKHLREPDFYSKLEAKLQKLLTGLQAAANEAGIAFKTQQVGGMFGLYFTDQEDITSFDSMLACDTDAFKKFFHGMLERGVNLAPSAFEAGFISSAHSDEDIELTIQAAKETFAEMK

SEQ ID NO: 2244 - protein, 512 aa, Aspergillus oryzae
MFRTLLPRAAPRAALRTARPQSVPSNFVAAPTLSFFSKRGYASESGEHDLVIIGGGVAGYVAAIKAGQEGLKTVCIEKRGRLGGTCLNVGCIPSKSLLNNSHLYHQILHDTKKRGIEVGDVKLNLEQMMKAKDTSVEGLTKGIEFLLKKNGVDYVKGTGALVDPNTVKVNLLEGGEQTLRGKNILIATGSEATPFPGLNIDEKRIITSTGALSLQEVPKKMVVIGGGIIGLEMASVWSRLGAEVTVVEFLNQIGGPGMDAEIAKQAQKILSKQGIKFKTGTKVTKGDDSGASVSISVESAKGGKEETLDADVVLVAIGRRPYTEGLGLENVGIEKDERGRLVIDQEYRTKVPHIRVVGDCTFGPMLAHKAEEEAVAAVEYITKGYGHVNYGVIPSVMYTHPEVAWVGQNEAEVKAAGIKYRVGTFPFSANSRAKTNLDTEGQVKFIADAETDRVLGVHIIGPNAGEMVGEATLAVEYGASCEDIARTCHAHPTLSEAFKEAAMATYSKAIHF

SEQ ID NO: 2245 - protein, 302 aa, Xylella fastidiosa 9a5c
MSLSGIITALVTPFDRDGAFDRDAWIRLLDLQLAGGVQGVVIAGSTGEAATLTDAEYDEMLCSAVVRVGGRVPVLAGTGLSGTAKTISQTKRAADNGAGYALVVTPPYIRPNQGGLKAHYLAVADQGGLPVVLYNVPSRTGCDLLPETVADLAGHPNIVGIKEACASRERVQALLALRRPGFTVFSGDDSSAARSMLDGADGLVSVASNVLPSAYRHLCDLARAGERGAIDLWNARLSDFHAFCGLDSNPIPIKALLQRIGIGYGLRLPLLPLSVCHHDIADHLADQVAALEALSSRKIVAA

SEQ ID NO: 2246 - protein, 883 aa, Arabidopsis thaliana
MSYMPTSCLVLFFLLFLFHPLPWALSKEDLGWCEALFQCGNNTAGFPFWGGNRAKPCGHPLLELRCLNNITSLNISNHEYNVFHIDQTSNTLRLARTDLLGSFCSAEFNTPTFPREIFKLFPTYKSLTVLYNCDPKLSYRSSYTCPDLGLFSMSQSLDYQNSCQDSFKVNVPTSFVPEEKEMNLTHLESALRKGFEVKLVIDEIPCQECSSSRGICGFNSTTQICCNVTSLSGGVTCVPQHQPSADELRRRCSERFSCGNQRNLYYPFWIPGREYCGHPDFKLDCSGGFAELNIASVNFRILNMSYDSSNKRLARSDYLNDLCPPNPLNDEPLIETVLQFSADTELLTLYYDCQLNSSATSPFPSSYFGELGCDEGRSYYVTRNLSSPLLDRFRGVLNNLREMCKRKVSVPASGPALNTLQTNPNSNNLKMALEHGFELQDNSNCSMCVLSGGSCGYNQNSSLFVCYCKDGPQDNQCDINLDDIIGNRIVAIIIGIFVALCTIGGFIAFLVLLCPCCKVRIFRNRKTSDDRRQEKLKALIPLKHYTYAQVKRMTKSFAEVVGRGGFGIVYRGTLCDGRMVAVKVLKESKGNNSEDFINEVSSMSQTSHVNIVSLLGFCSEGSRRAIIYEFLENGSLDKFISEKTSVILDLTALYGIALGVARGLEYLHYGCKTRIVHFDIKPQNVLLDDNLSPKVSDFGLAKLCEKKESVMSLMDTRGTIGYIAPEMISRVYGSVSHKSDVYSYGMLVFEMIGARKKERFGQNSANGSSMYFPEWIYKDLEKADNGDLEHIEIGISSEEEEIAKKMTLVGLWCIQSSPSDRPPMNKVVEMMEGSLDALEVPPRPVLQQIHVGPLLESSWITEESSSISEIENRNLQVCEKILS

SEQ ID NO: 2247 - protein, 161 aa, Glycine max
MTTTLERGFSEEQEALVVKSWNVMKKNSGELGLKFFLKIFEIAPSAQKLFSFLRDSTVPLEQNPKLKPHAVSVFVMTCDSAVQLRKAGKVTVRESNLKKLGATHFRTGVANEHFEVTKFALLETIKEAVPEMWSPAMKNAWGEAYDQLVDAIKSEMKPPSS

SEQ ID NO: 2248 - protein, 222 aa, Candida glabrata CBS 138
MSFRGGFRGGRGGSRGGFGGRGGARGGRPIQQGPPDTVLEMGEFMHPCEGDVVCRSINTKVPYFNAPIYLENKTQVGKVDEILGPLNEVYFTIKCGEGVQATSFKEGDKFYIAPDKLLPIERFIPKPKVAGPPKPKNKKKRSGAPAGRGGARGGFGGRGGSRGGFGGRGGSRGGFGGRGGSRGGFGGRGGSRGGFGGRGGSRGGFGGRGGSRGGFGGRGGRS

SEQ ID NO: 2249 - protein, 251 aa, Triticum aestivum
  misc_feature (193)..(193): Xaa can be any naturally occurring amino acid
  unsure (1)..(251): unsure at all Xaa locations
MVADEKLPASGDANNSEQQLHDTDTKSRVEDMWKKMNSGLPVKMPKPAMVKLKTAAKEKKPKATNNWMTILGLPPKKASANDQVPKNVQQQTQHETSEDAKKLAANALAAVRDAATAASGRGKVEITEVRDFAGKDIEIKKLVDADSKEAVEKASAAGASPSAVDNILEQIRKKQKLSVLDKTKKDWGEYKAXKGVEEELGAYKKSSNQYLDRQSFLKKSDYREYKPERDPRLVFNAQPEKPDLQGRLFLG

SEQ ID NO: 2250 - protein, 456 aa, Acinetobacter sp. ADP1
MSVNSVNPATNSTNEYYLTRQSQMESNVRSYPRKLPLAIARAQGCWVTDVEGTQYLDCLAGAGTLALGHNHPAVIQSIQDTLASGLPLHTLDLTTPLKDAFTEALLSFLPGGKEEYCLQFCGPSGADATEAAIKLAKTYTGRSSVISFSGGYHGMTHGSLAMTGNLSAKNSVNNLMPGVQFMPYPHEYRCPLGLGGEAGVDALTYYFENFIEDVESGVTKPAAVILEAIQGEGGVVTAPVKWLQKIREVTERHNIVLILDEVQAGFGRSGKMFAFEHADIEPDVVVMSKAVGGGLPLAVLGIKRKFDAWQPAGHTGTFRGNQLAMGTGLVVLDTIKNENLAQNAQERGEFLQAELKKLANEFPCIGNVRGRGLMIGVEIVDERQSADRIGSLPADAQLAAAIQTACFNNKLLLEKGGRNGSVIRLLCPLIITQDECVQVIERFKKSVAEALKAVRG

SEQ ID NO: 2251 - protein, 177 aa, Triticum aestivum
  misc_feature (168)..(168): Xaa can be any naturally occurring amino acid
  unsure (1)..(177): unsure at all Xaa locations
MAPAVMASSATTVAPFQGLKSTAGLPVSRRSGSAGLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLSEVEEVKKEYPDAYVRVIGFDNMRQGQCVSFFAFRPPXCKESGKSLK

SEQ ID NO: 2252 - protein, 431 aa, Francisella tularensis subsp. tularensis SCHU S4
MENKSNSQILFAEAQQYIPGGVNSPVRAFKSVGQEFPRFIKFAKGAYLYDVDWNKYIDYIGSWGPMILGHCDDDVLEAIQCQVKNGLSYGAPCKQEVDLAKKIIELMPNIEQVRFVNSGTEATMSAIRLARAYTCRNKIIKFEGCYHGHADEFLVAAGSGALSLGQPNSPGVPEDVVKDTLVASFNDMESIQALFEKYKDEIACIIIEPIAGNMNMIFPQDDFLAKLRAICDQNSSLLIFDEVMTGFRVALGGAQSIYNVKPDLTTLGKVIGGGMPVGAFGGRKEIMQKVSPAGPVYQAGTLSGNPIAMTAGIKTLEKISQPGFFDELGAKAQKLVDGLNEAAKAYDFNFHAKCLGGMFGLFFCSDKIAVNTFVDLGKTNLKMFNQFFAYMLDNGVYLAPSAYEAGFISIAHSDEDIEKTIYLAKKFFQEN

SEQ ID NO: 2253 - protein, 132 aa, Brassica napus
MKGVGGPLLSIGDLLADLVEEPVVSAPPNPENASKLETDAISEPLDLTGLFQDNYDKLNRAFAGSDHSWTSLTLELCTSLETANKLVHATTTNARFLTEKVRELEKIVKQGDSAVAAARSVHATVNQKGLPS

SEQ ID NO: 2254 - protein, 357 aa, Magnaporthe grisea 70-15
MAEFVRAQIFGTTFEITSRYSDLQPVGMGAFGLVCSARDQLTNQNVAIKKIMKPFSTPVLAKRTYRELKLLKHLKHENVISLSDIFISPLEDIYFVTELLGTDLHRLLTSRPLEKQFIQYFLYQIMRGLKYVHSAGVVHRDLKPSNILVNENCDLKICDFGLARIQDPQMTGYVSTRYYRAPEIMLTWQKYDVEVDIWSAGCIFAEMLEGKPLFPGKDHVNQFSIITELLGTPPDDVINTIASENTLRFVKSLPKRERQPLKNKFKNADPSAIDLLERMLVFDPKKRITATEALAHEYLTPYHDPTDEPIAEEKFDWSFNDADLPVDTWKIMMYSEILDYHNAEAGMQQMDDQFTGQ

SEQ ID NO: 2255 - protein, 519 aa, Oryza sativa (indica cultivar-group)
MNGEEAPAGSGGGGGGRAEIDTSAPFESVREAVDHFGGGAAAVWSSCLVNRMLTPPKEHDQMNGRTLQLEKELIIKESQTLDVLKELESSKRIISDLKLKVQNDSAITGHPGQTEAPGAGPEERRSSENVETDGELGGLDSQSLQPPSSVLMQLEQAKAYLTRTTADLAEIRASVESLCNEIAKEKILVERSREKVCSNTSLISSLEGELDRTTHKLQTLNDRQRRREDSSQILMEIKKVTSEIEQLKSASNASKSEATMLAAEIEQTKASIATAEVRCLAAKKMEDAARAAEALALAEIKALLSGEASAGDLQGTDGVNLSLEEYFELASKAQECDVSSRKKIEAAMLQVEEANRSKSNSLNKLEEAKLEFEKCKIALQDALKRAHAANRGKLAVEESVRRWLSESGYKRHSFHDSSKLKNAADITDVSKSFLKPTLSIGQILNLKLMGPDGYDKSVWDDTTEASNVSLGQILNRRNAVFCNSDITSQKILSGKRKKFAFTGLSVLLAKQAKRQEQEK

SEQ ID NO: 2256 - protein, 315 aa, Mycoplasma genitalium G37
MEQPLCVLGIETTCDDTGLSIVIDQKIKSNIVISSANLHVKTGGVVPEIAARCHEQNLFKAIRDLNFEIRDLSHIAYACNPGLAGCLHVGATFARSLSFLLDKPLLPINHLYAHIFSCLIDQDLNKLQLPALGLVISGGHTAIYLVKSFYELELIAETSDDAIGEVYDKIGRAMGFDYPAGSKIDSLFNKELVKPHYFFKPSTKWTKFSYSGLKSQCLNKIKQISANKTRIDWSELASNFQATIIDHYIDHVKNAIKKFAPKMLLVGGGVSANSYLSNRISTLNLPFLIADSKYTSDNGAMIGFYASLLINGDKN

SEQ ID NO: 2257 - protein, 461 aa, Escherichia coli O157:H7 EDL933
MADNKPELQRGLEARHIELIALGGTIGVGLFMGAASTLKWAGPSVLLAYIIAGLFVFFIMRSMGEMLFLEPVTGSFAVYAHRYMSPFFGYLTAWSYWFMWMAVGISEITAIGVYVQFWFPEMAQWIPALIAVALVALANLAAVRLYGEIEFWFAMIKVTTIIVMIVIGLGVIFFGFGNGGQSIGFSNLTEHGGFFAGGWKGFLTALCIVVASYQGVELIGITAGEAKNPQVTLRSAVGKVLWRILIFYVGAIFVIVTIFPWNEIGSNGSPFVLTFAKIGITAAAGIINFVVLTAALSGCNSGMYSCGRMLYALAKNRQLPAAMAKVSRHGVPVAGVAVSIAILLIGSCLNYIIPNPQRVFVYVYSASVLPGMVPWFVILISQLRFRRAHKAAIASHPFRSILFPWANYVTMAFLICVLIGMYFNEDTRMSLFVGIIFMLAVTAIYKVFGLNRHGKAHKLEE

SEQ ID NO: 2258 - protein, 239 aa, Zea mays
MDSDLWISRLTAAKRQFALQRAQRQHAAPASHHDRFGYDDIEPEDDLHSDFPCPYCYEDHDVASLCAHLEDEHPFESKIVSCPVCSARISKDLVDHITLQHGYLFKLQKHQRVRRVTGNGNHNLSYAGRDLQLQETYLKVLLGNSSRSSSTNASSTVTDSLLPSLVVNLSSPEVEDASKFSAPAVVENNWFKRSLPSKTWKLRTVDSTLSHEERERRRRRAAVRSAFVQHLLVTTIFED

SEQ ID NO: 2259 - protein, 448 aa, Brucella melitensis 16M
MNIRPEAGDVAGMNITIEETLDQAGTGSFQRGLLGIFGLVWAADAMQVLAVGFTGAAIAKTFGLTVPQALQTGTLFFLGMLVGAALFGRLADKYGRRRILLITVACDALFGLLSAFAPDFGSLLALRFLTGLAVGGTLPVDYAMMAEFLPAKNRGRWLVMLEGFWAVGTVVIAIAAWATSVAGVEDAWRYIFIVTAAPALIGIWLRFRVPESPMHLLKSGRVEEAKAVINLVLSRNGKPELPPGAKLLAPRLVTNERLLSPNLRQRTLTSLAIWFLVSVSYYGIFTWIPAKLASDGFGFVRGYGFLVVVALAQLPGYALAAYGVEAWGRRKTLIGFLFVSAAACALFTVATSSSVVGASILIMSFALLGTWGALYAFTPELYPTALRASGMGAAGAMARLGGLLAPSAMAVVINQSFYTAVAMFAGLLALAGIIAFFINVETRQQALN

SEQ ID NO: 2260 - protein, 360 aa, Burkholderia xenovorans LB400
MSKKYRIAVIPGDGIGVEVMPEAIRVLEAVKARFGIELEYQHIEWASCEYYAKHGKMMPDDWKAQLLSADAILFGAVGWPDTVPDHISLWGSLLKFRREFDQYINLRPARLFAGVPSPLAGRKAGDIDFWIVRENTEGEYSSVGGVMFEGTEREFVLQESVFTRHGSERVLKFAFDLAQRRARKKITVATKSNGIAISMPWWDKVAAGIAAQYPDVTWDKQHIDILCARFVLNPDRFDVVVATNLFGDILSDLGPACTGTIGLAPSGNLNPDRKFPSLFEPVHGSAPDIAGKNIANPIAMIWSAAMMLDFLGNHAGKEREAHDAILAAIEATLIEGPHTGDLGGKANTTEVGQAIAKKLA

SEQ ID NO: 2261 - protein, 490 aa, Burkholderia xenovorans LB400
MTRTFELGELIRSDNFIDGAWTPAQDNLRFAVTNPASGEIIAEVADSSPADARAATDAAARALPAWRARLPKERAAVLHRWHALIMANLDALGALISLEQGKPLAEGKGEVAYGASYVAWFAEEATRIYGDLIPQQQRGKRMTAVKEPVGVVAAITPWNFPLAMIARKIAPALAAGCTVVAKPAEDTPLTASALVLLAHEAGVPPGVLNLITASRDHAVAAVAEWLHDARVRKITFTGSTPVGKYLARESAETLKKLSLELGGNAPFIVFDDADLEAAVAGLMAAKFRNGGQTCVCPNRVYVQAGVYERFGALLAERVGALKVAPATDPAAQIGPMINSRALDKIARHVDDAVAHGARVLTGGKRLAELGPHYYAPTVLADATAAMQLNSEETFGPIVPLFRFEDEAEAVNAANDTPFGLAAYFYSEGVKRIDRVARALEAGIVGINEGAVASEAAPFGGVKESGYGREGSKYGLDDYLSIKYLCQGNLE

SEQ ID NO: 2262 - protein, 447 aa, Clostridium acetobutylicum ATCC 824
MKDIERDDLKYIWHPCTQMKDYEKMPPIVIDKGEGCYLYDVNGNSYLDCISSWWTNIFGHSNKRINKAIEKQLNEIEHVIFAHFSNKPAVEFSKSLIQIAPEGLDKIFFSDNGSSAVEIALKMSFQYYQQTGKVKKTKFAALTNAYHGETIGALSVGDLDLYSKIYKPLLIDTLRIQGPDCYRCKYNKERHSCEAECFEEMEKSLKKHNSELCAIIIEPMIQGAAGMKMYSPKYLKKLRYACDYYDISVIFDEIAVGFGRTGKMFACENADISPDIMCLSKGISAGYMPMSVVLTTSKIYNAFYDDYVNLKAFIHSHTYAGNALACAAAIESLKIFKEESIIEKNIGKSKLIEKLTKNRARNNKFIGDIRSLGMVTAIELVKDKDTKESFDWKSRVGYEIYKIALKKGLLLRPIGDVLYFMPPYSIGEKDIEFMVEKCFESIEQYLE

SEQ ID NO: 2263 - protein, 558 aa, Aspergillus oryzae
MADTLKAAATPTPPSRKDTILSRRWIEGQIAEGKQVIVYDDRVLRVDAWIKFHPGGDKSIKHMVGKDATDEINALHSKEARQRMLAFQIGRIQGPWLNFLPPIQGGKFRPYTEATCTSDEDSSGQDLSTPPSPIFDSVDAKSGLRRRKSVSSDTSVSSATSECEPKPFFLDARTQEEIVLDVTKYPSLDTESQESIKKKYRALDQRIRDEGLYNCNYFSYFIECCRYTLFAALSYIFLRSGWYATSGFFLGCFWHQLVFTAHDSGHMGITHNFHVDSVIGIIIADYLGGLSLGWWKRNHNVHHIVTNAPEHDPDIEHMPFFAISHRFLTSLRSTYYERIMTFDAFANFMLRYQNYLYYPILLFGRFNLYRLSWEYLLCGQAPKKGPAWWHRWFEMAGQVFFWYWFGYAVVYRSIPDWSSRLIFILISHMVTAPLHVQITLSHFAMSTADLGVNESFPQKMLRTTMDVDCPTWLDFFHGGLQFQAIHHLYPRIPRHNLRRTQKLVMEFCRDTGIPYAVFTFYDGNKEVIGKLGDVAKQVRILDECRKSCAQQGVFSDHH

SEQ ID NO: 2264 - protein, 589 aa, Rhizobium leguminosarum bv. viciae 3841
MTQMTFGPAFTEEGVLFRLWAPLHESVSLTIECADPRPMQAVEDGWHHYTVADASVGKRYRFVLPDGLEIPDPASRFQPQDVHGPSEVVDLSFYRWKTSDWTGRPWEEMVIYEMHIGSFTPEGTFKAAIERLDHLQALGVTALQIMPLSEFPGRYSWGYDGVLPYAPDSSYGRPEDFMALVDAAHQRGISVFLDVVYNHFGPDGNYIPAYAPLFTDHHKTPWGNGINYDGDGSEMIREFIIENAIYWITEFRLDGFRFDAVHAIKDDSAEHLLHALARRVRAAAGDRHVHLIVENEENDSDLLTRDENGEVKLFTAQWNDDVHHVLHITATGETFGYYADYAGDAGKLGRALAEGFVFQGEHMPYRGGSRGRPSGHLPPTAFISFIQNHDQIGNRALGDRVLASSPADVVRAVAAIYLLAPEIPMLFMGEEWGATEPFPFFCDFDEDLNEKVRKGRREELSRLPGFDADDLLDPTAPSTFAAAKLDWSKLASSEVLGFYRTLLDLRHSRIVPLLKGAGAGNAVYRSAGSALAVDWTLAQNRRLHLHANLGAEAAPLVSQRSDGETIFRLGGSDGGNLVPWTVIWSISEA

SEQ ID NO: 2265 - protein, 171 aa, Oryza sativa (japonica cultivar-group)
MASSSSWWVVMLLMVVAAAGWGGVAAATAAEAAHEVLRAHGLPRGLLPAGIADFRHDEGSGRFEAALGESCTAQFEVGLRYNATVAGVISYGRIASLSGVSAQDLFLWFPVRGIRVDVPSSGVIYFDVGVVFKHFPLAVFEAPPPCTPDPLLLLTQVCEDGSVAGGGAASQ

SEQ ID NO: 2266 - protein, 175 aa, Triticum aestivum
MAPIVMASSATSVALFQGLKSTGGLPVRRRSIGASLGSVSNGGRIRCMQVWPIEGIKKFEMRSYLPPLSTEALLKQVDYLIRSKWVPCLEFSKVGFIFREHNASPGYYDGRYWTMWKLSMFGCTDSTQVINEVEEVKKEYPDAYVRIIGFDNMRQVQCVSYIAFNPPGCEESGEA

SEQ ID NO: 2267 - protein, 791 aa, Xylella fastidiosa 9a5c
MNENILWLHELRLTDLARVGGKNSSLGEMIGNLTALGVSVPGGYATTAAAFKAFIAYNNLSKRIYDKLATLDVEDVKALTAAGKEIRDWIIDAPLQPELEKDIRDAYDTLSKDNSGNDVAVAVRSSATAEDLPDASFAGQQETFLNVIGADQVVHKIKEVFASLYNDRAIAYRVHHGFKHEDVFLSAGIQLMVRSDISASGVLFTLDTESGFRDVVFVTASFGLGEMVVQGAVNPDEFYVYKKTLKAGKPAILRRTLGSKLVRMVYSDSPGERVKIEDTPTELRHCFAISDADVQELAKQALIIEEHYGRPMDIEWAKDGVSGKLFIVQARPETVKSRSHTTQIERFALQQRGEILTEGRAIGQKIGSGISRVVHSLEDMHHMQPGDVLVADMTDPDWEPVMKRASAIVTNRGGRTCHAAIIARELGVPAVVGTGNALSIIQDGQPITVSCAEGDTGYIYAGKLPFERTTTDLGHMPPAPLKIMMNVANPERAFDFGQLPNAGIGLARLEMIIAAHIGVHPKALLEYHKQDADTKQKIDAKIAGYPDPVSFYVNRLAEGIATLTASVAPHTVIVRLSDFKSNEYAHLIGGQHYEPQEENPMLGFRGASRYVDPSFSDAFALECKAVLKVRNEMGLDNLWVMIPFVRTLEEGRKVIDVLRQNGLKQGENGLKVIMMCEVPSNALLADEFLDIFDGFSIGSNDLTQLSLGLDRDSSIVAPLFDERNPAVKKLLSMAIKAARSKGKYIGICGQGPSDHPDLAEWLMQEGIESLSLNPDTVVDTWLRLAKLKTVH

SEQ ID NO: 2268 - protein, 412 aa, Escherichia coli CFT073
MADTRPERRFTRIDRLPPYVFNITAELKMAARRRGENIIDFSMGNPDGATPPHIVEKLCTVAQRPDTHGYSTSRGIPRLRRAISRWYQDRYDVEIDPESEAIVTIGSKEGLAHLMLATLDHGDTVLVPNPSYPIHIYGAVIAGAQVRSVPLVEGVDFFNELERAIRESYPKPKMMILGFPSNPTAQCVELEFFEKVVALAKRYDVLVVHDLAYADIVYDGWKAPSIMQVPGARDMAVEFFTLSKSYNMAGWRIGFMVGNKTLVSALARIKSYHDYGTFTPLQVAAIAALEGDQQCVRDIAEQYKRRRDVLVKGLHEAGWMVEMPKASMYVWAKIPEPYAAMGSLEFAKKLLNEAKVCVSPGIGFGDYGDTHVRFALIENRDRIRQAIRGIKAMFRADGLLPASSKHIHENAE

SEQ ID NO: 2269 - protein, 180 aa, Brassica napus
MVLVLALGDLHVPHRAADLPPKFKSMLVPGKIQHIICTGNLCIKEIHDYLKTICPDLHIVRGEFDEDARYPDTKTLTIGQFKLGLCHGHQVIPWGDLDSLAMLQRQLDVDILVTGHTHQFTAYKHEGGVVINPGSATGAYSSINQDVNPSLVLMDIDGLRVVVYVYELIDGEVKVDKIDF

SEQ ID NO: 2270 - protein, 231 aa, Triticum aestivum
  misc_feature (74)..(74): Xaa can be any naturally occurring amino acid
  unsure (1)..(231): unsure at all Xaa locations
DQVFYQKNQAWYRFRISRDFVRPNGSPTWGPKDPEHGLNPESLLLTKLYPNIVQPWPPPVMPSSATSVAPFQGXLKSTAGLPVSRRSNGASLGSVSNGGRIKCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 2271 - protein, 306 aa, Francisella tularensis subsp. tularensis SCHU S4
MPYNPSLEALLDTPEIRRIKKLDLTQQREIFTSLSVEQLKRLPRPDILEEDIKLENNTILRHYQPKKSSNKAVLFIHGGGWCLGSINTYDHVCRYLCDQGNLNIFSLEYGLAPEQKYPAAVDHALYAYDWLYQNINKFKISAENIFVMGDSAGGNLVTIVCHERQENMPKAQILVYPAVDMYTKYDSNKKFDENKYHLTTEWCELFLKAYIGEDVMSEPKKLRHPTISPLFYKDTKQPDTLIVAATHDILIDGIYAYEEKLKQQGTYVETYYDDEMFHGFMGILGITPFENPKIALNKVIEFINKR

SEQ ID NO: 2272 - protein, 354 aa, Oryza sativa (japonica cultivar-group)
MAKEAFVNGFLSVFMHVGLTLVLLVYLPIAFACRALGRLLVRPFVSGEDLRGKVVLVTGASSGIGEHLVYEYAKKGACVALTARTEIALRAVAKTARDLGAPDVLVVPADITKVDDAKRAVEETVAHFGKLNHLVANAGIWSSCFFEEITNITAFHNVIDLNFWGAVYPTYFALPYLKASRGNIVVTSSVAGRVPTARMSFYNASKGAVIRFYETLRAELGSHVRVTILTPGYVVSNLTMGKGIQKDGHVGIDEEARDINVGPLPVGKTETLAKVVVAAVRRGDYYVTWPGWYWPFHMVMCTAPELVDWFSRTFYVSKSSDHDGDALSKKILEAVGGKKFLYPKTIRSHAIAAS

SEQ ID NO: 2273 - protein, 314 aa, Arabidopsis thaliana
MADSESKIYHERQRLQFCLLHCLNNLFQDKDAFTKESLNSIAEKLETNDPNKETWTPLSFVLKPHHNTITGNYDVNVMITALEGKGKSVVWHDKRIGASSIDLDDADTLMGIVLNVPVKRYGGLWRSRHWVVVRKINGVWYNLDSDLVVPQLFRDDDEVRGFLDQNLSLGGEPQVSSKVSAIYKATGTKRFNANTRPVTPGKQSSVKGPYYKNPGCTTSCGLRLPRKTECTAARLIKDLSCKFVMGLRLVVMRKKKKKRSPPLKKASSSGISQPSVISVVNDNNHRSAAIEDCIQFINSSSSFTRSNSTCGSKS

SEQ ID NO: 2274 - protein, 396 aa, Nicotiana benthamiana
MSCTVAISNLPAFWPVARVPLTKSLLCKSASFSSSSSPNSSKTLTKFPSFTSSSSSSSSPSLQFHILRFQKPLPVPAPAPINLIRNSTECSTSTPNSTSPTVLKRKRPAKLDIPIVSTTFGNFPALPAAAAADFVEVEGDGYYVCCKRGRRGPMEDRFSALVNLQGGSKEGIFGIFDGHGGAKAAKFAAENLNKNIMDEVVTRKDENVMEAVKNGYLKTDSEFLNQEFRGGSCCVTALIRNGDLVVSNAGDCRAVVSRDGIAEALTSDHKPSRKDEKDRIETLGGYVDYCNGVWRIQGYLAVSRGIGDRYLKQWIIAEPETMVLRLNPELEFLVLASDGLWDKVSNQEAVDAARPLCARISKPQLLSASKSLVDLAVSRGSVDDISVMIIQLQQFC

SEQ ID NO: 2275 - protein, 337 aa, Brucella melitensis 16M
MTKMTMIEAIQNAHDIAMERDQKVVVFGEDVGYFGGVFRCTAGLQKKYGKERCFDAPISELGIVGTAIGMAVYGLRPCIEVQFADYVYPAYDQIVSEAARLRYRSAGEFTCPIVIRMPSGGGIYGGQTHSQSPEALFTHVSGLKTVMPSTPADAKGLLLAAIEDPDPVIMFEPKRLYNGPFDGHHDKPVTSWKKHDLGEVPEGYYTVPLGKAAIRREGSDVTVLAYGTMVHVALAAAEETGVDAEVIDLRTLLPLDTETIMASVKKTGRCIIVHEATLTCGYGAELAALVQRDCFYHLEAPIMRVTGWGTPYPHAQEWAYFPGPDRVGRALVSIMEA

SEQ ID NO: 2276 - protein, 565 aa, Pseudomonas putida KT2440
MIENFWKDKYPAGITAEINPDEFPNIQAVLKQSCQRFADKPAFSNLGKTITYGELYALSGAFAAWLQQHTDLKPGDRIAVQLPNVLQYPVAVFGAMRAGLIVVNTNPLYTAREMEHQFNDSGAKALVCLANMAHLAEKVVPKTQVRHVIVTEVADLLPPLKRLLINSVIKYVKKMVPAYNLPQAVRFNDALALGKGQPVTEANPQANDVAVLQYTGGTTGVAKGAMLTHRNLVANMLQCRALMGSNLHEGCEILITPLPLYHIYAFTFHCMAMMLIGNHNVLISNPRDLPAMVKELGKWKFSGFVGLNTLFVALCNNEAFRALDFSALKITLSGGMALQLSVAERWKAVTGCAICEGYGMTETSPVAAVNPSEANQVGTIGIPVPSTLCKVIDDAGNELPLGEVGELCVKGPQVMKGYWQREDATAEILDSEGWLKTGDIAVIQADGYMRIVDRKKDMILVSGFNVYPNELEDVLAALPGVLQCAAIGVPDEKSGEVIKVFIVVKPGMTVTKEQVMEHMRANVTGYKVPRHIEFRDSLPTTNVGKILRRELRDEELKKQGLKKIA

SEQ ID NO: 2277 - protein, 562 aa, Pseudomonas putida KT2440
MQADFWNDKRPAGVPSTIDINAYASVVEVFERSCKRFADRPAFSNLGVTLSYAELERHSAAFAAWLQQHTDLKPGERIAVQMPNVLQYPIAVFGAMRAGLIVVNTNPLYTEREMRHQFKDSGARALVYLNMFGKRVQEVLPDTGIEYLIEAKMGDLLPAAKGWLVNTVVDKLKKMVPAYRLPQAVPFKQVLREGRGLSPKPVSLNLDDIAVLQYTGGTTGLAKGAMLTHGNLVANMLQVLACFSQHGPDGQKLLKDGQEVMIAPLPLYHIYAFTANCMCMMVTGNHNVLITNPRDIPGFIKELGKWRFSALLGLNTLFVALMDHPGFRQLDFSALKVTNSGGTALVKATAERWEDLTGCRIVEGYGLTETSPVASTNPYGQLARLGTVGIPVAGTAFKVIDDDGNELPLGERGELCIKGPQVMKGYWQQPEATAQALDAEGWFKTGDIAVIDPDGFTRIVDRKKDMIIVSGFNVYPNEIEDVVMGHPKVANCAAIGVPDERSGEAVKLFVVPREGGLSVDELKAYCKANFTGYKVPKHIVLRESLPMTPVGKILRRELRDIA

SEQ ID NO: 2278 - protein, 249 aa, Zea mays
  misc_feature (211)..(211): Xaa can be any naturally occurring amino acid
  unsure (1)..(249): unsure at all Xaa locations
MQFGTHGNLEQHGFARNRFWTIDNNPPPLPVNPAIKAYVDLILKPSEEDLKIWPHSFEFRLRVSLGPSGDLSLTSRIRNTNTDGRPFSYTFAYHTYFSVSDISEVRVEGLETMDYLDNLKAKERFTEQGDAIVFESEVDKVYLAAPSKIAIIDHEKKRTFVVTKEGLPDAVVWNPWDKKAKAMQDFGDAEYKSMLCVEPAAVERPITLKPXEEWFGRSSLPLIFDAGLASTPHVPFAISTPYISGPFCI

SEQ ID NO: 2279 - protein, 279 aa, Coxiella symbiont of Carios capensis
NGNLQRLDGPVSGNGKIIQELEGLFRGAGWRVIKVIWGQDWERLFKRDKSGLLLKHVSEMVDGEYQACFSKDGAHLRQHFFGKYPELLELVSDMSDDELKRLTDGGHDPQKVYAAYTEAMKDCGKPTVILAKTVKGYGYGKEGESQNIAHNLEEISEEGLKIFRQRFELPLSDKQLSDLEFYKPDDNSLELNYLHKQREKLGGPLPARDGRFESIKVPDLSLFEPVLKGTEERSVSTGAAFSRIMGLMLKDKNIRDRIVPIVADEARTLGLEGLFRQTR

SEQ ID NO: 2280 - protein, 203 aa, Aspergillus oryzae
MADKKTPTINPETNPRGIPVAPFVDNVTDYVSTRADVEPTLRSFQEMISKYQFMEVNTQRRAAGLREKIPDIKKTLEMVKFLKMRRDNNADPLETNFELNDTLYARATVDPADTEEVYLWLGANVMLAYPIGEAETMLTEKLSTAELSLANCDEDLEFLREQITTMEVATARVYNWDVVQRRKDKADGKGDEDDDTAKGPSGA

SEQ ID NO: 2281 - protein, 482 aa, Mycobacterium sp. KMS
MDTTALLKSVPTGLWIGGEEREAKSTFNVLDPSSDEVLVAVGDATAEDAVAALDAACAVQAEWAATPARKRGEILRSVFETLTDRADDIAALMTLEMGKVLAESKGEVTYGAEFFRWFAEEAVRIGGRYTPSPAGTGRIIVTKQPVGPCYAITPWNFPLAMGTRKMGPAFAAGCTMIVKPAQETPLTMLYLAKLMAEAGLPKGVLSVLPTSSPGPVTEALVDDGRLRKLTFTGSTGVGKSLVKQSADKLLRTSMELGGNAPFIVFDDADVDAAVDGAMLAKMRNGGEACTAANRFHVANSVREEFTEKLVKRMSEVTLGNGLDESATLGPLINNKQLQKVTELVSDAVSRGATVAVGGVAPGGPGNFYPATVLADVPADARILKEEVFGPVAPITGFDSEEEGVAAANDTEYGLAAYVYTRSLDRALRVAEAIESGMVGINRGVISDAAAPFGGIKESGFGREGGTEGIEEYLDTKYIALTK

SEQ ID NO: 2282 - protein, 266 aa, Medicago truncatula
MANQSSELAIEQLKKLLREKEELNGVATAKIEQLIVELQGCHPNPIEPADQRIIDGFTYFKLNNFNKNPELYDRLAKGQSPKFMVFACSDSRVSPSVILNFQPGEAFMVRNIANMVPPFNQLRYSGVGATLEYAITALKVENILVIGHSRCGGISRLMNHPEDGSAPYDFIDDWVKIGLSSKVKVLKEHERCDFKEQCKFCEMESVNNSLVNLKTYPYVDREIRNKNLALLGGYYDFVSGEFKLWKYKNHVTEPVTIPLKGLDMTI

SEQ ID NO: 2283 - protein, 398 aa, Fucus vesiculosus
MALKKKEFEKKLQHFTINFGPQHPAAHGVLRLILELNGEVVQRADPHIGLLHRGTEKLIEAKTYVQALPYFDRLDYVSMMCQEHTYVLAVENLLQVSIPRRAQYIRVLFAEITRILNHLLAVGCHAMDVGAMTPFLWSFEEREKLMEFYERVSGARMHASYFRPGGVSQDISLGIVDDIYTFAGQFGQRLDEMEEMLTDNRIWQERLVDIGVVTAQEAVNWGFSGVMLRGSGVRWDLRKNEPYEVYSELNFRGVVGKTGDCYDRYLARVEEMRQSLSIIHQCLNNMPKGSVKIDDAKISPPSRSEVKQNMESLIHHFKLYTEGVSVPSGETYTATEAPKGEFGVYLVSDGSNRPYRCKIKAPGFSHLQGLNFMAKSHMLADVVTIIGTQDIVFGEVDR

SEQ ID NO: 2284 - protein, 206 aa, Geobacter sulfurreducens PCA
MVNITSAEFVTSGTRPEHYPPGDLLEIAFVGRSNVGKSSLINVLVNRKSLVRTSSTPGRTQLINFFRVNGSLMLVDLPGYGFARVPPEVKRQWGPMVETYLAGRSCLACVVLIVDVRRTPAEEDRLMLQWLRAYDIPVLVVITKCDKVSKNERAKQASLISRTLGLAPDEMAFFSALSREGRDAIWARIEAIMAEGHSPSVDGAPE

SEQ ID NO: 2285 - protein, 328 aa, Thiobacillus denitrificans ATCC 25259
MQVQSLSAEHSLALARQVLEIEADALHTVSTRLDHGFADAVRLILACTGRVVVSGMGKSGHVGSKIAATLASTGTPAFFMHPGEASHGDLGMIAHDDVVLALSNSGESSEIVCIVPLIKRRGAKLVAMTGNPASTLAREADAHLNAKVDKEACPLNLAPTASTTAALALGDALAVALLDARGFSADDFARTHPGGSLGRRLLVHVADVMHGGDALPKVGRDATLKAALFEMTKKGLGMTAVVDADDRVVGLFTDGDLRRTLEHALDIQHAKIADLMTPNPKTIRADELAAAAVEKMETLKINGLLVVDADNRLVGALNMHDLLKAGVV

SEQ ID NO: 2286 - protein, 524 aa, Oryza sativa (indica cultivar-group)
MGIVRAAEDVEGAVVAGAAGGGGGGGGGEVTAPLLLRQHKQGRGDEEKIQNDAGGDGGGRRGGGGGGSMSMLMLSTAVAVCGSFEFGTCVGYSAPTQSGIVDEVGLSISQFALFGSVLTIGAMIGAVTSGRLADFLGRKMVCHIFRLSQTMRISATICIFGWLSLHLAKGVIMLYFGRILLGFSTGILSYVVPVFIAEIAPKNLRGGLATSNQLLICSGSSATYIIGALVAWRNLVLVGIVPCVLLLTGLLFIPESPRWLANVGREKEFHASLQMLRGEDADVSEEAVEIKEYIESLHRFPKARVQDLFLRKNIYAVTVGVGLMIFQQLGGINGVGFYASSIFTSAGFSGKLGTILIGIIQIPITLFGAILMDKSGRRVLLMVSASGTFLGCFLTGISFYLKAQGLFSEWVPELALTGILVYIGAYSIGMGPVPWVVMSEIFSIDMKAIGGSLVTLVSWLGSFAISYSFSFLMDWSSAGTFFMFSAASLITILFVVMVVPETKGRTLEEIQDSLIDSRSRLRDP

SEQ ID NO: 2287 - protein, 431 aa, Prochlorococcus marinus str. MIT 9303
MIDSLDLVIDTIVAREVLDSRGNPTVEAEVLLEAGAIGRAIVPSGASTGAHEAHELRDGDSRYMGKGVTKAVNHIEDRIAPALCGISSLDQASVDGTMQELDGSDNKSSLGANAILAVSMATARAAANGLGLPLYRYLGGPMASLLPVPLMNVINGGAHAANNLDFQEFMLVPHGASTFRESLRMGAEVFHTLKGLLSAQGLSTAVGDEGGFAPNLTNNDAAGDLLIQAIEKAGYSPGKDISLALDVASTEFYKDGCYAFGGGSYTSTEMVNELEKLVDRYPIISIEDGLAEDDWQGWALLTKKLGKRIQLIGDDIFVTSTKRLQQGIDQNVANSILIKVNQIGSLTETLQAIDLAGRSGYTSVISHRSGETEDTTIADLAVATRAGQIKTGSLSRSERVAKYNQLLRIEDELGTQALYAGATGQGPRGRS

SEQ ID NO: 2288 - protein, 321 aa, Escherichia coli CFT073
MTKYALVGDVGGTNARLALCDIASGEISQAKTYSGLDYPSLEAVIRVYLEEHKVEVKDGCIAIACPITGDWVAMTNHTWAFSIAEMKKNLGFSHLEIINDFTAVSMAIPMLKKEHLIQFGGAEPVEGKPIAVYGAGTGLGVAHLVHVDKRWVSLPGEGGHVDFAPNSEEEGIILEILRAEIGHVSAERVLSGPGLVNLYRAIVKADNRLPENLKPKDITERALADSCTDCRRALSLFCVIMGRFGGNLALNLGTFGGVFIAGGIVPRFLEFFKASGFRAAFEDKGRFKEYVHDIPVYLIVHDNPGLLGSGAHLRQTLGHIL

SEQ ID NO: 2289 - protein, 465 aa, Bacillus anthracis str. A2012
MTIVTFSKSTTDKPSYTYEELSVKNKAYVWHPFTQMKDYLEEDPVIIERGEGRKLYDVNGNEYWDGVSSIWLNVHGHQVPELDEAIREQLNKIAHSTMLGLANVPSILLAEKIIEVVPEGLKKVFYSDSGSSAVEIAIKMAFQYWQHKGKPKKQRFVTLKEAYHGDTIGAVSVGAIDLFYQVYSSLLFEAIKMPYPYTYRSPYGNDKAEIVKKHLEEMEELLKDKHEEIAAIIVEPLMQGAGGMITMPKGYLRGLRNLCTKYNVLFITDEVATGFGRTGKMFACEHENVTPDILTAGKGLTGGYLPVAITVTTDEIYNAFLGSYEEQKTFFHGHSYTGNPLGCAVAIANLELYEKTNLIEEVARKTEYVATQLEELFACKHVGDIRQCGLMVGIELVKNKETKEAFEWTERVGVQVCKRSRELGMILRPLGNTIVFMPPLASTIDEIDEMLRILYKAISDITEGE

SEQ ID NO: 2290 - protein, 489 aa, Glycine max
MSDDQFQASGNWWESAARNVRFESGESQSSSSGLTNNMGSYAASWQHHDMATTRSSNSSIDNNSVSGGSSVMFHDQKQLQQVQPHHHESSAAATSTNDPNLHMMGLGLSSQAMDWNQASLQLRGEKGSESSFRSMLQENLSSSNTNFQPQESGSNIGLSQHHHHHHHHQQLHWRPEKLFSAESSSNEFKRGFSLDQTQFSPQYSSGDSTVTSQGLPCSFQMDYVGNPSSILQGLLGQESNNNNNQQQQQPYQGGGGGAMNFAYSAAASYGLNSNVELVRSWSKVPQFLRASPPKQQPNNQLHFTNNAPFWNANSEPAIKDSRSSFIPSLHPPFSTSNFDVQSKNISEVRDSGGVVKKSGSEAAPKRPRNETPSPLPAFKVRKEKMGDRITALQQLVSPFGKTDTASVLSEAIEYIKFLHEQVTVLSTPYMKSGAPIQHQQSSGKSKESEGPKQDLRSRGLCLVPVSSTFPVTHEPTVEYWTPTFGGTYR

SEQ ID NO: 2291 - protein, 457 aa, Xanthobacter autotrophicus Py2
MSAPAQAGPRPVNIQQLIDESPVSRFQLLIIVLCFLIVAVDGFDTAAAAFIAPAIRAEWQLTPAVLGPMFGAGLFGLMVGALVIGPFADRFGRKPLLIFSVVFFGLASLGAAFSHSITELTWWRFVTGLGLGAAMPSAITLTSEYCPERRRSFLVTIMFCGFTLGSAMGGLLAAQLVAEHGWRSVLVVGGAVPLVVAVLLWALLPESIRFLVLKDPRSAAAARNLARIAPKADLAGAVFVGPKKAKGLPVQQLFSRNLVGGTLLLWLAFFMSLLVYYLLTNWLPTFINAGGASIQQAALVTMMLQLGGTLGGVVLGLFMDKVNPHALLASAYVGGGLCVTAIGNSTGVPGLLPVAVFGAGFCIAGSQIGINALAAAYYPTASRATGVSWANGIGRSGSVVGSMVGGLLLSFHWGFETIFAIAAAPALVAGLAIFLKGRLQSGATLDAAPVAQVAQEG

SEQ ID NO: 2292 - protein, 436 aa, Aquifex aeolicus VF5
MDMREVVVIGAGISGLSTAYRLKKEGVDVVVYEKDDRIGGTIHTVKEKGYLFEVGAQTILADQEVIDFLKEAGIEPVEASPSSKYRYIYKKGRLIPLPMSPVEFLKTPLLSLKTKLKVLTEIFKRGVDEDISIADFVREHFGEEFLNYVVAPFISGVYAGDPEKLSLKHATPKLYEAQKKYGSLIKAFIKEKTAGPKGKLISFGEGLGELINALAQKLEVHTENVVLRMRKFEDFFRLDVRGKKVETKSVVVASPAYTSSYLLKEVSFSASEEFDKIDYPPVVVVNVGVEGKFPKVRLLSSESGKKRILGAMFMSKLFPGRAPQGKELLTVFLGGATDREVIELSEEEIENIVERELKEILQIDCIDFMHVQKWKRAIPQYTLGYDRFLNLAQEMEKDYPGLFLTGNWLYGVSTADCIRASKKVAQKVLSFLRPQA

SEQ ID NO: 2293 - protein, 401 aa, Pseudomonas viridiflava
MDPLPEAVCKMEQQCEVAVLGLGAMGAATLYQLARQGADVLGIDRYAPPHTQGSSHGDTRITRLSVGEGPQYLPLVRHSQRIWRELEALTGESLFEQCGVLVMTSSPTYDPHDPEDFTHKTIALAREYGVKHEVLSAGAIRERFPQFSPILETAIGYFEPDGGFVRPERCIAIQLQLAEKLGARIRMNETVTRLQPQGDQVRITTDQGSILANKVVVSAGMWSSQLLGEPFTDLLRVCRQQLFWFALEDTAAFAPVSPSFILTHGPGEMDINYGFPPLPGEGSMKIATEQYLQASAACELDRSVSAEDERTMFKTQVSGKIAGLKAEVVKSSVCAYTVTPDYHFIIDDHPHLKNVTVVSACSGHGFKHSAGLGLALAQRCLHGTSDVDLSAFSLKRFGKKA

SEQ ID NO: 2294 - protein, 419 aa, Sulfolobus solfataricus
MEEVLSSSLYTQQVKKLYKVGELLGLDNETLETLSQPERIIQVKIQIRGSDGKLKTFMGWRSQHNSALGPYKGGVRYHPNVTQDEVEALSMIMTWKNSLLLLPYGGGKGGVRVDPKKLTREELEQLSRKYIQAIYKYLGSELDIPAPDVNTDSQTMAWFLDEYIKITGKVDFAVFTGKPVELGGIGVRLYSTGLGVATIAKEAANKFIGGVEEARVIIQGFGNVGYYAGKFLSEMGAKIVGVSDSKGGVINEKGIDVGKAIEIKEKTGSVINYPEGRKVTNEELLISDCDILIPAALENVINKFNAPKVKAKLIVEGANGPLTADADEIMRQRGIAVVPDILANAGGVVGSYVEWANNKMGEIISDEEAKKLIVDRMNNAFNTLYDYHQKKLEDHDLRTAAMALAVDRVVRAMKARGIL

SEQ ID NO: 2295 - protein, 453 aa, Francisella tularensis subsp. tularensis SCHU S4
MSNNHFDVISLGGGSGGIASAVQAAKFGKKVAIIEKRELGGTCVNRGCVPKKAMWYGANLAEILKHDVAGYGFDVEVKGFNWAKLKEKRATYIGNIHGFYDRLLDKWNITHFNNWGKFKDNKTIVLDDGAELTADHIFISPGAYPIVPKNIEGAELGITSDEFFELEETPKKAVIVGGGYIGVEIAGVLNAHGTDTTIMVRRDKPLMEFDNCISDALVECMQMTDLNIMNHTNITKVEKTGSTLKITTDTDKVLEDVDTLIWATGRAPNTHNLGIENTDIRITDKGVIPANEWSETNVAGVYSLGDASGVPQLTPVAIKTGRYLARRLFNGETNLKANLEYIPTVIFSHPAIGTVGLTEKEARDKYGDENVKVYKSRFTALYCAISGHRMPTVMKLVVTGDNEKIVGCHMIGLNVDEMLQGFAVAINMGATKRDFDDTIAIHPTSSEELVTLV

SEQ ID NO: 2296 - protein, 640 aa, Oryza sativa (indica cultivar-group)
MDHLSIRNPLSLLLSLQLSLLLFNPLSVADLASEKQALLDFASAVYRGNRLNWSQSTSLCSWHGVKCSGDQSHIFELRVPGAGLIGAIPPNTLGKLDSLQVLSLRSNRLAGSLPSDVTTLPSLRSIYLQHNNFSGDLPSFLNPNLSVVDLSYNSFTGEIPISLQNLSQLSVLNLQENSLSGSIPDLKLPSLRLLNLSNNDLKGQIPQSLQTFPNGSFLGNPGLCGPPLAKCLLPDSPTPSPASPSSAPTPMSAHHEKKFGAGFIIAVAVGGFAVLMFVVVVLVVCNSKRKGKKESGVDYKGKGTGVRSEKPKQEFSSGVQIAEKNKLVFLEGCSYTFDLEDLLRASAEVLGKGSYGTAYKAILEDGTVVVVKRLKDVVAGKKEFEQQMELIGRLGKHANLVPLRAYYYSKDEKLIVYDYLTNGSFSTKLHGIRGVTEKTPLDWSTRVKIILGTAYGIAHVHAEGGAKLTHGNIKSTNILLDQDYSSYVSDYGLSALMSVPANASRVVVGYRAPETIENRKITQKSDVYSFGVLLMEMLTGKAPLQSQGNDDVVDLPRWVHSVVREEWTAEVFDVELIKQQNIEEELVQMLQIAMACTSRSPDRRPSMEDVIRMIEGLRHSASESRASSDEKIKDSNPPSV

SEQ ID NO: 2297 - protein, 461 aa, Ralstonia eutropha JMP134
MVESNNDGTLKRGLKNRHIQLIALGGAIGTGLFLGIAQTIKMAGPSVLLGYAVAGIVAFFIMRQLGEMVVDEPVAGSFSYFANKYCGHFAGFMSGWNYWVLYILVSMAELSAVGIYVQYWWPGIPTWISALAFFLIINAINLSSVKSFGEMEFWFSIIKVAAIIGMIGFGGYLLMSGNAGPQASITNLWQHGGFFPNGLGGLVMAMAVIMFSFGGLELVGITAAEADQPEKSIPKATNQVIYRILIFYVGALAVLLSLYPWENVVTGGSPFVLIFHALNSNWVANVLNVVVLTAALSVYNSGVYCNSRMLFGLAQQGNAPKSLLKVSKRGIPLTALGVSAAATGLCVLINYFMPGKAFELLMGLVVSALIINWAMISIIHLKFRADKRKAGQETRFKSFGYPLTNYLCLAFLGGILVVMYLTDGLRISVYLIPVWLAVLGISYRLRQKNAVPALQGSVSAQ

SEQ ID NO: 2298 - protein, 151 aa, Candidatus Pelagibacter ubique HTCC1002
MFKKRENIVEIEEGKLLSPKFDNDGLIPVITMCSKTKDVLMHGYMNVEAFKKTIETKEAHYFSRSRQQIWHKGKTSGFTQKVTEIRIDDDQDSVWLTVDIGDGSSCHVGYRSCFYRSIPLGPIENGREVEMKFEEKEKSFDPEVVYKGQPT

SEQ ID NO: 2299 - protein, 402 aa, Roseovarius nubinhibens ISM
MSKIVVIGAGQAGSSLVAKLRTLGHDGSITLIGAESAPPYQRPPLSKKYLLGEMELERLYLRPESFYADQGIDLRLGATVTGIDRDAREVILGDERLPYDQLALTTGSAPRRLPAAIGGDLAGVFTVRDLADVDAMEPMVRAGAHVLIVGGGYIGLEAAAVAASRGLKVTLVEMSDRILQRVAAPETSDFFRKLHGNHGVDIREGVGLDRLLGDGKVSGARLSDGSELAVDFVIVGVGITPETALAEAAGLALDNGIAADAQGRTSDPAIWTAGDCASFPHGAGRLRLESVPNAIDMAECVAENMLGAGKDYVPQPWFWSDQYDVKLQIAGLSTGFDRIVTRHDDGDAVSFWYFKGDQLLAVDAMNAPRAYMVGKRLIDNGKTADPAAIADPATELKTLLKP

SEQ ID NO: 2300 - protein, 532 aa, Hordeum brevisubulatum
MGQCCSRATSPDSVQGGANGYGYSHQPKQAQAPPSYNNAQPPPRAEVRYTPPAMNPPVVPPVVAPSKPMPDTILGKQYEDVRSVYSLGKELGRGQFGVTYLCTEISTGRQYACKSISKRKLVSKADKEDIRREIQIMQHLSGQPNIVEFCGAYEDKGSVHVVMELCAGGELFDRIIAKGHYSERAAATICRGVVNVVNVCHFMGVMHRDLKPENFLLATKDENAVLKATDFGLSVFIEEGKMYRDIVGSGLLCCSEVLRRNYGKEIDVWSAGVILYILLSGVPPFWAETEKGIFDAILQGEIDFESQPWPSISESAKDLVRKMLAQDPKKRISSAQVLRHPWLREGEASDKPIDSAVLSRMKQFRAMNKLKKMALKVIASNLNEEEIKGLKQMFMNMDTDNSGTFTYEELKAGLAKLGSKLSEAEVKQLMDAADVDGNGSIDYVEFITATMHRHKLERDEHLFKAFQYFDKDNSGFITRDELETALIEHEMGDADTIKDIISEVDTDNDGRINYEEFCAMMRGGIQQPIKLK

SEQ ID NO: 2301 - protein, 220 aa, Hordeum brevisubulatum
MDTVAVWQQFDGQEYMTGCPEEQEYRTVWSEPPKRRAGRIKLQETRHPVYRGVRRRGKVGQWVCELRVPVSRGYSRLWLGTFANPEMAARAHDSAALALSGHDACLNFADSAWRMMPVHATGSFRFAPAQEIKDAVAVALEVFKGQHPADACTAEESAPSITSSDLSGLDDEHWISGMDAGSYYASLAQGMLMEPPAAGAWREDREHDAGVDTSTSLWSY

SEQ ID NO: 2302 - protein, 257 aa, Medicago truncatula
MANQSSELAIEQLKKLLREKEELNEVATAKIEEIIVELQGCHPQPIDPAEQRIIDGFTYFKLNNFDKDRKLYDRLAKGQSPKFMVFACSDSRVSPSIILNFQPGEAFMVRNIANMVPPFNQLRYSGVGATLEYAITALKVENILVIGHSRCGGISRLMSHPEDGSAPYDFIDDWVKIGLPSKVKVLKEHKFCDFEQQCEFCEMESVNNSLVNLQTYPYVDAEIRNKNLALLGGYYDFVSGEFKFWKYKTHITEPITI

SEQ ID NO: 2303 - protein, 373 aa, Zea mays
MLGVARRRLGSGCVLAQLAQALRPAAAPARTYSAAAKEITVREALNTALDEEMSADPSVFLMGEEVGEYQGAYKISKGLLDKYGPDRVLDTPITEAGFTGIGVGAAYHGLRPIVEFMTFNFSMQAIDHIINSAAKSNYMSAGQISVPIVFRGPNGAAAGVGAQHSQCYAAWYAHVPGLKVLAPYSAEDARGLLKAAIRDPDPVVFLENELLYGESFPVSAEVLDSSFCLPIGKAKIERQGKDVTITAFSKMVGYALQAADILAKEGISAEVINLRSIRPLDRATINASVRKTNRLVTVEEGFPQHGIGAEICMSVVEDSFEYLDAPVERIAGADVPMPYAANLERMAVPQVDDIVRAAKRACYRAAVPMAATA

SEQ ID NO: 2304 - protein, 547 aa, Glycine max
MADDGSRRELIFRSKLPDIYIPKHMPLHSYCFENLRECGSRPCLINAPTGDVYSYHEVDSTARKVARGLKKEGVEQGQVIMILLPNCPEFVFSFLGASHRGAMATAANPFFTPAEIAKQAHASNAKLLITQASYYDKVKDLRDIKLVFVDSCPPHTEEKQHLHFSHLCEDNGDADVDVDVDIKPDDVVALPYSSGTTGLPKGVMLSHKGLVTSIAQQVDGDNPNLYYHCHDTILCVLPLFHIYSLNSVLLCGLRAKATILLMPKFDINSLLALIHKHKVTIAPVVPPIVLAISKSPDLHKYDLSSIRVLKSGGAPLGKELEDTLRAKFPNAKLGQGYGMTEAGPVLTMSLAFAKEPIDVKPGACGTVVRNAEMKIVDPETGHSLPRNQSGEICIRGDQIMKGYLNDGEATERTIDKDGWLHTGDIGYIDDDDELFIVDRLKELIKYKGFQVAPAELEALLLTHPKISDAAVVPMKDEAAGEVPVAFVVISNGYTDTTEDEIKQFISKQVVFYKRINRVFFIDAIPKSPSGKILRKDLRAKIAASVPK

SEQ ID NO: 2305 - protein, 568 aa, Xylella fastidiosa 9a5c
MSSSSIEDIKGKSHRLRGSLLESLANPTTGALHESDQTLIKYHGSYQQDDRDLREERRRQKLEPAYQFMIRTRTPGGVITPQQWLQLDAIATRYANHSLRVTTRQAFQFHGVIKRELKATMQAINAALIDTLAACGDVNRNVQVAANPLLSRAHADLYTDAAHLSEHLLPNTRAYYEIWLDEKKVAGAGEEEEPIYGPHYLPRKFKIGFAAPPINDVDVFANDLGFIAVIVDNTLLGYNVAIGGGMGTTHGDPDTWPRVGNIIGFITRADLIAISTAIVTTQRDFGNRTLRKRARFKYTIDDRGLDCIVGEIQQRAGITLQPARPFVFEHNGDRYGWIEGEDRHWHLTLSLPAGRIADTESSPLLSGFRAIAQLGIGQFRMTPNQNVVIAGISPGQRATIDALVTQYGLDTGNRAPTALARHAMACVALPTCGLAMAEAERYLPDFNVKLQPILEKYGLAEKPILLRISGCPNGCSRPYLAEIALVGKAPGRYNLMLGGDQRGQRLNTLYRENITETEILAALEPLLGRYQQKRLPGEGFGDFLHRTGIIALPPYPTHRHVISSTLQA

SEQ ID NO: 2306 - protein, 641 aa, Rhodococcus erythropolis
MCGLLGLLTSGGTSEDAVSRVDQAMHCLRHRGPDEHGTWNDDHLVFGFNRLAIIDIAHSHQPLRWGPPENPERYALTFNGEIYNYLEIRAELVKDHDAKFFTEGDSEAIVAAFHYWGEDAVRRLRGMFAFAIWDTDTRELFIARDPFGIKPLFIATGAGGTAFGSEKKSLLELTDLIGIGTELDPRAIEHYTVLQYVPEPETLHKEIRRLESGSFARVRPGEEPTFTRYFTPKFPAKPFAPGTEKARYQEIAEALEDSVAKHMRADVTVGSFLSGGIDSTAIAALAMRHNPNLITFTTGFEREGYSEVDVAAESAAAIGAKHVVKVVSPAEFAAAIPEIVWYLDDPVADPALIPLWFIAKEARKHVKVVLSGEGADELFGGYTIYREPLSLKPFEYLPKGLRRAAGKLSERIPDGTRGKSLLNRGSLTLEERYYGNARSFNDAQLRAVLRDFRPEWTHQDVTAPIYAQSRDWDPVARMQHLDLFTWLRGDILVKADKMTMANSLELRVPFLDPEVFDVASRVPLDQKITKDTTKYALRQALEGIVPHHVLHRAKLGFPVPLRHWLRGTELFDWAHLQIEESGTDHIFDKQAVVKMLNDHREGVSDHSRRLWTVLTFMVWHGIFVEKRIVPQIQEPVYPVNI

SEQ ID NO: 2307 - protein, 468 aa, Roseovarius nubinhibens ISM
MSATDLLKMIKDEDIEYVDVRFTDPRGKLQHVTLMSDQVDEDFLEEGFMFDGSSIAGWKSIEASDMKLMIDTDSAYVDPFYAEKTLCVHCSVVEPDTGEAYERDPRGTAEKAEAYLKASGIGDVAYMGPEAEFFLFDDVRFSNTINKVSYEVDAQDASWNSDTEYEMGNMGHRPGVKGGYFPVNPIDDAQDIRSEMLSTMKRLGMKVDKHHHEVASCQHELGLIFDSLTKQADELQKYKYVIHNVAHAYGKTATFMPKPIAGDNGTGMHVNMSIWKDGKPLFAGDKYADLSQEALYFIGGILKHAKSLNAFTNPATNSYKRLIPGFEAPVLRAYSARNRSGCVRIPWTESPKAKRVEARFPDPAANPYLAFAALLMAGLDGIKSKIDPGEAMDKNLYDLPAEELEGIPTVCGSLREAMEELKADHDYLLAGDVFTKDQIDGYIALKMEEIELYEHTPHPVEFGMYYSC

SEQ ID NO: 2308 - protein, 112 aa, Vibrio vulnificus CMCP6
METIDKIKQQIAENPILLYMKGSPKLPSCGFSSQAAQALMACGEKFAYVDILQNPDIRAELPKYAEWPTFPQLWVEGELIGGCDIVIEMFQKGELQPLIKEAAARAAGSDAE

SEQ ID NO: 2309 - protein, 179 aa, Zea mays
  misc_feature (150)..(150): Xaa can be any naturally occurring amino acid
  unsure (1)..(179): unsure at all Xaa locations
MIQKNEKPFHTRRNKDEEITMFHGSRAPSMNIQRYTERVHRYARCSPACFVAAFVYIIRYLERPGATSMTLRLTSLNVHRLLITSLLVAAKFLDRKCYNNAYYAKIGGASTEEMNRLERTFLFDLDFRLNITAEMFEKHCLMLQRQTVPXGSRERRTALEKMTCGCPSDLTYTKAIRGA

SEQ ID NO: 2310 - protein, 202 aa, Triticum aestivum
  misc_feature (79)..(79): Xaa can be any naturally occurring amino acid
  misc_feature (110)..(110): Xaa can be any naturally occurring amino acid
  misc_feature (137)..(137): Xaa can be any naturally occurring amino acid
  unsure (1)..(202): unsure at all Xaa locations
MSSQGNDQEQDVLPEQTEGFRVGEKKTMNEYQQLDAEDEAMQRYKRSLGIGGDGKYLTDPNDPRQCIILSLTMESQDRXPVTIDLSEEDSLSTLKDKPFKIKEGASYSMXAKFKVQHEILSGLHYVQIIKRKGIRVXKDQEMIGSYAPNTEANPVYTKRFAVNTGPSGIMARGNYTVISNFIDDDKKVHLIFEWSIMIGKDW

SEQ ID NO: 2311 - protein, 350 aa, Oryza sativa (japonica cultivar-group)
MSLQVPNVQELALTCNRPDQQIPDRYIRPEAGTEEVICGQGINTAIPVIDLAKLLNPQSSQEECAKLRSACQHWGFFQLVNHGVPDDVISDVRRDLTEFFKLPLEAKEAYAKPPDKYEGYGQHFVVSEKQKLDWGDLLHLRLRPTESRDLRFWPAHPSSFRNSMERYSLETAKVARCLLEFLAMDMGVDPESLLEVFRGQPQNMRVNYYPPCRQTGKVLGLSPHCDATSLTLLLHVNDMQGLQIRKDGKWLTIEALDGAFVVNVGDMLEILSNGRYRSVEHRAVVHPEKERISAAVFHQACRDATVGPLPELVTKDGGRPVYKSMAYEDFMKRFFSAKLDGRANVEGMKI

SEQ ID NO: 2312 - protein, 957 aa, Candida glabrata CBS 138
MVKNSMVHGVTRVDLTAYSAESFENAIQFYLAFLVLDELDQNEDGGVVLANSHVYIKISYKEDGEMERKVNDRLMNLIEKTTSGDWRAVSSNVLVYTVDDIGLVKETLKRIGLPHQAYPTELTPAQIYTLDPLGNVVGFTGNKLAIATEIPFVLPTEEDDESELSSKESSYTNLTSLMRTTSGYPSLPFGHSRTHRNIAILTSGGDAPGMNSVIRAVVRTALFKGCRVYIVREGLEGLVKGYIEEFFWEDVGGWNSQGGTNIGTAKSNAFLQRRGRLLAARNLIIHDIDSLIVCGGDGSLAAADIFKHEWHSLISELLSSHLIKIEQLHSHKHLTICGISASIDNDIPVTDASIGAYSALDRICKALDYIQVTAESTSRAYVVEIMGGNCGWLTLLAGIATAADYIFLPECPQQKEDWRTHLQRIVKRNRRNGRRNTLVLLCEGAVAADSTPITSRDVHQVLSEELDIDTRITVLGHVQRGGAPVAYDRILATLQGVEAVSVILESTPDTPSYLIAVKENKILRKDLQDAVRQTFKISTSLKDREFEKAFRAKEAEFIEHYHNFLAINAADQDKKLVKSASLLNIAIINIGAPAGGMNSAVYAMASYCMWKGHRPIAIYNGWSGLARHESIRSLKWSEIVGWQSRGGSEIGTNRETPNEADVGMIAYYFQKYKIDGLIIVGGFEGFESLRQLEKARELFPAFRIPMVLIPATLSNNVPGTEYSLGSDTALNSLTEFCDNIGISSAATKDKAYVVEVQGGNSGYLATLTSIAIGACATYVPEEGISLVQLSEDIETISKSFDCVQTGDHAGKIILKSQNASKAMSAEKLANIITEEAAGKFEAKSVIPGHLQQGGTPSPIDRTRATKLAIRAVDFILEKSKVLKSQDDVIYEHTKELTESAVVLGVKGSNILFTSVKQLYLFETNVRDRMPKVIHWDGIRTLSDHMAGRRRIYEDEDN

SEQ ID NO: 2313 - protein, 423 aa, Arabidopsis thaliana
MATAMAEDTSFEGDQLASMTTDDIGRASRLLANEIRILKEESQRTNLDLESVKEKIKENQEKIKLNKQLPYLVGNIVEILEMSPEDDAEEDGANIDLDSQRKGKCVVLKTSTRQTIFLPVVGLVDPDTLKPGDLVGVNKDSYLILDTLPSEYDSRVKAMEVDEKPTEDYNDIGGLEKQIQELVEAIVLPMTHKEQFEKLGIRPPKGVLLYGPPGTGKTLMARACAAQTNATFLKLAGPQLVQMFIGDGAKLVRDAFLLAKEKSPCIIFIDEIDAIGTKRFDSEVSGDREVQRTMLELLNQLDGFSSDDRIKVIAATNRADILDPALMRSGRLDRKIEFPHPTEEARGRILQIHSRKMNVNADVNFEELARSTDDFNGAQLKAVCVEAGMLALRRDATEVNHEDFNEGIIQVQAKKKASLNYYA

SEQ ID NO: 2314 - protein, 343 aa, Ralstonia eutropha JMP134
MDTASELQATIRAMVQPGKGLLAADESGPTIAKRFTTIGVESNEENRRAWRSLLLSTPGLGAHISGVILYEETLGQRADDGTPLPELCARQGIVPGIKVDKGKVPLVNAPGDEITEGLDGLPKRLEAYRQQGARFAKWRAVFNVSDTLPSALAVQANAQVLAAYAAICQASGIVPIVEPEVLMDGDHGLARSAAVTERVLHAVFHALHRYGVVLEHMVLKPSMVIAGKKSAQQTSVQDVATETVRVLKRTVPGAVPGIFFLSGGQTPEQATANLDAMNRLGPLPWPLSFSYGRALQEPPLAAWRGQAANVGKAQQALLQRSLLNGEACQGQYEAAQESMEKVG

SEQ ID NO: 2315 - protein, 344 aa, Oryza sativa (japonica cultivar-group)
MGSLPVSSPECAPGRRVTVAASDLAPLFGAQRRHLDHFFDRLDLSQAAAFAQALVDAPGAVFFTGVGKSGIVARKLAQTLASLGFTRAGFLSPVDALHGDIGSVFPGDLLVLLSKSGASDELLALAPCARAKGAHLISLTSAASGADCPLAAVCDLNVHLPLQAEVCPFGLAPVTSTAIQMVFGDTVVAAIMEARRLSRDQYASNHPAGKIGKSLIFKVKDVMKKQNELPLCKEGDMIMDQLTELTSKGCGCLLVVDDEYHLIGTFTDGDLRRTLKASGQAIFNLTVGEMCNRHPRTITADAMAVQAMEKMESPPSPVQFLPVVDSNNVVCGIITLHGLVSAGL

SEQ ID NO: 2316 - protein, 518 aa, Roseovarius nubinhibens ISM
MTEILTSAQMRALEAREIESGRATGRALMERAGRGVVAALLAHWPALGNQPGKAVVLCGPGNNGGDGFVVARLLRNRGWQVAVGMLGTAEGLPPDARANHDLWRSMGRVAALDAVLAGCAGADVIIDALFGIGLSRPLEGAARRWAEMSAAGLAARVLAIDLPSGLCAERGQPIGVAARAALTVSFHRPKPGHYLGAGPDHCGALEIVDIGIQAPCPEAVLRRVERPAAADLAKVGHKFDNGHALVLCGGYGRSGAARLAARAALRIGAGLVSLGVPGSAQMEVAAQITALMMQRIEGAEDLAAALTDRRLGALCLGPGLGVARAAELLPVALADGRGCVLDADALTALAEVGLRAPLHSGCVLTPHGGEFARLFPDLAEASGSGGEMSKVEATRQAAVRAGAVVLYKGPDTVIAAPDGRAFLHAACYERAAPWLATAGSGDVLAGMIAGLMARGHAPLDAATRGHAPLHAAAQGHAPLNAATMATWLHAEAARGFGPGLIAEDLPEALPQVLAGLAG

SEQ ID NO: 2317 - protein, 317 aa, Brucella suis 1330
MSSSSDAIKAALEKGRAAGLSATGGKNADYIPFLASVPSDLFGLAVVTADGQTFKTGDADFAFAIESISKVFTLALVMEEIGPDSVREKVGADPTGLPFNSVIALELHNGKSLSPLVNAGAIATASLVPGDTADARWNNILECQCGFAGRRLKLSNEVNQSEQTTNFHNRAIAWLLYSAGTCYSDPMEAVDIYTRQCSTLVTATDLATMGATLAAGGVNPISGKRMVSAGNVAPILAEMTMEGLYTASGDWAYTVGLPGKSGVGGGIMAVVPGELAIAAFSPPLDPAGNSVKAMAAVAAVADSLGHNLYTTRGKVSS

SEQ ID NO: 2318 - protein, 365 aa, Zea mays
APIGEEAEGRRKYVIHPYTPISDPDSKGYFDLLIKVYPDGKMSQYFASLKPGDVVEVKGPIEKLRYNPNMKKQIGMIAGGSGITPMLQVVRAILKNPNDNTQVSLIYANVSPDDILLKRELDRLASSYPNFKVGIAVFYTVDKPSTDWRGGVGFVSKDMVLKGLPGPAEDSLILVCGPPGMMNHISGDKAKDRSQGELSGVLKDLGYTAEMMPRCDVCENSSMLALEIRAIEFYWIAAANYEGGASSMAGLQRSSQTFRRSGSSGLVWDERLTSQDDDQSGPEDADAATDLKELRHSRSVGSVGLQPQPQPQPQRRRSDDSGQGFRTRRVAPALDPPSPKVPGCIFCGIFRKAGASEPKSKPRRY

SEQ ID NO: 2319 - protein, 341 aa, Myxococcus xanthus DK 1622
MSTTSNRQWVLKTRPREAVSEDCFEWREGPVPTPGPGEALVRVTWLAIEPTQRTWLNANATYIQPVALGEVMRGAGVGLVIASRTERLAVGDWVAGLTGWQDYVLTGDAGLFGLNKVPDGVAPKAMLNLYGASGLTAYFGITEVGRVAPGETVLVSAAAGSVGSIAGQVARLRGCRVIGIAGGPHKAEWVTRTARFDACIDYKSEDIRARLRALAPQGVDVVFDNVGGHVLEAALDHLARGARVVLSGSVASGYKDGDYGTAPRNYMQLGFKRARMEGFIFLDYVSRFPEAFRELAAWDAQGALHCAESIAEGLEQAPSALRGLFEGRNVGKQLVRVTSIP

SEQ ID NO: 2320 - protein, 556 aa, Cryptococcus neoformans var. neoformans B-3501A
MDGKPATQYQAWKKLQSLHASKADKLVLKDLFKADPKRFSNLSKTFSSSSPNVSLLLDYSKNLVDDEVLSTLFDLAREAKVETFRDEMFAGKHINTSEDRSVLHIALRNPPADKGGFKISEAGVDEVHAVLAHMKEFSDSVRSGAWKGYTGKAIDTIVNIGIGGSDLGPVMVCEALKHYSKRDLKTHFVSNIDGTDMAEVLKACNRETTLFIVASKTFTTQETITNAESAKEWFLEQAKEKAHVAKHFVALSTNTKGVTEFGIAESNMFQFWDWVGGRYSLWSAIGLSICLSIGFDNFQELLNGAHEMDKHFKTAKLEDNLPVILALVGIWYNDFYGAQTQALLPYDQYLKKFADYFQQGDMESNGKSVTKDGSRVDYETGPIIWGQSGTNGQHAFYQLIHQGTKLIPCDFLAPVETLNPISGGKHHEILLSNFFAQPEALAFGKTEEEVIKELGPEQSKNSALVKSKIFEGNKPTNSIMFQKLTPGTLGALIALYEHKIHVQGAIWGINSYDQMGVELGKVLAKAILKQLGSENDVQGHDSSTTGLIHFYQKNRK

SEQ ID NO: 2321 - protein, 471 aa, Bacillus cereus G9241
MKQIFQKKPIAKLMQESKQKTLARTLGALDLTMLGIGAIVGTGIFVLTGVVAAKHSGPAIILSFAIAALACAFAAFCYAEFASSVPVSGSVYTYTYATMGEVFAFLIGWDLMLEYLLATSAVANGWSAYFQSLLKGFGIHIPTILSSAPGTGKGGIIDLPAVLIILVMTVLLSRGVRESARVNNIMVFIKIAVVLIFIFAGFNYVKPENWTPFMPFGLDGVMAGAATVFFAFIGFDAVSTAAEEVKRPQRDLPIGIIASLLICTVLYIVVSLILTGIVPYGQLNISDPVAFALQFIGQDGLAGVISVGAITGITTVMLVMMYGQVRVSYAMSRDGLLPKRLAKVHPKFKTPFLNTWTTGIIAALISGLIDLNVLAHLVNMGTLSAFALVAVAVIVMRRTHPDLPRAFKAPLVPILPALTVIFCLYLMLQLSGTAWISFGIWMVIGIAVYFLYSRKHSALNNSKDEEDVANL

SEQ ID NO: 2322 - protein, 601 aa, Xylella fastidiosa 9a5c
MNITTALPLPTHLLSEKVTAPLLGARKIYITGSRQDIRVPMREIALTPSSARYGGNENLSLALYDTSGIYTDPQATIDLACGLPRLRAAWIDERADTVEAALYFKVPESVSVTAPPFPTAPRPRRARDNVAVTQLEYARRGLVTPEMEFVAIREQQRREQTVENLRGQRHAGDAWGALVGTPITPEFVRDEIARGRAILPNNINHPESEPMIIGRNFLTKINANIGTSALSSSIAEEVEKLVWAIRWGADTIMDLSTGRDIHATREWILRNSPVPVGTVPIYQALEKVGGHVEALSWAVFRDTLIEQAEQGVDYVTVHAGVLRDFIPLTASRLTGIVSRGGSIMARWCQAHRSENFLYTHFEELCEIMRAYDVAFSLGDGLRPGCIADANDAAQFAELEILGELTHIAWNHQVQVMVEGPGHVPMHLIKANMDKQLAACGEAPFYTLGPLTTDIAPGYDHITSAIGAAMIGWYGTAMLCYVTPKEHLGLPNLQDVHDGIIAYKIAAHAADLAKGHPAAQARDDALSKARFEFRWQDQFHLSLDPEKALALHDESLPKEAHKRAAFCSMCGPQFCSMKISQEVRDASSNELSDGNTNTNDAI

SEQ ID NO: 2323 - protein, 660 aa, Rhodospirillum rubrum ATCC 11170
MSAVPHADLANAIRFLSADAVQKAKSGHPGMPMGMADVATVLFTRFLTFDPAAPRWPDRDRFVLSAGHGSMLLYSLLYLTGYADIDLDQIKSFRQLGARTAGHPEYGHVAGAETTTGPLGQGLANAVGMALAERMTAARFGEAVVNHRTYVIAGDGCLMEGISQEAISLAGHMKLERLIVLWDDNRICIDGDVGLASSDDVPARFQASGWRTLACDGHDPQDITRALTEAQTSDRPTLIACRTIIGKGAPTLQGTAKTHGSPLGDAEIAGARAALGWPHAPFEVPEPILSAWRTAGARGGVARVAWEDRLASLPGDERATLIRALAGDLPAGWEDAVLAAKRALIETRPKVASRKASQMALEVLVPQIPELVGGSADLTGSNLTQVKGQADILPGSYGGHYIHYGVREHGMGSLMNGLALHGGVIPYGGTFLVFADYMRPAIRMAALMGLRAIYVLTHDSIGLGEDGPTHQPVEHLASLRAIPNLWTFRPADAVETLECWALAVGRSDGPSLLALSRQDLPTLREAYGEENLSAKGAYVVAGEGPRDVTLIATGSEVTIAMAARELLAADGLAAAVVSMPSWELFEAQSAEYREAVLGPRARRVAVEAASAFGWERWVEDKTAVVGMPGFGASGPIGDLYEHFGITAEAVARVAKARAEG

SEQ ID NO: 2324 - protein, 401 aa, Prochlorococcus marinus str. MIT 9303
MAKRSLSSLSAADLRSKRVLVRVDFNVPLNENGAITDDTRIRAALPTINDLIDKGARVILSAHFGRPKGQINEGMRLTPVAKRLSELLGKTVIKTESCVGSDAEAKVNAMADGDVVLLENVRFFSEEEKNDANFAQKLAALADAYVNDAFGAAHRAHASTEGVTKFLNPSVAGHLMEKELQYLQGAIDDPKRPLAAIVGGSKVSSKIGVLEALIDKCDKVLIGGGMIFTFYKARGLSVGKSLVEEDKLELAKELEAKAKAKGVQLLLPTDVVLADDFSPDANSQTVSIDAIPDGWMGLDIGPDSINLFQDALADCQTVIWNGPMGVFEFDKFAAGTNAIATTLADLSGKGCCTIIGGGDSVAAVEKAGLAEKMSHISTGGGASLELLEGKVLPGVAALDDA

SEQ ID NO: 2325 - protein, 207 aa, Zea mays
MTSVWKQQGSGPGLNKIFDKDGKKAAAGFLKSFNKEEIDKEIEDKKTELEPKVGGLRRTSPRGQGSVTRSRIPARSSKKNSAAVTKFLDELAKIDFPGAKVGERGRWPNLLPAITFILDKVAPFIPKEEPKEEPAAEATSREVAVEEKKEEAEPAAATEAAPAPAETPSEAAVVEEKKEEEKKEEEDKPAAEEAAPPAAAAAAAEEK

SEQ ID NO: 2326 - protein, 530 aa, Aquifex aeolicus VF5
MFSFPITSILKRALKKGLTPSHKGSNKYLPTGVKGHISVLVYKSGMTKLNAYQKKAVERALKAEKVFLIHGPPGTGKTTTLVECIKRLAQEGYKVLATADSNVAVDNLVERLVRENVKVVRVGNPVRVLKTIQRHTLDYLVQFEPEFDKARKIYEEIDNLKEEQKKYVKPEPRYRRGLSDEEILKRAKTGTPVRGLSPKILRSMAKWIKLQEKVKELYEKAKKEEEKAVNKILSRAQVVCTTNSTAGSEVLQNLNFDVVIIDEATQATEPSCLIPLIKGKKLIMAGDHKQLPPTVLSQEAQEALSYTLFERLLDLYGEEIYEILRIQYRMNKKIMEFSNKMFYEGKLIADKSVENHTIKDLINPEKLKEIPEPFKSVLEPEKVVVFINVRGKEKQRRGSTSFYNEEEAKVAVKIVEYLMKIGLRSEHIGVISPYEDQVNFLEELLKDFEVEVKTVDGFQGREKEVIIISFVRSNEKGEIGFLKDYRRLNVALTRARRKLITLGNEKTLSSDEVYKQFIGYVKSIGGYINI

SEQ ID NO: 2327 - protein, 1462 aa, Cryptococcus neoformans var. neoformans B-3501A
MAASTLSNYQLGDLLGRGASGNVYRALNFLTGETVAIKSISLLSLPPSSLPDIMSEIDLLKNLNHANIVKYKGFARDKENLWIILEYCENGSLQTILKKFGKFPESLVAVYISQVLEGLIYLHEQGVIHRDIKGANILTNKDGSVKLADFGVSSRAPTAVLDQSGKSNDGEAEVVGSPYWMAPEVIEQSGASTASDIWSVGCVVVELLEGKPPYGDLAPMQALWRIVQDESMRIPEGASPIVKDFLYHCFQKDPNLRISAKKLLRHPWMLSVKKSASNRPPITPSLVDTTFDHSIDPKANSDGITPQAQRDGNKSRPEREGENEKQSRQGTVKPRKKIMTVYDEAVQRVQEWNEALKASPKNLSKPSPSPSPSTSSASASTSASKALLLPVPSTNPLISKARQRGESNPPLSLFSLLPTSNSKPLSSSLSQEQPLSLPLQLRNQVGQGGGLLSKNYMVSDVLERAKEEGEERWDDDFAEGISFSKLGRTEIYKHPQAHHHTHLTSSASSASTAREEAEEANQKTLRQNRALALPTPSSKPGRKSNLSRPVGEVEDYSDMEQAFGENEGSLEKKMRILKLKAIGRKGLMHPDDIHKYPLSPVKRKPSSRVDVRGNSSTSTTATTCASASASNPGAPPITVPLSSSIPIPNSSFPRRRAPSNPIPSSFSTLTIPSLSETGTGMSTETKNRNRDNSFLSQDAPTRSSPSSRSSSLRNKAKVGEEVEEQIKKYTENEEENYEDIFGGANKTFSSSQEVPLKLVLLPSHPLSSSSALRNGGGGGRGSSEGGISFTDPHSHINFDYPESDEEDMLDPFAEIEDEFDTAEDLEKKLMRDKKVMMQGKVSKLVDELMIGGVGGGGLRGVCDDLFGILENSSPEMGLEAHFVAQHGLIAVLEVLESRLSRDVVVRLLKLVNLIVTSNVELLESFCLIGGIPVIIPYTSKKHSLETRLEASRFIRQLTRSALTLQMFISCRGLRILVELLDEDYALNKTLILSSLEGINSVFELQSPTPRNDFVRMFVREGVIDPLSTALLAILKDKYEDRSANDDGNGNGNGEMEDGQGQERGQFMMEQASRSVGVLLFFCQVAQADARVREAFATRTIMIRLLKACDLLPRKLLVTAIKAIKHLSTSPQLIEVLQNSNAMEILVDLLGKNIKGSHSNEICSHIFQTIYSMTRLSKSRQEEAASSGIIPLLKRVIQNKSPLKQFALPILCDMANAGKGSRRLLWHYDGLGLYLDLLEDPYWRVSALDAILAWMQDETARVEDVLLEKSASDSLVRCFVQASGVSFEGILDPLFKVLRLSTSLTSSLSHPPFFSRLSESLERSSKAVIKLNLLRLTKVVCECHPDKATLVERFGLAQIVERLSKQDGAVLVRELAKEILPGLLFGGDAPDPAASFRYTSSGTVGEERGGRTMKSQGRMEGRRSSQLRRTLSENVATDLLHPAPPVAPFPSTVSRCKYTKERG

SEQ ID NO: 2328 - protein, 249 aa, Chrysanthemum x morifolium
MGRGRVELKRIENKINRQVTFAKRRNGLLKKAYELSVLCDAEVALIIFSNRGKLYEFCSSSSMLKTLERYQKCNYGAPETNVSAREALELSSQQEYLKLKARYEALQRSQRNLLGEDLGPLNCKELESLERQLDTSLKQIRSARTQFMLDTLTDLQKKEHALNDANRTLKQRLMEGHQVTSLHWNPHVQQEMGYDQQHEPQHQNGEAFFHPLDCGPTLQMGYPSDSLTAEAAASVAGPSCSNYMPGWYQ

SEQ ID NO: 2329 - protein, 246 aa, Chrysanthemum x morifolium
MGKGRLELKRIENKINRQVTFAKRRNGLLKKAYELSVLCDAEVALIIFSTRGKLYEFSSTSSMLKTLERYEKSSFGPPEQRRPAKEDLQEQSSYQEYMRLKERYDALKQLERNYYGEEIDNLSTNELESLERQLHCSLKQIRTIRTQSLVDRLYEQQKMEHHLYESNKTLRLKFEEESQAEALQWEAHARANGMVYGHPQHQLSQTTHDAFYHPTGCETTLQIGYQTDMSAVTSTSMNHQMQGWPA

SEQ ID NO: 2330 - protein, 678 aa, Cryptococcus neoformans var. neoformans B-3501A
MSDGERITQASSGHGYKQKSRYPLTAAMTEGKPVTQHVEGGASEKPGIPRTSSDDASSEGHPKKATGNALGRKESHKVDLISNTNAKLANPLGDLTDEEVMDNAAAFAAANNLPVEVFRKGGLVAKRPNGFEKMSILTEKDKERLRREITHPYSQTKTLYNLVIACSVAAAVQGMDESVISGAQLFYPEQFGIGAINPDPRYAHNHEWLEGLVNGAPYLCCAVLGCWLTAPLNKWFGRRGTIFITAFFSFITCIWSACMNNWWLLFISRFFLGLGIGPKSATVPVFAAECTPAKIRGSLVMQWQVWTAFGIMLGYVADLIFYHVPDTPNITGLNWRLMLGSAGFPALIVMAQIFFLPESPRWLMAKGKYEKAYRSMLRLRGDELLAARDLYYIFVLLEEEAAIVRGRNLFWELFSVGRNRRAMIGSTIVMFGQQFCGVNAIVYYTASIFTSAGFSEISALLASFGFGLINALFAIPGMLTIDKFGRRPLLLVTFPIMSILLLFTGFCFWIPDREARVGCIALGIYLYCMAYSPGEGPVPFTYSAEVYPLYIREVGMSLATATTWLFNFIVSLTFPKLLTAFTPQGAFGWYAAWCALLFVLILFFLPESKGYTLEELDQVFSVPTGVHAKYQLWNIKWHFNHYILRSKEPFKPLYQFEDDDEPASVRHEKHDGQAEHVA

SEQ ID NO: 2331 - protein, 498 aa, Escherichia coli CFT073
MLLEDEELEQEIIALIKDKHMTADAAAHEVIEGQASALEELDDEYLKERAADVRDIGKRLLRNILGLKIIDLSAIQDEVILVAADLTPSETAQLNLKKVLGFITDAGGRTSHTSIMARSLELPAIVGTGSVTSQVKNDDYLILDAVNNQVYVNPTNEVIDKMRAVQEQVASEKAELAKLKDLPAITLDGHQVEVCANIGTVRDVEGAERNGAEGVGLYRTEFLFMDRDTLPTEEEQFAAYKAVAEACGSQAVIVRTMDIGGDKELPYMNFPKEENPFLGWRAIRIAMDRKEILRDQLRAILRASAFGKLRIMFPMIISVEEVRALRKEIEIYKQELRDEGKAFDESIEIGVMVETPAAATIARHLAKEVDFFSIGTNDLTQYTLAVDRGNDMISHLYQPMSPSVLNLIKQVIDASHAEGKWTGMCGELAGDERATLLLLGMGLDEFSMSAISIPRIKKIIRNTNFEDAKVLAEQALAQPTTDELMTLVNKFIEEKTIC

SEQ ID NO: 2332 - protein, 622 aa, Cryptococcus neoformans var. neoformans B-3501A
MSSGGHTNAAGPSRQHSLTAESRSLTTARQKEKAPQLEDVVLEEGLFEQEIDLLIGQYLEARGASKAARIWDEQILGRSANGSTRKEHIEDVERAILDGDWGSIENLVARPGLLRIQTQKAFLYLVYRQQFLEHVENRESQKAFNLLQKRLKALEHYQPVPYDFYSLSYLTSASTVHDAPTFRDWAGVGPERDRLVGVWKELMDAERGGGVDERRYIPPDRLKTLLKQAAAWQVGRVGKKRDDIVKIPTLLQDYRPLELPSKLLRLVEGHLANVKCVELIGSTAQHVVSGSSDCTLRVVSTEDGSLSHILSGHSSRVWSCASSPSGEMIASSSGDGTIRLWSASKGDCLGVLVGDGGDVYNVRWRPNREDQVVSASYDRILRSWDIETGKQLRTFSGHSQSTLAIAYDSTGNTIASGSKDKHVRLWDAVGGVCTNTMTDCLGEISSVEFDNEGKYLLVGCKDNSNRLWDLRMQRSVYRYTGHQNTSKNLVRCSFACSTSLVISGSEDGSVYIWDREGNSNDRRSNSLVPSTRDNELLAPERKGSGGDLTDFNIHPSSPAYYPPREGVRNRNSFARRGEITVRPSKVLVGHGEGAVFEVRWKEGKMVSAGEDGSVGVWGVETN

SEQ ID NO: 2333 - protein, 219 aa, Streptococcus agalactiae 2603V/R
MPVKDFMTKKLVYVSPDTTVAEAADLLREHHLRRLPVVENDQLVGLVTEGTMAEAQPSKATSLSIYEMNYLLNKTKIRDIMIKDIVTVSQYASLEDAIYLMMSRKIGVLPVVDNGQLYGIVTDRDVFKAFLEIAGYGQESYRLVILADEGIGVLSKVLNRLSSANLSVKRLVIIERKAGKKAVEIQLEGYADKDVLKQELVFDDVIVETLEKTMKKPLS

SEQ ID NO: 2334 - protein, 196 aa, Zea mays
MRPPRGRGGGGRFGGGGGRGRGGGRFSGGGRGGGGGRFGGGFRDEGPPAEVVEVSTFLHACEGEAVTKLTNEKVPYFNAPIYLQNKTQIGKVEEIFGPINESYFSVKMMEGIIATSYNEGDKFYIDPMKLLPLSRFLPQPKGQSQGAPRGGGRGGGRGFGRGRGGGSFRGGRGPPRGGGRGPRGGGRGGFRGRGRF

SEQ ID NO: 2335 - protein, 316 aa, Zea mays
MSMGHCSEQRTGFEVTKDWNGADQFAIRSPRGASVRVCLHGGQVVSWRNHRGEELLFSSSKAIFKPPRATRGGIPICFPQFGNCGTLEQHGFARNKIWTIDDEAPPLNYGDNNSNKASVDLLLKPSEDDLKCWPHCFELRLRVSLSMDGDLSLISRVRNVNGKPFSFAFAYHTYLSVSDISEVRIEGLETLDYLDNLSQRERFTEQGDAITFESEVDRVYVGCPGVIAVLDHGKKRTFIVRKEGLPDIVVWNPWEKKSKTMADFGDDEYKQMLCVDAAAVERAITLKPGEEWTGKLELSAVASTNCSDHLDRPGRL

SEQ ID NO: 2336 - protein, 180 aa, Agrostis stolonifera
MFPMVTGFMSYGQQTIRATRYIGQSFITTLSHTNRLPITIHYPYEKSITPERFRGRIHFEFDKCIACEVCVRVCPIDLPVVDWRFEKDIKRKQLLNYSIDFGVCIFCGNCVEYCPTSCLSMTEEYELSTYDRHELNYNQIALSRLPISIMEDYTIQTIRNSTKSKIDEDKSSNSRTITDY

SEQ ID NO: 2337 - protein, 75 aa, Triticum aestivum
RAAARAGEKLQWFLDSIKSYSNDIKLVGVHCHLGSTITKVDIFRDAANLMVNFVDEIRAQGFELEYFGLVFVLFS

SEQ ID NO: 2338 - protein, 393 aa, Agrostis stolonifera
MSLPLTRKDLMIVNMGPQHPSMHGVLRLIVTLDGEDVIDCEPILGYLHRGMEKIAENRTIIQYLPYVTRWDYLATMFTEAITVNAPEFLENIQIPQRASYIRVIMLELSRIASHLLWLGPFMADLGAQTPFFYIFRERELIYDLFEAATGMRMMHNYFRIGGVAADLPYGWIDKCLDFCDYFLRGVVEYQQLITQNPIFLERVEGVGFISGEEAVNWGLSGPMLRASGIQWDLRKVDPYECYNQFDWKVQWQKEGDSLARYLVRVSEMRESIKIIQQAVEKIPGGPYENLEVRRFKKAKNSEWNDFEYRFLGKKPSPNFELSKQELYVRVEAPKGELGIYLVGDDSLFPWRWKIRPPGFINLQILPQLVKKMKLADIMTILGSIDIIMGEVDR

SEQ ID NO: 2339 - protein, 215 aa, Xylella fastidiosa 9a5c
MSEAKRRAAEKAIEYVENDMIIGVGTGSTVAYFIDALGRTPKRIKGAVSSSEQSTAHLKQHGIEVLELNHTGTLPLYVDGADECDPYKRLIKGGGASLTREKIIAEASKQFICIIDPNKQVATLGKLPLPIEVIPMARSLVARQIMARTDGQPVWREGVITDNGNVILDVHHLRITDPVKLEQELNQIPGVVCVGLFARRCADLVIIGSEPPHIL

SEQ ID NO: 2340 - protein, 455 aa, Francisella tularensis subsp. tularensis SCHU S4
MDNNQDKLKRDILSRHIVMISLGGTISASFFLGIGSILNTVGAFGTVIGFFIGGIIMMLVMISLAEMAFEMPISGSFQSYATKFISPYSGFLTGWLYLLNWLTAAAGGLVAAGIICNNFYPAISVWQFCLAIILIVSLLNLCAVRVFAEIEFWLSAIKIITIIIFIIIGIGIIGGFLHSNKPIAGLVNFYVDGLFPNGFKAFLFGLVIIVCTFQGAEVVGIAAGETKEPEKNIRKAIRSVAVRILLFFVFSSFIIAYVIPYKDSGITNTPFVTVLQLVNIKYVDTIMQLVILSASLSAVNSCFYTCARLMWSMAEANQAPKIFAKISKKQVPIYGVVFVALLSCICLITKFIGAEKIFILVISSSGMVGCMIWIIISMCHIYFRKSLTASQIESLRFKAWGFPLIPYTSILFNSCVILAMFWDPEQRMVVYSGVILILLFSFLYKFYYKKIIVKT

SEQ ID NO: 2341 - protein, 171 aa, Rhodospirillum rubrum ATCC 11170
MNLKDHIREVPDFPKPGILFYDISTLLADPDAWQVTMGRMAKVVAPRLPDVLAGIESRGFLVAAPLALKLGLGFVMVRKKGKLPGATVRHEYALEYGTDTVEVQEGAVLPGQRVVILDDLLATGGTLNAASELLGKMGANVVGAACIIELSFLKGRERTKVPIDSLVAYDS

SEQ ID NO: 2342 - protein, 388 aa, Cistus creticus
EALQRMTGKSLSGLPLEGFDYQSILGQCCEMPVGYVQIPVGIAGPLLVNGREYSVPMATTEGCLVASTNRGCKAIHLSGGATSILLKDQMTRAPVLSFGSARRAADLMFYLESPANFETLAAEFNRSSRFGRLQKIKCATAGKNLYPRFSCSTGDAMGMNMVSKGVQNVLDFLRKDFPDMNVLGISGNFCSDKKPAAINWIEGRGKSVVCEATIKGDVVRKVLKTSVSALTELNMLKNLVGSAMAGSLGGFNAHASNIVTAVFLATGLDPAQNVESSNCITMMEAVNNGEDLHVSVTMPSIEVGTIGGGTQLPSQSACLNLLGVKGSNKDLPGANAKLLATIVAGQVLAGELSLMSALAAGQLVKSHMKYNRSNKDILNATANAKASS

SEQ ID NO: 2343 - protein, 435 aa, Oryza sativa
MSAPPVRRNAYASSSTAMNGGFPRGKRGRNATATAGPDFLSALPEGILHHIMSFLNVRQVIQTCVLSWRWRDLWRSVPRINANYCELSMSPIAAFTPDNEAAFKRFVNRLLERRDPAAVIHTFNLRYTISNPNNRDNDSADANRWISHALQNQASFLKIIVDAHELHLDHTVFTSCYLGRITLKNVFLDQGFFEQLEIGCPLLQDLLLYDCIIGDDEISSETLNVLTMYGCQFPTLQESCISAPNLTSLIMHQPENFVPVLDDVASLVTATVDLFPLIEFCAYDMRQLLWSLSGVRNLDLDYYACKMTIKNNPQLCPKFINLVDLTLGQWCLDSDFYVLIIFLQSSPKLEKLTLKLEKYYPHPYEHIIGDELTERSFTCEHLKIVEIICMEDDEPLAKIVEGLFVDNGMNSVRFDIKYWSQIPFQLPAFYRELYN

SEQ ID NO: 2344 - protein, 586 aa, Xylella fastidiosa Temecula1
MSPQTSLSILLHPGSPAPMSSSSIEDIKGKSHRLRGSLLESLANPTTGALGESDQTLIKYHGSYQQDDRDLREERRRQKLEPAYQFMIRTRTPGGVITPQQWLQLDAIATRYANHSLRVTTRQAFQFHGVIKRELKTTMQAINAALIDTLAACGDVNRNVQVAANPLLSRAHADLYTDAAHLSEHLLPNTRAYYEIWLDEKKVAGAGEEEEPIYGPHYLPRKFKIGFAAPPINDVDVFANDLGFIAVIVDNTLLGYNVTIGGGMGTTHGDPDTWPRVGNIIGFITRADLITISTAIVTTQRDFGNRTLRKRARFKYTIDDRGLDCIVGEIQQRAGITLQPARPFVFEHNGDRYGWIEGEDGHWHLTLSLPAGRIADTEGSTLLSGFREIAQLGIGEFRMTPNQNVVIAGISPGQRAAIDALVTQYGLDTGNRAPTALGRHAMACVALPTCGLAMAEAERYLPDFNAKLQPILEKYGLAEAPILLRISGCPNGCSRPYLAEIALVGKAPGRYNLMLGGDQRGQRLNTLYRENITETEILAALEPLLGRYQQKRLPSEGFGDFLHRTGIIALPPYPTHRHVISSTLQA

SEQ ID NO: 2345 - protein, 577 aa, Gloeobacter violaceus PCC 7421
MSSVCNGEIMTTTKDPSESKVQPQSEAKADAKTGMIRFQLLAPYNEKAALVGSFSNWEEIPMEKDDKGCFFVEIDLPDGEHQYKFKLVSKSFFCEGETVAIADPYARQVDEKNRENTVIRIKDGKQITDEYVWEHDDVPLSPDDHLIIYELHVSAFGGDTFIDAIQQLDYLVDLGVNCVQLMPVTEYPGEHYWGYNPRHPFAPESSYGKPEDLKAFVDACHERGFRVILDIVLNHSESESPLTRIDFTYWFYAPGTEPDEPGNVWGPKFNLEFYDEHYKRNPAREYLYDLVDYWVREYHIDGYRIDAAAQIKYFDFLGEVARRSKANSGGKPFYLVGEHIPENPAITGADGPMDGAYHETYYWMIDDLMVRNMFDTDQIVDSINPLHHGYPGPSNAVNFYENHDKPRLLQRLRDAGINEEGSFKRLECAAALLMTSVGLPMLYQGQAMGQAYPQDEEVHAVEWTLLDHDRHVALLERYKGLIDLRRETQALWTNEIDFFHIDQEARVIAYVRFNAEGSRVAVVAHLGDGNLGDYQVPCFPEDGHWFEKTRLYEVDVEGGILNVHLSDWDVHVFRNGG

SEQ ID NO: 2346 - protein, 443 aa, Ralstonia eutropha JMP134
MSQPAPAPVDERLPWRQLFVFGLQHVLVMAASPIAAVFLMSKALNLPSALSVQLLSATFVVCGLGTLLQSLGRRGIGARLPFVMLPGGAPIVLFILIAQQTSVQTAAGAVIITGLFYFCALPVFRRCLRYFPPVVVGTMLLLVAINLAQVSGRLIAGHPAAGASVDPMNLLLAFVTIACTVAASRWFGGTLARLAILIGLVGGALSAMALGVFHAGQVSASPLLALPTPFPFGWPQFDVVAAIPLVVFAVISMVEATGQTLAISDAVGRPVDGERDVPRTIRADALASLLGGVFGTSLIITSGENIGIVRATGVRSRYVTAVSGLILVAFGLLVPVSSLISAIPEAVVGGTGLVVFCIVGTMGIDVLRRVDLRDHANMYVVAVALAAGLLPILVPGIYGALPPNLRILLGNGVAMGAFTAALLNFLFFHTGARRVADVAPVTH

SEQ ID NO: 2347 - protein, 374 aa, Clostridium perfringens str. 13
MKKVLILSTSTGYGHNQAANSLMELIKNDDTEILVHDFLKENRFFDRSIVNGYDLCASSLGTLYGLLYKISNIKFINNLVSFLFLPVANKLAKFIHSFNPDLIITTHPLAVSILSYLKKRQIIKVPVISVVTDFKCHYTYVSKIIDHYIVACDFTKENLASKGIPKERISPFGIPVKQDFYKEDYHNYVENIIQSPLNILLMGGGMGLDNISKVLKTLIKNENPLNLTIVCGNNAELKEDLCKEYGHIKGNKKLNILGYTTEIPKIMKSSDLIITKPGGLTTTESLLSHLPMIIPFIIPGQESENREFLSKSNCAITINHLEELNKVINDLNKDNNKLINMRKSILDVLSSYSPEGTIKLCTKMLNDSYNKRRY

SEQ ID NO: 2348 - protein, 350 aa, Listeria monocytogenes EGD-e
MTYKITSLAGDGIGPEIMTSGLQVLEAVAKKYNHTFEIESHPFGGAGIDVAQDPIPSSTLKACQDADAILLGAIGGPKWDNAPKRPEDGLLALRKALGLFANIRPIQVPSSITHLSPLKKEIVENTDFVVVRELTGGLYFGEPKHWDESAAVDSLTYTRAEIERIIEKAFEIAATRNKKVTSVDKANVLASSKLWRKIAEEVASRHPDITLEHLYIDAAAMLMIQRPTTFDVIVTENLFGDILSDEASVITGSLGMLPSASHAENGPSLYEPIHGSAPDIANQNIANPMSMISSVSMMLRQSFSLFKEADAIDAAATRTMQAGFLTADLGGNTTTTDFTNEVLKQIEGGE

SEQ ID NO: 2349 - protein, 326 aa, Triticum aestivum
  misc_feature (278)..(278): Xaa can be any naturally occurring amino acid
  unsure (1)..(326): unsure at all Xaa locations
MAGDGTDAAFEDEVEPTVTISEYMDGIEAEELEADLVLGGDDGNECTYGAGYLKRQAVFSCLTCVPDGVAGVCTACCLACHDGHEVVELWTKRNFRCDCGNSKFGGHLCKLSPEKDPENPANSYNQNFKGSYCTCSRPYPDPEAKEQVEMIQCCICEDWFHEDHIGLDSLEKIPRDEEGEPLYEEFICHQCSPVCYFLKLYPDTIWASSKQSSASEAVTADSNGMEGGSSGHADTEKNENGAPVDRQSIENTSVEENRTIDIAASDKSILGDNSGGNXKIGVDINTTSADSEKTMPLFMSKGWRETLCKCGTCTNFYAQRGMHIHG

SEQ ID NO: 2350 - protein, 288 aa, Arabidopsis thaliana
FTFVLCKYCSRYCHESIVSCLELNSSGGKSLTQEANEPPVPISVSSPCGKRTRDPEDEVYLDNLRSQKRYLSEIMACSLNGLTVGDSLPVNMLESPARSESFLYHRDDLSLQYSPMSEDSDEARFCEDPTATASTSSSQPESRPTSPVSPYRYQRPLTSTNSPQPSPTILHHSHTCPASMISNAATTTTPQSRQRGSDTEGRFPSSPSDICHSGDLRRTALLRSVQMRTQPCGYSSSSGPSNIDGEERMCSKSMEEDRGYNKGEDIPYAEVSSKSKSCKALDMRLCEK

SEQ ID NO: 2351 - protein, 567 aa, Streptococcus pneumoniae
MALEVIMPKAGVDMTEGQIVQWNKKVGEFVKEGEILLEIMTDKVSMELEAEEDGYLIAILKGDGETVPVTEVIGYLGEERENIPTAGAASPEASSVPVASTSNDDDKSDDAFDIVVIGGGPAGYVAAIKAAQFGGKVALVEKSELGGTCLNRGCIPTKTYLHNAEIIENIGHAANRGIVIENPNFTVDMEKLLETKSKVVNTLVGGVAGLLRSYGVTVHKGIGTITKDKNVLVNGSELLETKKIILAGGSKVSKINVPGMESPLVMTSDDILEMNEVPESLVIIGGGVVGIELGQAFMTFGSKVTVIEMMDRIVPAMDAEVSKNLRLILERKGMTILTGTKLQEIIEENGQLRIKVEGKDDIIASKALLSIGRMPDLEGIGEVEFELDRGCIKVNEYMETSVPGIYAPGDINGTKMLAHAAFRMGEVSAENALKGNHAVAKLNLTPAAIYTLPEVAAVGLTEEQAREKYDVAIGKFNFAANGRAIASDAAQGFVKVIADKKYGEILGVHIIGPAAAELINEASSIIEMEITVEEMLKTIHGHPTYSEVMYEAFADVLGMAIHSPKKK

SEQ ID NO: 2352 - protein, 530 aa, Cryptococcus neoformans var. neoformans B-3501A
MSSVCRISNCLSPRALSTAIRPKVTFRATPPSCRRRTFLSRRRTSFWAPSYPESKPLASTLQVPFTPPPPTDNGDDHLSEETRPEVIVAEPRDKKNRYLNSLMEKAGELSLKCSILDAEGNWGAEGQKYTKLELCREYDLDPRDLRKLDSLSPSLVPVILTRKTCILISMLHFRALIKPDSVIVFDSSHAHKDVTRRFKYHLERNIKAGLGIKVGGADEEKCDEIVLSYEHRALESILVVTANALEEEMAFSRHIVQQLLADLEDHIDRENLKKLLHYSKKIAAFQSRARYVKSAIDELLDSDEDLSAMYLTSRAQGRPRALHDHEQLELLLESFVKQVEEIVSEVDTTVVNMQSTQEIAELMLDSGRNALLALDIKISIATLGIGSGALLAGLFGMNLTTQLEETPYAFAVISSTAFLVTVLITAYGLRTLRRVRRVALSGRNPAVLSSVLGSASWDSSVAQFSQGFDPALVDMRTEMAKRAIWERLWWGSKRKEVEEGEKWRKAYTYASAKKEQEKRKWARLPGGQTR

SEQ ID NO: 2353 - protein, 217 aa, Oryza sativa
  misc_feature (99)..(99): Xaa can be any naturally occurring amino acid
  misc_feature (105)..(105): Xaa can be any naturally occurring amino acid
  misc_feature (110)..(110): Xaa can be any naturally occurring amino acid
  misc_feature (121)..(121): Xaa can be any naturally occurring amino acid
  misc_feature (153)..(153): Xaa can be any naturally occurring amino acid
  unsure (1)..(217): unsure at all Xaa locations
MEKAACNEHVIGIPVSNRAFGIEEPDFPSEGAAAYHAEAKSSATARTSSRFGRTGDRLAQGIKEHVTLGPKLYETMKGKLTLGARILQAGGVEKVFRRXFAVGKXEKLLXASQCYLSTTAXGPIAGMLFISTERIAFRSDRSLALTTPSGDTXVRVPYKVAIPLRRVKTAKPSENKHRPEQKYVQVVTDDGFEFWFMGFVSFQVTLKNLELAVAQAQ

SEQ ID NO: 2354 - protein, 126 aa, Clostridium perfringens str. 13
MAKEIIKTNKAPGAIGPYSQGIKIGDFVYTSGQIPLNPETGVMAGSIEEQTAQSLENVKAILEAAGTSMDKVIKTTVFLSDMNDFVRMNEVYATYFTENQPARSAVEVAKLPKDAKIEIEVIATLK

SEQ ID NO: 2355 - protein, 266 aa, Brassica napus
  misc_feature (30)..(31): Xaa can be any naturally occurring amino acid
  misc_feature (83)..(84): Xaa can be any naturally occurring amino acid
  misc_feature (239)..(239): Xaa can be any naturally occurring amino acid
  unsure (1)..(266): unsure at all Xaa locations
MMQMDGGDRLRVTLLDCMETGRSSLPGLTXXAILMADRNGTPPQPLPSRNQSNRTLLDVMQREHRHDYSSHRDKTAWKSLREXXRLKRNATVWISSNPIPSLNTPVLNRDNDSHQLGSLLSNSRNEGGQSQPESASSGGVTADGRLQLGAVLAEERALSAREEETPPVTADMQPARMSLMELLDENEGQMSLVGVGGDGEEEERGVVEETAAAAEISCCVCMVRSKGAAFIPCGHTFCXLCSRELWVQRGNCPLCNTSISEILDLF

SEQ ID NO: 2356 - protein, 878 aa, Clostridium perfringens str. 13
MNYLEVKKDIYWVGSLDPELRVFDIIMYTPYGTTYNSYVVKGSEKIAVFETVKEKCFDDYLSKLNSLGIDPKSIDYIVVDHTEPDHAGSVEKLLELSPKAKVIGSMQAIEFLKDIVNKDFEYIVVGDNDTISLGNKTLQFISAPFLHWPDSMYTYIPEDKALITCDSFGSHYSCEEVFNDLVPNEEEYLDALRYYYDCIFGPYKPYVLKAIDKIKDLDIELVCPGHGPILRQDPWKIINTYKEWSTPVKPKINGDKKVTIPYVSAYGYTKELAEEIAKGIQSEHNVEVKLYDLTYSKQEDVLADIGESDGILFGSPTIVGELLPPIRILLANLNPIIHGGKYAAAFGSFGWSGEAVPRIEARLKELKMNIFGPGLRIKFKPSTTELKEAFEFGRDFSRTMFGEKELDYAPNNATETKEVLTGNGKTRYWKCLVCGEIFESPVCPEVCPVCGAGKEQFIEVEMDTFEKNDTNDNFVIIGNGAAGFYAAKTIREINSTASVKLLSSEEVSSYSRPNLSDLLNEEMNLDTFYLAKSSWYKENNIEELLGVTVTSIDKDAKKVILKDGTEIPYTKLILANGSHNFIPPFRIKNNDEEVTLNCENIHEFKGIYSIKDLKDTFDVKEEMKEAKKAVVIGAGPLGLEAAWEMKLAGLDVTVVEFLPNLMNNQLDQEGADIFKNQVSDCGITFITSDECTEIITKDSKLTSLNLKSGKTLDADILLVSTGIRSNIELAKESGIECNRGVIVNERMETSVKDIYACGDVAEFNGLVYGNWPAAIEMGKTAGANACEAEKAFENFTPSIILDALNTHVFSAGLIRFNDSSYEKISSKDESKGQYTKLFFKDNILVGGIIVGDISKAGQIIIAIDNKLSKAAALSNDLL

SEQ ID NO: 2357 - protein, 162 aa, Triticum aestivum
CRAIMVARQGPELQRYSASRGGRMVVGSIPYRVRDDNGEVEVLVICSRKKGASAGVLFPKGGWELDESMDEAARREALEEAGVRGETGPSLGRWCYQSRSYEATYEGYMFPLRVTDELERWPEMSGRGRTWVTVQDAMDRCPHLWMREALQRFADRVADAAL

SEQ ID NO: 2358 - protein, 230 aa, Triticum aestivum
  misc_feature (193)..(193): Xaa can be any naturally occurring amino acid
  misc_feature (214)..(214): Xaa can be any naturally occurring amino acid
  unsure (1)..(230): unsure at all Xaa locations
MVLTTLLLLGLLVGLAGSSPPPATVVCAHGTFDCTVSNAYGSFPDRTVCRAANATFPRTEKELVAAVAAAAAAKRKVKVATKHYHSFPKLACPGGSDGTIISTERLNRVVSIDVAKGLMTVESGMVLRDLIKKAAAKGFALPHSTYWSGLTIGGLLATGAHGSSLWGKGGAVHEYVVGMRIVTPAPASPGFAXVVRELSADDPGLDAGKVSLGXVLGVVSPVTLALRAMF

SEQ ID NO: 2359 - protein, 327 aa, Oryza sativa (indica cultivar-group)
MGPNVSSEKKALAAAKRRAYVTFLAGDGDYWKGVVGLAKGLRRVRSAYPLVVAVLPDVPGEHRRKLVEQGCVVREIQPVYPPQSQTQFAMAYYVINYSKLRIWEFVEYERMVYLDADIQVFDNIDHLFDLDKGAFYAVKDCFCEKTWSHTPQYDIGYCQQRPDEVAWPERELGPPPPLYFNAGMFVHEPGLGTAKDLLDALVVTPPTPFAEQDFLNMFFREQYKPIPNVYNLVLAMLWRHPENVDLDQVKVVHYCAAGSKPWRFTGKEENMNREDIKMLVKRWWDIYNDESLDYKEEEDNADEASQPMRTALAEAGAVKYFPAPSAA

SEQ ID NO: 2360 - protein, 386 aa, Magnaporthe grisea 70-15
MASSFPPEPVSTIDWSNVGFKIREVNGHIESHYSVQTGEWSPLKWVEDPYIRIHGMAPALNYGVQAYEGLKAFRGPGDKTIQIFRPDRNATRLQHSASFICIPPVPVQLFMDAVTAAVARNAEYVPPHETGAAMYIRPQIYGSSAQLGLNPCEEYTFAVYVVPTGVYHGTAPTKAFILDEFDRAAPNGTGSAKVGGNYAPVLKWGEKARSEGYGINLHLDSATHSEIDEFSTSGFIGAIDDGQGNITIVVPDSKNVIDSVTSESIQEIGASFGWKVEKRSIKYTELPTFSEVMAAGTAASLVPIRSITRKISSSDPKSLAATVKQHPRLEVTVDQETVTYVPSSQPEAGPICTKLLSQFKGIQLGKVKDEFGWNHMVTEADTKKAA

SEQ ID NO: 2361 - protein, 591 aa, Dechloromonas aromatica RCB
MSNLVEVKVPDIGDFAEVPIIDLFVKVGDSIKVDDAICTLESDKATMDVPSPVAGVVKEVLVQLGAKVAEGSLLIKVESGAAAAAPAPQAAAPAAAPAAVPVAAPVAGSHAGGADIECEMLVLGAGPGGYSAAFRSADLGMKTVIVERYATLGGVCLNVGCIPSKALLHVAAVMEEAEHANDLGVTFAAPTVDIDKLRAHKDKVVGKLTGGLAGMAKGRKVEIVRGYGTFIDPHHIEVEVTDGTGQDKTGAKKIVKFQKCIIAAGSAAMHLPFIPKDPRIVDSTGALELRFVPEKMLVIGGGIIGLEMATVYSTLGAKVDVVEMMDGLMQGPDRDAVKVWEKQNAKRFDKIMLKTKTVAVDAKDDGLYVKFEGEGVSPEPVKYDMILQAAGRTPNGNKIGADKAGVAVTERGFINVDAQMRTNVPHIFAIGDLVGQPMLAHKAVHESHVAAEAAAGQKSAFDASVIPSVAYTHPEVAWVGVTEDQAKKDGRKIEAAKFPWAASGRAIANGADYGFTKLIFDAETHRVIGGAIVGPNAGDMIGEVCLAIEMGCDSVDIGKTIHPHPTLGETVGMAAEVAHGTCTDVPAPRKK

SEQ ID NO: 2362 - protein, 250 aa, Roseovarius nubinhibens ISM
MTKTAIVTGAARGIGLATTELLLEDGWQVAMVDWDADELARATEGRERILALPLDVSKPDQVAEIMTRTKEAFGGIDALINNAGVADFGPIEETDFARWRRVMETNLDGVFLMTQAATPMLRASGQGAIVNIASISGLRASTLRVAYGTSKAGVIQLTQQQAVELGEYGIRANCVAPGPVRTKLAMAVHSQEIIDAYHDAIPLNRYGSEREIAEVIAFLCSHRASYVNGQTIAVDGGFECTGVGLPALRK

SEQ ID NO: 2363 - protein, 546 aa, Dechloromonas aromatica RCB
MSQIIEVTVPDIGDFDSVPVIDLFVKVGDTIKVDDAIVTLESDKATMDVPSTVAGVVKEVLVSLGSKVGEGALLIKVETGGAAAEPAAAPAPAAQAAAPAPAPAAAPVAAAPAAGGGVVEVKVPDIGDFAEVPVIELYVKVGDAIKVDDAIATLESDKATMDVPSTVAGTVKEVLVQIGSKVGEGTVLIKVESGASAPAAAPQAAAPAPAAAAPAPVAAPVAAPAAASPAALAPALAAGSKVHASPSVRAYARELGVDLNKVPATGPKNRIVKEDLTKYVKGVMSGAVAGPTAGGGASLGGGLDLLPWPKVDFAKFGEIEVKPLSRIKKISGQNLSRNWVMIPAVTYHEDADITDIEAFRVLLNKENEKGGGAKLTMLAFLMKACVKGLQKFPEFNSSLDGDNLVLKKYFNIGFAADTPNGLVVPVVKNVDKKSVFELAQESGDLAKQARDGKLKPADMSGACFTISSLGGIGGTYFAPIVNAPEVAILGVNKSAMKPVWDGKQFVPRLVLPLSLTADHRVIDGALATRFNVYIAQLLADFRRVAL

SEQ ID NO: 2364 - protein, 891 aa, Dechloromonas aromatica RCB
MAEQPNALPDPADVDPQETKEWMDALDGVINQEGPTRAHYLIEKVIGQARLQGVDIPYSANTEYINTIPAHQQPKYPGNADMEIKIHSYIRWNAMAMVVRANKDTNVGGHIASFASAAALYDVGFSHFWRSINDPSGGDLIFFQGHSVPGVYSRAFMLGRLTAEQMDNFRQETDGKGISSYPHPWLMPDFWQFPTVSMGLGPIQAIYQARFMKYLDSRGLAKAGDRKVWAFLGDGETDEVESLGAIGMAGREKLDNLIFVINCNLQRLDGPVRGNGKIIQELESEFRGSGWNVIKLIWGTQWDTLFQRDKKGIMKQRMMELCDGEYQTFKAKNGAYVREHFFNTPELKELVADWTDDQVWQLNRGGHDIFKIFAAYNAAVTHKGQPTLILAKTIKGFGMGQAGEAMNISHQQKKMDIEQIGRFRDRFGLPVPDDKLYELPYLKFAEDSEEYKYMLQRRMDLGGFLPQRRRKAEPLQIPALDTFAALLKASGEGRELSTTMAIVRIMNMMLKDKNVGKNVVPIVPDESRTFGMEGMFRSVGIWNQEGQNYVPEDHDQLMFYKESKTGQVLQEGINESGAMSDWIAAATSYSVHNVQTIPFYICYSMFGMQRVLDLCWAAGDQRARGFLIGGTAGRTTLNGEGLQHEDGHSLILSNLIPNCVSYDPTFQYEVAVVAQDGMRRMFQEQEDVFYYLTVMNENYEHPEMPVGAEADIIKGMYLFKKGADSAAPRVQLLGSGTIFREVIAAADLLKQDWGVEADLWGCTSMNELARNGQDVQRWNMLHPLEAPKLSHVEEKLAGAKGPVIASTDYIKLFSEQIRPFVKAPYVTLGTDGFGRSDTREKLRHHFEVDRHWVTLAALKALADNGEVKREVVAAALVKYNLDPNKPNPLSV

SEQ ID NO: 2365 - protein, 398 aa, Xanthobacter autotrophicus Py2
MSLLSSPSARPARSLNPLYAELPTTIFEVMSQLARTHEAVNLGQGFPDDPGPEDVRRKAADAVVNGWNQYPPMMGLPELRAAAAAHYRHWQELELDPDAEVMVTSGATEALAGALLALIEPGDEVVLFQPLYDAYLPLVKRAGGIPRLVRLEPPSWSITREALTAAFSERTKLVLFNNPQNPTGVVYSRADLALLAEFCVAFDAYAVCDEVWEHVIFDGVAFTSLMALPGMRERTVKISSAGKIFGMTGWKVGLVFAAPPLMKVLSKAHQFLTFTTPPNLQVAVAYGLGKADDYFTGMRADLQRSRDRLAQGLAGLGFSVLPSAGTYFLSIDLAAHTNAADDEAFCLDLVRTHGVATIPVSAFYAQDAVKSVVRFCFAKRDETIDRALERLAKVPLLR

SEQ ID NO: 2366 - protein, 595 aa, Cochliobolus lunatus
GAGKTTLLDVLAQRKTAGTIKGEILVDGRPLPVSFQRSAGYCEQLDVHDAYSTVREALEFSALLRQSRDTPVEEKLAYVDTIIDLLELHDLENTLIGTVGAGLSVEQRKRVTIGVELVSKPSILIFLDEPTSGLDGQAAFNTVRFLRKLADVGQAVLVTIHQPSALLFAQFDVLLLLASGGKTVYFGEIGENAEKIKEYFGRYDAPCPISANPAEHMIDVVSGHHPSGKDWHEVWLSSPESAALNQHLEEIISDAASKEPGTKDDGYEFATTFWTQTKLVLHRMNVGFFRDTAYFNNKLLLHGGVAFFIGFTFWQIGNSVGEQKYILFSIFQYIFVAPGVIAQLQPIFLERRDVYETREKKSKMYSWQAFVTALIVSEMPYLVICAVLYYVVFYFASGLPTDASSAGAVFFVFLIYQFIYTGFGQFVAAYAPNAVFASLVNPLLLAVLCCFCGVLIPYDNIQEFWRYWIYYLDPFKYLIGSLLVFTDWDWKIECKDSEFAIFNPPGGGNQTCGEYLEAWLSGPGSRTNLVNPDATSDCRVCQYTWGRDYLATVNLTEKYFGWRDAGICVIFSLSGYALVYLLMKLRTKASKKAEQ

SEQ ID NO: 2367 - protein, 529 aa, Oryza sativa (japonica cultivar-group)
MQFSSVFPLEGKACVSPIRRGGEGSASDRLKIGDSSSIKHDRAVRRMCLGYRGTKNGAQCVLTSDAGPDTLHVRTSFRRNFADPNEVAAVILGGGTGTQLFPLTSTRATPAVPIGGCYRLIDIPMSNCFNSGINKIFIMTQFNSASLNRHIHRTYLGGGINFTDGSVEVLAATQMPGEAAGWFQGTADAVRKFIWVLEDYYKHKAIEHILILSGDQLYRMDYMELVQKHVDDNADITLSCAPVGESRASDYGLVKFDSSGRVIQFSEKPKGTDLEAMKVDTSFLNFAIDDPTKFPYIASMGVYVFKRDVLLNLLKSRYAELHDFGSEILPRALHEHNVQVKVFKLEHYYAYVFADYWEDIGTIRSFFDANMALCEQPPKFEFYDPKTPFFTSPRYLPPTKSDKCRIKDAIISHGCFLRECTIEHSIVGVRSRLNSACELKNTMMMGADLYETEDEISRLLSEGKVPIGVGENTKINNCIIDMNARVGRNVVITNSEGVQESDRPEEGYYIRSGIVVILKNATIKDGKVI

SEQ ID NO: 2368 - protein, 300 aa, Burkholderia xenovorans LB400
MQVNWKGVFPAVTTKLKDDGSLDHEAIKSGLNRLIENGVGGVVMMGMVGENAQLTADEKRTVLKLAVETVAGRVPVISGLAETSTALAVQFVQDAEAIGVQGLMVFPGLTYRSDDRETVEFYRTIARSTRLGLMIYNNPRGYGVDMRPDLMDQLKDEANVVAIKEETYDTTRVTDLLKRFGDRFAVFCGVDDLVLESAALGVTGWVSGMANAMPKESVELLNLAVAGDFVKARELYRALIDLFHLDVHVKLVQYIKLAENMTAGYPENVKAPRLKLEGEERQKVVAIVEQAIANVRALSN

SEQ ID NO: 2369 - protein, 518 aa, Oryza sativa
MRTSTDPSGSIESFHGLVHLRTAAPLLAAAVALYMLIEQLSYHRKKGSMPGAPIVLQEFGTSAHMIRDPTGFWDAQAARARKSGAGLAADFLIGRFVVFIRDSELSHRVFANVRPDAFHLIGHPFGKKLFGDHNLIYMFGEDHKDLRRRIAPNFTPRALSTYAAIQQRVILSHLRRWLDRSAANGGKAEPIRVPCRDMNLETSQTVFAGPYLTKEAREKFERDYNFFNVGLMALPVDLPGFAFRSARLGVARLVRTLGECARASKARMRAGGEPECLVDFWMQETVREIDEAKAAGKPPPAHTDDEELGGFLFDFLFAAQDASTSSLCWAVSALDSHPDVLAGVRAEVASLWSPESGEPITAEKIAEMKYTQAVAREVVRHRPPATLVPHIAGEEFQLTEWYTIPKGTIVFPSVYESSFQGFPEPDTFDPERFFSEARREDVVYKRNFLAFGAGPHQCVGQRYALNHLVLFMALFVSVVDFRRDRTEGCDEPVYMPTIVPRDSCTVYLKQRCAKFPSF

SEQ ID NO: 2370 - protein, 125 aa, Beta vulgaris
  misc_feature (65)..(65): Xaa can be any naturally occurring amino acid
  misc_feature (68)..(68): Xaa can be any naturally occurring amino acid
  misc_feature (84)..(84): Xaa can be any naturally occurring amino acid
  misc_feature (92)..(92): Xaa can be any naturally occurring amino acid
  misc_feature (99)..(100): Xaa can be any naturally occurring amino acid
  misc_feature (111)..(112): Xaa can be any naturally occurring amino acid
  misc_feature (115)..(116): Xaa can be any naturally occurring amino acid
  misc_feature (118)..(119): Xaa can be any naturally occurring amino acid
  misc_feature (121)..(121): Xaa can be any naturally occurring amino acid
  misc_feature (123)..(124): Xaa can be any naturally occurring amino acid
  unsure (1)..(125): unsure at all Xaa locations
QKRARFRCSYPYITPTLKEDMAYEESIAALKRLLIENGELENEAAAKVAQITAELRTGDSKPVAXGPXERIKQGFIHFKREKYXKNPGIIWXTSQGPKXXFYGVYMLQTPXXVPXXVXXFXNXXR

SEQ ID NO: 2371 - protein, 308 aa, Xylella fastidiosa 9a5c
MSLDSALRSRIETLLHSNRVVLFMKGRPGMPQCGFSAKAAGILQALGVEYAHVNVLDDQEIREGIKRYGDWPTIPQLYIDGELIGGSDIVSQMYENGELSALLGVAAPDLTPPSITITPTAVEMLKSTLANAPGSALALSIDSRFQPTFELTPINTQAIAAESNGLRVQFDLASARRAEGITIDWVDDIRGQGLVIDNPNAPQPIQELSPGDAAAQVGAGALTLVDVRPADERAIASVAVPFRTMDGGERAALEQLPKETPLAFLCHHGGRSLQAAEHFRSLGFTSIYNIGGGIDAWSIQVDASVPKY

SEQ ID NO: 2372 - protein, 191 aa, Triticum aestivum
  misc_feature (12)..(12): Xaa can be any naturally occurring amino acid
  unsure (1)..(191): unsure at all Xaa locations
STSWNVGENPQXLVPIANGTEEMEAVMIIDILRRAKANVVVASLEGTLEIVASRNVKMVADVLLDDALKQQYDLILLPGGLGGAQAYAKSDKLIGLIKKQAEASKLYGAICASPAIALEPHGLLKGKKATSYPAMWSKLADQSECENRVVVDGNMITSQGPGTSMEFSLAIVEKLFGRERAFELAKSMVFV

SEQ ID NO: 2373 - protein, 449 aa, Listeria monocytogenes str. 4b H7858
MEKHYDYIAIGGGSGGIASINRAAMHGAKCALIEPKFLGGTCVNVGCVPKKVMWYGAQIKEAMDLYADAYGYQVDASFNFQKLVENREAYIERIRGSYKNGLDNNKVEWIKGYAEFVDEKTLRVNGELVTADHILIATGGEPALPSIPGAEFGITSDGFFALKELPKKVAVVGAGYIAVELAGVLQQLGSETHLFVRKHAPLRNFDPLLTDTLTEIIEQSDMTLHKHAVPQKVEKNPDGSLTLSLEDGRTETVDTLIWAIGRKPVIQGLQIEKAGVKLLESGHIAVDKFQNTNVAGIYAVGDVTGHYELTPVAIAAGRRLSERLFNNKKDAHLNYENIPTVVFSHPAIGTVGLTEPEAIEKYGKENIKVYTSSFTSMYTAITDHREPCRMKLICEGKTERVIGLHGIGYGVDEMIQGFAVAINMGATKADFDNTVAIHPTGSEEFVTMK

SEQ ID NO: 2374 - protein, 119 aa, Brassica napus
  misc_feature (111)..(111): Xaa can be any naturally occurring amino acid
  unsure (1)..(119): unsure at all Xaa locations
DLLLIAYFHLQILRGTAPFNNPRWQTPNNLESKFSRVGDNYRSIDEVASALPHAGLESSNLIVGIDVTKRNEVKSFGRKSLHYIGTINPYQQAISIIGKTSSVFNQDNLIXCYGFRYGK

SEQ ID NO: 2375 - protein, 414 aa, Aquifex aeolicus VF5
MIEDPMDWAFPRIKRLPQYVFSLVNELKYKLRREGEDVVDLGMGNPNMPPAKHIIDKLCEVAQKPNVHGYSASRGIPRLRKAICNFYEERYGVKLDPEREAILTIGAKEGYSHLMLAMISPGDTVIVPNPTYPIHYYAPIIAGGEVHSIPLNFSDDQDHQEEFLRRLYEIVKTAMPKPKAVVISFPHNPTTITVEKDFFKEIVKFAKEHGLWIIHDFAYADIAFDGYKPPSILEIEGAKDVAVELYSMSKGFSMAGWRVAFVVGNEILIKNLAHLKSYLDYGIFTPIQVASIIALESPYEIVEKTAKVYQKRRDVLVEGLNRLGWKVKKPKATMFVWAKIPEWINMNSLDFSLFLLKEAKVAVSPGVGFGQYGEGYVRFALVENEHRIRQAIRGIRKAFRKLQKERKLEPERSA

SEQ ID NO: 2376 - protein, 277 aa, Triticum aestivum
  misc_feature (77)..(77): Xaa can be any naturally occurring amino acid
  misc_feature (114)..(114): Xaa can be any naturally occurring amino acid
  misc_feature (167)..(167): Xaa can be any naturally occurring amino acid
  unsure (1)..(277): unsure at all Xaa locations
RGKVLSRPDLGTRREEGFINEVAPIGLIHHANIVRLLGLCSEGLRRALIYDFMPNGSLEKYIFAHVSDISRQLLAPXKMLDIALGIARGMEYLHQGCNQRILHFDIKPHNILLXDYNFNPKISDFGLAKLCSRDQSIVTLTATRGIMGYIAPELYSRNFGGVSYKSXGVYSFGMLVLEMVSGRRNSGPRSRSQDDVYLPEWIYEKVVNGEELALTLETTEEEKEKVRQLAIVALWCIQWNPRNRPSMTKVVNMLTGRLQSLQMPPKPFVSSENELMP

SEQ ID NO: 2377 - protein, 47 aa, Triticum aestivum
  misc_feature (6)..(8): Xaa can be any naturally occurring amino acid
  misc_feature (15)..(15): Xaa can be any naturally occurring amino acid
  misc_feature (35)..(35): Xaa can be any naturally occurring amino acid
  misc_feature (41)..(42): Xaa can be any naturally occurring amino acid
  unsure (1)..(47): unsure at all Xaa locations
PVMERXXXRMRKGGXFVFAQVKHGVGVEEIVDHVXRAWEIXXGNRRR

SEQ ID NO: 2378 - protein, 557 aa, Aquifex aeolicus VF5
MPKRTDIKKILIIGSGPIVIGQAAEFDYSGTQACKALKQEGYEVILVNSNPATIMTDPEMADKTYIEPLTADILEEIIKKERPDALLPTLGGQTGLNLAVELYENGVLERYGVELIGANYEAIKKGEDRELFKETMESIGLKVPESAVVRSVEEGLKAVEKIGFPVILRPAFTLGGTGSSVAYNVEEFKEKLKVALETSPIHEVLLDKSLIGWKEIEFEVVRDKADNVIIVCAIENFDPMGVHTGDSITVAPTQTLTDKEYQMLRDAAIAVIRAIGVDTGGSNIQFALSPESGDFYVIEMNPRVSRSSALASKATGFPIAKVAAKLAVGYTLDELKNDITKFTPASFEPSIDYVVVKIPRFDFAKFPEADRTLTTMMKSVGEVMAIGRTFKEALLKAVRSLELDRYGLAFPKLTNVDKVELERNLINPNDQRLWYIAEAFRRGYSVDEVYELTKIDRWFLYNIEEIVKFEEVLRKEELTPEILRQAKEMGYSDWEIAKIKGITEEEVRKLRKEEGIVPTFKGVDTCAGEFVAYTPYYYSSYERPYYTVDGQEILDED

SEQ ID NO: 2379 - protein, 489 aa, Cryptococcus neoformans var. neoformans B-3501A
MGKRTADAADLPVSKAAATGQATAREPAADDEMGEFEDRWEDEIESEEEVVEHDADGEADGKSCSEDAEPAAAPTQTYLPGTAIAEDEQLVPDNSVYLALHSLSYAWPCLSFDVLRDSLGTDRATYPHTSWIVTGTQAGEVPGEGKAKDEVVIMRLGNLSKTQHDDDDDSDDGKDDDDDEADDEDATLDFLTIPHVGSVNRVRAAPAPVGGAVPDPYHVATFSETGKVHIFDVRPYIDTLAGPSRPRQKLPVHTISNHGRAEGFAVEWGATGLLTGDIDRKIYLTTLTPSGFTTSPNPYLSHTSSVEDLQWSPTEPTVFASASADRTVRVWDVRAKGRRSVVSVEAHSEDVNVISWNKTVDYLLVSGGDEGGLKVWDLRMFKDTPSPVAQFQWHTAPITSVEWHPTDSSVFAASGSDDQLTLWDLSVEPDEDEAPIGPADGNITAVPPQLLFVHQGQKDVKELHWHPQIPGMVISTASDSFNVFKTISC

SEQ ID NO: 2380 - protein, 494 aa, Bacillus anthracis str. Ames
MSQLAVNLHEKVEKFLQGTKKLYVNGSFIESASGKTFNTPNPATGETLAVVSEAGREDIHKAVVAARMAFDEGPWSRMSTAERSRLMYKLADLMEEHKEELAQLETLDNGKPIRETMAADIPLAIEHMRYYAGWATKIVGQTIPVSGDFFNYTRHEAVGVVGQIIPWNFPLLMAMWKMGAALATGCTIVLKPAEQTPLSALYLAELIEEAGFPKGVINIVPGFGESAGQALVNHPLVDKIAFTGSTPVGKQIMRQASESLKRVTLELGGKSPNIILPDADLSRAIPGALSGVMFNQGQVCSAGSRLFVPKKMYDNVMADLVLYSKKLNQGVGLDPETTIGPLVSEEQQKRVMGYIEKGIEEGAEVLCGGNNPFDQGYFISPTVFADVNDEMTIAKEEIFGPVISAIPFNDIDEVIERANKSQFGLAAGVWTENVKTAHYVASKVRAGTVWVNCYNVFDAASPFGGFKQSGLGREMGSYALNNYTEVKSVWLNLN

SEQ ID NO: 2381 - protein, 174 aa, Mycobacterium sp. JLS
MPKLWDAVAGFAVTFGTLFKKPITEEYPEKPGPVAPRYHGRHQLNRYPDGLEKCIGCELCAWACPADAIYVEGDDNTADERYSPGERYGRVYQINYLRCIGCGLCIEACPTRALTMTNDYEMADDNRADLIWGKDKLLAPLQDGMLAPPHPMAPGATDDDYYLGRIGPVTEDVR

SEQ ID NO: 2382 - protein, 141 aa, Bacillus anthracis str. Ames
METILHNDPLMAAVISWFLAQFTKVIFKLVKTGEFDFAKFFASGGMPSSHASTVTALATGVGVVEGVESTLFAIAAIFAIIVMYDASGVRLAVSKQAKILNEFFHGRQTEYKKLNELVGHTPYEVVVGALLGIIVGVGYCL

SEQ ID NO: 2383 - protein, 263 aa, Mycobacterium sp. CH-1
MSAVKAGDRRVAIVTAAAAGIGKAIALRWCREGGCCVMADTDGEGLDAAVAELAESGAAVCGVAGDVCLSDVANSVVERALTEFGRLDTLFNVVGGSLARNVEEISEEQWRSQIDMNLGSVFQMSKPVIPLLRQGGGGSIVNVASTAGILAENRCSAYSASKGGVVLLTKNMALDFARDNIRVNAIAPGGTRTPRIERFLAEHPEHASMMVDLCAMQRFAGPDEIAAPAVFLASPEASYITGAVLPVDGGMTAGVTFRAFEAV

SEQ ID NO: 2384 - protein, 442 aa, Brassica oleracea
MYGGDEVSAIVVDLGSHTCKAGYAGEDAPKAVFPSVVGAVDGVEAMDVDADSAKNNSNSEDSKTNESDKEKGKRKLYVGSQALNYRRDHMEILSPIKDGIVSDWDLVDNIWEHAFRGCLMIDPKEHPMLLAEPPLNTQQQREKAAELMFEKYKVPALFMAKNPVLTSFATGRATSLVVDCGGGSTTISPVHEGYVLQKAVVSAPIGGEFLTDCLLKSLESKGIKIRPRYSFKRKEVRPGEFQVEDVGVPDTTESYKLFCQRMIVGDIKDSICRVPDTPYDDKSYANIPTTSYELPDGQTLEIGADRFKIPDVMFNPSIVQTIPGMEKYGDMIPTVRGLPHMVMESINKCDVDIRRELYSSILLAGGTSSMQQLKERLEKDLIEESPHSARVKVLASGNTTERRFSVWIGGSILASLGSFQQMWFSKSEYEEHGASYIQRKCP

SEQ ID NO: 2385 - protein, 491 aa, Listeria monocytogenes str. 4b H7858
MVFLSIKETALPKVQTKLFINGKWTDGDNKETKDIVNPANGEVIAKIAQAGPNETKKAIKAAKEAFPDWAKMELADRVKLLHKIADLMEEKADTLAKIMTLEQGKPLKESKGEVLTGAENFRFAAEEARRLYGETIPAPNNHAFIVKKQPIGVVAAITPWNFPGGMVTRKLAPALATGNTIVLKPSGDTPLSALAIFEIFEEAGLPKGVANIVMGSSKEIGETLTDSDDVRKLTFTGSTKVGQTLFKQSAETLKKISLELGGHAPFIVFDDANLDAAVNDLVAAKFRNNGQVCVSPNRIFVAKEIKEKFTKALVAKVKQLKVGNGLDDVNVGPLIREDAIDKIDKQLKNATDKGAKVLTGGGRLTGSDYDKGNFYKPTVLDNVTREMDIFYEETFGPVIPLITFETEDEAIEMANDSEFGLASYFYTKDLARVEKVGAALEYGMVGANEIVISNPETPFGGVKHSGFGRENGHYGMEEYIQVKFINLKYRD

SEQ ID NO: 2386 - protein, 164 aa, Glycine max
  misc_feature (68)..(68): Xaa can be any naturally occurring amino acid
  misc_feature (109)..(109): Xaa can be any naturally occurring amino acid
  misc_feature (116)..(116): Xaa can be any naturally occurring amino acid
  misc_feature (125)..(125): Xaa can be any naturally occurring amino acid
  misc_feature (133)..(133): Xaa can be any naturally occurring amino acid
  misc_feature (135)..(135): Xaa can be any naturally occurring amino acid
  unsure (1)..(164): unsure at all Xaa locations
VYRASVCMVGPFTGLKSMAGLPTKKTNYDITFIALNCGILQCMRVCPPDGKKKFETLCYLPHLDDAQXAKEVQYLLRKGWIPCLQFQLDHGFVYREHNRSPRYYDGRYXTMWDLPXFGCTDAYQXVKELQEAXTXYPNCFIRIIRFDHLSPSPCINFIAFKSPS

SEQ ID NO: 2387 - protein, 814 aa, Xanthobacter autotrophicus Py2
MQKLVVIGAGMASGRVLEHLFETDPDAYQVTLFNAEPRGNYNRIMLSPVLSGEKSYEEIVIHDDAWYVRHNVICRFGERVLEVDRARKVVVGPKGEIAYDKLLIATGSVPFIVPVDGHKLPGVISYRDLDDTNAMVEAAGVPGARAVVIGGGLLGLEAAAGLRLRGMEVTVVHLAGHLMERQLDEAAGYLLSKDLERRGIAVITRASTKAIVGTERVEGVQLEDGTLLPADLVVMAVGIRPAADLAKQSGLDVGRAVRVNAQMQTSDPDIYAVGECVEFEGTLFGLVAPLYDQAKVVAKSLLGEADAFAVKELSTKLKVTGCDLFSAGSFADGAGREDIVLRDPARGIYKRLVIEDDRLVGAVMYGDTSDSNWFFGLIRDGVKIADMRDTLIFGPSFQGGTPLDPMAAVAALPDEAEICGCNGVCKGTITAAIAAKGLTSLDDVRAHTKASASCGSCTGLVEQIMQISLGDSYTAAAVQPICSCTTLGHDDVRRLIKAKSLKTIPQVMQELEWKTSCGCAKCRPALNYYLVCDWPDEYADDYQSRFVNERIHANIQKDGTYSVVPRMWGGVTSSSELRAIADVVDKFAIPAVKVTGGQRIDMLGIKKEDLPAVWADLGKAGFVSGQAYAKGLRTVKTCVGTDWCRFGTQDSTGLGIRIEKFMWGSWTPAKLKMAVSGCPRNCAEATCKDIGVICVDSGYEIHFAGAAGLDIKGTEVLGLVKSEDEALEHIVALTQMYREQGRYLERIYKWAKRIGLAEIRQQIMEDHDKRRAYYDRFVFSQKFAQVDPWSERVSGKDKHEFRPMAELDITQAAE

SEQ ID NO: 2388 - protein, 897 aa, Xanthobacter autotrophicus Py2
MATGAAHDVKTTCPYCGVGCGVIATVTPDGSVSVSGDPEHPANFGRLCSKGSALAETIDLDGRLLRPHIDGRPADWDEALDLVAARFASTIAEHGPDSVAFYVSGQLLTEDYYVANKLMKGFIGSANIDTNSRLCMASSVAGHRRAFGTDTVPGNYEDLELADLIVLVGSNLAWCHPVLYQRIAAEKERRPSLKIVVIDPRRTMTADIADMHLAISPDGDVALFGGLLSWIANTGALNYSYISNFTTGAAQALRFGAQDLRAVSRKCGIAPSQLIEFYSLFTRTERTVTVYSQGVNQSETGTDKVNAIINCHLATGRIGKPGASPFSVTGQPNAMGGREVGGMANMLAAHMDIENETHRARVQRFWQAPTVATRPGRKAVEMFEAIGQGHIKAVWIAGTNPVDSMPEADRVRAALAACPFVVVSDVLADTDTTRVAHVLLPAAAWGEKDGTVTNSERRISRQRPFLPLPGSARPDWDIMADVARRMGFAEGFSYTTAAEVFAEHAALSAFENDGERDFDIGAHAGIDAVGYEALAPFQWPQRRGAVTGTERFFAAGGFFTPEGKGRFVAPREARAGTGPLARLPAQEPTDQGFILNTGRVRDHWHTMTRTGKSPRLSQHMAEPFVEIHPDDAVQSGIAEASLVRLSKGPAQAIARALITNRQRRGSVFVPMHWNDRFASNARIDALVDAVTDPVSGQPALKQARASLASFNAAAYGFAVVARKPADIPADYWAIARCTGGWRLELAFGQAKDDWHAFALRLFGGGEHVDILAYNDVGAGRYRIAAFDGAALLGALFIAPQPVGVARGWLVEQLATSHDLQRQRLAVLATRPSAGQSDKGAIVCSCFGVGSNEIAAAIASGCRTVKAVGDATQAGTNCGSCRAEIKGIIDAKHLQAAE

SEQ ID NO: 2389 - protein, 604 aa, Triticum aestivum
  misc_feature (151)..(151): Xaa can be any naturally occurring amino acid
  misc_feature (432)..(432): Xaa can be any naturally occurring amino acid
  misc_feature (452)..(452): Xaa can be any naturally occurring amino acid
  misc_feature (484)..(484): Xaa can be any naturally occurring amino acid
  misc_feature (502)..(502): Xaa can be any naturally occurring amino acid
  unsure (1)..(604): unsure at all Xaa locations
MVGLLPQTNAAAQAEVLGDAWDYRGRPAARSTTGRWGAAAMILVAELNERLTTLGIAVNLVTYLTATMHVGNAEAANVVTNFMGTSFMLCLLGGFVADSFLGRYLTIAIFTAIQASGVTILTISTAAPGLRPPACTAEGGGIGTCSRASGXQLGVLYLALYLTALGTGGLKSSVSGFGSDQFDESDRTEKSQMMRFFNWFFFFISLGSLLAVTVLVDVQDNLGRPWGYGACAASIAVGLVVFLAGTRRYRFKKLAGSPLTQIAAVVVAAWRKRGVQLPTDTSMLYDIDVGKVAAIEGASTKKSKLKERIPHTKQFRFLDHAAINSDPAGEPTKWQLATLTDVEEVKTVARMLPIWATTIMFWTVYAQMTTFSVSQATTMDRHIGPSFQIPAGSLTVFFVGSILLTVPIYDRIVVPVSRRLNGNPHGLTPLHXIGIGLVLSILAMTSAALVEXHNAPSVARDSAVPAGAPVPMTVFWLIPQFFCXGAGEAFTYIGQLDFFLRXCPKGMKTMSTGLFLSTLSLGFFVSSALVTVVHKITGDRRPWIADDLNKGELYKFYWLLAGVCLANLVVYLFAARWYKYKAGRPGADGSVNGVEMADAEPCLH

SEQ ID NO: 2390 - protein, 489 aa, Synechococcus sp. RS9917
MAGRFSQQHQRVRPSSKEDQVVQKAREHFERTLVPVAGSLAGSVAALEHPSLDGALNYGEIFLRDNVPVMVYLLTQRRFDVVRQFLSVCLDLQSTTYQTRGVFPTSFVEENQELIADYGQRSIGRITSVDASLWWPVLCWLYVKHSGDHAFGSSQKVQRGIQLLLDLVLHPTFEGTPVLFVPDCAFMIDRPMDVWGAPLEVEVLLFGSLRSCIQLMELSRSQHNSRLLDQRLVLTRQWVHDLRRFLLKHYWVTSKTMQVLRRRPTEQYGENQHQNEFNVQPQVIPDWLQDWLENRGGYLIGNMRTGRPDFRFYSLGNSLGCLFGLLTSPQQRALFRLVLHNRDHLMAQMPMRICHPPMDGLEWQNKTGSDPKNWPWSYHNGGHWPSLLWFFGASILLHERRNPHADVLLMGQMKALLEESYWSHLNQLPRQQWAEYFDGPTGTWVGQQSRTYQTWTIVGFLLLHHFLRVNPDDVELLDLDELQPSTAQP

SEQ ID NO: 2391 - protein, 157 aa, Triticum aestivum
  misc_feature (29)..(29): Xaa can be any naturally occurring amino acid
  misc_feature (37)..(37): Xaa can be any naturally occurring amino acid
  unsure (1)..(157): unsure at all Xaa locations
MLPAAMAAGLACRPSSPHLTWGVRQAHSXFLTFATSXPMQSAAAAALRAPDSYFEELKRDYGVKKALLVDGLKAAGFIVYPSSGTYFVMVDHTPFGFDNDIEFCEYLIREVGVVAIPPSVFYLNPEDGKNLVRFTFCKDDGTLRAAVDRMKAKLRKK

SEQ ID NO: 2392 - protein, 555 aa, Candidatus Desulfococcus oleovorans Hxd3
MDIIKGFPATSQDNYQLNVTTIIQHAARSFGQQEIVSRRLDGSMFKYTYSQAHERMKRLANGLRSIGVQVGDRVGVLAWNSHENYEIYFGLPGTGAVMLLLNLRLTPQDLAYVIDHSGATCIIVDETLLPIAHAVAPLCKNLKAFVIITLPGKKLADVETSLENIYSYEDLIAESAPDFEWPHMDETSAYAACYTTGTTGKPKGVYYSHRDVYLHSCSIGINAEISTTDTYCQIVPMFHALGWGLSQAATMVGARLVFPGMYTLDKLEGLCKIIVDEKVNVSAGAPAIFMPLLEYIRGLDKKPDLAGARLLSGASEPPVAMMKGFWDLTGAEIIHAYGATETTPLVTTNRIMPWLADKLTEDQKWELKKKQGFTVVGLDIKVVNALDEEVPCDGKTPGEILIRGPWITARYHNAPETEAQFTKDGYWRSGDVGTIDEYGYLKITDRVKDVIKSGGEWISSVDMENEIVSFPAVLEAAVVGITHPKWEERPLALVVLREGEKERITADDIRNHLAKTFARWQLPDEVLFVDQIPKTSVGKLNKKEIREQYKEMYLK

SEQ ID NO: 2393 - protein, 135 aa, Beta vulgaris
GELEDARNFGWELNEKIDFNWKKLLQKKTDEIIRLNNIYKRLLSNAGVKLYEGEGTVVGPNEVQVTQIDGTKLSYSAKHILIATGSRAQRPNIPGQELGITSDEALSLEEFPRRVVILGGGYIAVEFASIWRGMG

SEQ ID NO: 2394 - protein, 158 aa, Arabidopsis thaliana
MAGEQIKPVASGLLVLNFCMYVIVLGIGGWAMNRAIDHGFEVGPNLELPAHFSPIYFPMGNAATGFFVIFALLAGVVGAASTISGLSHIRSWTVGSLPAAATAATIAWTLTVLAMGFAWKEIELQGRNAKLRTMEAFLIILSVTQLIYIAAVHGVRRP

SEQ ID NO: 2395 - protein, 211 aa, Salicornia herbacea
MPINRIAVGTTEDARHPNTLKAGLAEFISTLIFVYAGQGSGMAFAKLTAGAANTPAGLVAAAISHGFALFVAVAVGANISGGHVNPAVTFGAFIGGNITLLNGIVYWIAQLLGSTVACLLLKFSTGGLQTSAFALCEGETVWGAFVMEIVMTFGLVYTRIRNRIGPKEGQHRDHCAPTHGFNRRCPPSLSGGAFCGPPINPLFFFGPPLVI

SEQ ID NO: 2396 - protein, 464 aa, Aspergillus oryzae
MKSPIPDYLRQVLEKARPDDSGQLANYIDVLAKADPSKMAIALSTVDGNLYSAGDDEVEFSIQSISKAFVYAIAIEDAGLPRVLEKIGVEPSGDAFNKLSLQPGTNRPMNPMINAGAIAAHTLVAGESASAEERVDHILKVLSKLAGRQLKVDEEVYEAELKDANRNMAIGYMLKAAGIISCDPQDAVRGYIRQGSITTNVRDLAMMAATLANAGVNPITGEEIMPHQSARQVLSVMTTCGMYDAAGDWVSRVGMPAKSGVAGGIIGALPGQVGIAVFSPKLDERGNSFRGVKMFEQLSSEMGLHMMDISQVGRATVRTWTLTIAGGAKQPDEREQEVPVFGLRGAVRFAGSERLTRAIVRELTPPNPDDPGSGRHADASAVIFSLKDTYSLNYVALRIISEDMRRLLAADKNVVVIDPVKVLKIDGNPAFKEKSPCVVNDEAEARRYIGGQGCRAVSHSDEFY

SEQ ID NO: 2397 - protein, 258 aa, Arabidopsis thaliana
MKSDGGEGKASWVGKDGKVYHSHDGLAPHSHEPIYSPGYFSRRAPPLHDRNFSERAFTVGIGGPVGTGKTALMLALCRFLRDKYSLAAVTNDIFTKEDGEFLVKNGALPEERIRAVETGGCPHAAIREDISINLGPLEELSNLFKADLLLCESGGDNLAANFSRELADYIIYIIDVSAGDKIPRKGGPGITQADLLVINKTDLAAAVGADLSVMERDSLRMRDGGPFVFAQVKHGLGVEEIVNHVMHSWEHATGKKRQ

SEQ ID NO: 2398 - protein, 283 aa, Kineococcus radiotolerans SRS30216
MDGMALDTTKTTGTALITGASSGIGAVYARQLAERGWGLVLVARRGDRLEQLAAALRDEHGVTVQTLTADLSQASDLTRVAARAVDVDLLVNNAGINGYGPFAQTEADLLTQVLAVNVTALTVLTRAAVPGMLTRGRGAVISVASLLAFAGSLPPDPLPHRAVYGGTKGYVVTFTRTLAAELAGSPVSVQVVCPGLTATEFHLTRGDLPVPGEEKVHDDGGMPPEDVVEASLSALRDGETMCVPGLEDPAAVEALTAAEGTLRASSRGGQIAGRYRQTGTRAD

SEQ ID NO: 2399 - protein, 85 aa, Triticum aestivum
MDVPLASKTFPSPSPSKREQCNIDGHKSSSKHADLNPHVDDSVLGIILGGGAGTRLYPLTKKRAKPAVPLGANYRLIDIPVSNCL

SEQ ID NO: 2400 - protein, 124 aa, Triticum aestivum
MAAAASPSKILIPPHRASAATAAAPTSCDSFRLLCAPRGRRQRPRGLVARSAPRRPFFFSPRAVSDSKSSQTCLDPDASTSVLGIILGGGAGTRLYPLTKKRAKPAVPLGANYRLIDIPVSNCL

SEQ ID NO: 2401 - protein, 168 aa, Rhodomonas salina
SVAAAQLMTGVLWVVPLWILGLRTAPKMTTENWMQMAPIGIFAAGAHGGSVVALGAGAVSFGQILKACEPAFSAVNEIIFLGEVQAWQVYMTLIPIIGGVAFASLKELSFSWLAVISAMLANQSAALKAVFGKSVMKQPWAKAMGPANQYGVVNIISVLATLPLVLGL

SEQ ID NO: 2402 - protein, 410 aa, Porphyra yezoensis
MAFVGSTVTGVAGARAPTSKICSSRASFAQFSGMRSVNGARMLQPVQGADANDAFFAAVSTAAVPSASTAPTMKLKVAISGFGRIGRNFLRAWAAKSDTPLEVVCINDTSGVKTACHLLKYDSILGTFAGTVEAGEDSITINGKKVRVVSNRDPLQLPWAEMGVDIVIESTGVFVDKKGASKHLTAGAKKVLITAPGKGEGIQTYVVGVNDQDYTHATDDIVSNASCTTMCMAPFVKVLEDEFGIVKGTMTTTHSYTGDQRLLDAGHRDLRRARSAALNIVPTTTGAAQAVALVIPSMKGKLNGYALRVPTPNVSVCDVVVEVKRPTFKEEVNGAFLKAAQGPMKGILKYSDEPLVSSDFKGMVESTAVDVSMTTVVGDTMVKVLAWYDNEWSYSLRVLDLAEIMANKWE

SEQ ID NO: 2403 - protein, 402 aa, Mannheimia succiniciproducens MBEL55E
MSNFDIITPDLPESVADATVVKWHKAVGDKVRRDEVLVEIETDKVVLEVPALNDGIIESIIEPEGATVVSKQLLGKAALLPVGEVTVRAETPTVAPQIEDSAVASSADTLGPAARRLIAEHDLNVNEIKGSGVSGRITREDVEAVIAQKAASVAAKSAVENTVISSPAAVRTEKRVPMTRLRKRVAERLLEVKNSTAMLTTFNEVDMQPIMQLRKKYAEKFEKQHDTRLGFMSFYVKAVVEALKRYPVINASIDGDDIVYHNYFDISIAVSTPRGLVTPVIRNCDKLSMAEIERQIKALAEKGRDGKLTVDDLTGGNFTITNGGVFGSLMSTPIINPPQAAILGMHAIKDRPVAIDGQVAIRPMMYLALSYDHRLIDGKDSVGFLVTVKELLEDPTRLLLEI

SEQ ID NO: 2404 - protein, 336 aa, Porphyra yezoensis
MVVKIGINGGGRIGRLVLRAALEKGGVEVVAINDPFIALDYMAYMFKYDSTHGPYKGKVEVVDGKLVIDGFTITMFGMRDPAEIPWKDVGAEYIVESTGVFTTTDKAKAHLVGGAKKVVISAPSADAPMFVCGVNEKKYTPDLSIVSNASCTTNCLAPLAKVLHEKYGILEGLMTTVHATTATQKTVDGPSHKDWRGGRGAGANVIPSSTGAAKAVGKVIPELNGKLTGMAFRVPTPDVSVVDLTVRLQKPTTYDDIKATMKAASEDDLAGILGYTEDAVVSTDFVHDNRSSIFDASAGIMLNETFVKLVAWYDNEWGYSNRVVDLITHMSKVDSA

SEQ ID NO: 2405 - protein, 979 aa, Bacillus anthracis str. Ames
MKNNMVHITIDGKKYTAEPSSTILGVINENGIEHPQICYVPEVDPIQTCDTCIVEVDGKLMRSCSTVVTEGMNIERNSTRAKEAQTEAMDRLLENHLLYCTVCDNNNGNCKLHNTAELMEIEHQKYPYEPKVDVSEVDMTHPFYRYDPNQCIACGQCVEVCQNLQVNETLSIDWEAERPRVIWDEGVSINDSSCVSCGQCVTICPCNALMEKTMLGEAGFMTGLKPDILEPMVDLIKEVEPGYSGIFAVSEVEAAMRDTRTKKTKTVCTFCGVGCSFEVWTKGRKILKVQPSSDAPVNAISTCVKGKFGWDFVNSKERITKPLIRKNGTFVESTWEEALNVVANKLGSIKEEYGKDAIGFISSSKITNEDNYVIQKLARQVFETNNIDNCSRYCQSPATDGLFRTIGMGGDAGTIKDIAQSGLVIIVGCNPTEGHPVLATRIKRAHKLHGQKLIVADLRKTEMAERSDVFISPKQGTDQVWLMAVTKYMIDQGWHDQQFIDENVNFFEDFKESLTEYTLEYAEEVTGISKETLIQMAEMIRDADGTCILWGMGVTQNTGGSDTSAAISNLLLATGNYRRPGAGAYPLRGHNNVQGACDMGTLPGWLPGYQHVTNDMERAKFEMAYGVKINSEPGLNNIEMLHAIDEGEMKAMYLVGEDMALVDSNANHVHEVLSSLDFFVVQDVFLSKTAQYADVVLPAAPSLEKEGTFTNTERRVQRLYQVLPTLGDAKPDWWIVQAIANKLGANWNYSHPSEIFAEMASLSPLFSQANYEVLEGWNSFHWGSFDGTNTPLLFQDGFNFPDKKARFAIADWVRPAEFPAEFDLHINNGRMLEHFHEGNMTNKSTGIQTKVPGVFVEVSPALAKERGVKTGSLVRLVSPFGALKLRVLVTDRVKANELYLPMNSTDNETAINFLTGPAVDTRTNTPAYKQTKVRMEVLEVDGENPMPKANPRNKKRHPQSGIEVHRKWARPGYVHLTDK

SEQ ID NO: 2406 - protein, 319 aa, Clostridium perfringens SM101
MKKIAVLTSGGDAPGMNAALRAVTRMALHHGLEVMGVQRGYAGLINGELFKMDRKSVSEIINRGGTILRTARCLEFKQEEVREKAAQILKAYGVEALVVIGGDGSFMGAKLLSKLGVKTVGLPGTIDNDLSYTDYTIGFDTALNTVVDAINKLRDTSTSHERVSIVEVMGRNCGDLALYAGIAGGAEAIIVPEMPFDKDELIKTILEGRTNGKTHSIIVVAEGVGGSAELAKEIESVTGIETRATILGHIQRGGSPTADDIVLASRMGAKAVEVLLEGKTSKVIGIKENRIFDMDIDEALDIERSFDESLYEMASAINK

SEQ ID NO: 2407 - protein, 180 aa, Rhodomonas salina
GAYTGECSADQIVDIGCKWVILGHSERRQYFKEDNEILRTKLEYALSKGLKVMYCIGESLDERNANKTIEVLKSQIEPVKDLMKPESVVIAYEPIWAIGTGVTATPQQAQDTHKELRAYISEACGAATAEAIRIQYGGSANAKNAPELSACPDIDGFLVGGASLKPEFGDIIKAIAAAKK

SEQ ID NO: 2408 - protein, 154 aa, Beta vulgaris
MESNGKGVSIDGVVLPFEAGEIDFGEPGTNGQHSFYQLIHQGRVIPCDFIGIAKSQQPVYLKGEVVSNHDELMSNFFAQPDALAYGKTQEELQKENVSPDLVPHKTFSGNRPSISLLLPSLTAYNVGQLLAIYEHRIAVEGFIWGINSFDQWGV

SEQ ID NO: 2409 - protein, 69 aa, Beta vulgaris
MAAANGVKRVWVGQNGLLSTPAVSAVIRERVGNAGSKASGAFILTASHNPGGPNEDFGIKYNMENGGPA

SEQ ID NO: 2410 - protein, 1717 aa, Magnaporthe grisea 70-15
MAPAPPPLPTRFPCWCRAVYSWGGESKRDLGFIEGDLIECLNAGDGSWWTGRLRRDRRMVGVFPSNFVELLPDNFRPMSRSTSPLPQNNTPSPKDTPQKSRTFRKPFEAYAKAPHYTTAKQPETYKESPTHSRDASATSVAARAPSPAPPRAHHQSSHHQSSHRAVSPAPTHRYDDMRRAASPAPSHRYDDIRRAASPAPTQRYNDMRRAASPAPSHRYDDMRRAASPAPLQRYEGMRRAASPAPLQRYEEMRRAVSPGGFDAFGSRAPSPAPSDIAYKPYRPSVGSFDSAQQLNLQDGPESPPPPAPPPHRHVPRHNSNMSYDSQNGAGLERHVSNLSYDNRQAGLSRHGSNVQYDHQQPEIEGSRHGSNVPYGLRTTGYHTPRAPSPCPPSPGLGRGGMTPSPLREAMDGVMEQLGALGLPPQDPSPEPTTFDPWSPESFDMVHQQSRRRNNKKEQLRPQTSMGIARADSGYETYSGGSSQGGSQENTLNNVGHDPDELGLPQLSNYVERMETRLRNMHNQSSSRVDDEMAPPPPPKSQAYERPKSSMGGSIHGSSGHSGSQPKLRHRKSAYDVGRQVLGRTFTTKTNSTSTSSGNQSTTTQSTSHSLMSGASAGGISATSAGSLARKNQHRRAQSAMSMREPELDRPETPFTGVTYHSSHASDAQVTRPKSQVAYHNDDPMANIGGLGGLTTPKTKKSNFFKKILESAKTGVASTRGSIATAGAGSMNSPRGRSTPNGFIGIAGGLAGPGAGRDTAREMGLGAGVDWVQIRRDVNRSNTLSRNEGSERRERCQMMDYPALDPVDELYGSIDGDEGADGMAVAEPMNYAAINLSQVDKNSRFISGLPPTTTSITLATTYVCRPYRSDVQRLRAIFTWVAEKICWEEDFEGQIDTRRSIASKRGCAEEYAVLVYEMCAAVGIHCEVVRGYLKSPGEVPEMGLMPRSNHWWNAVLVDNEWRMIDACLASPSNPQRGLYSSAGSGVADAFWFLTRPTEICWTHIPEHHGQQHICPPVAHEILLNLPCASPPYFRNGLHLVDYNTSLTRIEDLEMVHVKFTVPEDVEVAAEVEVRAFSRDADGDIFESGDVVKKRALAQADWVGGEKRYTVKALLPGDEGTGVLKVYAGKRGLMHSIKDIPHPVAFAVPIMHTGENPPYEFVTRHPTPHAQRHDIYVVQPQCQRLALNNTFVFAIRQHPSSLGTGSAMTPSSNPGGASPIPFARPGSAMSMTSSSAAGSMPSSASTNGSGVVSGKKPAKLAIQTPGGKILRLMRKEERRNGAVGVGGRTAGSDEDASDGGTWETIIKCSEKGVWRGLVLADRTARWCVFAEWAGDGRLRPATIMTSEQQPPSPPTASQKRHAFSWFTDANYLSINQLKTLPEPKSDFTGKTVIVTGGNSGLGREAARYFARLGAAKVILACRDTAKGEVARADIEVSTRSSRPPSAAGVRLAVEVWQVDMSSGSSVHDFCARVERELPRLDSLVLNAGVAIGAFVECEGGWESSVAINVIGTFLMAVLCLPIMRRTAAQHNVAPTIAVVASEAHVFASFAERKRQGLIFDAFKSAADMNEDRYNVTKLLDVLLARELAARLGPDSPVVVNALNPGLCQSELFRHCPFPLSALLRLGLMILGRKTEVGSRTLVAAAAAGRETHGKYMDSCELANESAFVRSDEGRASGVRVFDELMGIMEGLAPGARGNLNASTTTSMATAPASTAQASS

SEQ ID NO: 2411 - protein, 407 aa, Glycine max
NSSISLCHPQSQVTMATFIRRIAISYILVTLFFSSDIGFFGRVASFGINYGQVANNLPPPDKVLELFSNLKVTKTRIYDTNPQILTAFAKSNVEVIVTVENNMLSQLNDPQQALQWVSGHIKPYLPDTKITGIQVGNELYTNGDKTLIQYLVPAVVNIHNALVQLGLDSNIHVSTPSSLEVLQESYPPSAGSFKSEISGIMSQFLNFLATTKAPFWINAYPYFAYKDDPNRIPLDYVLFNPNEGMVDPYTNLHYDNMLYAQVDAVSFAIAKLGFSGIEVRVSETGWPSQGDPNEIGASVQNAQTYNRNLLRRQMANEGTPFSPRMRLEAYIFALFNEDMKSGATSERNYGLFQPDETMAYNVGLAAFADSSTSSTSISLTSSATKIKVKIKTSLLFPTPTLQKLFSL

SEQ ID NO: 2412 - protein, 108 aa, Geobacter sulfurreducens PCA
MNERDDILQAVYEVILDRKGALPESSYTASLFHKGIDKILKKVGEEATEVIIAGKGGKREEIVYETADLLFHTLVLLGHYDIAPADVYNELRRRFGTSGHAEKASRNE

SEQ ID NO: 2413 - protein, 167 aa, Magnetospirillum magnetotacticum MS-1
MVTNDLVTKEDAERLRRSGLIDPARVEAVEAGACPHTVIREDPTLNIAAGDDLEATFPGLQLLIFESGGDNLASTFSLDLVDWWIFVIDVAGGDDIPRKRGPGVLRCDLLVVNKVDLAPHVGVDLGAMLAEAARVRGEKPVLATNARAGEGVEAVADAICRAVLFAA

SEQ ID NO: 2414 - protein, 425 aa, Glycine max
  misc_feature (117)..(117): Xaa can be any naturally occurring amino acid
  unsure (1)..(425): unsure at all Xaa locations
MDSDTEETKPKHPKKEKKKKNKKKEVEVVQPQSEQIEVEVEVVREHPNKTPPVVGYFPSGFDPVKNHGGGPSNFQVYRHRSMPKRLELVVRPPRSSVEFVGTSYAGEAAARHRAKYXHLGVLDKEAGTLKVVPIAGNKIFRLEPKVKGVGAFENEPANSTLEEMTQQQKFAETTSIWGTKKDIEKAKKKLALRQDEDPDSQRNLDVKMKSVTVNKKALESTESHVSRNIPPYDASATTPQEAYILDKIILKGEWDYLEDIYNNLQRGEEADFSAYPTFVRNRIERLRKIKDESEKKQLSCIFSYINHLIKFKDQHSFDVLSAKGHKIPNILRHKFSNMFAVSESKRLPPEKISLLICYVLVLTLFSDEFRTDYTDIAKDLSMNILPVRQLYEHLGCKISRQKNIFYATLPVPLKFPELRQRKRKR

SEQ ID NO: 2415 - protein, 1236 aa, Rhodospirillum rubrum ATCC 11170
MSDLASLRLSLRREPLRDEAAVVADRLAALPLDADRRQAVSEAGRALVERMRASGEVTMMDNMLAEYGLSTDEGVALMCLAEAYLRVPDAPTLDALIKDKIGGRDWAEHAGESGSMLVNASTWGLMFTGRLYGESWAEDTLLGSVRKMVRRVGEPVVRTAVAQCMKIMGAQFVLGRTIDEAWRNGGPLIEKGYTYSFDMLGEAARTAADATHYFKAYANAIAAVGARATQADVHANSGISVKLSALHPRYEEVNRARVMAELVPRLSALAEMAAAVNVGMTVDAEEADRLDLSLSVMEAVLRNPNLAGWGGFGIVVQAYLKSTLPTIDWIIALARDLDRQLAVRLVKGAYWDAEIKTAQSLALPAYPVFTRKASTDVSYMASAARLLGAQDHIYPMFAGHNAHTASAVLEMAGPDAVFEFQRLHGMGETLHELLRRDHGHRCRIYAPVGVHKDLLAYLVRRLLENGANSSFVNQALDKDVPAAELTRDPATVVAQASSVAHAGIPLPPALFGAERANSKGWNLNNPLMAAELDERLTPFRAARWSAAPMIGATPPRSGGEAVTNPADRDETVGFVVSATANDVTVALETTTRAFPNWRDRAPAERAALLDRIAALYEEHAPELIALLSREAGKTRWDGILEVREAVDFCRYYAARSRADLAGSGRKGRGVFVCISPWNFPLAIFTGQIAAALVSGNTVIAKPAEQTPLIAARAVALMREAGVPPEVLALLPGEGASVGAALTASPLVAGVCFTGSTETAIAIDRAQASAGTGGAPLIAETGGLNAMIVDSTALPEHAVRDIVAGAFQSAGQRCSALRALFVQEDIADHLLTMLAGAVQELVVGNPWEAVTDVGPVIDAEAKAVITRHCEALTAAGRRLFVHDKAKAAKGGGFVAPVAFSLDRFEDLKSEIFGPVLHVIRFRNTEIDAVVDSINAAGYGLTLGIHSRVDAQVERICSRARVGNIYVNRNQIGAVVGVQPFGGEGLSGTGPKAGGPGYLERFTIAAPVALPEVALPASHGEDAAAENALDAARWAASVQPAWDGRSDRLAILEAALRALPEAARPTASAVLDLAKPLVAPPLDLVGVTGESNRLALHGRGVVLCLGGGERPATALLAQALLGLAAGNAVLLAGDPGAGVIAALRKALAEAGLSAGLVQSIVASDLPGLLREMPRLALVAHEGGVGGEGLRVALAARSGARVPLVALVDGVGRYVSERVVSIDTTASGGNASLLMLDEG

SEQ ID NO: 2416 - protein, 195 aa, Geobacter sulfurreducens PCA
MSRKATIERVTKETQIKLSLEIDGTGEAKICTSVPFLDHMLDLFARHGLFNLQVDATGDIDIDFHHTVEDIGIVLGQALKEALGDKKGIRRYGQATVPMDETLASVAVDISGRPYLVYHVSLPKVKIGEFDVELVREFFQAVVNNLGANIHVNVMYGDNVHHIVEACFKAFARAVDQATQVDSRIQGVMSTKGKL

SEQ ID NO: 2417 - protein, 856 aa, Aquifex aeolicus VF5
MSVDKSKALVLWLDEVTIEDIPIAGGKNASLGEMIRNLSPLGVKIPYGYVVTANAYYYFLDYNNLRDKIRKILEGLNTDDLKDLQRRGHEVRELIRGGTFPPDLEEAIKDYYNKLSEKYKTHAVDVAVRSSATAEDLPDASFAGQQETYLNVVGAENVLVAIKNCFASLFTDRAIVYRERFGFDHFKVGIAVGVQKMVRSDMGASGVMFTLDTETGFKDVVVINAAYGLGELLVRGEVTPDEYIVFKPTLMKGYSAIIEKKLGRKDRKMIYGTGDERVKIVNVPKEDQKKFALNDDEILQLAKWGVLIEEHYSKKNGRWTPMDIEWAKDGILNELFVVQARPETVHSRKKENVVKIYKIKTPEEERKNRVIVKGIAVGDKIATGKARVLFDLKEADQFQEGEILVTDITDPDWEPVMKKAAAIVTNRGGRTSHAAIVARELGIPAVVGTGNATEKIKTGEEITVSCAEGETGYVYEGKIDYEVEEINLENIPKPKTKIMMNIGNPESAFRYASLPNDGVGLAREEFIIANYIKIHPLALLHYEDLKELYEKLERENLIDEKGFVQFKLIYHYANGRLANKLAKGKDKLRVNLRKILQDIENLTFGYEDKATYYIKKLSYGIAKIAAAFYPNPVIVRFSDFKSNEYANLIGGILFEPEEENPMLGWRGASRYYSDVFKEAFGMECKAIIRVRNKMGLTNTKVMIPFCRTPEEGEKVLQVMEEYGLRKGENGLEVYVMAELPSNIVLADRYAQIFDGFSIGSNDLTQLTLGLDRDSELVAHLYDERNEAVKRLIAQLIKTAKEYGRKVGICGQAPSDFPEFAQFLVEQGIDSISLNPDSVLKTMLAVVEMEKKLGVLK

SEQ ID NO: 2418 - protein, 453 aa, Zea mays
MEKKPTILMNRYELGRTLGQGTFAKVYHGRNLASGESVAIKVIDKEKVMRVGMIDQIKREISVMRLVRHPNVVQLHEVMASKSKIYFAMEYVRGGELFARVARGRLKEDAARRYFHQLVGAVDFCHSRGVYHRDLKPENLLVDEHGNLKVSDFGLSALRECQKQDGLLHTTCGTPAYVAPEIINKKGYDGAKADIWSCGVILFVLLAGYLPFHDANLVEMYRKISRADVKYPQWFSPELRRLMPKLLEPNPNNRITIEKLVEHPWFKKGYRPAVMLAQPHGSSSLKDVQVAFSNADHKDSSSKVEQPADSSLKPASLNAFDIISHSRGFDLSSLFEVDQEQKASNSRFMTQKPASAIVSKLEQIAETERFMVKKQDGLVKLQGSKQGRKGQLAIDAEIFEVTPAFHVVEVKKSAGDTLEYEMFCSKGLRPSLSDICWSSRSEENMAPSVVQPS

SEQ ID NO: 2419 - protein, 1342 aa, Magnaporthe grisea 70-15
MSQNRPAAFNTLRMGEVIREKVQDGITGETRDLQYTQCKIVGNGSFGVVFQTKLSPSNEDAAIKRVLQDKRFKNRELQIMRIVRHPNIVQLKAFYYSNGERKDEVYLNLVQEFVPETVYRASRFFNKMKTTMPILEVKLYIYQLFRALAYIHSQGICHRDIKPQNLLLDPTTGILKLCDFGSAKILVENEPNVSYICSRYYRAPELIFGATNYTTKIDVWSTGCVMAELMLGQPLFPGESGIDQLVEIIKVLGTPTREQIRTMNPNYMEHKFPQIKPHPFNRVLRKADNNAIDLIARLLEYTPTERLGAIDAMVHPFFDDLRNPSTKLPDSRHQTGQVRDLPPLFDFNRHELSIAPQLNHQLVPPHVRPTLAAQGLDIDHFTPMRKEDMLASRDTPEIVPGRPRSRLGPSALDSTFGTGIPINLLTQMLPNEMLSEEVVRESSRIHKNYMIAKIGYAGGLIDSQILSGGESDTVLLVSETIYLIYERFIEVPGKLACLVGRSEWIIAAVVVGLAPSASASNMADYDRRYRGDGGRGGYNPRKRRYNDDDDYGRNRGGGRRRHDGSSHAPPFIRIRKQLLGLAESAARKWHEDVVSVSRLVVENYDDEFVRNGFLDLVCQLVVEQPLKTPFVAAVVLVTNTLKSELVAELLARVGKALETAITAGEWRDVKALLKLLACLQTCLEGEGIFPVLDELFNRAVDLQTASSDDTIGIELVKIILLTIPYIMAAAPGQWIDKAAELMDKTDVIASEDHPMQKLVDPYCPEAGEKDVEASPSLLSLLQKQLQTEAGNGWGLECLPRAWKMPLEEVEQQSKLDDCPRHPLPTISVPETIIAGSRPLFPEVSISIYAAQDVASVPPDTTIAASLIRDAILDTINTLHYNRNVVARFLIDLDCYFSNGTFVKRATPFDRLRDVEAGKSTWKPEDVVVDAVFSQILQLPRPEHKLVFYHSVLTETCKIAPAAIAPSLGRAIRHIYRNIPRHDLELNHRFIDWFSHHLSNFGFTWKWVEWVDDVELPALHPLKAFIVGALDKEIRLSFAQRIKNTVPDEYKSLIGPEKEIDVPEFKYKNDDVPFASQGREIANLLKKKEPDEAIQPLIEEIQNGAVDQGLDPLVTSTDVFMTAVLAVGSKSLSHVLACIERVKDRLLDAGAASVAARIQVIEAVMAYWSAHQGVALSIVEKLLNYAILTPAVVVEWAVGAGRGAVTAIEDDESRLAQDHIYELVLNTVRKVTGRVRQVALTKAQNLDGDVSMTEDQDGPEVKEMRELFQLIEHALAARASSLASNKLLARLWVDRWQRAFKRCAAIEENFLIEVEKNRKKQAAIAAAAPAPEAKPEVKDGDIE

SEQ ID NO: 2420 - protein, 351 aa, Streptococcus agalactiae 2603V/R
MRAATYLSANELSLTDKAKPQVIKPTDAVVRLVKTTICGTDLHILGGDVPACKPGTTLGHEGIGIVEEVGSAVNHFKVGDKVIISCVTACNTCYYCKHQLPSHCEDGGWILGHLIEGTQAEYVHIPHADGSLYHAPEGVCDDALVMLSDILPTSYEIGVLPSHIKPGDTVCIVGAGPIGLSALLTAQFYSPAKIIMVDLSQKRLEASKKFGATHTILSTSTQEVKEEIDKITKGRGVDVVLECVGYPATFDICQNVVSIGGHIANVGVHGKPVEFNLQDLWIKNITLNTGLVNANTTEMLLEVLETGKIDATQLVTHHFKLSEIEEAYKVFKAAEENNTLKVIIENDITPA

SEQ ID NO: 2421 - protein, 166 aa, Oryza sativa
MASKSLFLLGAVLASLLLVAQDVSAARELAEANEAKGKNMKQEVAYGPQDEKLAHHADGYGHGGGYGGGYGSGYGGGNGGGYGGGYGGYGGGYGGGYGVVVVVGGGGGYGGYGGYGGYGGGGYGGYNKGYGGGGGGGYSKGFGGGYGGGGYPGGGYYGGGGGGGWH

SEQ ID NO: 2422 - protein, 188 aa, Desulfovibrio desulfuricans G20
MNCTRRGFLKLAGAGAACISLAQLGFSLKEARAFAASLKIEGAKEVITVCPFCSVSCHIIAYVKNGKLISTEGDPDYPINEGSLCAKGAALLTMSTSHHRLLKPKYRAPFSDKWEEKDWGWTLEQIARRVKDTRDKEIILENNKGQRVNRLESMFLLGTSHADNEECALVHQAMRGLGVVHMDHQARI

SEQ ID NO: 2423 - protein, 459 aa, Thamnidium elegans
MSTLDRQSIFTIKELESISQRIHDGDEEAMKFIIIDKMVYDVTEFIEDHPGGAQVLLTHVGKDASDVFHAMRPESAYEVLNNYFVGDVQETVVTEKSSSAQFAVEMRQLRDQLKKEGYFHSSKLFYAYKVLSTLAICIAGLSLLYAYGVLPLWLSSHLLLLLVSFGNSVVGWLTISDIINASKTALGTMFLVVFLGNFCQGFSLSWWKDKHNVHHASTNVHGQDPDIDTAPVLLWDEYASAAYYASLDQEPTMVSRFLAEQVLPHQTRYFFFILAFARLSWALQSLSYSFKKESINKSRQLNLFERVCIVGHWALFAFCIYSWCSNVYHMVLFFLVSQATTGYTLALVFALNHNGMPVITEEKAESMEFFEIQVITGRDVTLSPLGDWFMGGLNYQIEHHVFPNMPRHNLPTVMPMVKSLCQKYDINYHDTGFLKGTLEVLQTLDITSKLSLQLSKKSF

SEQ ID NO: 2424 - protein, 808 aa, Desulfovibrio desulfuricans G20
MTNHWIDIKNADAILIMGSNAAEHHPISFKWVLQAKDKGAVVMHVDPKFSRTSARADFHVPLRSGTDIAFMGGMIHYILETESYFRQYVLDYTNASFIVGESYGFKDGLFSGYDIHTRSYDRSKWNFETDAQGTPKRDPSLKHPRCVFRLMQEHYSRYTLDNVSSVTGVTKENLLKVYKAFAATGKPDKAGTMMYALGWTQHTVGVQNIRSAAIVQLLLGNIGVAGGGINALRGEPNVQGSTDHCLLYHIIPGYMTMPMADWQTYADYNKANTPVSADPQSANWWQHKPKYLTSLLKAWFGDAATAENGYCYGLLPKIEKGADHSYMFLFDRMYSGKITGGFIIGLNPMNSVPNTNKVRKALDNLDWLVTAELHHSETTDNWRRPGVDPATVKTEVFLLPSAHRVEKAGSVSNSGRWLVWHHKAVEPEGEARSFGDMFVPLINVVRDLYRKEGGTMPEAVLNLDWPQQYDPEEWARRINGFFLKDTTVNGKEYKKGQLVPSFTALADDGSTSSLNWLYSGSYTEEDGNKAQRRDPSQTPMQAAIGLYPKWSWCWPVNRRILYNRASVDAQGKPWNPAKAVISWNGKKWEGDVPDGGWPPMATGKGRHPFIMSKHGFGQLYGTGRMDGPFSEHYEPVETPIDAHPFSKQLSSPVYKFVSSDMDKLARPADPRFPYVLTTYNVTEHWCGGGETRNVPNLLEAEPQLYVELSPELAEEKGIANGDGVILESARGRVEAIAMVTVRIRPFTVQGKTVHLVGMPFCFGWTTPGTGDSTNRLTPSVGDPNTSIPEYKASCVNIRKADTLTEIDR

SEQ ID NO: 2425 - protein, 365 aa, Saccharomyces cerevisiae
MVLAKQWVLKNLPTPGEPFNFHFHDPACTFELIEKELSSEQLKDGELLLETTYLSNDPAQKFWISSMDKNYAKGVQPGEIIPARGIGKVLASRNKAFSPGDYVSAVTGWTTHAIISQENVQGLRKLDKNKVGKLWWYLSVLGGTSLTAYFIFFTYAQLQEREEDYGKVYLISGAAGAVGTVCIQLALNVFKASKVIAIAGGPEKVAFVESFGDNVVGVDYKDPSFKQKLIEAAGGENTVDYFIDNVGSNVLEAGVLLLKQRAMLIACGAISAYNDPSKFVFKGYSFILTKRLVVKGVLVTDNIDDFPKALDKLGSLVKHGKIDLLKSATLEDGTGDKFKNVPLIWKGLFSGVNKGKLITKVNNEE

SEQ ID NO: 2426 - protein, 236 aa, Brassica napus
MVTKTEETELNQLENQVENGGGGVWEYLCLVRKLKVRRSELVLKHGLSILNDPGKRSSLGPDEWTLYEQVAIAAMDCQSLGAAQNCIKVLQKKFPESKRVGKLEALLLEAKGMWEEAEKAYSILLEDNPLDQVIHKRKVAMAKAQGKPSLAIEHLNKYLEVFMADHDAWRELAEIYVSLQMYKQAAFCYEELILSQPTLPLYRLAYAEVLYTIGGLENLIAARKYYAATIDLTGGK

SEQ ID NO: 2427 - protein, 532 aa, Oryza sativa (japonica cultivar-group)
MADEATTTPLLASYKAKPAKAPSIDDAIETYIGATGAGQLFKAILLAFAWAFDAQQVFISVFTDAEPRWHCTAGADPSCSPGAASPCALPPGAWAWDRPAETSVVSEWALKCAGPALVSLPASSFFAGCLAGGFLLTTLADSLLGRRKMLLVSLASMSVAGVLTAFSPNVWAYAALRFVCGFGRSMVGTCALVLSTELVGKRWRDTVSVAGFVCFTVGFLSLPALAYTFREASWRSMYLWTSLPSLGYAILLYFLVQESPRWLLVRGRKHDAIETVRQIAALNGGGGITCSFSMLHACATEREDDAAGGAGGGGGGVFATLRSMWERRWALRRLAAIMTASFGVGMVYYGMPLNVGNLGSNLYLSVTYNALAEFPSSVLSWLLMGRINRRSSVVALTAAAGVCSLACVAIPEGTGGRMAAEVLSFFATCTAFNIILMYSIELFPTSVRNSAVGMVRQALVLGGVAAPMLVALGRERSFWSFGVFGLAVGCLGLFAVCLPETRGRSMSDTMEEEEHKEAAAAIGDMDSNADLV

SEQ ID NO: 2428 - protein, 310 aa, Amaranthus tricolor
  misc_feature (197)..(197): Xaa can be any naturally occurring amino acid
  unsure (1)..(310): unsure at all Xaa locations
NEYIDYVGSWGPAIIGHADDEVLAALAETMKKGTSFGAPCLLENNLAEMVISAVPSIEMVRFVNSGTEACMGVLRLARAFTGKQKIIKFEGCYHGHADPFLVTAGSGVATLGLPDSPGVPKSATSDTLTSPYNDLETIKGLFEANKGEIAAVILEPVVGNSGFIPPNPGFLEFLREITKENDTLLIFDEVMTGFRLXYGGAQEYFKITPDLTTLGKVIGGGLPVGAYGGRRDIMEMVAPAGPMYQAGTLSGNPLAMTAGIHTLKRLMQPGSYEYLDKITSELTQGIIAAGKKTGHAICGGYISGMFGFFF

SEQ ID NO: 2429 - protein, 476 aa, Oryza sativa
MPPPGDPPTRSTQQHATSQRYDDRGGTAAPGDSLAAAAEAAAGQLGRATGRMRKLRAGERIPGGGRPPARGREGGGGGNPRGVEEALFDLGGEGGEEEEEEGMMDKSIGGSSARAGESEEIFGTNQWAFGFSAALHSFDVPPNPQFNMHGSSQMSCPPINEQPSQGFSIDNNIGSEDPPSLKSQRAAKKKKVSRRGTAFTKEEDMVVCSAFLNISKDAITGVNQTSGGYYKRMHDYFNEHKPEGKRNKFCGHKAAVDRLNESGKNEQDRIDDVVQMYEKTEPFTFMHCWKLLHNEAKWNNKFLELNNSTSPDRMEPPSTQGHTVAGHAESGNENIDTTRPEGRDSAKRRRLKSYAETSSSSTTVEVLQRLQEKSEKTELKQDQQMVEILSRKDEKIKIQRDLFNLQKKHMKMSVKQHKKENEIREKQTEAQLMSAESSIMSIDIEKVPPYLKNYYLGMQRQIMERRGFSSPLNNGD

SEQ ID NO: 2430 - protein, 171 aa, Brassica napus
  misc_feature (165)..(165): Xaa can be any naturally occurring amino acid
  misc_feature (169)..(169): Xaa can be any naturally occurring amino acid
  unsure (1)..(171): unsure at all Xaa locations
MNRGRRNLKQAASEQDFTLEECQSIAQVVSLRGSNQIEIMDAKGENSLALFPAKFRESMWIRRGSFVVIDHTGKEKAQESGSKVTSIVCKVLFFEQIRLLQKSPEWPEIFRDAKPVPADESSQIPIPQDDDIDLSDESDDGMPPLEANTNRLRPFGVQCDAETDXGSDXDS

SEQ ID NO: 2431 - protein, 424 aa, Burkholderia sp. 383
MAIVEVKVPQLSESVSEATMLQWKKKPGEAVAQDEILIELETDKVVLEVPAPAAGVLAQVLQNDGDTVVADQIIATIDTEAKAGAAEAAAGAAEVKPAAAPAAAAPAAQPVAAAASSTTASPAASKLLAEKGLSAGDVAGSGRDGRVTKGDALAAGSAPKAAPAAAPAKTAAAKPALPEVKVPASAATWLNDRPEQRVPMSRLRARIAERLLESQQTNAILTTFNEVNMAPVMELRNKYKDKFEKEHGVKLGFMSFFVKAAVHALKKFPLVNASIDGNDIVYHGYFDIGIAVGSPRGLVVPILRNADQLSLAEIEKKIAEFGQKAKDGKLSIEEMTGGTFSISNGGVFGSMLSTPIINPPQSAILGVHATKERPVVENGQIVIRPINYLALSYDHRIIDGREAVLSLVAMKDALEDPARLLLDL

SEQ ID NO: 2432 - protein, 476 aa, Burkholderia sp. 383
MSKEFDVVVIGAGPGGYIAAIRAAQLGKTVACIEKWKNPAGALKLGGTCLNVGCIPSKALLASSEEFENTSHHLADHGITVDGVKIDVAKMLGRKDAIVEKMTSGIEFLFKKNKITWLKGHGKFTGKTDAGVQIEVSGEGETEVVTAKNVIIATGSKARHLPGIPVDNKIVSDNEGALTFDAVPKKLAVIGAGVIGLELGSVWRRLGAEVTVLEALPAFLGAADEALAKEAAKLFKKQGLDINLGVQIGEVKATANGVSIAYTDKDGNAQTLDADRLIVSVGRVPNTDNLGLEAIGLKANERGFIDVDDHCRTAVPNVYAIGDVVRGPMLAHKAEDEGVLVAEVIDGQKPHIDYNCIPWVIYTYPEIAWVGKTEQQLKAEGREIKSGKFPFSINGRALGMNAPDGFVKMIADAKTDELLGVHVIAANASDLIAEAVVAMEFKAASEDIARICHPHPSMSEVMREAALAVDKRSLNS

SEQ ID NO: 2433 - protein, 215 aa, Geobacillus kaustophilus HTA426
MTADIRFDEKGLVPAIVQDAQSKEVLTLAYMNKESLKKTLETGETWFYSRSRQELWHKGATSGNVQRVVDIRYDCDADALLVLVEPAGPACHTGSYSCFSRSLDGAARTPAADRFAILHELEQIIAQRDAERPEGSYTTYLFEKGVDKILKKVGEEAAEVIIAAKNRSHDELKWEAADLLYHLLVLLREQKLPLDAVLATLAERHAQKVEAGDKK

SEQ ID NO: 2434 - protein, 195 aa, Geobacillus kaustophilus HTA426
MAREAMIARTTNETSIQLSLSLDGEGKAELETGVPFLTHMLDLFAKHGQFDLHIEAKGDTHIDDHHTTEDIGICLGQAIKEALGDKKGIKRYGNAFVPMDDALAQVVIDLSNRPHFEFRGEFPAAKVGAFDVELVHEFLWKLALEARMNLHVIVHYGRNTHHMVEAVFKALGRALDEATMIDPRVKGVPSTKGML

SEQ ID NO: 2435 - protein, 373 aa, Bacillus cereus ATCC 14579
MMKAEEKFSPGLDGIVAAETKISFLDTVKGEIVIQGYDLIELSKTKEYLDIVHLLLEEHLPNEDEKVTLEKKLKEEYAVPEGVFNVLKALPKETHPMDGLRTGVSALAGYDNDIENRSLEVNKSRGYKLLSKVPNIVANSYHILNNEEPIEPLKELSYSANFFYMLTGKKPTELEEKIFDRSLVLYSEHEMPNSTFTARVIASTQSDLYGALTGAVASLKGSLHGGANEAVMYMLLEAGNVEKFEELLQKKLYNKEKIMGFGHRVYMKKMDPRALMMKEALKQLCDVKGDYTLYEMCEAGEKIMEKEKGIYPNLDYYAAPVYWMLGIPIQLYTPIFFSSRTVGLCAHVIEQHANNRLFRPRVNYIGERHVLSK

SEQ ID NO: 2436 - protein, 513 aa, Saccharomyces cerevisiae
MLSKNLYSNKRLLTSTNTLVRFASTRSTGVENSGAGPTSFKTMKVIDPQHSDKPNVLILGSGWGAISFLKHIDTKKYNVSIISPRSYFLFTPLLPSAPVGTVDEKSIIEPIVNFALKKKGNVTYYEAEATSINPDRNTVTIKSLSAVSQLYQPENHLGLHQAEPAEIKYDYLISAVGAEPNTFGIPGVTDYGHFLKEIPNSLEIRRTFAANLEKANLLPKGDPERRRLLSIVVVGGGPTGVEAAGELQDYVHQDLRKFLPALAEEVQIHLVEALPIVLNMFEKKLSSYAQSHLENTSIKVHLRTAVAKVEEKQLLAKTKHEDGKITEETIPYGTLIWATGNKARPVITDLFKKIPEQNSSKRGLAVNDFLQVKGSNNIFAIGDNAFAGLPPTAQVAHQEAEYLAKNFDKMAQIPNFQKNLSSRKDKIDLLFEENNFKPFKYNDLGALAYLGSERAIATIRSGKRTFYTGGGLMTFYLWRILYLSMILSARSRLKVFFDWIKLAFFKRDFFKGL

SEQ ID NO: 2437 - protein, 217 aa, Glycine max
MSSSGAKRSGPPKHQNKYAWKPNAGRKINETEVGGRFRPLSEITGVCPRCKDQIEWKRRYGKYKPLLQPAKCQRCSKRAVRQAYHSLCPGCAKEHGVCAKCCCNTKQIVGRDISEVEAEQKMLEEAIKNSRERERRSLLRAMNKDKTKSSNSVPTDTKGNKSEGEVCEDEDDNSDNEDCDEDGNSDDEDGDSENEDCDENDDKNDENTPDHTSANHE

SEQ ID NO: 2438 - protein, 326 aa, Rickettsia akari str. Hartford
MQITVREALRDAMREEMIRDDKVFVMGEEVAEYQGAYKVTQGLLEQFGPKRVIDTPITEYGFAGLAVGAAFAGLRPIVEFMTFNFAMQAFDHIVNSAAKTHYMSGGQVKCPIVFRGPNGAASRVAAQHSQNYTACYSHIPGLKVVAPYGAEDHKGLMLTAIRDNNPVVFLENEILYGHSFYVPETIEPIPYGQAKILKEGSSVTIVTFSIQVKLALDAANVLHGDNIDCEVIDLRTIKPLDTDTIIESVKKTNRLVVVEEGWFFAGVGASIASIVMKEAFDYLDAPIEIVSGKDVPLPYAINLEKLALPSESDVIEAVKKVCYYSV

SEQ ID NO: 2439 - protein, 609 aa, Rickettsia akari str. Hartford
MTPIRNIAIIAHVDHGKTTLVDNMLKQSGTFRANQAVAERAMDSNDLERERGITILAKCTALMWNDIRINIVDTPGHADFGGEVERILSMVDGVVLLVDASEGPMPQTKFVLSKALKLNLKPIVVINKIDRDDQRIKEVIEEVFELFVALEANNDQLDFPIVYASGRAGRASLNFDDKINPLDNLADDLAPLFDLIVTHVPTPAADDKAPFSMLITTREYNSFFGRVLTGRVQNGTVKINQNIKVLNRENKVLETGRITKILAFRGLERIAIDEAIAGDIIAVAGVENANVADTICSPEVTEAVPSLPIDPPTLSMTFSVNDSPLAGSEGTKVTSSLIGARLMREIESNVALKVTEAAEKNAFQVAGRGELQLGILIETMRREGFELSISRPEVLFQTDGKGNKQEPMEEIQVDVDDDYVGVVVKSLALRKADMTDMRPSGGGKSRVTFIGPSRGLIGYHSQFLTETRGTGIMNRIFHGYANYKGAIAGRRNGVLISNGDGAAVAYALWNLEERGKMFINPSDKVYRGMIIGEHNRENDLEVNPLKARQLSNVRASGKDEAIRLTPPMLLTLEQAISYIQDDERVEVTPKSIRLRKALLDPNDRKRAAK

SEQ ID NO: 2440 - protein, 287 aa, Glycine max
  misc_feature (227)..(227): Xaa can be any naturally occurring amino acid
  unsure (1)..(287): unsure at all Xaa locations
QLRRPPPPPIGDSFGLNHSTVSQVTWRFVESMEERGLHHLPWPSTEVEMNAIKSKFEKIRGLPNCCGVIDATNITMCLPASEPYCNVWLDHKKNHSMVLQAIVDPDMRFRDIVTGWPGKMEDWLIFESSNFNKLCEKGERLNGSKLQLSEGSEIREYILGDSGYRLLPYLVVPYEGKELSEPKAQFNKQHLATRMVAQRALARLKEMWRIIHGMMWRPDKHRLPRIXLVCCVLHNIVIDLNDEVQDELSLSLDHDSGYHRLVCGAVDEKGVALRDRLSHYLAGRLPS

SEQ ID NO: 2441 - protein, 409 aa, Nitrosomonas europaea ATCC 19718
MTHPKHAPMTQFPIRNHCLVIGDLPLTRLAQRIGTTPFYAYDRKLISARIQFLRQHLPAGIHLHYAMKANPMPAVVQHLAGLVDGMDVASVGEMKVALDAGITPENISFAGPGKSRQELICAIAAGIVINVESEYELETIAQLAEETGFQPKVAVRVNPDFELKSSGMKMGGGSKQFGIDAECVPAVLQRIAQLRFDFEGLHIFSGSQNLRVEALREAHEKTLQLGLQLASTSPVPVRAINIGGGFGVPYFPGESPLDLNAVGTNLQRLLAEIPSQFSAIRFVIELGRYIVAEAGIYVCRVLEKKISRGQTFLVTNGGLHHHLAASGNFGQVIRKNYPVAIGNKMKIDETEIVSVVGPLCTPLDLLADRMELSRAEPGDLVVVFQSGAYGLTASPTAFLSHPASLEVLI

SEQ ID NO: 2442 - protein, 348 aa, Cryptococcus neoformans var. neoformans JEC21
MARNSEKAQSMLYRFREQQAIDMGIGTRQKGDRRPRMASSCTSLREAERWRGDILRDISRKVSKIQDVALTDYQVRDLNDEINQLFREKRAWENQIINLGGANYRRAAGVMTDDEGREVPGTRGYKYFGRAKELPGVKELFTRSTQQATEESARTASFQMFRHQGPDYYGDEDELDKELIDTEDVEAREGWEDQVRKSASTLGISDETLLPRYPVSISSKLPDASVDPTQLQENEEAPQKSEKALKGTGKSKRKYKGVNDLEEGGQKEEQEEAKKSKTDTSVAINSVAEGQNIASETAVAAAQAQAAAFLGVLDAESLEFPTMPSKDEMAKVLLEVRKQALKEEYGVY

SEQ ID NO: 2443 - protein, 250 aa, Solanum tuberosum
MGRGRVQLKRIENKINRQVTFSKRRSGLLKKAHEISVLCDAEVGLIVFSTKGKLFEYANDSCMERLLERYERYSFAERQLVPTDHTSPGSWTLEHAKLKARLEVLQRNQKHYVGEDLESLNMKELQNLEHQLDSALKHIRSRKNQLMHESISVLQKQDRALQEQNNQLSKKVKEREKEVAQQNQWDQQNHEINSSTFVLPQQLDSPHLGEAYQNTNVVDNGEVEGGNSSQQQGAANNTVMPQWMLRHLNG

SEQ ID NO: 2444 - protein, 356 aa, Magnaporthe grisea 70-15
MEEEVAALVIDNGSGMCKAGFAGDDAPRAVFPSIVGRPRHHGIMIGMGQKDSYVGDEAQSKRGILTLRYPIEHGVVTNWDDMEKIWHHTFYNELRVAPEEHPVLLTEAPINPKSNREKMTQIVFETFNAPAFYVSIQAVLSLYASGRTTGIVLDSGDGVTHVVPIYEGFSLPHAIARVDMAGRDLTDYLMKILAERGYTFSTTAEREIVRDIKEKLCYVALDFEQEIQTAAQSSSLEKSYELPDGQSWVLRAVVSHVTTFNSIMKCDVDVRKDLYNNIVMSGGTTMYPGLSDRMQKEITALAPSSMKVKIIAPPERKYSVWIGGSILASLSTFQQMWISKQEYDESGPSIVHRKCF

SEQ ID NO: 2445 - protein, 468 aa, Mycobacterium sp. JLS
MSGLRELCRCGPGLLRHRRSGTRGGPQDGGSFRGQDPGRGGCAQLSGGRAGSPRRMTSRVVIVGSSVGGVRTAQALRSQGYDGDVVLVGEETALPYDKPPLSKALLAGTSDIAAVTLLSRDAAAADRIELLLGRRAIGVDVAACQVEFADDEPLRYDHLVVATGASARPSPWGHGSGIHVLRTLEDCLRLRDDLVAGVRLVVIGGGFIGAEVASTARSMGGQVTVVDPVPVPMSRVLTEEIGEWFIDLHRNHGVHTRFGIGVENIEGERGNLKIGLTDGTVLEADTVVVGIGAVPNDGWLMPSGLLVDDGLVCDEFCRAVTSQNIYAVGDVSRWFHRARGVTMRIEHWTNAVDQASCVAHNILYPDELRCYEPVEYVWSDQYDWKIQVCGQTTHLGEPLVVGDRLSDNRFTVLYPDGEQRLGGAAVVNWPRALIECRRALQAGSDLESVRGRLEVLTNPPDTAATRSP

SEQ ID NO: 2446 - protein, 359 aa, Cicer arietinum
MSNFKSKYHDELIANAAYIGTPGKGILAADESTGTIGKRLASINVENVETNRRALRELLFTAPNVLQYLSGVILFEETLYQSTAAGKPFVDVLNEAGVLPGIKVDKGTVELAGTDGETTTQGLDGLGARCAKYYEAGARFAKWRAVLKIGPNEPSLSILSIENAYGLARYAVICQENGLVPIVELEILVDGSHDIHKCAAITERVLAATYKALSDHHVLLEGTLLKPNMVTPGSDSPKVAPEVVAEHTVRALQRTVPAAVPAVVFLSGGQSEEEATVNLNAINQVKGKKPWTLSFSFGRALQQSTLKAWSGKEENVKNAQDALLTRAKANSEATLGTYKGNSQLGEGASESLHVKDYKY

SEQ ID NO: 2447 - protein, 112 aa, Brassica napus
  misc_feature (93)..(93): Xaa can be any naturally occurring amino acid
  misc_feature (100)..(102): Xaa can be any naturally occurring amino acid
  misc_feature (104)..(104): Xaa can be any naturally occurring amino acid
  misc_feature (107)..(107): Xaa can be any naturally occurring amino acid
  unsure (1)..(112): unsure at all Xaa locations
MASSMLSSAAVATSPAQATMVAPFTGLKSSAAFPVTRKSNTDITSIANNGGRVSCMKVWPPVGKKKFETLSYLPDLTDVELAKEVDYLLRNKXFPCVEFXXXPXFVXKTCIP

SEQ ID NO: 2448 - protein, 256 aa, Sinorhizobium meliloti 1021
MYDAPFYKGSDKLKDKVALITGGDSGIGRSVAVLFAREGADVAIVHLDESQDADDTKAAVEKEGRKCLVIKGDVKDASFCRKAVEKTVMQLGRLDILINNAAFQVHTRDIEDLTDEHFDETLKTNLYGYFYMAKAAIPHLKNGSAIINTGSVTGLTGSKELLDYSMTKGGIHAFTRALSGHLVPKGIRVNAVAPGPVWTPLNPSDKEAEDVEKFGSQTPMKRAAQPEEIAPAYVFLASPQMSSYITGEILPIVGGY

SEQ ID NO: 2449 - protein, 373 aa, Mannheimia succiniciproducens MBEL55E
MSNTIKSRAAVAFAPNEPLKMVEIDVERPKKGEVLVKITHTGVCHTDAFTLSGADPEGVFPVVLGHEGAGVVVEVGEGVTSVAVGDHVIPLYTAECRECEFCKSGKSNLCVSVRETQGKGLMPDGTTRFSYNGQPIFHYMGCSTFSEYTVVADVSLAKINPQANPEEVCLLGCGVTTGIGAVHNTAKVQEGDSVAVFGLGGIGLAVIQGAKQAKAGRIIAIDTNPAKFELAREFGATECLNPNDFDKPIQQVIIEMTKWGVDHTFECIGNVNVMRAALESAHRGWGQSIIIGVAGAGQEISTRPFQLVTGRTWKGSAFGGVKGRTQLPGMVEDAMKGIIRLRPFVTHTMPIERINEAFDLMHEGKSIRTVVHY

SEQ ID NO: 2450 - protein, 286 aa, Synechococcus sp. WH 5701
MDPTAGWVDEIHQGVRYGLEAEVLLEQSSPYQRVTIIESRRYGKGLLLDGCWMTAERQERHYHEPLVHPALCAAASLERVLVIGGGDGGTARECLRHPGVRHLDLVEIDGLVVECAQRYLPSLGGGCWDDPRFQLTVGDGIAWVSAAAAASYDVVIVDGSDPAGPAEGLFNRAFFQQCRRLLRPGGVFATQSESPEAFREVHLATVRLLREVFGHADPLYGWVPMYPSGWWSWTFAAVDGPRYLEPRPERAEAVAAGCEIWSPRWQRGAFEAIPAGIERALDHPQA

SEQ ID NO: 2451 - protein, 131 aa, Brassica napus
IVMRALNSRLVLIDINTSWQASRRLISATATAFSSDSSSSFRRTRGARQRIASSKSPASPSPLRKPSDGFTFDVQLPSADSESSSSRKTSPSPPTVVELDAFLEILPPATRKELVKHEAIGELIEVVMDLG

SEQ ID NO: 2452 - protein, 491 aa, Solanum tuberosum
MANTKDSYHIITMDTKESSIPNLPMKEIPGDYGVPFLGAIKDRYDFHYNQGADEFFRSRMEKHDSTIFRTNVPPGPFNARNSKVVVLVDAVSYPILFDNSQVDKENYFEGTFMSSPSFNGGYKVCGFLGTTDPKHTTLKGLFLSTLTRLHDKFIPIFTTSITQMFTSLEKELSEKGTSYFNPISDNLSFEFLFRLFCEGKNPVDTSVGTNGPKIVDKWVFLQLAPLISLGLKFVPNFLEDLVLHTFPLPYFLVKGDHQKLYNAFYNSMKDILDEAEKLGVKREEACHNFIFLAGFNSYGGMKVFFPSLIKWIGTSGPSLHTRLVKEIRTAVKEAGGVTLSAIDKMPLVKSVVYETLRMDPPVPFQTVKARKNIIVSNHEASFLIKKDELIFGYQPLATKDSKVFKNAEEFNPDRFVGYGEKLLKYVYWSNGKETDNPTVNDKQCPGKDLIVLLGRLLVVEFFMRYDTFEIEFGKLLLGSKVTFKSLTKATS

SEQ ID NO: 2453 - protein, 370 aa, Cryptococcus neoformans var. neoformans JEC21
MANILKRSALKLGMIPADGIGKEVLPAAQRVIEALGSSIPKTTFVPLVAGWEEFNKNGKALPDDTVSALRECDGAMFGAVSSPSHKVAGYSSPIVALRKHLDLYANVRPVSSVPIPGQPSPKAVDLVIVRENTECLYIKQEEISGEGEDRVALATRKISAKASSRIGRMAFEIALRRGQEREAARAAGKDVWWKGEPKVTIVHKSNVLSVTDGLFRETVRAVKEGKGGEKYAGVKLEEQIVDSMVYRMFREPEFFDVCVAPNLYGDIISDGAAALVGSLGLVPSINAGDNFIMGEPVHGSAPDIEGKNIANPIASIRSAALLLSSLGYIEPAAKINAAVNAVLVEGQYLTPDLGGKSSTTEVTEAVLKRL

SEQ ID NO: 2454 - protein, 490 aa, Beta vulgaris
MSSDSEAGLGGGGGDLRKPFLHTGSWYRMGSRQSSLMGSSQVIRESSISVLACVLIVALGPIQFGFTAGYSSPTQSAITNELGLSVAEYSWFGSLSNVGAMVGAIASGQISEYIGRKGSLMIAAIPNIIGWLAISFAKDSSFLYMGRMLEGFGVGIISYTVPVYISEIAPQNLRGALGSVNQLSVTIGIMLSYMLGLFVPWRILAVLGILPCTILIPGLFFIPESPRWLAKMGMMEEFEVSLQVLRGFDTDISLEVNEIKRSVASSSKRTTIRFAELRQRRYWLPLMIGNGLLILQQLSGINGVLFYSSTIFKEAGVTSSNAATFGLGAVQVIATVVTTWLVDKSGRRLLLIVSSSGMTLSLLVVAMSFFLKEMVSDESTWYSVFSILSVVGVVAMVVTFSLGIGAIPWIIMSEILPINIKGLAGSIATLANWFVAWIVTMTANIMLSWNSGGTFSIYMVVCAFTVAFVVIWVPETKGRTLEEIQWSFRR

SEQ ID NO: 2455 - protein, 462 aa, Cryptococcus neoformans var. neoformans JEC21
MPRVIKPSKPRHDPLHLELEGDESIRKFGRVTKPGKRKAKKEEADDDEPKAEDARMSKKILDLARDQQEEVARELGQDDDWEDEDEAEAEPSRRPRDIAQLPSDDEEEEEFSDGEISGGEEYAELHIDPADHATLDALNRGSGTAPMGQDQGEEDGEPKTLADMIFSKMQGGAVSRGVVDEHEGPPDPRKGLNPKVVEVYSKVGFLLSRYKSGPLPKALKILPSLPHWAQLLALTKPTEWTPHATFACTKIFVSNLKPTEVRVFLEGVLLDKCREDMRMNNGKLNVHLYEALKKGLYKPAAFFKGILFPLCETGCSLKEAAIFASVLSKVSVPVLHSAAALLRLASMDYSGPNSLFIRILLDKKYALPYKVVDALVFHFIRLANSPRSKDGEDKLPVLWHQSLLVFVQRYASDLTPDQKDALLDVIRARPHPTISSEVRREIVNSVERGAPRPEDGEDVKMQ

SEQ ID NO: 2456 - protein, 392 aa, Oryza sativa
  misc_feature (222)..(222): Xaa can be any naturally occurring amino acid
  unsure (1)..(392): unsure at all Xaa locations
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDSLMKILTERGYSFTTTAEREIVRDIKEKLAYVXALDYEQELEAAKSSSSVEKSYELPDGQVITIGAERFRCPEVLFQPSFIGMEAPGIHETTYNSIMKCDVDIRKDLYGNIVLSGGSTMFPGIADRMSKEITALAPSSMKIKVVAPPERKYSVWIGGSILASLSTFQQVNLTPTLYEVARMQMWISKGEYDESGPAIVHRKCF

SEQ ID NO: 2457 - protein, 506 aa, Triticum aestivum
  misc_feature (201)..(201): Xaa can be any naturally occurring amino acid
  misc_feature (206)..(206): Xaa can be any naturally occurring amino acid
  misc_feature (240)..(240): Xaa can be any naturally occurring amino acid
  unsure (1)..(506): unsure at all Xaa locations
MQSEIWLLWATLAAALLFYLTSAARRGGTGARQPRGPTPLPVLGNVLDLGGNLHHTLARLARVHGPVMKLKLGLVTIVVVSSRDAAREAYTRYDRHLAARAVPDAANAVGNSGRSMIWLPSSDPLWKTLRGIVASHIFSPRGLAAARGVRERKVRDMVGYFRCHAGEEVDVGQAVYGGVLNLVSSAFFSVDVVDVGSESRXGLREXPVEDIIAALAKPNVSDIFPFLRPLDLQGWRRWAXARYQKVFGILDGIVDRRLADARTSNGEHAHGDFLDSLLELVSTGKIGRDKVTVILFDLFSAGTDTMAITVEWAMDELLRHPHAMAKVRAEMADILGGKGTDTLEEPDAANLPYLQAVVKEVMRLHPVAPIMLPHQAAEDGVEIGGYAVPRGATVIFNVWAIMRDPAAWERPDEFVPERFLLDKAVDRAVEFRGKDYEFIPFGSGRRLCPGLPMAERVVPFVLASLLHAFEWRLPDGVSADELDVSERFTTVNTLAVPLRAVPVVVT

SEQ ID NO: 2458 - protein, 374 aa, Chlamydomonas reinhardtii
MALMMKSSASLKAVSLAALAAPSLCAPGKYDEELIKTAGTVASKGRGILAMDESNATCGKRLDSIGVENTEENRRAYRELLVTAPGLGQYISGAILFEETLYQSTASGKKFVDVMKEQNIVPGIKVDKGLVPCPTPTMSWCMGLDGWTSAAEYYKAGARFAKWRSVVSIPHGPSIMLPRLAYGLARYAAIAQNAGLVPIVEPEVLLDGEHDIDRCLEVQEAIWAETFKYMADNKVMLQGILLKPAMVTPGADCKNKAGPAKVAEYTLKMLAARAPPVPGIMFLSGGQSELESTLNLNAMNQSPNPWHVSFSYARALTNTVLKTWQASPRTVQAPRLAAQARKANSDAQQGKYDATTEGKEAAQGMYEKGKGYVY

SEQ ID NO: 2459 - protein, 529 aa, Arabidopsis thaliana
MSLTERLYNHLSLFDLLLSLLGLFVFCCLREKLTNKRGPMLWPVFGITLEFFFHINDVYGWVTRSLKKCRGTFLYRGVWLDGSYGAVTCVPANVEYMLKTNFKNFPKGTFFKSRFNDLLEEGIFNADDDSWKEQRRIIITEMHSTGFVEHSFQTTQHLVRKKLLKVMESFAKSQEAFDLQDVFLRLTFDIICLAGLGADPETLAVDLPQVPFAKAFEEATESTLFRFMIPPFIWKPMRFLDTGYEKGLRIAVGVVHGFVDKMIVDRICELKEEETLDNRSDVLSRIIQIESHKRENEIDPSTIRFFRQFCTSFILAGRDTSSVALSWFCWVIQKHPEVENKIICEIREILRQRGDSPTSKNESLFTVKELNNMVYLQAALSETLRLFPPIPMEMKQAIEDDVLPDGTFVRKGSRVYFSIYAMGRMESIWGKDCEIFRPERWIQAGKFVSDDQFKYVVFNAGPRLCIGKTFAYLQMRMIAASVLLRYSIKVVQDHVIAPRVTTNLYMKYGLKVTITPRSLEEKKLESCSM

SEQ ID NO: 2460 - protein, 728 aa, Marinobacter sp. ELB17
MTVELFRALRHRITEGELPDVSAGNAQAAGLSRFDLIELFESQVQSRLIDLQARVLQARGDAYYTIGSAGHEGNAAIAKALRLTDPAFLHYRDAAFFIQRSKALPGQTVSWDMLLSFMASSDDPIAGGRHKVLGSKALNVPPQTSTIASHLPKAVGAAYGLGLWKRLGGAGGWPTDSLVLCSFGDASLNHSTAQGAINTACWTAYQGLPMPLIFVCEDNGLGISTPTPQGWVAASMANRPGLNYIACNGLDLVDTWQAASRAAILARTHRQPVFLHMRCVRLYGHAGSDAQQAYLSQAQIQAMTNEDPLAHGAARLLRETRLSRADLGQLLDTTWGRLGAVGDQTSQRPRLRGSEAVMSAIVPPLRPSLANPAAELPAIDPTPQPMARLINQSLHRLMARFPQLVMAGEDIGNKGGVYGVTQRLQQQYGRHRVIDTLLDEQSILGLGIGMGQNGLIPILEIQFLAYLHNAEDQLRGEAATLSFFSNGQFTNPMVVRIAGLGYQKGFGGHFHNDNSLAVLRDIPGLLVACPSDGTSAVGLLQEAVRLADEEQRVVVIIEPIARYHNRDLLTEGDQLACQPDPGPDYRLPRGRFRQCRSGSDLAIITYGNGVTLSLQAAEQLAPEGISVRVIDLCWLTEIDHAALYEAVKDCKQILVVDECRRHGSISEELISELSAQGVASSRMDRVTALDSFIALGKASTSTLPAVEDILEHVRALTGAGSTAIEKGA

SEQ ID NO: 2461 - protein, 204 aa, Glycine max
MACLHDHSCEDHDCSSNWSLYKHIDLSKVTALNEANPGSVKSVFKAWEERLDSSGVHLESNEGDPELLVFIPFTSDVKIKSISIVGGADGTSPSKMRVFINREGIDFSDAQSMQAIQEWDLVENMQGVLEYQTRYSKFQSVANITLHFPENFGGDTTKIHYIGFKGEATQLKRDVVATIVYELMPNPSDHKTRAESGGGLSHIE

SEQ ID NO: 2462 - protein, 457 aa, Streptomyces coelicolor A3(2)
MSTDSPKDLSRTAYDHLWMHFTRMSSYENAPVPTIVRGEGTHIYDDKGRRYLDGLAGLFVVQAGHGRQELAETASKQAQELAFFPVWSYAHPKAVELAERLANEAPGDLNKVFFTTGGGEAVETAWKLAKQYFKLTGKPTKYKVISRAVAYHGTPQGALSITGLPALKAPFEPLVPGAHKVPNTNIYRAPIHGDDPEAYGRWAADQIEQQILFEGPETVAAVFLEPVQNAGGCFPPPPGYFQRVREICDQYDVLLVSDEVICAFGRLGTTFACDKFGYVPDMITCAKGMTSGYSPIGACVISDRLAEPFYKGDNTFLHGYTFGGHPVSAAVGIANLDLFEREGLNQHVLDNEGAFRATLEKLHDLPIVGDVRGNGFFYGIELVKDKATKESFDEEETERVLYGFLSKKLFENGLYCRADDRGDPVIQLAPPLISNQETFDEIEQILRATLTEAWTKL

SEQ ID NO: 2463 - protein, 479 aa, Streptomyces coelicolor A3(2)
MSTELRRLRNYIDGEFRDAADGRTTEVVNPATGEAYATAPLSGQADVDAAMAAAAAAFPAWRDLVPAERQKALLKIADAFEERAEELIAAEVENTGKPIGLTRSEEIPPMVDQIRFFAGAARMLEGRGAGEYMEGLTSFVRREPIGVCAQVAPWNYPMMMAVWKFAPALAAGNTVVLKPSDTTPASTALMADIIGSIVPKGVFNVVCGDRDTGRLMVEHETPAMASITGSVRAGMSVAESASKDLKRVHLELGGKAPVVVFEDTDIPKAVEGISEAGYFNAGQDCTAATRVLVHESVHDEFVSALAKAASEIKTGQPDDEDVMYGPLNNPNQLKQVSGFIERLPAHAKVEAGGHRVGDKGYFYAPTVVSGLKQDDEIIQREVFGPVITVQAFRDEDQAVEWANGVEYALASSVWTKDHGRAMRMSKKLDFGCVWINTHIPLVAEMPHGGFKKSGYGKDLSGYGFEDYTRIKHVMTSLDM

SEQ ID NO: 2464 - protein, 375 aa, Oceanobacillus iheyensis HTE831
MGKRDYYEILGIDKSASQDEIKKNYRKLARKYHPDVNKEADAAEKFKEVKEAYEVLSDDQKRAQYDQFGHSGPQSQGFGGFGGGAQDFGGFGDIFDMFFGGGGRSRDPNAPQQGNDLQYTMILDFEEAVFGKETDIEIPKEESCDTCNGSGAKPGTKPETCSHCHGSGQLNQEQNTPFGRVVNRRVCNYCQGTGKIIPDKCNTCGGSGTVQKNKKIHISIPAGIDEGQQIRVAGKGESGKNGGPAGDLFVVIKVRPHDFFVREGDHIFCELPLTYAQAALGDELEVPTVHGKVKVKVPAGTQTGKTFRIKGKGAPNVRGRGHGDQHIKIKVMTPTNLSEKQKDLLREFNELGGNESTDEQDDNIFQRFRRAFKGE

SEQ ID NO: 2465 - protein, 570 aa, Medicago truncatula
MHFHIPYLSNTMTKSSNINFTSSNSSSSSSSSSPLAAANFNFNMIYSISLSLLQDIQILEILIAITLFIIIHSLRQKNHHGLPIWPFLGMLPSLINGLRTNLYEWITDILNKQNGTFRFKGPSFSSLNCIVTSDPRNLEHLLKTKFINFPKGTYFRNMVRDLLGDGIFSADDEIWQKQRKTASIEFHSTKFRNLTTDSLFELVHSRLLPVLDESVDKRAVTDLQDILLRLTFDNVCMIAFGVDPGCLSQKLPEIPFAKAFEDATEATVLRFVMPTCAWKFMRLLNLGVERKLKKSIKGVDEFAMNVIRTRKKELSLEVDEKKQRSDLLTVFMKMKDENGSAYSDKFLRDICVNFILAGRDTSSVALSWFFWLLDQNHEVEEKILEEICKVVSQRNDIKKEEFENSLIFRPEEIKKMDYLHACLSETLRLYPSVPVDHKEVVEDDTFPDGTILKKGTKVIYAIYAMGRMESIWGKDCREFKPERWLKDGRFMSESAYKFTAFNGGPRLCLGKDFAYYQMKYVAASIIYRYHVKVVENHPVEPKIALTMYMKHGIKVNLYRRDAAEIQKHLI

SEQ ID NO: 2466 - protein, 372 aa, Haplomitrium mnioides
MAKTKQIKNFTPNSGPQHPAAHGVSRLVLEMNGEVVERAEPHIGLLHRGTEKLIEYKTYLQALPYFDRSDYVSMMAQEHAYPSAVERLCNCEVPPRAQYIRVLFREITRILNHLLALTTHAMDVGAPTPFLWAFEEREKLLEFYERVPGARMHASYIRPGGVAQDLPLGLSEDISPFTQQFASRIDELEEMLTNNRIWKQRLVDIGTVTAQQAVDWGFSGVMSRGSGVCWDLRKSAPYDVYDRLDFDVPVGTRGDCYDRYCIRIEEMRQSIRIIMQCLNQMPSGVIKADDRKPRPPSRSQMKQSTESLIHHLKPHTEGVSVPAPSTHTAVEAPKGEFGVFLVSNGTNRPYRCKARAPGFAHLQGLDSMSKHH

SEQ ID NO: 2467 - protein, 305 aa, Haplomitrium mnioides
YSLAVERLCNCEVPPRAQYIRVLFCEITRILNHLLALTTHAMDVGALTPFLWAFEEREKLLEFYERVSGARMHASYIRPGGVAQDLPLGLSEDIFLFTQQFASRIDELEEMLTNNRIWKQRLVDIGTVTAQQAVDWGFSGVMLRGSGVCWDLRKSAPYDVYDRLDFDVPVGTRGDCYDRYCIRIEEMRQSIRIIMQCLNQMPSGVIKADDRKLCPPSRSQMKQSMESLIHHFKLYTEGVSVPASSTYTAVEAPKGEFGVFLVSNGTNRPYRCKIRAPGFAHLQGLDFMSKHHMLADVVTILGTQD

SEQ ID NO: 2468 - protein, 334 aa, Gloeobacter violaceus PCC 7421
MTMVQQQLPPTRYHIDRPEALVLYRDMVLGRTFEDTCAQMYYRGKMFGFVHLYNGQEAVSTGVIKAMRPDDYVTSTYRDHVHALSKGVPARSVMAELFGKATGCSKGRGGSMHLFSAEHNLLGGFAFVAEGIPIATGAGFTAVYKGTDQVSACFFGDGATNNGQFFECLNMAALWNLPVLYVVENNLWSIGMYHHRASSVIEIYKKADAFGIPGVRVDGMDVLAVRAVAKEAIERARAGGGPTLIECTTYRFRGHSLADPDELRDPAEKEFWRKQDPIPRLAAFVREQELASAEELKAIDQEIRAEIDDAVLFAEESPEPPIDELYRFQFAEDA

SEQ ID NO: 2469 - protein, 327 aa, Gloeobacter violaceus PCC 7421
MPVKLFYEALKDAMAEEMRRDPNVYVLGEDVGHYGGSYKATKDLYKEFGELRLLDTPICENAFTGLAVGSAMTGLRPIIEGMNMGFLLLAFNQIANNGGMLRYTSGGQFKIPMVVRGPGGVGKQLGAEHSQRLEGYFNNVPGLKIVHTSTVYNAKGLLKAAIRDDNPVMFFEHVLLYNLKEDIPEEEYLLPLDKAEMVKEGRDVTVLTYGRMRHHCTEALQELAARDIDVEVIDLISLKPLDLETIGRSLKKTHRVVIVEEDMKSGGVGAEIVASIDEHYFDYLDAPVLRLASKDVPVPYNGRMEATVIPQPQDIVQAVENMLALRV

SEQ ID NO: 2470 - protein, 537 aa, Bacillus anthracis str. Ames
MMMNVPLTISSMMERAEKLFSKKEIVSRTHDTVTTLTYKQLGERTRRLSSALKKLGIKEGERIGTLAWNHHRHVEAYFAIPGIASVLHTINIRLSPQHISYIIQHAEDRILLIDEDLVPLIENIQSQLSTVQAYIIMTDKDEIPNTTLEPIYHYEKLLEEGDPNFQFVKDIDENTPAGMCYTSATTGNPKGVVYTHRSTVLHCMALGLADTAALSESDAAMAIVPMFHVNAWGLPFAATWFGSKQVLPGPMFTPKILLEMIQAEKVTLAAGVPTIWLGVLQELENNSYDLSSMTRILCGGAAAPKSVIKAFEQKHNVPFIHAYGMTETSPLVTLARLKSYETELSYEEQLEIRSKQGYLVPGVEMKVVGTNGEVKWDSTEMGELCLRAPWIAESYYNDDRTVEGFRDGWLYTGDVVTVDEEGCVKIVDRTKDVIKSGGEWISSVDLENALMAHDAIFEAAVVAVPHPQWQERPVACVVQKKNSTVTKEEIYEFLKPQFAKWWLPDDIVFMEEIPKTSVGKFLKQALRKELEHLHKEK

SEQ ID NO: 2471 - protein, 430 aa, Shewanella sp. MR-4
MTRSEALFEQAKKTIPGGVNSPVRAFNGVGGSPLFIEKADGAYIYDADGKAYIDYVGSWGPMILGHNHPKIREAVLAAVHNGLSFGAPTELEVQMAEKVIAMVPSIEQVRMVSSGTEATMSAIRLARGFTNRDKILKFEGCYHGHADCLLVKAGSGALTLGQPSSPGIPEDFAKHTLTAVYNDLDSVRTLFEQYPIEIACIIIEPVAGNMNCIPPIPGFLEGLRTMCDEFGALLIIDEVMTGFRVSRSGAQGHYGVTPDLTTLGKVIGGGMPVGAFGGRKDVMQFIAPTGPVYQAGTLSGNPIAMSAGLAQMEALCEEGLYEALSAKTKRIAEGFKAAADKHGIPMAINYVGGMFGFFFTEQEQITRFDQVTKCNIEHFRTFYHGMLDEGVYLAPSAYEAGFLSMAHGEEELRLTLEAADRVLARMKAAM

SEQ ID NO: 2472 - protein, 512 aa, Rhodococcus sp. RHA1
MHIPFTVTDFLERGAAGFPDSVAVIDEPEQPGESVGQVTFRELAHRVCAWQAGFDRLGIRVGERVAVVSHNSARLLELLYAVPASGRICVPINFRLSPAEVDYIVGDCGASVLLVDPELEEALSGIKVRHRFVLGKHTDADLMRFDTEPAPWASPTEESTATINYTSGTTARPKGVEMTHRNLWVNAVTLAMHTRAWERDVYMHTLPMFHCNGWGMPFGMAGLGAKQIVLRKVDGTEILRRVEEHGVTLMCGAPAVWNAVLDAARSWQGEIPGRDRVRVVCAGAPPPSRTIARLSSELGWELQQIYGLTETSPLLTFNRSLPADDGLDLEERAHRLTRAGLPALGARLHISNSGEVLARSNVVMNGYWNNPEATDEALRDGWFHTGDGGMIDGEGQLTISDRKKDVIVTGGENVSSIEVEECIFSHPGVTQVAVIGVPDEKWGETVKALVVTTGPSTVSEAEIIAHCKQHLAGYKAPTSVEFRDSIPHTATGKIQKFKLRAPYWEGSTRGVN

SEQ ID NO: 2473 - protein, 501 aa, Suaeda liaotungensis
MSIPIPSRQLFIDGEWREPIKRNRLPIINPSTEETIGEIPAATAEDVEAAVSAARRALKRNKGRDWAATSGAHRARYLRAIAAKVSEKKDHFVKLETMDSGKPLDEAVLDIDDVSTCFEYFADQAEALDNKQKYPVKLPMDRFKSHVLRQPIGVVGLISPWNYPLLMATWKIAPALAAGCTAVLKPSELASVTCLEFGEVCNEVGLPPGVLNILTGLGPDAGAPLVSHPDVDKVAFTGSSATGSKVMGSAAQLVKPVTLELGGKSPIIVFEDVVDLDVAAEWTIFGVFWTNGQICSATSRLLVHESIAAEFVEKLVKWSKKIKISDPFEEGCRLGPVISKGQYDKIMKYISTAKSEGATILCGGSRPEHLKKGYFIEPTIVTDITTSMQIWKEEVFGPVLCVKTFSTEEEALELANDTEYGLAAAVFSKDLERCERVTKALEVGAVWVNCSQPCFCHAPWGGVKRSGFGRELGEWGIENYLNIKQVTSDISDEPWGWYKSP

SEQ ID NO: 2474 - protein, 148 aa, Oryza sativa
  misc_feature (109)..(109): Xaa can be any naturally occurring amino acid
  unsure (1)..(148): unsure at all Xaa locations
LGALCMQWLEDKVFSIRDAAANNLKRLAEEFGPEWAMQHIIPQVLEKINNPHYLYRMTILQAISLLAPVMGAEITCQQLLPVVINSSKDRVPNIKFNVAKVLQALIPIXLDQSNVKPCLVELSEDPDVDVRYYANQALQACDQIMMSS

SEQ ID NO: 2475 - protein, 504 aa, Bacteroides thetaiotaomicron VPI-5482
MSKKALLMILDGWGLGDQKKDDVIFNTPTPYWDYLMNNYPHSQLQASGENVGLPDGQMGNSEVGHLNIGAGRVVYQDLVKINRACADNSILQNPEIVSAFSYAKENGKSVHFMGLTSNGGVHSSMVHLFKLCDISKEYGIDNTFIHCFMDGRDTDPKSGKGFIEELSAHCEKSAGKIASIIGRYYAMDRDKRWERVKEAYDLLVNGQGKKATDMVQAMQESYDEGVTDEFIKPIVNANCDGTIKEGDVVIFFNYRNDRAKELTVVLTQQDMPEAGMHTIPGLQYYCMTPYDASFKGVHILFDKENVANTLGEYIASKGLNQLHIAETEKYAHVTFFFNGGRETPFDNEDRILVPSPKVATYDLKPEMSAYEVKDKLVDAINENKYDFIVVNFANGDMVGHTGIYEAIEKAVVAVDACVKDVIEAAKAQDYEAIIIADHGNADRALNEDGTPNTAHSLNPVPCVYVTGNKAAKVEDGRLADVAPTILKIMGLEAPADMNGQILIK

SEQ ID NO: 2476 - protein, 122 aa, Glycine max
MLSNSERNSQNQNQKKRAKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 2477 - protein, 102 aa, Glycine max
  misc_feature (45)..(45): Xaa can be any naturally occurring amino acid
  unsure (1)..(102): unsure at all Xaa locations
EQSKKKKKEKKGLKEKIEEKIEGDHHHKIKEKLPGHKKTEEAQVXTPPPPPLVASLEHGEGAHHEGEAKEKKGILEKIKEKLPGYHSKTEEEKEKEKESGAH

SEQ ID NO: 2478 - protein, 480 aa, Neisseria meningitidis FAM18
MKQLAMYINGRFENDFNGEWRDVLNPSTEETIAREPKGGKADVDRAVAAARAAQPAWERLPAVERGAYLRKIAQGIRERADELTDTIVAEGGKTKDLARVEVMFTADYLDYQAEWARRYEGEIIQSDRPRENILLFKRPLGVVAGILPWNFPFFLIARKMGPALVTGNTIVVKPSSVTPINCHIFAEIVDAVGLPAGVFNVVNGPGAEIGNALSAHPQVDMVSLTGSVEAGRQVMEAASANITKVSLELGGKAPAIVLKDADLDLAVKSILASRVGNTGQICNCAERVYVHSSLKDAFIEKMTAAMKGVRYGNPAEAEAGALEMGPLIEERAVKAVAEKVERAVKQGAKLVCGGKRAEGRGYFFEPTLLTDTDNSMDIMKEETFGPVLPVSAFDTLDQVIALANDCEFGLTSSVYTTNLNEAFYVTRRLQFGETYINRENFEAMQGFHAGWKKSGIGGADGKHGLEEYLQTQVVYLETDI

SEQ ID NO: 2479 - protein, 271 aa, Desulfovibrio desulfuricans G20
MFATQDILFAFGLTLFAGLCTGIGSALAFFTQKTNTKVLSVALGFSAGVMLYVSFVEILSKAQDALTASLGNVAGAWATVASFFGGIGFIALIDYFVPSEENPHEVQKVEAMDDQCEAARFKKLYRMGIFTALAIGIHNFPEGLATFTAALTDPQLGVAIAVAIAIHNIPEGIAVSIPVFYATGDRRLAFRLSFLSGLSEPVGALVGYLLLMPFFSDTVFGVLFAGVAGIMVFISLDELLPTAKEYGEHHLSIAGVVAGMAVMALSLLLFI

SEQ ID NO: 2480 - protein, 504 aa, Sinorhizobium meliloti 1021
MLSNFIAPDSNDPRLRIKSRYQMLVDGKSVDAASGSTIDRVSPGHAGEVVGTWPEASADDVRKAVAAARKAFDAGPWPRMSGAERSRLMFKVADLILARQEELALIESLEVGKPIAQARGEIGFCADLWSYAAGQARALEGQTHNNIGDDRLGLVLREPVGVVGIITPWNFPFIIASERVPWAIGSGCTVVLKPSEFTSGTSIRLAELAREAGIPDGVFNVVTGYGDPAGQVLAEDPNVDMVAFTGSVRVGTKLGEIAARTVKRVGLELGGKGPQIVFADADLDAAADGIAYGVYHNAGQCCISGSRLLVQEGIRDALMERLLDISRKVAFGDPLNERTKIGAMISEAHAEKVHSYVTAGITSGAELLLGGERIGREAGLYYAPTVFAGVTPDMSIAREEIFGPVLSTLTFKTADEAVALANATEFGLSASVWSTNLETALQTIRRIRAGRCWINSVIDGTPELPIGGYKKSGLGRELGRYGFDEYSQFKGVHVTLGRPAPWFT

SEQ ID NO: 2481 - protein, 448 aa, Sinorhizobium meliloti 1021
MNVDEKLEPILAEVLRRNGGEHEFHQAVREVLESLGRVIAKHPRYAENALIERICEPERQIIFRVPWVDDKGQVQINRGFRVQFNSALGPYKGGIRFHPSVNIGIIKFLGFEQTFKNALTGMPIGGGKGGSDFNPRGRSDGEIMRFCQSLMTELHRHLGEYTDVPAGDIGVGGREIGYMFGQYKRLTNRYEAGVLTGKALFYGGSRARKEATGYGATYFVQRMIATKGLDFEGKRVTVSGSGNVAIYTMEKVIEFGGKIVACSDSNGYVVDEDGIDLELVKEIKEVRRERISEYARLKGAGTHYIEAGSVWDVPCDVAMPSATQNELTGKDARTLVKNGVLAVGEGANMPCTPEAVRIFQEAGVLFAPGKAANAGGVATSALEMQQNASRDSWTFEQTEARLATIMQAIHDRCAETAEEYGTPGDYVLGANIAGFVRVAEAMDALGVI

SEQ ID NO: 2482 - protein, 340 aa, Pisum sativum
FTGTYMPSTQLTGGYRILSYLDPPEPKHDQLKRFLFFLLKSRSSHFIPEFHSSYTNLFETLEKELAKKGKAVFTDSGDQTAFNYLAKAFYGVNPSETKLGTDAPSIITKWAARQLGPILTTGLPRLIEEPLLHTFLLPPALVKKDYQRLYEFFYESSSGPVLDEAVRLGVSKEEAVHNLIFATCFNSFGGMKILFPSMLAYIGEAGVNLHRRLAEEIRSVVKSNGGKVTMAGLEQMRLMKSVVYETLRIDPPVPFQYAKAKRDLVIENHENAFQVKEGEMLFGFQPFATKDPKIFDRAEEFVGDRFLGEGEKLLKHVLWSNGPETEQTNVGNKQCAGKDL

SEQ ID NO: 2483 - protein, 206 aa, Zea mays
MRSCSSARQMLLTRLSSVSCSSTAQQLHAGVGKFAAAACWSWKKKREELPCFRARLAGKPPRASPAKGGIVPASDDDDGVSLGTVKLPGNIDTARLESLLFQWGNSLCQGANLPLPVPLKISSPDAIDQVDKVEGGIRLGFVAVEDGATRTLVYIDCLVSPAPDGSGPVFRAIRNGPMKDKEPPGEPRIMRSLLQALEKSIQIARV

SEQ ID NO: 2484 - protein, 413 aa, Rhodococcus sp. RHA1
MTSDIVVIGGGVAGVTAAQSLRSEGYDGRLVLIGKERELPYDRTALSKAVLAGDLADPPLLFPADWYDEWQIETVLDRTVLQVDVTRREVLLDGGPWLKVDRVLLATGASARVPSFSGSDLPGVATLRTADDVHRMRRDWEPGQRLVVVGGGLIGCEVATTARKLGLEVSILEASDELLQRVLGRRIGGWCRARLMELGISVVLNTGVAEFKGVDRITTVIGTDGRSFVADRAIVCVGAEPETAIAEQSGLACNRGILVNDSGGTAAEGVFAAGDVASWPLLTGGRRSLETYINSQREATAVASAMLGKAVHGPQLPLSWTEMAGHRIQMIGDIEGSGEYVMRGDPDDGPALLFRLSDGRVTAAVSVDAPRDFAMATRLVERGAQVGREVLGDTSMELRELNRAARERALIAE

SEQ ID NO: 2485 - protein, 301 aa, Brassica napus
MKGLFKSKPRTPSDLVRQTRDLFLYAHGSISLPDSKRDEKMAELSRNIRDMKSILYGNSEAEPVAEACAQLTQEFFRGDTLRLLITCLPKLNLETRKDATQVVANLQRQQVNSKLIASDYLEANLDLMDLWIEGFENTDLALHYGAMFRECIRHQIVAKYVLESEHVKKFFDYIQLPNFDIAADAAATFKELLTRHKSTVAEFLTNNEDWFFADYNSKLLESSNYITRRQAIKLLGDILLDRSNSAVMTKYVSSRDNLRILMNLLRESSKSIQIEAFHVFKLLVANQNKPADIVNILVANR

SEQ ID NO: 2486 - protein, 231 aa, Burkholderia sp. 383
MTQDELKRLVGQAAADYVIQNVPEGAVIGVGTGSTANCFIDALAVVKARYRGAVSSSVATTERLKSHGIKVFDLNEVDSLQVYVDGADEIDASGAMIKGGGGALTREKIVASVADTFVCIADASKRVPVLGAFPLPIEVVPMARTAIGRRVTALGGVPVLRVTKDGAPYITDNGNEIIDVKGLQIADPRGFEAQVNAWPGVVTVGLFAERGANLCLLGTENGVETIVYSAN

SEQ ID NO: 2487 - protein, 522 aa, Beta vulgaris
MDASAAAINVNAHLTEVGKKRFLGERISQSLKGKDLRALFSRTESKGRNVNKPGVAFSVLTSDFNQSVKESLKYEPALFESPKADPKNVAAIVLGGGAGTRLFPLTSRRAKPAVPIGGCYRLIDVPMSNCINSGIRKIFILTQFNSFSLNRHLARTYNFGDGVNFGDGFVEVFAATQTPGESGKKWFQGTADAVRQFFWAFEDSKSKDVEHIVILSGDHLYRMDYMSFWQKHIDTNADITVSCIPMDDSRASDYGLMKIDHTGRIVHFAEKPKGSDLTAMQVDTTVLGLSDLEAMSNPYIASMGVYVFRTDVLMELLNRKYPSSNDFGSEIIPSAVGESNVQAYLFNDYWEDIGTIKSFFDSNLALTQQPPKFEFYDPKTPFYTSARFLPPTKVDRCKIVDSIVSHGCFLQESSIQHSIVGVRSRLESGVEFQDTMMMGADYYQTESEIASLLAEGKVPVGVGQNTKIKNCIIDKNAKIGKDVVIANTDGVEEADRPNEGFYIRSGITIILKNATIQDGLVI

SEQ ID NO: 2488 - protein, 414 aa, Neisseria meningitidis FAM18
MTLFCEQVPYPRLAEAFGTPLYVYSQSALTEAFEHYQTAFAELSPLVCYAVKANGNLSIIKHFASLGSGFDIVSGGELARVLAAGGDAAKTIFSGVGKSEAEIEFALNAGVKCFNMESIPEIDRIQKVAARLGKTAPVSLRVNPDVDAKTHPYISTGLKANKFGIAYADALEAYRHAAQQPNLKIIGIDCHIGSQLTDLSPLVEACERILILVDALAAEGIVLEHLDLGGGVGIVYQDEDVPDLGAYAQAVQKLIGTRRLKLILEPGRSLVGNAGSLLTRVEFVKYGEEKNFVMVDAAMNDLMRPALYDAYHHIEAVETKDIATLTANIVGPICETGDFLGKDRTIACEEGDLLLIRSAGAYGASMASNYNARNRAAEVLVNGGGYKLIRRRETLEQQMANELACLQAEHQNAV

SEQ ID NO: 2489 - protein, 523 aa, Hordeum vulgare
MSSMQFSSVLPLEGKACVSPVRREGSACERLKIGDSSSIRHERASRRMCNGGARGPAATGAQCVLTSDASPADTLVLRTSFRRNYADPNEVAAVILGGGTGTQLFPLTSTRATPAVPIGGCYRLIDIPMSNCFNSGINKIFVMTQFNSASLNRHIHRTYLGGGINFTDGSVEVLAATQMPGEAAGWFRGTADAVRKFIWVLEDYYKHKSIEHILILSGDQLYRMDYMELVQKHVDDNADITLSCAPVGESRASEYGLVKFDSSGRVIQFSEKPKGDDLEAMKVDTSFLNFAIDDPAKYPYIASMGVYVFKRDVLLNLLKSRYAELHDFGSEILPRALHDHNVQAYVFTDYWEDIGTIRSFFDANMALCEQPPKFEFYDPKTPFFTSPRYLPPTKSDKCRIKEAIISHGCFLRECKIEHSIIGVRSRLNSGSELKNAMMMGADSYETEDEISRLMSEGKVPIGVGENTKISNCIIDMNARIGRDVVISNKEGVQEADRPEEGYYIRSGIVVIQKNATIKDGTVV

SEQ ID NO: 2490 - protein, 516 aa, Zea mays
MQFALALDTNSGPHQIRSCEGDGIDRLEKLSIGGRKQEKALRNRCFGGRVAATTQCILTSDACPETLHSQTQSSRKNYADANRVSAIILGGGTGSQLFPLTSTRATPAVPVGGCYRLIDIPMSNCFNSGINKIFVMSQFNSTSLNRHIHRTYLEGGINFADGSVQVLAATQMPEEPAGWFQGTADSIRKFIWVLEDYYSHKSIDNIVILSGDQLYRMNYMELVQKHVEDDADITISCAPVDESRASKNGLVKIDHTGRVLQFFEKPKGADLNSMRVETNFLSYAIDDAQKYPYLASMGIYVFKKDALLDLLKSKYTQLHDFGSEILPRAVLDHSVQACIFTGYWEDVGTIKSFFDANLALTEQPSKFDFYDPKTPFFTAPRCLPPTQLDKCKMKYAFISDGCLLRECNIEHSVIGVCSRVSSGCELKDSVMMGADTYETEEEASKLLLAGKVPVGIGRNTKIRNCIIDMNARIGKNVVITNSKGIQEADHPEEGYYIRSGIVVILKNATINDGSVI

SEQ ID NO: 2491 - protein, 348 aa, Arabidopsis thaliana
MEKPKFKTVQEVVAAGEGLPERYLHAPTGDGEVQPLNAAVPEMDIPAIDLNLLLSSSEAGQQELSKLHSALSTWGVVQVMNHGITKAFLDKIYKLTKEFFALPTEEKQKCAREIDSIQGYGNDMILWDDQVLDWIDRLYITTYPEDQRQLNFWPEVPLGFRETLHEYTMKQRIVIEQFFKAMARSLELEENSFLDMYGESATLDTRFNMYPPCPSPDKVIGVKPHADGSAITLLLPDKDVGGLQFQKDGKWYKAPIVPDTILINVGDQMEIMSNGIYKSPVHRVVTNREKERISVATFCIPGADKEIQPVNELVSEARPRLYKTVKKYVELYFKYYQQGRRPIEAALI

SEQ ID NO: 2492 - protein, 181 aa, Hordeum vulgare
KYPYIAGMGVYIFKKEILLNLLRWRFPTANDFGSEIIPAAAREINVKAYLFNDYWEDIGTIKSFFEANLALAEQPSKFSFYDASKPMYTSRRNLPPSMISGSKITDSIISHGCFLDKCRVEHSVVGIRSRIGSNVHLKDTVMLGADFYETDAERGDQLAEGKVPIGIGENTSIQNCIIDMN

SEQ ID NO: 2493 - protein, 444 aa, Streptomyces coelicolor A3(2)
MTALPQERRVVTAIPGPKSQELQARRTAVVAQGVGSTLPVFVARAGGGVIEDVDGNRLIDFGSGIAVTSVGASAEAVVRKASAQLADFTHTCFMVTPYEGYVAVAEALAELTPGDHAKKSALFNSGAEAVENAVKIARAYTKRQAVVVFDHGYHGRTNLTMALTAKNMPYKHGFGPFAPEVYRVPVAYGYRWPTGAENAGPEAAAQAIDQISKQVGAENVAAVIIEPVLGEGGFIEPAKGFLPAIREFASDNGIVFVADEIQSGFCRTGQWFACEDEGIVPDLITTAKGIAGGLPLSAVTGRAEIMDAAHSGGLGGTYGGNPVACAGALGAIETMKELDLNARAKDIEAVMKSRLAAMAEKFDVIGDVRGRGAMIAIELVKDRETKEPNPAATAALAKACHQEGLLVLTCGTYGNVLRFLPPLVIGEDLLNEGLDIIEQAFTRV

SEQ ID NO: 2494 - protein, 519 aa, Solanum tuberosum
MDALCASMKGTAQLVAICNQESAFWGEKISGRRLINKGFGVRSCKSFTTQQRGRNVTPAVLTRDINKEMLPFEESMFEEQPTADPKAVASVILGGGVGTRLFPLTSRRAKPAVPIGGCYRLIDVPMSNCINSGIRKIFILTQFNSFSLNRHLATYNFGNGVGFGDGFVEVLAGTQTPGDGRKMWFQAADAVREFIWVFENQKNKNVEHIIILSGDHLYRMNYMDFVQKHIDTNADITVSCVPMDDGRASDFGLMKIDETGAIIQFAEKPKGPALKAMQVDTSILGLSEQEASNFPYIASMGVYVFKTDVLLNLLKSAYPSCNDFGSEIIPSAVKDHNVQAYLFNDYWEDIGTVKSFFDANLALTKQPPKFDFNDPKTPFYTSARFLPPTKVDKSRIVDAIISHGCFLRECNIQHSIVGVRSRLDYGVEFKDTMMMGADYYQTECEIASLLAEGKVPIGVGPNTKIQNCIIDKNAKIGKDVVILNKEGVEEADRSAEGFYIRSGITVIMKNATIKDGTVI

SEQ ID NO: 2495 - protein, 481 aa, Streptomyces coelicolor A3(2)
MTSTHAFWLAGRQAAGESGFDVTSPWDGTTVGTVSLPTDAQVEEAVAAAYAVRDEFAATPAHVRAAALDHVGRRLAERTEEIARLISAENGKPVKWARGEVGRAVSVFRFAAEEARRFNGGEAQRLDTDAGGQGRLALTRRFPKGVVLGIAPFNFPLNLCAHKIAPAIAAGAPLILKPAPATPLSGLILGELLAETDLPAGSWSILPVPNDKMPALVQDERLPVISFTGSETVGYAIMDSVPRKHCTLELGGNGAAVVLADWASDEDLDRAATRIATFSNYQGGQSCISVQRVIADAAVYDRLLPRIVAAVEAQVTGDPNDDATDVGPLVSEAAAERVEAWVREAVDAGAKLLTGGKRDGASYAPTVLTELPADTTLAHEEVFGPVLSVQRVTGEAEAFAAVNDSKYGLQAGVFTHDLQAAFRAHRALEVGGVVIGDIPSYRADQMPYGGAKQSGVGREGVKFAMDDYTYERVLVLTGLAL

SEQ ID NO: 2496 - protein, 276 aa, Oceanobacillus iheyensis HTE831
MTLSLKLIGYPIEHSMSPWIHNEFLKRSNLEGTYELFEISPEESFEDNVTTLKKSVLTGFNVTVPYKQKIMQFLDEVDDTANLMGAVNTVSIRDGKWIGYNTDGIGYLRSLYAAYPFLKGVTNKRVLILGAGGAARGIFHALVNEGYNNIKIANRTLSRAESIIGTNKQALAISLEEAAEELHQFDLVIQTSAVGMNEPRSIIILDRINEDTVVSDIVYQPLETHFLQLAKQRTPYIHHGHTMLLYQAQAAFEIWTGTNVNVSGMDMQIEQILKGR

SEQ ID NO: 2497 - protein, 261 aa, Streptomyces antibioticus
MSQAVKPVALVTGATSGIGLEIARRLAGLGARVYLCARHEDQLADTIKELTDAGYEVDGTTCDVSDPEQIRAFVRAAVDRFGPVDILVNNAGRSGGGATNEIPDDLWFDVINTNLNSVFLMTKEVLNTGGMLAKKSGRIISIASTGGKQGVVHAAPYSASKHGVVGFSKALGLELARTGITVNAVCPGFVETPMAERVREHYAGIWGVSEQETHDRITTRVPLGRYVETREVAAMVEYLVSDDAAAVTAQALNVCGGLGNY

SEQ ID NO: 2498 - protein, 160 aa, Neisseria meningitidis
MPEGAEQDILKGMYLLKAGGKGDKKVQLMGSGTILQEVIAGAELLKADFGLEADIWSCPSFNLLHRDAVEVERFNRLHPLEAEKVPFVTSQLQGHDGPVIAATDYIRSYADRIRAYIPNDYHVLGTDGFGRSDSRANLRRFFEVDRYNVAVAALAALAEQ

SEQ ID NO: 2499 - protein, 489 aa, Clostridium perfringens ATCC 13124
MSQEQNTNLKRGLKSRHLSMIAMGGAIGTGIFLAMGDTLHQAGVGGAFVAYGIIGVMVYFLCTSLGEMATYMPETGSFGAYATKFVDPALGFALGWNYWYNWAITIAAEMVAGSLLMKFWFPNVPAIVWSALFLVIILTLNLLSAKAYGESEFWFAAVKVATVIIFLIVGVLMIFGILGGDNVGFKNFYENGGPFIGGAKSIFMIFLIAGFSFQGTELVGVAAGESEDPEKNVPKAVNTIFWRILLFYLGTILVIGALVPNAQAGVETSAFTIVFEKLGLAGAASIMNAIILTSVLSAGNSGMYASSRMLYAMAKSGMAPKIFEKTNSRGVPVNAIIITTIIASLCFLTGIYAENTVYVWLVAASGLSGFIAWLGIAICHYRFRKAYVAQGKDMNRLVYKAKLFPLGPIIALILCGIIVLGQGYAYLDVRNGVDWGGLISSYIGLPLFFGLFAYYKIKYKTKIIDLKDVDLSVEHIDTDESIEDEVFSY

SEQ ID NO: 2500 - protein, 425 aa, Shewanella sp. MR-4
MSTTNDSLMARRQAAVAGGVGQIHPVFTARAENATVWDVEGREFIDFAGGIAVLNTGHLHPKVKAAVAAQLEDFSHTCFMVLGYESYIQVCEKLNQLVPGDFAKKTALFTSGSEAVENAVKVARAYTKRAGVIAFTSGYHGRTMAALALTGKVAPYSKGMGLMSANVFRAEFPCALHGVSDDDAMASIERIFKNDAEPSDIAAIILEPVQGEGGFYAASPAFMQRLRALCDREGIMLIADEVQTGAGRTGTFFAMEQMGVSADITTFAKSIAGGFPLSGITGKAEVMDAIGPGGLGGTYGGNPLACAAALAVLEVFEEEKLLERANAIGERIKSALNTMQVEHPQIADVRGLGAMIAIELMEDGKPAPQYCAQILAEARNRGLILLSCGTYGNVLRILVPLTVPDEQLGAGLGILKACFDAVLKG

SEQ ID NO: 2501 - protein, 166 aa, Lactuca sativa
MFPMVTEFMNYGQQTVRAARYIGQGFMITLSHANRLPVTIQYPYEKLITSERFRGRIHFEFDKCIACEVCVRVCPIDLPVVDWKLETDIRKKRLLNYSIDFGICIFCGNCVEYCPTNCLSMTEEYELSTYDRHELNYNQIALGRLPMSVIDDYTIRTIFNLPEIKT

SEQ ID NO: 2502 - protein, 482 aa, Shewanella sp. MR-4
MLLKDPSLLRQQCYINGQWCDAQSKETVAIANPATGVVIASVPVMGQAETQAAIAAAEVALPAWRALTAKERGAKLRRWFELLNENSDDLALMMTSEQGKPLAEAKGEVTYAASFIEWFAEEAKRVYGDTIPGHQGDKRIMVIKQPVGVTAAITPWNFPAAMITRKAAPALAAGCTMVVKPAPQTPFTALALAVLAERAGIPAGVFSVITGDAIGIGNEMCSNPTVRKLSFTGSTQVGIKLMEQCAPTLKKLSLELGGNAPFIVFDDANIDAAVEGAMIAKYRNAGQTCVCANRIYVQAGVYDEFARKLSIAVGKLKVGEGITEGVTTGPLINRAAVEKVQSHLEDALSKGASVVAGGKPHSLGGNFFEPTVLTHVDSSMRVAREETFGPLAPLFKFTDVDDVIKQANDTEFGLAAYFYGRDISLVWKVAEALEYGMVGVNTGLISTEVAPFGGMKSSGLGREGSKFGIEEYLEIKYICMSV

SEQ ID NO: 2503 - protein, 393 aa, Lactuca sativa
MTGPATRKDLMIVNMGPHHPSMHGVLRLIVTLDGEDVIDCEPILGYLHRGMEKIAENRTIIQYLPYVTRWDYLATMFTEAITVNAPEQLGNIQVPKRASYIRVIMLELSRIASHLLWLGPFMADIGAQTPFFYIFRERELIYDLFEAATGMRMMHNFFRIGGIAADLPHGWIDKCLDFCDYFLTGIAEYQKLITRNPIFLERVEGVGIIGGEEAINWGLSGPMLRASGIQWDLRKVDHYECYDEFDWEVQWQNEGDSLARYLVRISEMTESIKIIQQALEGIPGGPYENLEIRRFDRVKDTVWNEFDYRFISKKPSPTFELSKQELYARVEAPKGELGIFLIGDKGVFPWRYKIRPPGFINLQILPQLVKRMKLADIMTILGSIDIIMGEVDR

SEQ ID NO: 2504 - protein, 888 aa, Magnaporthe grisea 70-15
MTRITRLIFGHVVLINVTPSIPIPMRNSNPSRSTVPVQYVRHGGLGGGRVPRYEVFGLCNTPQHTKMSSPQDRAQYYIGQLDRELSKYPALNNLERTTGVPKAYAVVGVVVLYFFLIVFNLGGQLLTNIAGFGIPAYYSLDALFSANKEDDTQWLTYWVVFAMFTVVESLVSVVYWFPFYYMFKFVFLLWLSLPAFKGADIIFRSFLAPTLSRYFVHSRPASSNLRAKADSAGKAEYSNREVFDESIVMGLRIVLNQTNSVGPSKPRRFETSSARTHVLAMRLTFIQSRLAASLGVAASLLPLHLAFAQELSGEGRDTHNDALKPRLAPGYEPVFSSIDRTIIGRAPAGVTPLDNNIPRRLELQPGSTQFLVFERPGEVRTELRRDIGGTQDLPQENGLFEDAAASSGDLDRRQAPTRSVYISATTCQQPQVKADATAPEIPQLTLFISTKNLRDLTQNGNSSDPNMTWRIFDEGAAMFNITTSENVFVGIQAPALPNTISGSWGFEVAASTDQPYHGHSSIETRDLMWMDSDASGALMVTRTASGLSEGDQGPYELFASRADGKNRTLSGIRNSYCGLQNYAEISATKGGEQSVLVRSSLVKRATGNMAKQQFHLTGLQAGTVYDGIIATKQRANLPGGGGLVFRSTQFTTRQVENSSCMLVSGLAFCDKVAYKVPANTTAFPNPEALGKAYDDQAKEIYDSFEIQIAQVQCETENAQIYSLARTCDDCRAAYKDWLCSVSIPRCEEVTENKGWLHNRNFDNSDGQLETFEASSRNSFVNEAIVPRPYKELLPCDELCYDLVQSCPNSMGFVCPTPQSKYGFNHSYHIREQDEASGEFKCNFPDNAHFIGVRKSAAGTFRALAGSDRFLSHSVVMYGIVTALGLALM

SEQ ID NO: 2505 - protein, 690 aa, Oryza sativa (japonica cultivar-group)
MSVLLLLFLPLAAAQPWQVCQDSRGKYTSNSTYQANIQSLSSTLPAKAAAPSTGLFATRVAGNAPDTVYALAFCRGDITNASACAGCVASGFQDAQQLCPFNKAASLYYDLCLLRFADENFLATNNSDVVMLMNSQNFTASVGSVRLLLFTLLNATAESAASSSRRFTTSRLDVSSLPTLYCLMQCTPDLTAGECAACFEDFPRLTLQYLDGARGGRILATRCTMRYEIYPFYSGDTMLRIINLATTVPEMNTTAPTTPVTVYPQPAGPGGASAPPPPQPNPGIPEQAQRSPYHKSKVWIVAIVAPLLAILFCFMLSIVWIRRGRKGEVNMQNNIAAVNRLEEDALVWRLEERSSEFSLFEFSELLEATDNFAAENRLGQGGFGPVYKGQLHDGVEVAVKRLASQSGQGFTEFKNEVELIAKLQHTNLVRLLGCCIQGEEKILVYEYLPNKSLDFFIFDVDKTSLIDWNKRCGIIEGIAQGLLYLHKHSRLRVIHRDLKASNILLDQDMNPKISDFGLAKIFSSNNTEGNTKRVVGTYGYMSPEYASEGIYSIKSDVFSFGVLLLEILSGKRNSGFHQYGDFLNLLGYAWHMWEEGRWLDIIGASIPQTIPTEGLRKYINIALMCVQENADDRPTMSDVVAMLSSESAVLPEPKHPAYYNLRVSKVQGSTNVVQSISVNDVTITSNPEGR

SEQ ID NO: 2506 - protein, 496 aa, Arabidopsis thaliana
MAGTGLFAEILDGEVYKYYADGEWKTSSSGKSVAIMNPATRKTQYKAQACTQEEVYAVMELAKSAQKSWAKTPLWKRAELLHKAAAILKDNKAPMAESLVKEIAKPAKDSVTEVVRSGDLISYCAEEGVRILGEGKFLLSDSFPGNDRTKYCLTSKIPLGVVLAIPPFNYPVNLAVSKIAPALIAGNSLVLKPPTQGAVSCLHMVHCFHLAGFPKGLISCITGKGSEIGDFLTMHPAVNCISFTGGDTGISISKKAGMIPLQMELGGKDACIVLDDADLDLVASNIIKGGFSYSGQRCTAVKVVLVMESVADELVEKVKAKVAKLTVGPPEENSDITAVVSESSANFIEGLVMDAKEKGATFCQEYKREGNLIWPLLLDNVRPDMRIAWEEPFGPVVPVLRINSVEEGINHCNASNFGLQGCVFTKDINKAILISDAMETGTVQINSAPARGPDHFPFQGLKDSGIGSQGVTNSINLMTKVKTTVINLPTPSYSMG

SEQ ID NO: 2507 - protein, 479 aa, Salmonella enterica subsp. enterica serovar Typhi str. CT18
MAQHAVYFPDAFLTQMREAMPSTLSFDEFISACQRPLRRSIRINTLKISVADFLALIAPYGWSLTPIPWCHEGFWIERDDEEALPLGSTAEHLSGLFYIQEASSMLPVAALFADDNHPQRVMDMAAAPGSKTTQIAARMGNRGAILANEFSASRVKVLHANISRCGIANTALTHFDGRVFGAALPEMFDAILLDAPCSGEGVVRKDPDALKNWSPESNLDIAATQRELLDSAFHALRPGGTLVYSTCTLNRQENEAVCLWLKETYADAVEFLPLGDLFPDADRALTPEGFLHVFPQIYDCEGFFVARLRKMSSLPAMPAPGYKVGAFPFTSLKGREALNVTQAANAVGLLWDENLHLWQREKEVWLFPAEIESLIGKVRFSRLGIKLAESHNKGYRWQHEATIALACPTHAHAFELSVQEAEEWYRGRDIYPQTPPAADDVLVTFQHQPLGLAKRIGARIKNSYPRELVRDGKLFTGNS

SEQ ID NO: 2508 - protein, 181 aa, Arabidopsis thaliana
MASSMLSSTAVVTSPAQATMVAPFTGLKSSASFPVTRKANNDITSITSNGGRVSCMKVWPPIGKKKFETLSYLPDLSDVELAKEVDYLLRNKWIPCVEFELEHGFVYREHGNTPGYYDGRYWTMWKLPLFGCTDSAQVLKEVEECKKEYPGAFIRIIGFDNTRQVQCISFIAYKPPSFTEA

SEQ ID NO: 2509 - protein, 181 aa, Arabidopsis thaliana
MASSMLSSAAVVTSPAQATMVAPFTGLKSSAAFPVTRKTNKDITSITSNGGRVSCMKVWPPIGKKKFETLSYLPDLSDVELAKEVDYLLRNKWIPCVEFELEHGFVYREHGNTPGYYDGRYWTMWKLPLFGCTDSAQVLKEVEECKKEYPGAFIRIIGFDNTRQVQCISFIAYKPPSFTEA

SEQ ID NO: 2510 - protein, 119 aa, Zea mays
SPRRYRENDALSSFFKILTTSPDENGKVYVSTVQANNYPITCTQWHPEKAIFEWRKPMIPHSEDAVQVTQHFANHFISQARKSPNRPPADKVLDNLIYNYSPTFTGKKSKSFEEVYIFS

SEQ ID NO: 2511 - protein, 483 aa, Solanum tuberosum
MGKKLKYTKFQLRSNVVKPNICMSLTTDIAGEAKLKDLERQKKGDARTVVAIILGGGAGTRLFPLTKRRAKPAVPMGGAYRLIDVPMSNCINSGINKVYILTQFNSASLNRHIARAYNFGNGVTFESGYVEVLAATQTPGELGKRWFQGTAHAVRQFHWLFEDARSKDIEDVLILSGDHLYRMDYLHFVQSHRQSGADITISSLPIDDSRASDFGLMKIDDTGRVMSFSEKPKGDDLKAMAVDTTVLGLSPEEAKEKPYIASIGKVYVFKKDILLNLLRWRFPTANDFGSEIIPASTKEFCVKAYLFNDYWEDIGTIRSFFRANLALTEHPPRFSFYDATKPIYTSRRNLPPSAIDNSKIVDSIVSHGIFLTNCFVEHSVVGIRSRIGTNVHLKDTVMLGADYYETDAEIRSQLAEGKVPLGIGENTRIKDCIIDKNARIGKNVVIANSEGVQEADRSSEGFYMASGITVISKNSTIPDGTVI

SEQ ID NO: 2512 - protein, 609 aa, Rickettsia rickettsii
MTSIRNIAIIAHVDHGKTTLVDNMLKQSGTFRANQAVAERAMDSNDLERERGITILAKCTALMWNDIRINIVDTPGHADFGGEVERILSMVDGVVLLVDASEGPMPQTKFVLSKALNLGLKPIVVINKIDRDDQRIKEVIDEVFELFVALEANNDQLDFPIVYASGRAGRASLTFDDKINPLDNLADDLTPLFDLIVQHVPKPLANDKAPFSMLVTTREYNSFFGRVLTGRVQSGTVKINQNVKVLNRENKVLETGRITKILAFRGLERIAINDATAGDIIAVAGVENANVADTICSPDVTEAVPSLPIDPPTLSMTFSVNDSPLAGSEGTKVTSSLIGARLMRELESNVALKVTEAAEKNAFQVAGRGELQLGILIETMRREGFELSISRPEVLFQTDEKGNKQEPMEEIQVDVDDDYVGVVVKSLALRKAEMTDMRPSGGGKSRVTFIGPSRGLIGYHSQFLTETRGTGIMNRIFHGYADYKGNIEGRRNGVLISNGDGAAVAYALWNLEERGKMFINPSDKVYRGMIIGEHNRDNDLEVNPLKAKQLSNVRATGKDEAIRLTPPMLLTLEQAISYIQDDERVEVTPKSIRLRKALLDPNDRKRAAK

SEQ ID NO: 2513 - protein, 1054 aa, Saccharomyces cerevisiae
MPPLFKGLKQMAKPIAYVSRFSAKRPIHIILFSLIISAFAYLSVIQYYFNGWQLDSNSVFETAPNKDSNTLFQECSHYYRDSSLDGWVSITAHEASELPAPHHYYLLNLNFNSPNETDSIPELANTVFEKDNTKYILQEDLSVSKEISSTDGTKWRLRSDRKSLFDVKTLAYSLYDVFSENVTQADPFDVLIMVTAYLMMFYTIFGLFNDMRKTGSNFWLSASTVVNSASSLFLALYVTQCILGKEVSALTLFEGLPFIVVVVGFKHKIKIAQYALEKFERVGLSKRITTDEIVFESVSEEGGRLIQDHLLCIFAFIGCSMYAHQLKTLTNFCILSAFILIFELILTPTFYSAILALRLEMNVIHRSTIIKQTLEEDGVVPSTARIISKAEKKSVSSFLNLSVVVIIMKLSVILLFVFINFYNFGANWVNDAFNSLYFDKERVSLPDFITSNASENFKEQAIVSVTPLLYYKPIKSYQRIEDMVLLLLRNVSVAIRDRFVSKLVLSALVCSAVINVYLLNAARIHTSYTADQLVKTEVTKKSFTAPVQKASTPVLTNKTVISGSKVKSLSSAQSSSSGPSSSSEEDDSRDIESLDKKIRPLEELEALLSSGNTKQLKNKEVAALVIHGKLPLYALEKKLGDTTRAVAVRRKALSILAEAPVLASDRLPYKNYDYDRVFGACCENVIGYMPLPVGVIGPLVIDGTSYHIPMATTEGCLVASAMRGCKAINAGGGATTVLTKDGMTRGPVVRFPTLKRSGACKIWLDSEEGQNAIKKAFNSTSRFARLQHIQTCLAGDLLFMRFRTTTGDAMGMNMISKGVEYSLKQMVEEYGWEDMEVVSVSGNYCTDKKPAAINWIEGRGKSVVAEATIPGDVVRKVLKSDVSALVELNIAKNLVGSAMAGSVGGFNAHAANLVTAVFLALGQDPAQNVESSNCITLMKEVDGDLRISVSMPSIEVGTIGGGTVLEPQGAMLDLLGVRGPHATAPGTNARQLARIVACAVLAGELSLCAALAAGHLVQSHMTHNRKPAEPTKPNNLDATDINRLKDGSVTCIKS

SEQ ID NO: 2514 - protein, 764 aa, Streptomyces aureofaciens
MSAARQPSPTVRDKAAPEPAAPAAPKGARAPRARRAAPPHGVRPAPALAAEERARLLEGRHHDPHAVLGARTQRGGVAFRVLRPYAKAVTVVAKGLRTELVDEGDGLFSGLLPLTGVPDYRLLVTYDSDEIEVHDPYRFLPALGELDLHLIGEGRHEELWTALGSQPMEHQGVAGTRFTVWAPNALGVRVTGDFSYWDAVAYPMRSLGASGVWELFLPGVAEGALYKYEITRPDGGRTLRADPMARYAEVPPANASIVTASRYEWQDAEWMARRGALAPHQAPMSVYELHLASWRPGLSYRQLAEQLPAYVKELGFTHVELMPVAEHPFGGSWGYQVTGFYAPTSRMGTPDDFRFLVDALHRAGIGVIVDWVPAHFPRDDWALAEFDGRPLYEHQDPRRAAHPDWGTLEFDYGRKEVRNFLVANAVYWCQEFHVDGLRADAVASMLYLDYSRDEGDWSPNAHGGREDLDAVALLQEMNATVYRRFPGVVTIAEESTAWDGVTRPTDSGGLGFGLKWNMGWMHDTLRYVSKEPVHRKYHHHDMTFGMVYAFSENFVLPISHDEVVHGKRSLVSKMPGDWWQQRATHRAYLGFMWAHPGKQLLFMGQEFAQGSEWSETYGPDWWVLDSSYPAAGDHLGVRSLVRDLNRTYTASPALWERDSVPEGFAWVEADAADDNVFAFLRFARDGSPLLCVSNFSPVVRHGYRIGVPQEVGQWREVLNTDLEPYGGSGVHHARALRPEPVPAQGRAVSLRMTLPPMATVWLRP

SEQ ID NO: 2515 - protein, 514 aa, Staphylococcus aureus subsp. aureus MW2
MVVEFKNEPGYDFSVQENVDMFKKALKDVEKELGQDIPLVINGEKIFKDDKIKSINPADTSQVIANASKATKQDVEDAFKAADEAYKSWKTWSANDRAELMLRVSAIIRRRKAEIAAIMVYEAGKPWDEAVGDAAEGIDFIEYYARSMMDLAQGKPVLDREGEHNKYFYKSIGTGVTIPPWNFPFAIMAGTTLAPVVAGNTVLLKPAEDTPYIAYKLMEILEEAGLPKGVVNFVPGDPKEIGDYLVDHKDTHFVTFTGSRATGTRIYERSAVVQEGQNFLKRVIAEMGGKDAIVVDENIDTDMAAEAIVTSAFGFSGQKCSACSRAIVHKDVYDEVLEKSIKLTKELTLGNTVDNTYMGPVINKKQFDKIKNYIEIGKEEGKLEQGGGTDDSKGYFVEPTIISGLKSKDRIMQEEIFGPVVGFVKVNDFDEAIEVANDTDYGLTGAVITNNREHWIKAVNEFDVGNLYLNRGCTSAVVGYHPFGGFKMSGTDAKTGSPDYLLHFLEQKVVSEMF

SEQ ID NO: 2516 - protein, 891 aa, Arabidopsis thaliana
MAPVPDPNSVGGGAKRDEATTKIPSKDSKKKDDKKEEDLSEEDLQLKQNLELYVERVQDPNPELQKIALESMRKEIRDSTSSMTSVPKPLKFLRPHYGVLKEFHAKMAESDLKKMLADILSVLALTMSAEGERESLNYRLNGSESDIGSWGHEYVRNLAGEIAKEYTIRQGEESSIEDLMDLVQQIVSFHMKHNAETEAVDLLMDVEDLDLLLEHVDNTNFRRTCNYLTSAAKYLPGPDDMLVLDIAYMIYIKFAEYPNALQIALFLDNMQYVKQVFTSCTDLVKKKQFCYMIARHGMTFELDQEMVANDEDKEALQDIVNNSKLSEGYLTLARDIEVMEAKTPEDIYKAHLLDGRASSGPSVDSARQNLSATFVNAFVNAGFGQDKLMTVPSDSTSGSAGNWLFKNKEHGKTSAVASLGMIQLWDVETGLGHLDKYFHSNDNPVVAGALLGVGIVNCGIKNDCDPAFALLSGYIDNEDSSVRIGAIMGLGIAYAGSQNDQIKIRLSPILNDANAPLDVIAFAALSLGMIYVGSCNEEVAQSIIFALMDRSEAELGEALTRFLPLGLGLLYLGKQESVEATAEVSKTFNEKIRKYCDMTLLSCAYAGTGNVLKVQDLLAQCGEHLVKGDIHQGPAVIGLAMVAMSEELGLDMEIRSLERVLQYGEQNIRRAVPLALGLLCISNPKVTVMDTLSRLSHDTDSEVAMAAIISLGLIGAGTNNARIAGMLRNLSSYYYKDASLLFCVRIAQGFVHMGKGLLTLNPFHSERLLLSPTALAGIVTLLHACLDMKSIILGKYHYVLYFLVLAMQPRMMLTVDQSLKPISVPVRVGQAVDVVGQAGRPKTITGFQTHSTPVLLAAGERAELATEKYIPLSPILEGFVILKENPDYREE

SEQ ID NO: 2517 - protein, 487 aa, Sinorhizobium meliloti 1021
MTFHAKFSGYADPALHAAGLYIGGKWQSGSGITVLDPSTGNLLAEVADASIEDAQRAVDAADAAAAGWRATPARQRSEILRRWYQLMTQHAEELATLIALENGKALADARGEVAYAAEFFRWYAEEATRIPGEFRHTPSGSHNILVDHEPIGIAVLITPWNFPAAMATRKIGPALAAGCTVILKPASETPLTAYAMARLGEEAGVPPGVVNVLTTSNPGGITNAMLADPRVRKLSFTGSTGVGRVLLAEAAKSVVSCSMELGGNAPFIVFDDADLEVALDGAMIAKMRNAGEACTAANRFYVQAGIHDAFVAGLTARMKSLKLGPGYDPETQCGPMITQNAVRKIDRLVSEALAAGARATTGGKPLTENGYFYPPTVLENVPVNASIAREEIFGPVAPVYKFESDDEAIRLANNTEYGLAAYIYSRDLKRAMKVGKRIETGMLGINRGLMSDPAAPFGGVKQSGLGREGGVTGILEFMEPKYFAVDY

SEQ ID NO: 2518 - protein, 806 aa, Arabidopsis thaliana
MICFILFVFSFLVSVSATAPYKPDDVFLINCGETDVPFDNHGRTWTQEEKNILPKNSDNASFSSVVSYKEESGIPQVPYMTARIFRSDFTYSFPVSPGWKFLRLYFYPTSYKSGFDAVNSFVSVTVNDFTLLQNFSADLTVKASIPESKSLIKEFIVPVYLTLNLTFRPSNNSLAFVNGIEIVSMPDRFYSKGGFDDLITNVGSLIDFEIDNSTASETVHRLNVGGHMVDEVNDSGMFRRWLSDDYEFLIGGVSPYMPDVNISYTEKTPAYVAPAYVYSTCRMMGNAQDTYLNLNFNLTWLFTVDAGFSYLVRLHFFEKYLNKANQRVFSIFLGNQMAREEMDVIRLSGGPRIPIYLDFRIYVGSESGPRPDLRLDLHPLVKDNPEYYEAILNGVEILKLNNSGNLAIIQDNELKPNPPLSSNLTPNHVTQQIKGKSSHLLVKIFIAVGPGTGLATFVVVLMLWMRQMKRKNRKEERVVMFKKLLNMYTYAELKKITKSFSYIIGKGGFGTVYGGNLSNGRKVAVKVLKDLKGSAEDFINEVASMSQTSHVNIVSLLGFCFEGSKRAIVYEFLENGSLDQFMSRNKSLTQDVTTLYGIALGIARGLEYLHYGCKTRIVHFDIKPQNILLDGNLCPKVSDFGLAKLCEKRESVLSLMDTRGTIGYIAPEVFSRMYGRVSHKSDVYSFGMLVIDMIGARSKEIVETVDSAASSTYFPDWIYKDLEDGEQTWIFGDEITKEEKEIAKKMIVVGLWCIQPCPSDRPSMNRVVEMMEGSLDALEIPPKPSMHISTEVITESSSLSDGGEDV

SEQ ID NO: 2519 - protein, 489 aa, Mycobacterium sp. MCS
MAILANGESRLLIDGKLVAGTAGTFPTVNPATEEVLGVAADADSDDMGRAIAAARSAFDDTDWSTNTELRVRCLRQLKDALREHVEEMRDITIAEVGAPRMLTSGAQLEGPIDDLSFAADTAETYEWRTDLGHATPQGIPTRRTLAREAVGVVGAITPWNFPHQINLAKVGPALAAGNTLILKPAPDTPWCAAAVGEIIAEHTDFPPGVINVVTSSDHAVGALLSQDPRVDMVSFTGSTATGRAVMTDAAATIKKVFLELGGKSAFLVLDDADLAGACSMAAFTAAMHAGQGCAITTRLVVPRAKYDDAVEAAAATMGSIKPGDPTSKRTVCGPVISARQRDRIQGYLDLALQEGGRFACGGGRPADRDTGFFIEPTVIAGLDNNARVAREEIFGPVLTVIAHDGDDDAVRIANDSPYGLSGTVFSGDDARAQAVAARMRVGTVNVNGGIWYSADAPFGGYKQSGIGREMGVAGFEEYTEIKLIATAAN

SEQ ID NO: 2520 - protein, 489 aa, Beta vulgaris
ITVPSTSSKNLQNSLAFSSSSLSGDKIQTTSFLNRRYCRISSRAPIVVSPKAVSDSKNSQTCLDPEASRSVLGIILGGGAGTRLYPLTKKRAKPAVPLGANYRLIDIPVSNCLNSNISKIYVLTQFNSASLNRHLSRAYASNMGGYKNEGFVEVLAAQQSPENPNWFQGTADAVRQYLWLFEEHNVLEYLILAGDHLYRMDYERFVQAHRETDADITVAALPMDEKRATAFGLMKIDEEGRIIEFAEKPKGEQLKAMKVDTTILGLDDERAKEMPFIASMGIYVISKDVMLNLLREQFPGANDFGSEVIPGATSIGLRVQAYLYDGYWEDIGTIEAFYNANLGITKKPVPDFSFYDRSSPIYTQPRYLPPSKMLDADITDSVIGEGCVIKNCKIHHSVIGLRSCISEGAIIEDTLLMGADYYETDADRKFLAAKGSVPIGIGNARIGDDVKIINSDNVQEAARETDGYFIKSGIVTIIKDAMIPSGTVI

SEQ ID NO: 2521 - protein, 494 aa, Gluconobacter oxydans 621H
MENDTKTVRTGRDHIDPASIEVSSNAKLMLILAAVVAAICGGLYGYDTGIISGTLPLIGDDFRLGATMKEWVASAILLGAIFGAFAAGGLSEKFGRRNTTCMVSGLFVVGATACSLAPDVWSLIGARFVLGLAVGGSTQVVPMYISELAPQERRGTLVTMFNVAIGLGILIANIIGFTERVNWGWRPMVGVAAIPAAIVFISMFFMPKSPRWTAENEGMKSAIIQLGRIRTTKRAIRREVQTIRENAEGIDPKNRGWRGLFQPWVRPALVAALGVAFFTQCGGLEMMIYYTPTFLNDAGFGTSSALLASLGVAVIYCIMTFLGCMFVDRIGRRRLMLIMGPGAALSLVGLGVMFLSHPAPGSVGAYMIVVFLLLFMMFNSGGIQVCGWLLGAEMFPLSMRGQATSLHAATLWGADLLVTSTALSMAEAIGLSWTMWFYAFVNLASVVFVFFFVPETAGASLEDIEEALLEKRFRPTPGNTRIVQSDDGDAEAAA

SEQ ID NO: 2522 - protein, 451 aa, Mycobacterium sp. MCS
MTTAVVPRVSGGEEEHGHLEEFRTDPIGLMKRVRDECGDVGWFQLVDKHVILLSGAEANEFFFRSADEDLDQAEAYPFMTPIFGKGVVFDASPERRKEMLHNSALRGEHMKSHAATIEGEVKKMIAGWGEEGEIELLDFFAELTIYTSTACLIGLKFREQLDHRFAEYYHELERGTDPLCYVDPYLPIESFQRRDEARVKLVALVQEIMNQRVADPPKDKADRDMLDVLVSIKDEEGNPRFSADEVTGMFISLMFAGHHTSSGTSSWTLIELIRHPEVYAAVQQELDELYADGQEVSFHALRQIPLLDNVVKETLRLHPPLIILMRVAQGEFEVAGFPIHKGDFVAASPAISNRIPEDFPDPDAFKPDRYDKPEQADVVNRWTWIPFGAGRHRCVGAAFATMQIKAIFSVLLREYEFEMAQPPETYRNDHSKMVVQLERPAKVRYRRRVKA

SEQ ID NO: 2523 - protein, 417 aa, Vibrio fischeri ES114
MDYFNYKDDGQLWAEELPITQLAEQFGTPLYVYSRATLERHWKAFDNSVGNHPHLVCYAVKANSNIGVLNALARLGSGFDIVSQGELERVVAAGGDPTKVVFSGVGKTADEMRRALELKIKCFNVESEPELERLNAVAAEMGVIAPISLRINPDVDAKTHPYISTGLRDNKFGIAFDHAPEVYKFAQSLPNLDVQGIDCHIGSQLTDIEPFIDATDRLLALIDDLKAQGVNIRHLDVGGGLGVVYRDELPPQPSEYATALLGRLAEHQDLELIFEPGRAIAANAGILVTKVEFLKHTEHKNFAIIDAAMNDLMRPALYQAWQDIVPVVPREGDAQNYDLVGPICETGDFLGKDRALVLEANDLLAVRSSGAYGFVMSSNYNTRCRAAEIMVDGGDVHLVRKREELSSLWELEAILPN

SEQ ID NO: 2524 - protein, 310 aa, Glycine max
  misc_feature (10)..(10): Xaa can be any naturally occurring amino acid
  unsure (1)..(310): unsure at all Xaa locations
MDIELPPEDXGNALQLLEFCRVFGKALDLKKGEADAILRELVRKQNLRRGQNTLVVQFQIRVLTLILTDSGNESPSLTTSNGNNSWLKPLEDLITKSNHILKDFPLDWLQEGVSGYSNLDLSKKLTLWNFLCDEALATDKLRSCIEDKNSRHVEEVKEAKTRIAAAKEKEKGLRQKLQNETVKAVLSNATPLKMEKHDALLKKMKSEVAQAHAVVLKLKGTIPKGKHSSDAMRIEPACLDNNGQVFWKLKSYNSECAVLLQDIKIKDETATAPAEKWFVYGPEKKDEVDKYISSRAKRLKGHKVAYMLSQ

SEQ ID NO: 2525 - protein, 343 aa, Gossypium hirsutum
MENSTQESHLRSDNAVTYESPYPLYAMALSSTPAVTHLNYQRIALGSFIEDYTNRVHIISFDPESLTLITHPSLSFDHPYPPTKLMFQPHRKSPFSSSSDLLASSGDYLRLWEVGHSSIELISVLDNSKTSEFSAPLTSFDWNDVEPNRIGTSSIDTTCTIWDIEKGVVETQLIAHDKEVYDIAWGEGRVFGSVSADGSVRIFDLRDKEHSTIIYESPQPDTPLLRLAWNKQDLRYMATTLMDSNKVVILDIRSPTTPVAELDRHGASVNAIAWAPQSCKHICSAGDDTHALIWELPTVAGPNGIDPLSMYSASSEINQLQWSAAQPDWIAIAFSNKMQLLKV

SEQ ID NO: 2526 - protein, 451 aa, Vibrio fischeri ES114
MTTHFDYICIGGGSGGIASANRASMYGAKVALIEAQDLGGTCVNVGCVPKKVMWHGAQVAEAINLYAEDYGFDVELKEFKWNKMIESRQAYIGRIHESYDRVLGNNKVNVIKGFAKFVDAKTVEVNGEHYTADHILIAVGGRPTIPNIPGAEYGIDSNGFFELTEQPKRVAVIGAGYIAVEIAGVLHSLGTETHLFCRKESPLRSFDPMIIDTLVEVMNTEGPTLHTHSVPKEVVKEADGSLTLHLENGNTQNVDTLIWAIGRHPATDAINLDKTGVATNDRGYIKVDEYQETNVKGIYCVGDIMEGGIELTPVAVKAGRQLSERLFNGKTNAKMDYDLVPTVVFSHPPIGTIGLTEQEADEQYGKENVKVYTSGFTAMYTAVTKHRQPCKMKLVCAGEDEKVVGLHGIGFTVDEMIQGFAVAMKMGATKADFDAVVAIHPTGSEEFVTMR

SEQ ID NO: 2527 - protein, 503 aa, Burkholderia mallei ATCC 23344
MQFNDILAALDVDLSRWQGRALTARSPVDGATLATLAADAPADAERKIDAAHQAFLKWRTVPAPVRGELVRVFGNVLREHKAALGRLVTLEAGKIASEGLGEVQEMIDICDFAVGLSRQLYGLTIASERPGHRMMETWHPLGVCGVISAFNFPVAVWSWNAALAFVCGDPVVWKPSEKTPLTAIACHTLFAKAVREFDKTHPGVVPEGLHQLVLGGRDVGEALCASPKVPLVSATGSVRMGIEVAQVLSRRLARSILELGGNNGMIVAPSADLDLVVRAVTFAAVGTAGQRCTTLRRLIVHRSVADQLLPRLEKAFASVKVGDPLEAGTLVGPLIDRASFDAMQKALGDAREQGGEVKGGERVELGRADAYYVRPALVRMPRQTAVVTRETFAPILYVLVYDDFDEALAIHNGVPQGLSSAIFTNDMREAERFMSVAGSDCGIVNVNIGTSGAEIGGAFGGEKETGGGRESGSDAWKSYMRRATNTINYSRELPLAQGVKFDV

SEQ ID NO: 2528 - protein, 348 aa, Pyrococcus horikoshii
  misc_feature (1)..(1): Xaa can be any naturally occurring amino acid
  misc_feature (5)..(5): Xaa can be any naturally occurring amino acid
  misc_feature (9)..(9): Xaa can be any naturally occurring amino acid
  misc_feature (65)..(65): Xaa can be any naturally occurring amino acid
  misc_feature (229)..(229): Xaa can be any naturally occurring amino acid
  misc_feature (335)..(335): Xaa can be any naturally occurring amino acid
  misc_feature (346)..(346): Xaa can be any naturally occurring amino acid
  unsure (1)..(348): unsure at all Xaa locations
XSEKXVAIXKTKPGYGAELVEVDVPKPGPGEVLIKVLATSICGTDLHIYEWNEWAQSRIKPPQIXGHEVAGEVVEIGPGVEGIEVGDYVSVETHIVCGKCYACRRGQYHVCQNTKIFGVDTDGVFAEYAVVPAQNIWKNPKSIPPEYATLQEPLGNAVDTVLAGPISGKSVLITGAGPLGLLGIAVAKASGAYPVIVSEPSDFRRELAKKVGADYVINPFEEDVVKEVXDITDGNGVDVFLEFSGAPKALEQGLQAVTPAGRVSLLGLYPGKVTIDFNNLIIFKALTIYGITGRHLWETWYTVSRLLQSGKLNLDPIITHKYKGFDKYEEAFELXRAGKTGKVVFXLK

SEQ ID NO: 2529 - protein, 416 aa, Zea mays
MPRHDYHHPPPPACCSCCCAGAGAAPCYYPAPAPAPPSSTASDQLLHAIAAHLLLSSPVPAQPQSQPQPQPQPQPPPPPAAQHATNPHPYPYPYPQQYQYQYQQQEPKHHTYIHPPLPQLRPNPSGDNGHLLLHSLLRRVAAIESALPHCFPAPPPARRPPHPNHRPRRAARYHEEEQEVEEDGSEPESPPSPPPPRPRPRPRRSARAGPPSAASDRAARTIQAHFRRFLARRSRTLRQLKELAVLRSKAAAIRGSLSGRRGGADPAAVSEVAMGLLLRLDAIQGGDPMIREGKRAVSRELTRILEFVDKVLIKEHQQMVMGDALETHEYHDGCNATFVAARPSVSKKVSFSGNDQVRTLNGKIENRNEVDEGSEGSSSAESDELKPNKRGAYGKPGLAAPMPVHMESRPVAGERR

SEQ ID NO: 2530 - protein, 151 aa, Oryza sativa (japonica cultivar-group)
MELLGRRRGDRDHLTPSSPAAAAAANDQAIDIVLTDYCMPEMTGYDLLKAIKALGSPNPIPVVVMSSENEPQRISRCLTAGAEDFILKPLKMNDVQRLRKCSGATRPKSAVAGDDDRCCNTAKKAAAAAAATPEQQQQQQRSSHLAGLAMA

SEQ ID NO: 2531 - protein, 577 aa, Arabidopsis thaliana
MSFWLSLIFCFFTFASSSPPDDPVNCEFGNTMCTVTNSYGAFPDRSICKAAKVEYPRTEAELVSIVAAATRAGQKMRVVTRYSHSFPKLVCTDGKDGTLISTKFLNHVVTTNPEAKTLTVESGVTLRQLIEEAAKFDLALPYAPYWWGLTVGGMMGTGAHGSSLWGKGSAVHDYVTEIRLVSPGLASDGYVKVQVLSETIDPEEFRAAKVSLGVLGVISQVTFELQPMFKRSLNYVMRNDSDFGDQAVSFGERHEFADFLWLPSQGKVVYRMDGRVPLNTSGDGLFEFFPFRSQLSLVLAIDRSLEESEESLEDANMKCVRAKLVSSSMFLMSYGVTNNGLIFTGYPVIGMQNHMMSSGSCLDSRQDGLITACPWDPRIKGQFFHQTTFSVSLTNVKSFINDIKALVKIEPKSLCVLEGSNGILIRYVTSSLAFLGKEEKALDFDLTYYRSKNDPLAPRLYEDYIEEIEQMAIFKYNALPHWGKNRNLAFDGAIRKYKNANAFLKVKEKFDSLGLFSTEWTDQILGLKGNVTIVKQGCALEGLCICSEDSHCAPTKGYLCRPGKVYREARVCTRVSS

SEQ ID NO: 2532 - protein, 436 aa, Arabidopsis thaliana
MGLEDAGDLVLHIVLSKIGPENTARVACVSKRLKVSASEESLWSIFCSNDLNISTPLDPHGDPAPSFKRAYQLWRESFRMYPWNLVKRVRLCWDNLKQWLTLNFPEAKATLRKGVTEDDLQEFETSLKVKLPLPTRLLYRFVDGQELSSPNGLDGSLGLIGGYSAYSHDVNVYLLPLKEVMRETKESFMRDLGFSSRLDLIVMAASVVASLKIFLLDCTTGQLFTGTSNRQLLPCVPDALVRSVHDTNGDQQQDAMLLWLEEHGRRLQTGTINVRQQNNVKSISLFPEIPPLCSVSVTNGVQVRASSVFIPEISNLRDQPPAYWYAYSIRMSLMPEGCILNGTHHSSCQLYWRHWVIRADNEVIDNVNGEAVIGKYPLLQAGEEEFVYESCSSFPTTAGSIDGSFTFVPGSLRDPKGSQFEVKVVEFPLELPDYIF

SEQ ID NO: 2533 - protein, 513 aa, Hordeum vulgare
MAMAAAASPSKILIPPHRASAVTAAASTSCDSLRLLCAPRGRPGPRGLVARPVPRRPFFFSPRAVSDSKSSQTCLDPDASTSVLGIILGGGAGTRLYPLTKKRAKPAVPLGANYRLIDIPVSNCLNSNISKIYVLTQFNSASLNRHLSRAYGSNIGGYKNEGFVEVLAAQQSPDNPDWFQGTADAVRQYLWLFEEHNVMEYLILAGDHLYRMDYEKFIQAHRETDADITVAALPMDEERATAFGLMKIDEEGRIIEFAEKPKGEQLKAMMVDTTILGLEDARAKEMPYIASMGIYVISKHVMLQLLREQFPGANDFGSEVIPGATSTGMRVQAYLYDGYWEDIGTIEAFYNANLGITKKPIPDFSFYDRSAPIYTQPRHLPPSKVLDADVTDSVIGEGCVIKNCKIHHSVVGLRSCISEGAIIEDTLLMGADYYETEADKKLLAEKGGIPIGIGKNSHIKRAIIDKNARIGDNVMIINVDNVQEAARETDGYFIKSGIVTVIKDALLPSGTVI

SEQ ID NO: 2534 - protein, 199 aa, Triticum aestivum
MAARSENESDGDVGTNPAEGGSSLSLPPLAAGPAVCVLRSAGDFAGGAFVGSIFGYGQGLLSKKGLKGSLGNAGSSAKSFAVLSGVQSLVLCLLRKLRGKDDIINSGIAGCCTGLALSFPGTPQALLQNCATFAAFSCIMEGLNKQQTAMAHTLTGNALTFAHDNGAGVLPPFTLPPILDASDAFASCCQALVAKPKKH

SEQ ID NO: 2535 - protein, 125 aa, Zea mays
VTDSVIGEGCVIKNCKIHHSVVGLRSCISEGAIIEDTLLMGADYYAETEADKKLLAENGGIPIGIGKNSHIRKAIIDKNARIGDNVKILNADNVQEAARETDGYFIKGGIVTVIKDALLPSGTVI

SEQ ID NO: 2536 - protein, 384 aa, Staphylococcus aureus subsp. aureus MW2
MISNKLANIPDSYFGKTMGRKIEHGPLPLINMAVGIPDGPTPQGIIDHFQQALTIPENQKYGAFHGKEAFKQAIVDFYQRQYNVTLDKEDEVCILYGTKNGLVAVPTCVINPGDYVLLPDPGYTDYLAGVLLADGKPVPLNLEPPHYLPDWSTVDSQIIDKTKLIYLTYPNNPTGSTATKEVFDEAIAKFKDTDTKIVHDFAYGAFGFDAKNPSILASENGKDVAIEIYSLSKGYNMSGFRVGFAVGNKDMIQALKKYQTHTNAGMFGALQDAAIYALNHYDDFLEEQSNVFKTRRDRFEAMLAKADLPFVHAKGGIYVWLETPPGYDSEQFEQFLVQEKSILVAPGKPFGENGNRYVRISLALDDQKLDEAAIRLTELAYLYE

SEQ ID NO: 2537 - protein, 508 aa, Vicia faba
MSSIVTSGVINVPRSSSSSKNLSFSSSSQLSGNKILTVSGNGAPRGRCTLKHVFLTPKAVSDSQNSQTCLDPDASRSVLGIILGGGAGTRLYPLTKKRAKPAVPLGANYRLIDIPVSNCLNSNISKIYVLTQFNSASLNRHLSRAYASNLGGYKNEGFVEVLAAQQSPENPNWFQGTADAVRQYLWLFEEHNVLEYLILAGDHLYRMDYEKFIQAHRESDADITVAALPMDEKRATAFGLMKIDEEGRIIEFAEKPKGEQLKAMKVDTTILGLDDERAKEMPFIASMGIYVISKNVMLDLLRDKFPGANDFGSEVIPGATSIGMRVQAYLYDGYWEDIGTIEAFYNANLGITKKPVPDFSFYDRSSPIYTQPRYLPPSKMLDADITDSVIGEGCVIKNCKIFHSVVGLRSCISEGAIIEDTLLMGADYYETEADKRFLAAKGSVPIGIGKNSHIKRAIVDKNARIGENVKIINSDNVQEAARETEGYFIKSGIVTIIKDALIPSGTVL

SEQ ID NO: 2538 - protein, 512 aa, Vicia faba
MAAIGVLKVPPSSSSSSSSSSSKAIARNLSFTSSHLSGDKIFTLSGRTRRTSGRNPFIVSPKAVSDSKNSQTCLDPDASRSVLGIILGGGAGTRLYPLTKKRAKPAVPLGANYRLIDIPVSNCLNSNISKIYVLTQFNSASLNRHLSRAYASNLGGYKNEGFVEVLAAQQSPENPNWFQGTADAVRQYLWLFEEHNVLEYLVLAGDHLYRMDYERFIQAHRESDADITVAALPMDEARATAFGLMKIDEEGRIIEFSENPKGEQLKAMKVDTTILGLDDDRAKEMPYIASMGIYVVSKHVMLDLLRDKFPGANDFGSEVIPGATELGMRVQAYLYDGYWEDIGTIEAFYNANLGITKKPVPDFSFYDRSSPIYTQPRYLPPSKMLDADITDSVIGEGCVIKNCKIHHSVVGLRSCISEGAIIEDTLLMGADYYETDADRRFLAAKGGVPIGIGKNSHIRRAIIDKNARIGDDVKIINSDNVQEAARETEGYFIKSGIVTVIKDALIPSGTVI

SEQ ID NO: 2539 - protein, 148 aa, Brassica napus
MEASSDDEKRPMVDLVKDKNGTDQVLLQNPKGASVKISLHGGQVLSWKTERGDELLFTSAKANSKPPHPVRGGIPICFPQFGTRGSLEQHGFARNKMWLVENDPPALPSFDSTGKAYVDLVLKSSDEDTTRIWPHCFEFHLRVSLGLD

SEQ ID NO: 2540 - protein, 317 aa, Phalaenopsis sp.
MELLQGSQRPAAMALLRDACENWGLYELLNHGISHELMNRVETVNKEHYRRFREQRFKEFASKTLDTVENVEPENLDWESTFFLRHLPTSNISQIPDLDDDCRSTMKEFALELENLAERLLDLLCEDLGLEKGYLKKVFCGGSDGLPTFGTKVSNYPPCPKPELIKGLRAHTDAGGIILLFQDDKVSGLQLLKDGEWIDVPPVRHSIVVNIGDQLEVITNGKYKSVLHRVVAQTDGNRMSIASFYNPGSDAVIFPAPALVEKEAEEKEEKKKEIYPKFVFQDYMNLYIRKKFEAKEPRFEAMKSMEIVMSSQPIPTA

SEQ ID NO: 2541 - protein, 498 aa, Shewanella sp. MR-4
MSTPKKRSDWESLAASLAINGKAYINGEYRDAAAGSTFDCVSPIDGRVLAKVASCDLMDANIAVANAREVFESGVWSKTAPVKRKQVMIRFAELLEENANELALLETLDMGKPIRFSKAVDIAGAARAIRWSGEAVDKLYDELAPTAHNEIGMITREPVGVVAAIVPWNFPLLMACWKLGPALATGNSVILKPSEKSPLTAIRIAELAVQAGIPKGVLNVLPGYGHTVGKALALHMDVDTLVFTGSTKIAKQLMIYAGESNMKRVWLEAGGKSPNIVFNDAPDLKAAAVAAAEAIAFNQGEVCTAGSRLLVESGVKEQLIALIAEELASWQPGHPLDPATVSGAVVDKQQLDTILSYIKAGQDEGASLVHGGQQVLAETGGVYVQPTIFSQVHNKMKIASEEIFGPVLSVIEFNGMDEAIAIANDTIYGLAAGVWTADISKAHKTAKALRSGMVWINHYDGGDMTAPFGGYKQSGNGRDKSMHSFDKYTEIKATWIVL

SEQ ID NO: 2542 - protein, 446 aa, Shewanella sp. MR-4
MADSPYNTTHEHPSLEHYWMPFTANRQFKASPRLLAQAEGMYYTDINGNKVLDSTAGLWCCNAGHGRREISEAVSKQIREMDYAPSFQMGHPLAFELAERLTELSPEGLNKVFFTNSGSESVDTALKMALCYHRANGQASRTRFIGRELGYHGVGFGGISVGGLSNNRKAFSGQLLQGVDHLPHTLDIQNSAFSRGLPSLGAEKAEVLEQLVTLHGAENIAAVIVEPMSGSAGVILPPQGYLKRLREITQKHGILLIFDEVITAFGRVGAAFASQRWGVIPDIITTAKAINNGAIPMGAVFVQDFIHDTCMQGPTELIEFFHGYTYSGHPVAAAAALATLSIYENEQLFERSFELERYFEDAVHSLKGLPNVIDIRNTGLVAGFQLAPNSQGVGKRGYSVFEHCFHQGTLVRATGDIIAISPPLIVDKHQIDQIVNSLSDAIRAVG

SEQ ID NO: 2543 - protein, 266 aa, Triticum aestivum
TDNSTVASDGKSPAPEKLKLVSGSCYLPHPAKEATGGEDGHFICIDEQAIGVADGVGGWADHGVDAGLYAKELMSKSMSAIKDEPEGAIDPSRVLEKAFTGTKARGSSTACIITLKEQGLHAVNLGDSGFIVVRDGRTVLKSPSQQHDFNFTYQLESGGGSDLPSSADVFHYSVAPGDVIIAGTDGLFDNLYDNEITAVVVEALRSGLGAQGTAQKIAALARERAEDKHRQSPFAAAAQEAGYRYYGGKLDDITVVVSYVTSASAV

SEQ ID NO: 2544 - protein, 76 aa, Arabidopsis thaliana
MVIKKIELCIEITKITMEFLVVVADAVTIFLRQSSPPPPALLRHDLERHLIGDKWLIFACDIFPDFIQFQITSKSE

SEQ ID NO: 2545 - protein, 501 aa, Rhodococcus sp. RHA1
MTSTINPTAGLSPTVADFLSRPIEHLIDGSNVASATGETFATVNPSTGAALTQVTRGSAEDVDRAVAAARQALDGPWGRLTASARSKILWRVADLIEDKLEEFAILEAIDSGKPVTYAQLVDVPLAIDWFRYFAGWPTKLEGTTIPVSAVATPGDYFAYTVREPVGVVGAIIAWNFPLLLAAWKLAPALAAGNTVVLKPAEQTPLSAALLGDVLREAGVPEGVVNIVHGYGDQVGAALAAHPGVDKISFTGSTEVGRQIIAAARGNLKKVTLELGGKSPNLIFADADIDAAIAGAANAIFFNQGEACEAGSRLFVQSSVYDRVVAGIAEAATQIKVGDSLAADTQLGPLVSQQQLDRVLGYLVSGRAEGATAVAGGTRKGDTGYFVEPTVLVDTKPNMRVVKEEIFGPVVTVAPFDDVDDVVRSANDTDYGLAAAVWTSDVAKAHNLAAKFRAGTVWINSYHILDPALPFGGYKQSGWGREHGSSALDGYTETKTVILKKG

SEQ ID NO: 2546 - protein, 111 aa, Clavispora lusitaniae
EDTWHYWFHRGLHHGVFYKYIHKQHHRYAAPFGLTAEYAHPVEVALLGMGTVGIPLVWCYFTRDLHLFTISLWICLRLFQAVDAHSGYEFPWSLHHFLPFWAGADHHHEDH

SEQ ID NO: 2547 - protein, 152 aa, Staphylococcus aureus
NFNSLGLDDTYEALNIPIEDFHLIKEIISKKELEGFNITIPHKERIIPYLDYVDEQAINAGAVNTVLIKDGKWIGYNTDGIGYVKGLHSVYPDLENAYILILGAGGASKGIAYELAKFVKPKLTVANRTMARFESWNLNINQISLADAEKYL

SEQ ID NO: 2548 - protein, 297 aa, Nicotiana tabacum
MWVRHFPVMGPRSASTVALNDKQHDKKVENGGAAASGGGDGGDEKSVVSYWGVPPSKVTKEDGTEWKWNCFRPWETYKADLSIDLTKHHAPTTFLDKFAYWTVKALRYPTDIFFQRRYGCRAMMLETVAAVPGMVGGMLLHCKSLRRFEQSGGWIKALLEEAENERMHLMTFMEVAKPNWYERALVFAVQGVFINAYFVTYLLSPKLAHRIVGYLEEEAIHSYTEFLKELDKGNIENVPAPAIAIDYWRLPKDSTLRDVVLVVRADEAHHRDVNHFAPDIHYQGQQLKDSPAPIGYH

SEQ ID NO: 2549 - protein, 240 aa, Zea mays
IGPDIDILAPDVYTNEMMMGWMMDQYSIIRRKISPAVVTGKPVTMGGSQGRNTATGTGAFYIMQGMLPKFDQYPENTTVAVQGFGNAGMVVAECLYQDGYKVVAISDSQGGIYNEQGIDIPAVIDYKQRHRTLAGMYCDQAICDLGENQQISNAELLALDVDVLIPAALENQITRDNADQVRARYIFEVANGPTTTAADDILASKGIYVFPDILVNAGGVTVSYFEWVQNRSGLYWSAKE

SEQ ID NO: 2550 - protein, 463 aa, Bacillus cereus ATCC 14579
MKTVVVIGGGITGLSTMFYLEKLKKDYNIDLNLILIEKEEYLGGKIHSVEEKDFIMESGADSIVARNEHVMPLVKDLNLEDEMVYNETGISYIYSENMLHPIPSDTIFGIPMSVQSLFSSTLVSTKGKIVALKDFITKNKEFTKDTSLALFLESFLGKELVERQIAPVLSGVYSGKLNELTMASTLPYLLDYKNKYGSIIKGFEENKKQFQSAGNKKFVSFKGGLSTIINRLEEVLTETVVKKGVITTAVSKQEDRYEISFANHETIQADYVVLAAPHDIAQTLLQSNELNEQFNTFKNSSLISIYLGFDILDEQLPADGTGFIVTENSDLHCDACTWTSRKWKHTSGKQKLLVRMFYKSTNPVYETIKNYSEEELVRVALYDIEKSLGIKGEPEVVEVTNWKDLMPKYHLEHNQAVQALQEKMTNLYPNVYLAGASYYGVGIGACIGNGKNIANEIMDTLNK

SEQ ID NO: 2551 - protein, 373 aa, Clostridium difficile 630
MKDDKTILILTAQFGAGHISAAKAVKECIIEKYSNYNVVIQNFINASIPMMNKPMVKLYENNTKYTPGLYNYYYYFKKSFDSRHDLSHKLYTPKLSEYIADINPDLIISTFPLAAACVNNFKIKNPDINIPTLTVITDVVDSMEWVFENTDLYFVPSPEIKNRFFQKGINPDSIKVTGVPVDKRFQIESKELCCDKYRLLLLGGGRGLFDIDEDFMHWIDEFIEEHSNSIEITIVTGKNKKLYDNLTHKKPLKNIKVLGFVNDMYNLIRECDLMLTKPGGATIFEAIQSQTPVLVKMPKVGQEIENAKFIIDKGLGMIYSDDLDLKNIFYKLVSNEFDSIINFMKKNLKEFKTVIHPEKIADYISELIDNHYS

SEQ ID NO: 2552 - protein, 98 aa, Glycine max
MEVEGSSKKMIATQEEMVEARVPLAYRDQCAHLLIPLNKCRQAEFYLPWKCQDQRHSYEKCQYELVMERMLQMQKIREHQQNPNAKQPLIALPKPANA

SEQ ID NO: 2553 - protein, 214 aa, Glycine max
QHQHSSLSTTSTRSLLSHDRLTPHPRGRLQELLVGCLWLNDYLVTVSLGGTISIFLATDLDKAPTTFSGHMKNVSSLTILRSNPRVLLSSSYDGLIVKWIQGIGYSEKLQRKENSQIKCLAAVEEEIVTSGFDNKIRRVSLHRDQCGDTEAIDIGSQPKDLSVALLSPELALVSIDSGVVMLRGTKIVSTINLGFIVTASAVSPDGSEAIIGGH

SEQ ID NO: 2554 - protein, 429 aa, Shewanella sp. MR-4
MATKRIVIVGGGAAGLALASKLGRKMGGSDVVDVCLIDKSPIHIWKPKLHEVAVGVIDQSIEGLLYRDHGLKNGYRYIRGEIEQCEPDAKTIQLAAVYSDSGELLLEPRQIEYDYLVLALGGVSNSFNTLGAEKHCIFLDSLDNANLFHQKLLDALLQLNETQEKVSIGIVGAGATGVELAAELHHVIESVKEYGYLNISKHHLDVHLIEASPKILPQLPERVSARAQAVLDKIGIRLHIGVQVKEVTRDGFITQDGDVIEAGLKVWAAGVKGPKAFQNFSKLPITPRNQVEVDACMRVKGHQDIYALGDCALLILESGQPVPPRAQAAAQMADTLYENIVSRLQGKAEKPFVYKDYGSLVSLSRFSAIGNLMGNLRSGTFFVEGHIARIMYISLYQRHLASLYGWFSAIIYRIAQKLLKWQRPKLKLH

SEQ ID NO: 2555 - protein, 206 aa, Robiginitalea biformata HTCC2501
MKSIDFEKTGGLVPAIIQDSNTRAVLMLGYMDAEALEATKSSGKVTFYSRSKKRLWTKGESSGNFLEFVDVRVDCDGDALLIRARPTGPVCHTGSDTCWDEANPGDEDFLPELEAIIASRKEQADTPGGEANSYVAGLLRRGTAKVAQKVGEEAVETVIEAMGSDDNRFLNESADLLFHWLILLQAKGFRMADIERLLAERHRQRR

SEQ ID NO: 2556 - protein, 176 aa, Glycine max
  misc_feature (125)..(125): Xaa can be any naturally occurring amino acid
  unsure (1)..(176): unsure at all Xaa locations
MVLVLALGDLHIPHRAPDLPAKFKSMLVPGKIQHIICTGNLCIKEVHDYLKSLCPDLHITRGEYDEDARYPETKTVTIGQFKLGLCHGHQVVPWGDLDSLAMLQRQLDVDILVPGEPHKVKGLKXRGGGAPLNPGSGTGAPGGFQIDPHPEFLGSGKPKGPPGWLPTGEQPFWGGG

SEQ ID NO: 2557 - protein, 1083 aa, Haloarcula marismortui ATCC 43049
MTADEDRTILLIGSGPIKIGQAAEFDYSGAQACRALQEEGARVVLVNSNPATIMTDPEMADKVYLEPINTEAISEIIRKEEPDGVIAGLGGQTGLNVTAELAEEGVLDEYDVDVMGTPLDTIYATEDRDLFKQRMEDIGEPVPRSTTITLDDGESVTDLDEDSLIDRVESAVDEVGGLPVIARTTYTLGGSGSGVVDEMDELIERVRKGLRLSRNNEVLITESISGWVELEYEVMRDADDSCIIICNMENIDPMGIHTGESTVVTPSQVIPDEGHQEMRDSALKVIRDLGIQGGCNIQFAWHDDGTPGGEYRVVEVNPRVSRSSALASKATGYPIARVTAKVALGKRLHEIDNEITGETTAAFEPAIDYVVTKVPRWPIDKFRDTEFELSTAMKSTGEAMSIGRTFPESLLKALRSSEYNPAADFNEIDDAELETEYLEKPTPDRPYAMFEAFCRGYTVEEVVDITDIKEWYVERFKEVADAAEAARDGDYETAAQAGFTDQEITALAGGEFNDTHVSWLPADLDEDGGDEPEVEAATDGSGVTVDTVETETTDRDFKLVDTCAGEFEATTPYYYSTRDPLSGIDRDELQIDPDLESVVVVGGGPIRIGQGVEFDYCSVHAVRALENLGIDAHVVNNNPETVSTDYDTSDGLFFEPVTAEEVADVIEATDADGVMVQFGGQTSVDIGHPLEQELERRDLDCEIMGTSVDAMDLAEDRDRFNKLMDELGISQAEGGSATSKEEALDLAHDIGYPVLVRPSYVLGGRAMDVVYNDEDLETYIEEAVRVSPDKPILVDEFLADAVELDVDAVADEDDVLIGGVMEHVETAGIHSGDSACMIPPRSQEIKDVMPRIREVVEDIADALDTVGLLNVQLAVRDGEVFVLEANPRSSRTVPFISKTAGVPIAKIAAKVMSGATLSELDVQEQIPEQVSVKEVVLPFDRLPGSDPRLGPEMKSTGEVMGTAGSFGKAYQKAQMAVGKAIPLEGTAIVDLPILGFEEHFDVQDFDDYEDTDAIIDAIQSGKVDLVLSRNRDVLEACVEETVTYFSTHESAEAALEAINSADQPLAVQAIDERPKTQREWGAE

SEQ ID NO: 2558 - protein, 388 aa, Robiginitalea biformata HTCC2501
MNRGNMNHGKMKKRLLIIDRDGTLIREPEDEQIDAFDKLEFLPGVFRYLGAIARETDFVLVLVTNQDGLGTDAYPEDTFWPVQEFMMNALKNEGIEFASVHIDRTFPEQGAETRKPGTGMLKDYMSPEWDLAGSFVIGDRLTDMKLAENLGARGIFLNSHPELGASELTDSVDSLGEIIAWEGSDWKGIYEFLKMGRREAVVKRKTAETDIDIRLVLDGTGKSDIHTGLAFFDHMLDQLARHGQMDLEIRTRGDLEVDEHHTIEDTAIALGSAFSEALGGKLGIERYGFCLPMDDCLAQVAVDFGGRNWLVWDAAFQREKIGDMPTEMFMHFFKSFSDSARANLNIKAEGGNEHHKIEAIFKAFAKSVKMAVRRDPDRMVLPSTKGML

SEQ ID NO: 2559 - protein, 438 aa, Rhodobacter capsulatus
MSAVKKALDLMKAEEVEYVDIRFCDPRGKLQHVTLIADLVDEDFFEEGFMFDGSSIAGWKSIDQSDMKLIPDASSVYIDPFYAEKTMCVHCNVVEPDTAEAYSRDPRIALKAEAYLKASGIGDVAYFGPEAEFFIFDDVRYSVTPAKVAYQIDAEAAAWNTDAEVEMGNLAHRAGHKGGYFPVNPVDEAQDLRGEMLSTMKRMGMKVDKHHHEVATCQHELGLIFGGLTEQADNILKYKYVIHNVAHAYGKTVTFMPKPMKGDNGSGMHVNMSIWKDGKPLFAGDKYADLSQEALYFIGGILKHAKALNALTNPGTNSYKRLIPGFEAPVLRAYSARNRSGCVRIPWTESPKAKRVEARFPDPSANPYLAFAALLMAGLDGIKNKIDPGPASDKDLYDLPPEELAAIPTVCGSLREALTELEKDHDFLLAGDVFTKDQ

SEQ ID NO: 2560 - protein, 119 aa, Trichodesmium thiebautii
PIEKHHHEVATAGQNEIACQFNTLVKKADEIQVYKYVVHNVAHAYGQTATFMPKPLVGDNGSGMHCHQSISKDGVNIFAGDKYAGLSEEALYYIGGIIKHARAINAFRNASTNSYKRLS

SEQ ID NO: 2561 - protein, 473 aa, Mycobacterium smegmatis str. MC2 155
MTIPSAIRGRRRPGTAEHTVTPDGPAPSNDGGGPAPNPVDEVPSAWKLLVYGLQHLLVMYASTITVPVVVASALDLSQQDLVYLVTADLLLCGFGTLLQSLGIWRVGVRLPMVIGASYTGIAPMLIIGQGSGLQTMYGAVLVVGLATIAVAPLVGKMMRFFPPVVIGTTILLIGIQLIPAGAKMIVGTDPDASGFGSPAAIGLAAVTALAVLLGYRLLPRLLRSLAVLIGMIAGTVIAAATGFLDLSGIGDTQAISFPDLLHFGAPRFDVLAICSLAIIQIVLVVELAGQVNAVGEVVDQEISDRRLAAAVRADGVVTALGGGVFQSFMYVTFAQNVGILTITRMFSRYVTATTGVLLMSLAFFPVVGEIVAAIPRPVLGAAAVVMFGTIAVVGIRILGQVDFADTANVIIVAAALGVALLPTTVSGFYSQFPDAARQLLSSGVATGICVAVLLNILFHARRPLEVPVSDRLS

SEQ ID NO: 2562 - protein, 491 aa, Solanum lycopersicum
MANTKDSYHIITMDTKESSIPSLPMKEIPGDYGVPFFGAIKDRYDFHYNQGADEFFRSRMKKYDSTVFRTNVPPGPFNARNSKVVVLVDAVSYPILFDNSQVDKENYFEGTFMSSPSFNGGYKVCGFLGTSDPKHTTLKGLFLSTLTRLHDKFIPIFTTSITSMFTSLEKELSEKGTSYFNPIGDNLSFEFLFRLFCEGKNPIDTSVGPNGPKIVDKWVFLQLAPLISLGLKFVPNFLEDLVLHTFPLPYILVKRDHQKLYNAFYNSMKDILDEAEKLGVKRDEACHNFVFLAGFNSYGGLKVFFPSLIKWIGTSGPSLHARLVKEIRTAVKEAGGVTLSAIDKMPLVKSVVYETLRMDPPVPFQTVKARKNIIITNHESSFLIKKDELIFGYQPLATKDSKVFKNAEEFNPDRFVGGGEKLLKYVYWSNGKEIDNPSVNDKQCPGKDLIVLMGRLLVVEFFMRYDTFEVEFGKLLLGSKVTFKSLTKATS

SEQ ID NO: 2563 - protein, 607 aa, Zea mays
MCTVLRHVYKLSMMTIFSLSSLLRSSAPVSALPHLSVPKRATKSRHRSPSPLPSFPTPTLPHPPLVLVLVPQPPHREKTQQGVGPPPPPAPPCRSRPDLRRWGTGVPGSTTPPPRVRMAMRKENPVLNACQASNGRITRAQAAANRRSFGAFPSVPLPAKTERKQTAQGKAKRGSSYDNTRCKCCTFQAPQPKRRTVLRDVTNLSNANSNKSFAAAPKLQTKPSLRTGRTVSKSKPCAKKIPKKPPPAGNGSALTNVLNIAEETQAEKILAERVEPVLLLENRGPLSLQNVERNRDSACHEVFFEERNLRDKCEPSVSKNGDSYVLDIVDIDKDNGNPQMCASYVVEIYSNLMASELMRRPSPNYMEGLQRDITKGMREILIDWLVEVSEEYKLVPDTLYLTVYLIDRFLSRNYIERQRLQLVGITSMLVASKYEEICAPRVEEFCFITDNTYTKAEVLKMESQLLNDLGFNLSVPTTKTFLRRFLRAAQASRKTPSMTLGFLANYLAELTLTEYEFLKFLPSLVAASAVFLARWTLDQSDLPWNQTLEHYTSYKCSDIQLCVCALRELQHNTSNCPLNAIREKYRHQKFECVANLTSPEFPRSFFS

SEQ ID NO: 2564 - protein, 170 aa, Oceanobacillus iheyensis HTE831
MEFKNYIEIVEDWPKEGIKFKDITPLMADGKAFKSAVDEIVDYANTKEIDLVVGPEARGFIVGCPVSYALEVGFAPVRKEGKLPREVIKVDYGLEYGENVLTIHKDAIKPGQRVLITDDLLATGGTIEATIKLVEQLGGIVVGCAFLVELGYLDGKDKLEGYDVLTLMKY

SEQ ID NO: 2565 - protein, 79 aa, Beta vulgaris
MISENTLSCCRRGKLAKILLSLTVSVFTSVCLYGLPFLVSCTKCDSSLSNSECSTTGRTGNYKNDIMQFNLLTKTKHEI

SEQ ID NO: 2566 - protein, 172 aa, Zea mays
MAPSKLTLFLALSLVLVGTSHGCGSCGNTPSVPVPTPPIAVPPPAGPVPTPPIAVPPPAVPVPSPPIAVPPPAVPVPTPPTPGGGSGTCSINTLKLGACANVLNLLKLNLGVPASEQCCPLLSGLADLDAAVCLCTAIKANVLGIKLNVPVDLVLLLNQCGKTCPADFTCPS

SEQ ID NO: 2567 - protein, 262 aa, Brassica napus
  misc_feature (103)..(103): Xaa can be any naturally occurring amino acid
  misc_feature (183)..(184): Xaa can be any naturally occurring amino acid
  unsure (1)..(262): unsure at all Xaa locations
VDPRVRGSNLLIDSNGVLKIADFGLATFFDPRNSVPLTSRVVTLWYRPPELLLGACHYGVGVDLWSAGCILGELYSGKPILPGKTELHITILNPSRNSTSCFXVEQLHKIFKLCGSPTEDYWRKLKLPPSAAFRPSLPYGRHVAEMFKDLPTNVLSLLEALLSIDPEQRGSAAIALESEYFRXXPFACDPSSLPKYSPIKEIDAKLRDEAKRQQRRPQEKQDSLTRRSHERKLIPPVKANPSLAAATENPYLRRCCPGSFNK

SEQ ID NO: 2568 - protein, 525 aa, Oryza sativa (indica cultivar-group)
MSPPAAAARAPPVLRNELSRRTAVLGLRLWVLVGIAVGAAFLLLLAVISFHLAQARRRKPAAKRASSAAAAAAAPGGAAVPLSPATIPPVSKEIQEVAVHVGSLRHYLEAGATFLKEGGGVGGAVVDGDSLGGSTVYGSQRVHIEAGKGRRMVAYADGEAAVGVGVGPEVSHLGWGHWYTLRELEEATAAFAPEHVVGEGGYGIVYRGVLADGCEVAVKNLLNNRGQAEREFKVEVEAIGRVRHKNLVRLLGYCAEGAHRILVYEYVDNGNLEQWLHGDVGPVSPLSWDIRMNIVLGTAKGITYLHEGLEPKVVHRDIKSSNILLDKRWNPKVSDFGLAKLLGSDNNYVTTRVMGTFGYVAPEYASTGMLNERSDVYSFGILIMEIISGRSPVDYARAPGEVNLVEWLKNMVSNRDYEAVLDPKLPEKPTSKALKKALLVALRCVDPDSQKRPKMGHVIHMLEVDDFPYREIILYVHGSSDSAGEPTGQNKNICEAGDGVGRRGQHHHSCQYAIQIARELEIGLT

SEQ ID NO: 2569 - protein, 602 aa, Coprinellus disseminatus
MYHSIPQSCLDDSRQVCSGMWGGSNAYINVTVDSASQGQVALVIYEWKDVQYLGKTQRGGEDQDLPIVYVCTAKAFNAGYCAVNQLGRFILDLPAGKGINETSFWSERVQLPANKTVLQPTSIAVAEFWNNPAGNPTPPASNYSSPWRRDTPHYPNSASLSTRQTTGEEKGGVYEYDGPIHYPVANDGFYCVAIVPITGEHAHSATDLFQHPSYHGDILFQNVFNGHLAAADYPKLTFYFVMFLCYVVVGAVWGWLSYRHLQELFSLQYYLSGLIGLLVIEMLATWVYYRYLNARGPGTASTVFLIVVAILDAGRNSMSFFLLLIVSLGLGVVRESLGRTMIKCQVLAVCHFIFGVIYAIGIVELELESTSALMLLLFIIPLAFTLSGFLLWIMYALNGTIQQLEARKQHYKLRMFKRLHYILYFVVLAITIFFFISSMSFSGRGQQGYAANTWRTRWWLLDGFLAILYFVVFCGIAYLCFLLIFWAIFTLAMSDELAQDEEDAEDYDLEAIQSRTRRREEDDDDDRTLVGGRRGGHEPLPGENVVFDIGDDDEDDDDDAPKKPQQQRKPLERHSGDNDEYRPVNGRNSEERQDLMSRARND

SEQ ID NO: 2570 - protein, 592 aa, Beta vulgaris
MTCRKEKTGKKLGKEASIDVSHETRRKGKHKKSSKDRRKKRRKYYTSDSNGSSDSDMDSTETDTDSETDASSDVSSSSDDRRKKRKRSSKRDKYKRGKRRDRRRDKKRRRHDKRSRRKSRRASDSLTDTDSESSEESSEDEDNAKDFEKKNNDDLHNNAENHSPVVENAAATVNNHKIREGSDMFDDEELESPKENGGKQTNGYERDSRSDRNGTRQPDVVEDHPGKSRSRSASPKKAMSKSMSISPRSMSRSRSATPRRSVSRSPSVSKSPPLAVQRSRSLSRSPLRSASQSPARSPDRSDSGSPPRIRPRRNASVSPVTSPPRRSPSGSYPGGSSRRSIGRSPGRVGRSPVHPLRGSASPVKSSHRSISRSSGRPSSRRVASRSPIRSPRRSYRRSLSRSPARRSPPSIRRRSMSRSASPDGSPKRIRRGRGFSDRFSYARKYRTPSPERYRYGGRDRYPSYRRYSDRSPRHYRSPRRSPIRYRRRRSRTRSPSVSRSPPYRRRRYSRSPIRSRSPSDPPRYRASPRAEKRVSSSRSRSRSASVSGSSRGSPPPKRASRDKSRSRSSSGSPPGKKGLVSYGDGSAEASPR

SEQ ID NO: 2571 - protein, 271 aa, Robiginitalea biformata HTCC2501
MDRLPKIALPAVITIILLIILISKSAVTIGSGEAGVLYRTFGDGVVTDEPPLGEGFHIVAPWNKVFIYEVRQQEVFEKMKVLSSNGLDISLDASAWFQPKASDLGKLHQEKGEEYKERILLPAIRSAARSVVGRYTPEQLYSSKRDAIQQEIFSETQKIVDDQYIQLNEILVRDVTLPATIKEAIERKLKQEQQSLEYEFRLISADKEAQRQRIEAQGKADANRILSASLTDKILSDKGIEATLKLAESPNAKVVVVGSGEDGLPIILGNN

SEQ ID NO: 2572 - protein, 481 aa, Rickettsia rickettsii
MRDNSQKISSLKQEKLMSFLRKKSFESVKEIGSSSGFSKTLGAFDLILLGLGAMIGTGVFVVTGIIAAKYSGPAVMLSYAIAGITCIFVALVYTELAAMLPTSGSIYTYSYVAFGEVFAWMIGSVIILELGFAAGIVAAGWSGYVQGILAAGGINLPKELTTVPTNGGIINLPAFLISGFIGFILYLGTKDSKRLNAILVFIKMTAIFVFILAAAPHFDATNWSNFMPFGFSNVLVGASILFLAFTGFGTIATAAEECKNPKRDIMIGIIGSLVLTTIVYVTMAGLVTGIAPFDQLNNDQPLAYALTINNSKIGSAIVATGAVCGMMTVLMMNIYGTSRIFYAIARDGLLPKSFAKLHPKYDSPYITIIIFASLAAILGGFCSTELLTQLTSMGALIDYITVTIIVVLFRVTLPDAQRPFRCPLVFIIVPFILIACAYLLFIQIYDGEFNLLTAGRVLIYWFITIFVLYIIRSFFMQKEQN

SEQ ID NO: 2573 - protein, 304 aa, Burkholderia mallei ATCC 23344
MDYQPILERIHTELAPWIGAGRVADYIPELAKVPAERFGMAVVTLDGRIHTVGDARERFSIQSISKLFACTLAFQLLGDALWERVGREPSGNAFNSLVQLESERGIPRNPFINAGALIVTDVLCRRFVGAETALVQFMRRLTGVAELDYDLRVASSELAHAERNRAMAHFMASFGNLHMPPETVIDAYCRQCAIEMNCIELATAALFLANAGVAPVSGERILDASSAKRLSALMLTCGTYDAAGDFVYRVGLPAKSGVGGGIVAVLPGEMAVCVWSPGLDANGNSVAGVQALEQLTTLTGRSIF

SEQ ID NO: 2574 - protein, 802 aa, Oryza sativa (japonica cultivar-group)
MERSSGGGMEKEESTAGAGRRRRGGGAGGVSATKRAVTSSGTRPLPPPGGGGGRPVRVLVYDAFLLWARAVAVAFTFFTQSCAVNVVYGHAWCGRVHVPVEAGAIALIGLPALELEGLPWFIKVGPGPYPAYFDLVMKQFDRLELADDVLVNSFYEFEPELSYLLAGVTVGLQLARCCLPPPVHARAVSRHRHLLLSLNSIPTEKDKKHLTYPKVPVWMPPPEDCVKINVDAAISRWGNKGAVGAVCHTVSGEFVAASAMVWEGLSDSATLEALGCNEGLAIAMGCNMSESMSRGPTCSLTSQSHQNPHHPDSEGEGQPKERRKRGHGGRRAAVVASAAAAAEVVVLVLRAAQAAVRAVQVSLTLAAALAYLTLTALLQGRGLRRLLYLDRLRDDSEEVRSGYIEELAGSFRVLACFLLPCTLAEAAYKAYWYLAAPPFRSPWWSAAACAVEVASWAYRTAVFFMVCVLFRTICYLQILRMKGFAREFCRFADVAAVLESHRRIRKQLHRISHRYRRFILCCLVLVTTSQFAALLATTRPHAQINLATAGELALCSLSLVAGLLVCLQSAAKITHKTQAITSVAAGWHADATINAFDNDQEDPNPDLPRIVGYLVPVNAYWMASGESSSDSSSSSSSSDDDDSGHPKSKYIPFQNNHCFQQRQALVTYLENNRAGITVYGFVVDRTWLHALFMIEFSLVMWLLGKTVVEYFNKHAAVNPKASATDSSTKTSAPKASKEELKSFDAKFVNVDKTMLVGLILAANYLNVKDLLDLTCQHAVDLIKDMTLEQVREVFNIVNDFTL

SEQ ID NO: 2575 - protein, 513 aa, Hordeum vulgare subsp. vulgare
MDGNNRGGGHSEVLKNYNLGKTLGLGTFGDVKVAEHKLTGQRVAIKILNRRKMETMEMEEKANREIKIMRLFIDFIHPHIIRVYEVIETPKDIFVVMEYCNNGELLDYIIENGRLQEDEARRIFQQILAGVEYCHRIMVVHRDLKPENLLLDSKYNVKLADFGLSNVMRDGHFLKTSCGSLNYAAPEIISSKLYAGPEVDVWSCGVVLYALLCGSVPFDDDNIPSLFRKIKGGTYILPSYLSDSARDLIPKLLNIDPMKRITIHEIRVHPWFKNHLPCYLAVPPPYKEQQAKMIDEDILREVVNLGYDKDHVCESLWNRLQNEETVAYYLLLDNRFRSTSGYLGADHQHLMDRSFNEFTLSESASPSTRNYLPGINDSQGGGLRPYYPVQRKWAIGLQSGAHPRDIMIEVLKALKELNVCWKKNGLYNMKCRWCPGFPQVSDMLLDSNHNFVDDSTIMDNGNADGRLPAVVKFEIQLYKTKDNKYLLDIQRVTGPQLLFLEFCGAFLTNLRVL

SEQ ID NO: 2576 - protein, 94 aa, Anabaena variabilis ATCC 29413
MSEQFSAEISSRICNHMNEDHANAVVLYAQVFGGVSQATSAQMLAIDAQGMDLTAQVNGESVPVRIHFDHVLADAEDAHHTLIAMVKQARVNSH

SEQ ID NO: 2577 - protein, 429 aa, Nostoc sp. PCC 7120
MKKVLAIILGGGAGTRLYPLTKLRAKPAVPVAGKYRLIDIPVSNCINSEIFKIYVLTQFNSASLNRHIARTYNFSGFSEGFVEVLAAQQTPENPNWFQGTADAVRQYLWMLQEWDVDEFLILSGDHLYRMDYRLFIQRHRETNADITLSVIPIDDRRASDFGLMKIDNSGRVIDFSEKPKGEALTKMRVDTTVLGLTPEQAASQPYIASMGIYVFKKDVLIKLLKEALERTDFGKEIIPDAAKDHNVQAYLFDDYWEDIGTIEAFYNANLALTQQPMPPFSFYDEEAPIYTRARYLPPTKLLDCHVTESIIGEGCILKNCRIQHSVLGVRSRIETGCMIEESLLMGADFYQASVERQCSIDKGDIPVGIGPDTIIRRAIIDKNARIGHDVKIINKDNVQEADRESQGFYIRSGIVVVLKNAVITDGTII

SEQ ID NO: 2578 - protein, 392 aa, Arabidopsis thaliana
MRKKMMISDLPHDLESEILSRVPAKSLAKWKTTCKRWYALFRDPSFVKKNFDKAGGREMIVLMNSRVYSNSVNLQGINNRFDPSMEVTGKLIKLNDSKGVDISAIFHCDGLILCTTTESTGLVVWNPCTGEIRCIKPRIFYRCNDRYALGYGNSKSSCHSYKILRSCCYYVDQNLSLMAAEFEIYDFSTDSWRDLGDITRDMIVYSSGVSLKGNTYWVSGSKEKGFFMRYFDFSKEVFGRLPLPYQSFNANHTAALSAVGNEKIAVLQQKILAMSDEMRIWVTNKIDEAKDLSWSNFLLTVDYGKFNLPCLVNVTSFLLDEENKVAVCSDVDTKDGLRSRIYIVGKDFYKEVFKDTRGSDNNWPLLLCYVPSLVSIQENIPNKAEENEIKGG

SEQ ID NO: 2579 - protein, 361 aa, Sulfolobus tokodaii str. 7
MRAAVLFNYKEPLKIEEVEIEDPKENEVMVQVVATGLCHSDINVFVGATPVPPPVVAGHEIAGIVKKVGPGVTRVKPGDRVISAFIHPCGKCKNCISGHENLCETFSSVRLKGTMFDGTTRLRLKNGTIVRTFLGGGFAEYAIVHENALTVVPQDMDLQKVAVLGCAGITGYGAVDSAKIEPGETVAVIGVGGVGLSIIQLLKASGAGRIIALGTKKWKLEKAMELGATDVINTKETDPIKALKEVTNGGPDVVIEAGGTQETVQMAIESVRIGGRVVLVGLPPVSAQIPLRIAMIVRNGITILGNYGGRPRIDMPRLLELVRSGKYDPGKLVTGKYRLEEVNEAVKLLEEGEAIRSLIIP

SEQ ID NO: 2580 - protein, 329 aa, Sulfolobus tokodaii str. 7
MSFEDYFNRIVENVNINIEKYLKGDIQELYEASFYLFKAGGKRLRPLILVSSADLLGGDLNRAYLAGASVEVLHTFTLIHDDIMDEDTTRRGMPTVHVKWGIPMAILAGDLLHAKAFEILNEAFRGMSSNKITRAFEIFTKAIIIISEGQALDMQFEDKVTVSEEEYLDMIKRKTAMLFSSSAALGGLIATDNEKEIQALADYGLNLGISFQIVDDILGLIADEKELGKPVYSDIREGKKTLLVIKTMKEATDEEKKILLKALGNKNASKDELITAAEIIRKYSLEYAYNKAEEYARKAIEALESIDWKNDEAGKALKYLAEFTVKRRK

SEQ ID NO: 2581 - protein, 484 aa, Capsicum annuum
MGGKSSREDSWRQTSSTRSSWNQYEYPPTHSSSPSYPQDSYSYSSQQQAVPSYAPPPPHQQAVPSYAPAPPQQNYASHASRPRLDRRYSRIADNYNSLDEVTEALARAGLESSNLIVGIDFTKSNEWTGKRSFGNRSLHHIGQNLNPYEQAISIIGKTLAAFDEDNLIPCFGFGDASTHDQDVFSFFPDERFCNGFEEVLFRYREIVPQLKLAGPTSFAPVIEMAMTIVEQSGGQYHVLLIIADGQVTRSVDTGRGQLSPQEQKTVDAIVQASKFPLSIILVGVGDGPWDMMKEFDDNIPARDFDNFQFVNFTEIMAKNVPQSRKETEFALSALMEIPSQYKATMELHLLGGQSGKSPSRVALPPPMYGATSVGASKPSRATSFQQPTSSYYGYGSPADAAPHFQQTSSSYYNSAHPVDTVPSAPSSPYIAPSSTYDNQVCPICLTNPKDMAFGCGHQTCCDCGRALENCPICRSSIQTRIKLY

SEQ ID NO: 2582 - protein, 459 aa, Vibrio vulnificus YJ016
MLNFFKTRPDVPLSDSSNEGMLKRYKSYQWQVFLGLIFGYAVFYVVRMSLGVVKKPMLDAGIVTIEELGIMGSAFFFTYAFGKFLNGFLSDYANIGRFMSCSLLVSGVLSVVMGMNTVGFFFVLLWGLNGWFQSVGSAPSCVSLYQWFSPKQRGSRYSIWGGSRNIGEGITWILTATLVSYFGWRAGFIGAGIAAVVAALIMLKVLKDRPQTYGLPDPGTAFGEGTEIKKANDPKETRRAQMFILKQPVVWLIALSCAAMYISRYAMSSWAVLFLQETKGYSLIDAGFAMSMYPTAGLAGAILSGILSDKVFKGNRNIPNLLYGLANIAGMCLMFFGPDNRVIDAVALSMIGFSIGGLVVFLAGLIACDLMPKNAVGAVKGLIGLCSYIAASAQELISASLITITEVDGVKHYDFGNAQYFWLAAGVVSVLLALTVWNAKKVVDIDEEQDKKLQTRTAS

SEQ ID NO: 2583 - protein, 127 aa, Glycine max
  misc_feature (12)..(12): Xaa can be any naturally occurring amino acid
  misc_feature (24)..(25): Xaa can be any naturally occurring amino acid
  misc_feature (84)..(84): Xaa can be any naturally occurring amino acid
  unsure (1)..(127): unsure at all Xaa locations
PTDKGQAGTKHXNKPPRQSGRPKXXRSGAAAAKNGDKRENTEPEEQGNTTGLFFLYGSDAPSPYNPLQHKIYEKFAAPFTKRRXILKILILGGGSTLTYLSGTKTGDSLPIRKGPQLPPKRGYRGKI

SEQ ID NO: 2584 - protein, 375 aa, Oryza sativa
  misc_feature (330)..(330): Xaa can be any naturally occurring amino acid
  unsure (1)..(375): unsure at all Xaa locations
MADELDELLGFLSSPQPNVRGAAAGIVRGLTGDADGLRALSARADRALPALLRLLASAGGELGTGGAAADSLVNLSQDGALSARLVSLGAVVAAMDVVAKRGGEQPGLARSLVMLLANLTQVDSGVAALLQVGDEKMQGLYVAKLVRSFCRSSSESEEEDIFEHVASILVNISKVEAGRRILMEPKRGLLKQIIRQSDSTNQLRKKGVVSTIRNCCFEADTQIQNLLSLAEYIWPALLLPVAGKKIYSEEDRSKMPPELANALSHEREAVENSEIRQQALEAIYMIVLQDEGRRAFWSVNGPRILQVGYEDEEDPKVMEAYELIGSLLVXFPWLKAIKSSPYNYVRTWRNMHKQSNLPTFHRKVKKTRGGARYPA

SEQ ID NO: 2585 - protein, 221 aa, Oryza sativa (japonica cultivar-group)
MRGVGGPLLTIGDLLSDLAVDGGADLAGGEVSVPSSPSSAGQQAEEADPSELNRLFGVRAPFLFFPLLPVPRFGRHQSIDPSYHMRFSSLIMRPSCNWFDFLSYLLGADVLQIDRVCCKIQIKSIVQMNDLQEHYDNLMKALQENDPSWPSLMLKLCTALKTADKLVSCASIDAEQLLQKVELLERLLVRGDRAVTAIVEELQRSRPSEDSHSSKSKPSGK

SEQ ID NO: 2586 - protein, 323 aa, Candida albicans SC5314
MSSNSLEQLKATGTTIVTDTGEFEQIAKYKPQDATTNPSLILAATKNPEYASVIDVAIEYAKDKGSSPKEKAEIALDRLLIEFGKNILDIVPGRVSTEVDARLSFDKEATVKKALELIDLYKQQGIEKDRILIKIASTWEGIQAARELESKHGIHCNLTLLFSFAQAVACAEAGVTLISPFVGRILDWYKASTGEEYTAETDPGVQSVKAIYNYYKKYGYKTIVMGASFRNTGEIKALAGCDFLTISPKLLEQLYNSTEEVPKQLDAATAKDEDVEKVTYVDDESAFRFALNEDAMATEKLSQGIRQFGKDAVTLLTELESRF

SEQ ID NO: 2587 - protein, 525 aa, Sandersonia aurantiaca
MCGILAVLGCSDDSQAKRVRVLELSRRLKHRGPDWSGLDHHGDCYLAHQRLAIIDPASGDQPLYNEDKTIIVTVNGEIYNHEELRKGLPGHTFRTGSDCEVIAHLYEEHGESFIHMLDGIFSFVLLDSRNNSFVAARDAIGVTPLYIGWGLDGSVWISSEMKGLNDDCEHFKFFPPGHLYSSKEGSFKRWYNPPWFSEVIPSVPFDPLALRKAFEDAVIKRLMTDVPFGVLLSGGLDSSLVASVTARYLEGTKAAELWGTQLHSFCVGLEGSPDLKAAKEVANFLGTIHHEFHFTVQDGIDAIEDVIYHVETYDVTTIRASTPMFLMSRKIKSLGVKMVISGEGSDEIFGGYLYFHKAPNKEELHLETCHKIKALHQYDCLRANKATSAWGLEARVPFLDKEFVNVAMSIDPEWKMIKPDIGRIEKWILRRAFDDEENPYLPKHILYRQKEQFSDGVGYSWIDGLKAHSALHVTDKMMLNAAHIYPHNTPTTKEAYYYRMIFERFFPQIDSPWRSKCGLQHSKSY

SEQ ID NO: 2588 - protein, 752 aa, Neorickettsia sennetsu str. Miyayama
MRRMSAAIRVLTIDAVSRANSGHPGMPLGMADVATVLFAKFLKFCPNHPDWPDRDRFVLSAGHGSMLLYSLLYLTGYPDYTIEELKNFRQLHSKTPGHPEYGIAKGIENTSGPLGQGLATGIGMALAEATLNSRFGNIIDHYTYIIAGDGCLMEGISHEAASFAGHMKLRKIILFFDDNGISIDGSTSLCLSDNNLKRFESYGWDVQQIDGHDFAAIENAIANARSSDRPSLIAAKTVIGKSMPKEGTSKTHSGGLTREEVIAFRKRLEYPLEEFSIPEDVLRKWRSLGSLERYKEWQLAYNNLPGEVSLALGRTGADHNTDFLLSSSKASTKTHSTPTNEEDYIPASGTPYLEGMGNSNGQPQKQNNVSGVCNSPELLIPRDKQELCHTTTSDSNIGKLNSENSMQDLCIEPQKYHPLKYTEIFNELRNHTQDVSSEATRQSSGRVVKFLTSKIPEMLGGSCDLTGSNNVVPEPFKPISASNYNGNYIHYGVREHFMGACMNGMALHGNLVPYGGTFLIFSDYMRPSIRMSALMGLQTIYVMTHDSIGVGEDGPTHQPVEQLDSLNLIPNLYVFRPCDHIEVAESWQAALSITNAPSVIVLSRQKVNYLQREFPKENMCCKGAYLIKKASKKAKVSLLASGSEVSICAEVQSALEKLGYPTDLVSVPCISILKRNSTNQNRKQLIEPESIPFVVEASSGLMISSMFGVDSESLFNITEFGISAPYDKVYNHFGLTVAAVLERCLDKLSKSE

SEQ ID NO: 2589 - protein, 199 aa, Campylobacter lari
MVKIGIGGPVGSGKTALVLNLCQALKDELSLAVITNDIYTNEDANFLIKQGVLEKERIIGVQTGGCPHTAIREDASCNLEAVELLQERFSDLDLIFIESGGDNLSMTFSPELVDFFIFVIDVAQGEKIPRKGGPAICRSDLMIINKIDLAPYVNASLKIMQEDTLKMRGDRPFIMSNLQTKEGLDEIITWIKKYTLLKD

SEQ ID NO: 2590 - protein, 119 aa, Rickettsia rickettsii
MYNKENVFAKIIGKNLPAEIIYEDEQILAFKDIAPVAPVHIIVIPKNEYIDYADFISKASIDEIKHFFAKLSDIANEAGLDKDGYRLITNKGEKSGQTIFHFHFHIIGGEKLIGLINND

SEQ ID NO: 2591 - protein, 77 aa, Arabidopsis thaliana
MDPSMANNPELLQFLAQEKERAMVNEMVSKMTSVCWDKCITSAPGSKFSSSESSCLTHCAQRYMDMSMIIMKRFNSQ

SEQ ID NO: 2592 - protein, 466 aa, Arabidopsis thaliana
MDIISGQPMFLLFCFILSCFLFFTAARSRRSPTQVLSKSPPGPPRLPIIGNIHLVGKNPHHSFTDLSKTYGPVMSLKLGYLNSVVITSRDAAREKVEEMTFTQLFSPQRIEATKALRMKKVQELVNFLSESSERGEAVDISRASFVTALNIISNILFSVNLGSYDSKNSSAFQEMVIGYMESIGNPDVSNFFPFMRLLDLQGNSKKMKEYSGKLLQVFREFYDARILENSSRIDEKDVSSRDFLDALIDLQQGDESEINIDEIEHLLLDMFLAGTDTNSSTVEWAMTELLGNPKTMTKVQDEINRVIRQNGDVQESHISKLPYLQAVIKETFRLHPAAPFLLPRKAERDVDILGFHVPKDSHVLVNVWAIGRDPNVWENPTQFEPERFLGKDIDVKGTNYELTPFGAGRRICPGLPLALKTVHLMLASLLYTFEWKLPNGVGSEDLDMGETFGLTVHKTNPLLACL

SEQ ID NO: 2593 - protein, 482 aa, Staphylococcus aureus subsp. aureus MW2
MGSFFNKIARKEDPAIYQNKDGHLKRTLRVRDFLALGVGTIVSTSIFTLPGIVAAEHAGPAVALSFLLAAIVAGLVAFTYAEMAAAMPFAGSAYSWVNVLFGEFFGWVAGWALLAEYFIAVAFVASGFSANLRGLVKPIGIELPAALSNPFGTNGGFIDIIAAIVILLTALLLSRGMSEAARMENILVILKVLAIILFVIVGLTAINVSNYVPFIPEHKVTATGDFGGWQGIYAGVSMIFLAYIGFDSIAANSAEALDPQKTMPRGILGSLSVAIVLFIAVALVLVGMFHYSQYANNAEPVGWALRQSGHGVVAAIVQAISVIGMFTALIGMMLAGSRLLYSFGRDGLLPSWLSHLNDKHLPNRALVILTIIGVLIGSMFPFAFLAQLISAGTLVAFMFVSLAMYRLRKREGKDLPIPAFKLPLYPVLPAVTFVLVLLVFWGLGFEAKLYTLIWFIVGIILYLSYGLRHSKKNDVAEYHPPK

SEQ ID NO: 2594 - protein, 457 aa, Staphylococcus aureus subsp. aureus MW2
MHINTVNGRGMYMSKAHQLIQEDEHYFAKSGRIKYYPLVIDHGYGATLVDIEGKTYIDLLSSASSQNVGHAPREVTEAIKAQVDKFIHYTPAYMYHEPLVRLAKKLCEITPGDFEKRVTFDLTGSDANDGIIKFARAYTGRPYIISFTNAYHGSTFGSLSMSAISLNMRKHYGPLLNGFYHIPFPDKYRGMYEQPQANSVEEYLAPLKEMFAKYVPADEVACIVIETIQGDGGLLEPVPGYFEALEKICREHGILIAVDDIQQGFGRTGTWSSVSHFNFTPDLITFGKSLAGGMPMSAIVGRKEIMNCLEAPAHLFTTGANPVSCEAALATIQMIEDQSLLQASAEKGEYVRKRMDQWVSKYNSVGDVRGKGLSIGIDIVSDKKLKTRDGSAALKICNYCFEHGVVIIAVAGNVLRFQPPLVITYEQLDTALNTIEDALTALEAGNLDQYDISGQGW

SEQ ID NO: 2595 - protein, 374 aa, Zea mays
MADCMQEWPEPVVRVQALAESGLSVIPRCYVKPPCDRPAVSPAAATTVQETTEPSDMSIPVVDLGALLAADGGAAVTEAVAAACREWGFFQVVGHGVRPELLRAAREAWRGFFRRPLAERQRYANSPRTYEGYGSRLGVQKGAALDWGDYFFLHLAPEAAKSTPKFWPAVPGNCKEVSEEYGREVVRLCELLMRVMSVSLGLDEAHLQRAFGGAGCCGATLRANYYPRCPQPDLTLGLSAHSDPGVLTALLADEHVRGLQVRRSAGDWVDVRPVRDAFIVNVGDQVQIMSNSVYKSVEHRVVVNAEEERISLAIFYNPKGDVPISPAPELVTAAKLPPLYPTMTFDEYRLYVRSKGARGKAQIEALKGQASPEN

SEQ ID NO: 2596 - protein, 290 aa, Gluconobacter oxydans 621H
MAETWLNETLYPDWGQRFLVTRELARVKSDFQDVVVFESSSHGRVLVLDGVIQITERDEFVYQEMLTHVPLLAHPCAKRVLIIGAGDGGVLRRVLQHDTVEKAVMVEIDGAVIELSKQYLPDIAGDAWNDPRAEVIVGDGIDYVAKAADGSFDVIIVDSTDPIGVGEVLFTDEFYSNCARILSAEGLIVNQCGVPFMQADELYETSLRRAKFFPHVGAYVAAVPTYVGGFMTLGVASKGQAPNTQTVEQIRTRAEAAKILGTTRYWTPEIHVGSFNLPPYIAEHLPKTGK

SEQ ID NO: 2597 - protein, 296 aa, Staphylococcus aureus subsp. aureus MW2
MNKEQLEKMKNGKGFIAALDQSGGSTPKALKEYGVNEDQYSNEDEMFQLVHDMRTRVVTSPSFSPDKILGAILFEQTMDREVEGKYTADYLADKGVVPFLKVDKGLAEEQNGVQLMKPIDNLDSLLDRANERHIFGTKMRSNILELNEQGIKDVVEQQFEVAKQIIAKGLVPIIEPEVNINAKDKAEIEKVLKAELKKGLDNLNADQLVMLKLTIPTEPNLYKELAEHPNVVRVVVLSGGYSREKANELLKDNAELIASFSRALASDLRAGQSKEEFDKALGDAVESIYDASVNKN

SEQ ID NO: 2598 - protein, 633 aa, Neisseria meningitidis FAM18
MTTPKKTAKTSGNEARELADLSEDIGIRFKYPNSERVYLQGSRDDIRVPLREIRQDDTYTAQGAEANPPIPVYDTSGVYGDPAAHIDLKQGLPHIRTAWLNERGDTEILPKLSSEYGIERAHDPKTAHLRFNQITRPRRAKSGGNVTQLHYARRGIITPEMEFVAIRERLKLDELSQKSEYAKLLKQHAGQSFGANIPTHPDQITPEFVRREIAAGRAIIPANINHPELEPMIIGRNFRVKINGNLGNSAVTSSLTEEVEKMVWSLRWGADTIMDLSTGAHIHETREWIIRNAPVPIGTVPIYQALEKTGGIAEDLTWDLFRDTLIEQAEQGVDYFTIHAGVLLRYVPMTADRLTGIVSRGGSIMAKWCLAHHRENFLYTHFDEICEIMKAYDVSFSLGDGLRPGCIADANDESQFAELHTLGELTSKAWKHDVQVMIEGPGHVPLQRVKENMTEELQHCFEAPFYTLGPLVTDIAPGYDHITSGIGAANIGWYGTAMLCYVTPKEHLGLPDKEDVRTGIITYKLAAHAADLAKGWPGAQLRDNALSKARFEFRWRDQFRLSLDPERAESFHDETLPAEGAKIAHFCSMCGPKFCSMKITQEVRDYADKQKAQRQGMEEKAVEFVKKGAKIYS

SEQ ID NO: 2599 - protein, 655 aa, Bacteroides thetaiotaomicron VPI-5482
MRELKNHPSPDQLDSYDKYPCYYENDLELVYTPQQSIFTLWAPSADNVRLNLYSSGEAGDPEEQLEMDIADNGTWCIHIDRDLKGSFYTFQIEKDGKWLDETPGIWAKAVGINGNRAAVIDWNETNPEGWESDQSPELKMYSDIILYELHHRDFSIDPNSGIEHKGKFLALTETGTKTPEGESSGLDHLKELGVTHIHILPSFDFATIDERKLEKNKYNWGYDPKNYNVPDGSYSTDPVTPTTRIREFKEMVKSLHQNGFRIVLDVVYNHTASTEHSNFDLTVPGYFYRQNPDGSYSNASGCGNETASEREMVRHYIIESVKFWAKEYHIDGFRFDLMGIHDIDTMNQLREELLKIDPTIFVYGEGWVAADSPLPFEQRAVKENVRKMKGISVFNDEFRDGLKGSTFDEQEPGYASGNINGHFEPVKYGIVGGTQHPQVDYSGLLYCDGPYAAAPSQMINFVSCHDGYTLVDKLKLSVQGEHSEEELVPIDKLIHTVLLTSQGIPFIRGGEEIMQDKQGEPNSYKSSDAVNQIDWALKAKNRDIFNYIRTLIALRKKHPAFRIPTAEGLEKWLHFLDTGDSGVIAYTLGEYANGDEWKEILVAYNGNRNQADINIPEQDWIIVCHNGQIDLDSQEHLSGGDISITASSALILYRQ

SEQ ID NO: 2600 - protein, 264 aa, Sulfolobus tokodaii str. 7
MPISLLSKENNSLKLIVGNYPLELVNSIRRASILYVPVMAVDEVYFIENNSPLYDEILAHRLAMIPFSSDEALDHYRPPEECAECKENCDGCYARVYLDVGANEGETVMVYSRDLKTDDPAIVPISGNIPIVLLGPKQKVTLEARLRLGYGKEHIKFSPVSIAVVRYYPHVEVKGNCEKAFEVCPEGVFGMENGKLFVKNEVACTLCEECIKYCENNIFISAVENKYILEIESVGSLKPERILIEAGKSLLRKLNQLKKLVEGL

SEQ ID NO: 2601 - protein, 356 aa, Oryza sativa (indica cultivar-group)
MDHAAEAQRTDLMTITRHVLNEQGRHPESRGDFTILLSHIVLGCKFVASAVNKAGLAKLIGLAGDTNFLFASISRCHTYEVAVQGEEQKKLDVLSNEVFVKALVSSGRTCVLVSEENEEAIIVDAPLRGKYCVCFDPLDGSSNIDCGVSIGTIFGIYMIKDKDNVTLDDVLQPGTDMLAAGYCMYGSSCTLVLSTGNGVNGFTLDPSLGEFILTHPNIKIPNRGKIYSVNEGNAKNWDAPTAKFVEKCKFPQDGSPSKSLRYIGSMVADVHRTLLYGGIFLYPADQKSPNGKLRVLYEVFPMSFLMEQAGGQAFTGKQRALELVPRKIHDRSPIFLGSYDDVEDIKALYASESIIG

SEQ ID NO: 2602 - protein, 377 aa, Brassica oleracea
MAEADDIQPIVCDNGTGMVKAGFAGDDAPRAVFPSVVGRPRHHGVMVGMNQKDANVGDEAQSKRGILTLKYPIEHGVVSNWDDMEKIWHHTFYNELRIAPEEHPVLLTEAPLNPKANREKMTQIMFETFNSPAMYVAIQAVLSLYASGRTTGIVLDSGDGVSHTVPIYEGFSLPHAILRLDLAGRDLTDYLMKILTERGYMFTTTAEREIVRDIKEKLSFVAVDYEQEMETSKTSSSIEKNYELPAGQVITIGAERFRCPEVLFQPSFVGMEAAGIHETTYNSIMKCDVDIRKDLYGNIVLSGGTTMFSGIADRMSKEITALAPSSMKIKVVAPPERKYSVWIGGSILASLSTFQQMWIPKAEYDEAGPGIVHRKCF

SEQ ID NO: 2603 - protein, 404 aa, Vibrio vulnificus YJ016
MQDILTVILAGGMGSRLSPLTDDRAKPAVPFGGKYRIIDFTLTNCLHSGLRKILVLTQYKSHSLQKHLRDGWSIFNPELGEYITSVPPQMRKGGKWYEGTADAIYHNLWLLERSEAKYVMVLSGDHIYRMDYAPMLEEHIANNAALTVACMDVNCKEAKAFGVMGIDEHHRVHSFVEKPQNPPHLPNDPERSLVSMGIYIFSMEVLQQALIEDADNDASSHDFGKDIIPKLIDTGSVFAYKFCGSKGRVDKDCYWRDVGTIDSFYQANMDLLEPIPPMNLYQKDWGIRTYEPQYPPARTVSSGSGNEGIFINSMISNGVINSGGSVQHSIVSSNVRINDSATIVDSIIFDDVEIGEGCQLVNCIIDKHVKVPPYTQIGLNRLEDAQRFKISENGIVVVPESYQF

SEQ ID NO: 2604 - protein, 582 aa, Vibrio vulnificus YJ016
MLSDIDICRTTPLKPIEQIAAKAGLLADEFETHGLYKAKVSARCVKRLAEQQDGKLVLVTAITPTPLGEGKTVTTIGLAQGLQSLNQSVMACIRQPSMGPVFGVKGGAAGGGYSQVAPMDELNLHLTGDIHAVTAAHNLAAAAIDARIYHEQRAGYQAFEARTGLPALRIDPDRVVWKRVMDHNDRALRKVRVGLNDEGKTINGFEREEGFDISAASELMAILALSKNLQDMRERIGKVVLAYNLDGEPVSAEQLQVAGAMTVTLKEAIKPTLMQTLEGVPTLIHAGPFANIAHGNSSIIADEIALKLSSYVVTEAGFGSDMGLEKACNIKSSTSHKAPDCVVIVATLRGLKANSGLYDLKPGMPLPDALFQPDRAALESGFSNLKWHIDNAQKYGLPAVVAINQFPQDSAEELGQLKLWIQQLPLNVRVAISEGFAKGGKGMEAVAREVIEACDAPANFRPLYRAEQTLEEKIITVCTKGYGCGEVQFSDTAKQQLALYQTLGFGELAVCMAKTPLSISSDSSLKGAPSGFTIMVREVRLCAGAGFVYALTGNVMTMPGLPDIPAFMALDIDENGDIVGLS

SEQ ID NO: 2605 - protein, 225 aa, Capsicum annuum
MKLHATVASPTDTCKTIEVAVVERHHHRSPPQAIKLSPIPTADDNNPYNLTSPDDENSGEEFFIPPLNFSMVDNGIFRSGFPDVANFSFLQTLGLRSIIYLCPELYPESNMEFLKANDIRLFQFGIKNCKEPFVNIPEEKIREALGVLIDVRNHPVLIHCKRGKHRTGCLVGCLRKLQKWCLTSVFDEYQRFAAAKARVSDQRFMELFDASIFKQQSLPFSCSKR

SEQ ID NO: 2606 - protein, 191 aa, Ustilago maydis 521
MQTIKCVVVGDGAVGKTCLLISYTTNKFPSEYVPTVFDNYAVTVMIGEDPYTLGLFDTAGQEDYDRLRPLSYPQTDVFLVCFSVTSPASFENVKEKWFPEVHHHCPGVPCLIVGTQVDLRDDHAVIEKLARSKQRPVPFEAGERLARELGAVKYVECSALTQKGLKNVFDEAIVAALEPPVIRKKSKCAIL

SEQ ID NO: 2607 - protein, 480 aa, Oryza sativa (japonica cultivar-group)
METRELWVLAAALAVSLLYYLAALMRYAGGGCSRSSRPPLPPGPTPLPLIGNLLSLRGVLHHRLASLARVHGPVMALRLGLTTAVVVSSRDAAAEAFTKHDRRLAARVVPDSNRAHGFSDRSIIWLPSSDPRWKALRGIQATHLFSPRGLAAVRSVRESKVRDIVAYFRSRAGEEVVFGEAIYSGVLNLVSSSFFSVNMAGVGSEEAHGLRELVEDLVEAIAKPNERMARAFGILDGIIDRRLANRTHGDRHGDFLDALLDLVSEGKMARDHVTIMLFEVFGAGSDTMSVSLEWAMAELLRNPRAMRKARAELEDAAAVVEESDAARLPYLQAVVKEAMRLHPVGPILLPHRAVEDGVEIGGYAVPRGAMVIFNAWAIMRDPAAWERPDEFVPERFMETTTAIDFRGKEYEYLPFGSGRRLCPGLPLAERVVPFVLASLLRAFEWRLPDGVSAEDLDVSERFNTANVLAVPLKVVPVIVN

SEQ ID NO: 2608 - protein, 364 aa, Ashbya gossypii ATCC 10895
MTCSRNGALTSDLASLSAPRSPRVLSRAFPMSNIVNIEYNRVTNTTSTDFPGFSHQKECAWDVDEFRRTMDVQIKSLDEREANFDLLRVDTSIANAFRRIMISEVPSVAPEYVYFFNNTSVIQDEVLAHRIGLVPLKVDPDMLTWVDKSLPEAERFTDENTVVLSLNVKCTHNPDAPKGSTDPKELYRNAHIYARDLKFEPQGKQLETFAKCPVVPADPDILLAKLRPGQEISLRVHCILGIGSDHAKFSPVATASYRLMPYINIVEPITGPDAEKFVKCFPPGVAAINEKGEAFVQDARKDTVSREVLRHPELEQKVKLGRVRDHFIFNVESAGAMTPEEIFFKSVRILKNKAEYLKNCPITQ

SEQ ID NO: 2609 - protein, 580 aa, Arabidopsis thaliana
MGCVLCKESTGDKRKHNNPDEPPPADLRNTEDLPSSSSTTTAAISVEIGEKKKKDLDSIQIQPERRTWHTGDFSAGSSRRPGMSLRTPEGWPPWLIAACGDSIKDLTPRRATTYEKLEKIGQGTYSNVYKAKDLLSGKIVALKKVRFDNLEAESVKFMAREILVLRRLNHPNVIKLQGLVTSRVSCSLYLVFEYMEHDLSGLAATQGLKFDLPQVKCFMKQLLSGLEHCHSRGVLHRDIKGSNLLIDNDGILKIADFGLATFYDPKQKQTMTSRVVTLWYRPPELLLGATSYGTGVDLWSAGCIMAELLAGKPVMPGRTEVEQLHKIFKLCGSPSDSYWKKYRLPNATLFKPQHPYKRCVAEAFNGFTPSSVHLVETLLTIDPADRGTSTSALNSEFFTTEPLPCDPSSLPKYPPSKELNVKLRDEELRRQKGLAGKGSGIDGARRIRYRGDRTGRAIPAPEANAESQANLDRWRSISQTNGKSKSEKFPPPHQDGAVGYPLEDLSKKTSVFGAKTETSFGLSRSLKSGEGTSMRKISNKDGARGASSRKYIWGLKPPPALGLSMDLLFRSRSEVFGIRR

SEQ ID NO: 2610 - protein, 496 aa, Staphylococcus aureus subsp. aureus MW2
MELLKHLSQRQYIDGEWVESANKNTRDIINPYNQEVIFTVSEGTKEDAERAILAARRAFESGEWSQETAETRGKKVRAIADKIKEHREALARLETLDTGKTLEESYADMDDIHNVFMYFAGLADKDGGEMIDSPIPDTESKIVKEPVGVVTQITPWNYPLLQASWKIAPALATGCSLVMKPSEITPLTTIRVFELMEEVGFPKGTINLILGAGSEVGDVMSGHKEVDLVSFTGGIETGKHIMKNAANNVTNIALELGGKNPNIIFDDADFELAVDQALNGGYFHAGQVCSAGSRILVQNSIKDKFEQALIDRVKKIKLGNGFDADTEMGPVISTEHRNKIESYMDVAKAEGATIAVGGKRPDRDDLKDGLFFEPTVITNCDTSMRIVQEEVFGPVVTVEGFETEQEAIQLANDSIYGLAGAVFSKDIGKAQRVANKLKLGTVWINDFHPYFAQAPWGGYKQSGIGRELGKEGLEEYLVSKHILTNTNPQLVNWFSK

SEQ ID NO: 2611 - protein, 299 aa, Streptomyces coelicolor A3(2)
MAPTSTPQTPFGRVLTAMVTPFTADGALDLDGAQRLAAHLVDAGNDGLIINGTTGESPTTSDAEKADLVRAVVEAVGDRAHVVAGVGTNNTQHSIELARAAERVGAHGLLLVTPYYNKPPQEGLYLHFTAIADAAGLPVMLYDIPGRSGVPINTETLVRLAEHPRIVANKDAKGDLGRASWAIARSGLAWYSGDDMLNLPLLAVGAVGFVSVVGHVVTPELRAMVDAHVAGDVQKALEIHQKLLPVFTGMFRTQGVMTTKGALALQGLPAGPLRAPMVGLTPEETEQLKIDLAAGGVQL

SEQ ID NO: 2612 - protein, 460 aa, Gluconobacter oxydans 621H
MIQEHAAEFVDLRFTDPKGKWHHTTQTVSTIEDDTFVEGFMFDGSSIQGWKAINESDMVLLPDPETAVMDPFSAKPQLILFCDIIDPKTGNFYNRDPRSTAKLAEAYLKDAGFGDTAFFGPEAEFFIFDNVQFGTGPNFGMYQLDSIEGPGASLKAYPEGNMGHRPVVKGGYFPVPPVDSENDLRAEMLSTMGEMGLPIEKHHHEVAQSQHELGTKFDTLVKSADFMQIYKYCVHNVAHSYGKTATFMPKPISGDNGSGMHVHQSIWKDGKPTFAGDKYADLSDEALYYIGGIIKHAKALNAFTNPSTNSYKRLIPGFEAPVLLAYSAANRSASCRIPHATNPKAKRVEVRFPDPTANPYLAFAAMLMAGLDGIRNKIHPGDAMDKDLYELPKEELAQIPTVCGSLREALEALKEDHAFLLEGGVFTKDQIESYIDIKWPEVYKFEHTPHPAEFEMYYSV

SEQ ID NO: 2613 - protein, 387 aa, Gluconobacter oxydans 621H
MKTPNQYLASLPTTIFTIMSQLAVKHGAINLGQGFPDTEGPQDIIQVAADALRDGRNQYAPLTGLPELREAVAASNRRFYGLEVDPATEVVVTSGATEALAACLMAVVEPGDEVVVIEPLYDTYLPALKLLGAVPRCVRLAPPHWSVPEAELRAAFGPKTKAIMLNSPMNPSGKVFVREELELIADLVREHDVYAICDEVYEHLTFHVKHIPLMTLPGMRERCMRIGSAGKSFSLTGWKVGYVTAPAALASVVAKAHQVLVFATAPNLQRAVAYGLNKDDGYYEGLSAQMETQRDLLRDGLHRLGFETLPADGSYFIVADISRHAAGRGDVEFARWLVEHAGVATIPVSAFYDPQGDAPPQNLIRFAFCKKPEILREALKRLEKALS

SEQ ID NO: 2614 - protein, 373 aa, Methanosarcina barkeri str. Fusaro
MNEIIIWILIIFCLVQSAIFSGMTIGLFSLGRLRLEIEAEADSKDAIKILQIRRDSNFLLTTLLWGNVGINVLIALLTGSVLTGASAFLFSTFVITSFGEIVPQAYFSRNALSIGAKLTPLVRFYQMLLYPVAKPTALILDWWLGREKLELFKEQSMRIMLEKHIESGKSDIGTFEGIGALNFLSIDDVSISDEGSLIDQRSIISLPVENNRPVFPPFKREPEDPFLQKIEASGKKWVIITNPQDEPVMVLDADGFLRDAVYKKGPFIPLSYCHFPVVVRSPKTRLEKVIRQFKVYPQYPEDDVIDQDLILYWDQEKRIITGSDILGRLLRGIVVECDLKSGCETPVPPSQPGVVRRSLRRGKKKESEEQKKE

SEQ ID NO: 2615 - protein, 405 aa, Ralstonia metallidurans CH34
MTADSGKRRFARIDRLPPYVFNITAELKMAARRRGEDIIDMSMGNPDGATPPHIVAKLVDAAQRPDTHGYSASKGIPRLRRAISHWYRERYDVDIDPDKEAIVTIGSKEGLAHLMLATLDRGDTVLVPDPSYPIHIYGAVIAGADIRSVPLTPGIDFFAELERAIRGSYPKPKMIVLGFPSNPTAACVELDFFERVIALARKHDIFVVHDLAYADIVFDGWKAPSIMQVPGAKDIAVEFFTLSKSYNMAGWRIGFMVGNPDLVAALTRIKSYHDYGTFTPLQVAAIAALEGDQQCVKEIAAQYQSRRDVLARGLIESGWPVDIPKASMYIWARIPEPYRALGSLEFAKQLLAKAKVSVSPGIGFGDYGDEYVRFALIENESRIRQAVRGIKAMFRADGLVTAPGG

SEQ ID NO: 2616 - protein, 341 aa, Ustilago maydis 521
MTFETDDQSSVPCISLHNFEQRRTEIIDQLMDASTRIGFFTLENHGISTEQIQDAFSLSQEFFALPDDVKAKTPLNGKNMGWEKGAQIRPSTGTADQKESMQLQFARMEGMWPSNDDVPNFRARAEAFMFAVQQLSVKVMECFAEGLGLPLSTFTEGTVDPGVGDSQSTLRLLHYHSVEGKEFGESFWRAGSHADFDVLTMLFQRDREGGLEVCPGREVVGDFGHGNTWKNVEARSDRIVCNIGDQLMRWSDDRLKSTFHRVRLPKQGEPKGPRYSIAFFNQARSNVVIQGPGKKYAPITGSEFIKQALERNKLGIAARSAAPAQSNENKATTSLSAVAVN

SEQ ID NO: 2617 - protein, 371 aa, Coccidioides immitis RS
MIAIGLEGSANKLGVGIILHPDNGGEPRVLANIRHTYVSPPGEGFLPKDTAKHHRKWVVSLVKAALKEAEIGVSDVDCICYTKGPGMGPPLQSVALAARTLSLLWGKQLVGVNHCVGHIEMGRYITGAQNPIVLYVSGGNTQVIAYSSQRYRIFGETLDIAVGNCLDRFARTLHISNDPAPGYNIEQLAKKGKRLVELPYTVKGMDCSFSGILAAIDALAAAYGLSGDQQAKENIGLTEDALKLKVDSVDKYNNEGGIPTREDLCFSLQETVFSMLVEITERAMAHVGSREVLIVGGVGCNERLQEMMGIMARDRGGNVFATDERFCIDNGIMIAQAGILAYKTGFTTKLEDSTCTQRFRTDEVFVQWRDD

SEQ ID NO: 2618 - protein, 526 aa, Citrullus lanatus var. lanatus
MASSMAAVGVLRLPTTSASSSSSSNGGSNRARRHSLRSLSFGASHISGDKIDFRASALGSRRVSGGRAVPSIVSPKAVSDSKNTQTCLDPDASRSVLGIILGGGAGTRLYPLTKKRAKPAVPLGANYRLIDIPVSNCLNSNISKIYVLTQFNSASLNRHLSRAYASNMGGYKNEGFVEVLAAQQSPENPNWFQGTADAVRQYLWLFEEQNVLEYLVLAGDHLYRMDYERFIQAHRETDADITVAALPMDEKRATAFGLMKIDEEGRIIEFAEKPKGEQLKTMKVDTTILGLDDARGKEMPFIASMGIYVISKDVMLSLLRDKFPGANDFGSEVIPGATSIGMRVQAYLYDGYWEDIGTIEAFYNANLGITKKPVPDFSFYDRSSPIYTQPRYLPPSKMLDADITDSVIGEGCVIKNCKIHHSVVGIRTCISEGAIIEDTLLMGADYYETDADRRLLAAKGSVPIGIGRNSHIKRAIIDKNARIGEDVKIVNGDNVQEAARETDGYFIKSGIVTVIKDALIPSGTVI

SEQ ID NO: 2619 - protein, 469 aa, Shewanella oneidensis MR-1
MSVESVLKQLEELEVKFVDLRFTDTKGKEQHVSIPSHQVDADFFEDGKMFDGSSIAGWKGINESDMVLMPDPTTFVLDPFTEETTALIRCDVLEPGTMTGYDRDPRSIAKKAEEYLRSTGIADTVLVGPEPEFFLFDDVRFGTDMSGCFVKIDAKEAAWNSGTSYEGGNTGHRPFVKGGYFPVAPVDSSQDLRSAMCLVLEEMGQVVEAHHHEVATAGQNEIATRFNTLTKKADEIQILKYVVHNMAHAYGKTATFMPKPIVGDNGSGMHVHQSLSKDGVNLFAGDKYAGLSETALYYIGGIIKHARALNAFTNPSTNSYKRLVPHFEAPVMLAYSARNRSASIRIPVVPSPKGRRIETRFPDPHANPYLGFAALLMAGIDGIQNKIHPGEAMDKDLYDLPAEEAAEIPQVATSLENALENLQADHEFLTRGGVFSEDFIQSYIALKSAEAERVARTTHPLEFEMYYSL

SEQ ID NO: 2620 - protein, 526 aa, Citrullus lanatus var. lanatus
MVAMDSCFVSLKSNTHLMKGNWGGLDRCENGFYGEKVRGSFNENAWIKSLKSEKKALKLTPNVAYAVATPNISKQPVSIQVPSIPKVKANPKNVASIILGGGAGTHLFPLTRRSATPAVPVGGCYRLIDIPMSNCINSGINKIFVLTQFNSASLNRHISRTYFGNGVNFGEGFVEVLAATQTSGETGMHWFQGTADAVRQFIWVFEDAKNRNVENILILAGDHMYRMDYMDFVQNHIDRNADISISCAAVGDSRASDYGLVKIDSRGRIIQFSEKPMGANLSAMRVDTTSFGLSREESLKSPYIASMGVYVFKTDILLNLLKWRYPTSNDFGSEIIPAAVKEHNVQAYIFRDYWEDIGSIKTFYDANLALTEEFPKFEFYDPKTPIYTSPRFLPPTKIDKCQIVDAIISHGCFLRECSVQHSIVGERSRLDYGVELKDTIMMGADTYQTEPEIAGLLAEGKVPIGIGRNTKIRNCIIDKNAKIGKDVVIMNKEGVQEADRPEQGFYIRSGITIILEKATIEDGTVI

SEQ ID NO: 2621 - protein, 136 aa, Capsicum annuum
MASKNVFPSTLALFLCLNLFFAVVSGCGTCPKPKPKPKPKPSCPPPPYYPTETCPIDTLKLGVCADVLGLVNAVIGSPPVTPCCSLLSGLANAEAALCLCTAIKANILGINLNVPVSLSLLLNVCSKEAPAGFQCS

SEQ ID NO: 2622 - protein, 338 aa, Solibacter usitatus Ellin6076
MRGTVLYGPRDIRFEDREDPRIEKPTDAVIRMAATCVCGSDLWPYRGIQATNGPTPMGHEYCGFVEEVGRAVKSVKPGQFVVGSFATSDNTCPHCQHGYQSSCAQREFVTRAQAPFLRVPLADGTLVPAPEAPSRDLIPSLLAASDVLGTGWFAADAANVKPGSTAVVVGDGAVGLLAVLSARQMGAGRIIAMSRHESRQKLAREFGATDVVSERGAEGIARIKELTNGVGADSVLECVGTMESMQQAIQVTRPGGFVSYVGVPQGVELDGQALFFAHVHLHGGPAPVRRYLPHLMDLVLNEKINPGRVFDLTLPLEQVAEGYRAMDERRAIKALLRP

SEQ ID NO: 2623 - protein, 448 aa, Arabidopsis thaliana
  misc_feature (419)..(419): Xaa can be any naturally occurring amino acid
  unsure (1)..(448): unsure at all Xaa locations
MAFAKAPRLSRDDILGNRVSTRSFKIFSDNQKTDPASTIGTSQKKTRIPLRRKKIRESQERAKAVLKTGRNTLKANNISVKKSTKENVSKRTTELGNNNLYKTASKASNQAVPQLSSAGTYTWKTRTSVGSIQSDGNKQSKNNVRFIQTTVKTSLQNRSSLKKPPVGRSKSRSISSIPSSAVASTLSLPEKVETKCLEEDTQGESSSSGNKDPTTKVLDVTAKPKSKRRKSFTSLLVNGSKFDEKNGETTEPEKLPSIDDESNQLEVAEYVDDIYQFYWTAEALNPALGHYLSAHAEVSPVTRGILINWLIEVHFKFDLMHETLYLTMDLLDRYLSQVPIHKNEMQLIGLTALLLASKYEDYWHPRIKDLISISAESYTREQILGMERSMLKQLKFRLNAPTPYVFMLRFLKAAQSNKXRCTLHMTPVWTSLLNNHTHYNVSQMKDCS

SEQ ID NO: 2624 - protein, 519 aa, Haloarcula marismortui ATCC 43049
MDAGLIILDGWGLNPDDDVRDAVAAADTPNFDRYRDAGAASTLTTHGRRVGLPEGQMGNSEVGHLNIGAGRVVKQDSARVSDSIARSRGEAPPDDDAQDPPFFENETILSAFEHAEAHGGRVHFMGLVSDGGVHSYQDHLHALIELAGERGTDAVSHAFTDGRDTSPTGGEDYLADLEAHVEEHGTGHVATVCGRYYAMDRDQNWERTRRAYDAIVHREGDHHADEAVTAATESYARDTTDEFIEPTTVGDHAGLEAGDAVVFFNFRSDRARQLTRMLGDIRPEDWGSDTEPPDTRLVTMTQYDETFDLPVAFPPNQPADVLGEVLSEAGKTQIRLAETEKYPHVTYFLNGGREVAFDGESREIVDSPDVATYDLQPEMSAPELADTAIEFIETEDPSAMVLNFANPDMVGHTGDFDAAVTAVEAVDEQLGRLVETIGAAGGHALICADHGNADDMGTEDDPHTAHTTNPVPFIYLSPDGTAGGRTARDGGTLADLAPTMLTLMGIDRPDAMTGTPLVE

SEQ ID NO: 2625 - protein, 432 aa, Synechococcus sp.
VTSSPFKTIKSDEIFAAAQKLMPGGVSSPVRAFKSVGGQPIVFDRVKDAYAWDVDGNRYIDYVGTWGPAICGHAHPEVIEALKVAMEKGTSFGAPCALENVLAEMVNDAVPSIEMVRFVNSGTEACMAVLRLMRAYTGRDKIIKFEGCYHGHADMFLVKAGSGVATLGLPSSPGVPKKTTANTLTTPYNDLEAVKALFAENPGEIAGVILEPIVGNSGFIVPDAGFLEGLREITLEHDALLVFDEVMTGFRIAYGGVQEKFGVTPDLTTLGKIIGGGLPVGAYGGKREIMQLVAPAGPMYQAGTLSGNPLAMTAGIKTLELLRQPGTYEYLDQITKRLSDGLLAIAQETGHAACGGQVSGMFGFFFTEGPVHNYEDAKKSDLQKFSRFHRGMLEQGIYLAPSQFEAGFTSLAHTEEDIDATLAAARTVMSAL

SEQ ID NO: 2626 - protein, 284 aa, Burkholderia mallei ATCC 23344
MSGRSFLIGLIGAGIGGSLSPAMHEAEGRRQGLNYVYRRIDLDALGLTADALPELLATAERMGFDGLNITHPCKQRVIEHLDELSADAAALGAVNTVCFAHGRRIGHNTDWSGFAKAFARGLPGASLERVVQLGAGGAGAAVAHAALTMGAAQLALFDVDPVRARSLADQLQARFPHARLSAGGTLADALANATGLIHATPTGMLGHPGLPLPAHLLRSGLWVADIVYFPLETKLIRAARALGCRTLPGGGMAVYQAVDAFELFTGRAPDAERMFEHFRALVAR

SEQ ID NO: 2627 - protein, 405 aa, Haloarcula marismortui ATCC 43049
MTDSDVVALAERVRDGELRLYELEDHAEPDVAAAARRHLLAEETDTDLSAVGDYTFDAADAESNIENMVGAAQVPMGVVGPLPVDGGAAEGDHHLPLATSEGALLASVNRGVSTIRNAGGATARVLKSGMTRAPVFRVEDVAEAGEVSAWVREHVDVLADAAESTTSHGELQDVTPYVVGDSVFLRFSYDTKDAMGMNMATIATEAACDVVETETPADLVALSGNLCSDKKPAAINAVEGRGRTVAADVLIPHEQVEDRLDTTSDAIVEANTRKNLVGSAKAGALGFNAHAANVVAAAFLALGQDMAQVVEGSNAITTVDAREDGLYASVTIASLEVGTVGGGTGLPTQSEALDVLGYSGGGDPAGSNADALAEVIAAGALAGELSLLAALSSRHLSSAHADLGR

SEQ ID NO: 2628 - protein, 207 aa, Saccharum officinarum
MSNEFDYLFKLLLIGDSSVGKSCFLLRFADDSYVDSYISTIGVDFKIRTIEMEGKTIKLQIWDTAGQERFRTITSSYYRGAHGIIIVYDITDMESFNNVKQWLSEIDRYANDSVCKLLVGNKCDLAESRTVDTSVAQAYAEEIGIPFLETSAKESINVEEAFLAMSAAIKKSKAGSQAALERKPSNIVQMKGQPIQQEQQKSRCCLT

SEQ ID NO: 2629 - protein, 267 aa, Anabaena variabilis ATCC 29413
MEDFVTPPAFGEKVRERWTLAGRKALITGATKGIGLAIAQEFLALGAEVIIVARNAEAIEQQINAWDSAGKVHGVTADVSTSEGRQIIHEYVSKTVGELDILVNNVGTNIRKKATDYTEEEFAGIFQINLTSIFELSRLFYPLLKTSKNSSIVNIASVAGLISVRTGAPYGMTKAALVQLTRSLAVEWADDGIRVNAIAPWFIQTPLTEPLLNNPETLSAVLSRTPMKRVGQPEEVASLTAFLCMPTASYITGQCIAVDGGFLAFGF

SEQ ID NO: 2630 - protein, 207 aa, Saccharum officinarum
MSNEFDYLFKLLLIGDSSVGKSCFLLRFADDSYVDSYISTIGVDFKIRTIEMEGKTIKLQIWDTAGQERFRTITSSYYRGAHGIIIVYDITDMESFNNAKQWLSEIDRYANDSVCKLLVGNKCDLAESRTVDTSVAQAYAEEIGIPFLETSAKESINVEEAFLAMSAAIKKSKAGSQAALERKPSNIVQMKGQPIQQEQQKSRCCLT

SEQ ID NO: 2631 - protein, 476 aa, Ashbya gossypii ATCC 10895
MLHVIRRSRATSARQLPRVAGLLAGAAAVRSRTYIGTRILHEEQKPKKPEPPNSILTEDMLARAGVDAERGPETEKAPAEDKAGESTETGSGAGKKKRARKTTTEIKRERYANLFYLFSLTGLAGGAVYMSRDWDADEPEEERKGIENGYTPGLMYRRFKARFDSLFTFFQEPPYPDLLPPPTSPSYQRPLTLVLPLEDFFVHFEWTQQYGWRTVIRPGADYLLGYLSDYYENVLFPSNYMVYSKKVVEKLDPIRAFITYNLFKDHCVYKDGIHIKDLSHLNRDLGKTLIIDTDPNSVKLQMENAILAEPWDGKADDALLRYIPFLEYLVTQPINDVRPILNSFKDRHHIPEEFAERVEKLRAKFNADQKAKAGSGLSFLLNPGMASKPAKFPLDLIREEGEKNYVRFMKLIEEEKEKLKLQQEHMSAPTFTLKDMAEGNMPTPEEQMKMQLQKQKEFEELYEKEKQKMQQQTKGQ

SEQ ID NO: 2632 - protein, 421 aa, Mesorhizobium sp. BNC1
MNHFQYRDGVLHAENVPIPRITAAVGTPFYCYSTATLERHYRVFSEALSGLDALVCYAMKANSNQAVLKTLGNLGAGADVVSQGELRRALAAGIPANKILFSGVGKTGEEMDFALSAGILCFNVESLPELELLSARARAIGVKAPVSLRINPDVDAKTHKKISTGKSENKFGIPWKDARAAYARAASLPGLEVTGIDMHIGSQITELQPFDQAFALLTELTETLRADGHAIKHVDLGGGLGVPYREDNEPPPLPDAYAEVVRRHVTRLGLKVIFEPGRLIVGNAGVLISRVLYLKEGEGKNFLIIDAAMNDLIRPTLYDAYHTIRPVAEPAADAPHLKADVVGPVCETGDFLALDRDLPRMEPGDLIAVGTAGAYGAVLSSTYNSRLLVPEVLVNGDRFHIVRPRPTYEQLIALDSLPDWL

SEQ ID NO: 2633 - protein, 210 aa, Saccharum officinarum
MSYAYLFKYIIIGDTGVGKSCLLLQFTDKRFQPVHDLTIGVEFGARMITIDNKPIKLQIWDTAGQESFRSITRSYYRGAAGALLVYDITRRETFNHLASWLEDARQHANANMTIMLVGNKCDLSHRRAVSYEEGEQFAKEHGLIFMEASAKTAQNVEEAFVKTAGAIYKKIQDGVFDVSNESYGIKVGYVVPGQSGGAGSSSSQGGGCCS

SEQ ID NO: 2634 - protein, 240 aa, Gluconobacter oxydans 621H
MIQVPFPPSRAALLLDFDGTLVDIAPTPESVRVPEGLAADLLRLRDMLDGALAIITGRPIAQIDHFLPDIPHAVAGEHGVMMRHAPGQALRERKLPVVPGEWVQAVEKAAADHPGASVEHKKAGMVLHYRRAPEAESAFRELASAWPVENWGFHLQDAQMAIELRPLGIDKGKALRELMAEPPFAGRLPVFAGDDVTDRDGVRAARQMGGAGWLIPDDFPDAATFRRWLHDLSEGHGWGA

SEQ ID NO: 2635 - protein, 317 aa, Triticum aestivum
  misc_feature (45)..(45): Xaa can be any naturally occurring amino acid
  misc_feature (141)..(141): Xaa can be any naturally occurring amino acid
  misc_feature (158)..(158): Xaa can be any naturally occurring amino acid
  misc_feature (166)..(166): Xaa can be any naturally occurring amino acid
  misc_feature (177)..(177): Xaa can be any naturally occurring amino acid
  misc_feature (192)..(192): Xaa can be any naturally occurring amino acid
  misc_feature (270)..(270): Xaa can be any naturally occurring amino acid
  misc_feature (282)..(282): Xaa can be any naturally occurring amino acid
  misc_feature (301)..(301): Xaa can be any naturally occurring amino acid
  unsure (1)..(317): unsure at all Xaa locations
MESGSTFYAGEGLHIDPSWLIDPKLLFVGPRIGEGGHAKVYEGKXGSSVYTTMYKNQNVAIKIVHKGDTPEEVIKRQGRFLREVTMLSRVQHKNLVKFIGACLEPVMVVVTELLVGGSLRKYLVSLRPRNLEPRVAVGFAXLDLPRAREWLPAQGILXRGLNPEKXRLTADPRTVKXPTLVLPREDPLTEMXTPETGTYRWMAPELYSTVTLRHGEKKHYNHKVDVYSFAIVLWELLHNRLPFEGMSNLQAAYAAAFKNIRPSADNCRRXLSEFLTSCWKEXPSDRQTHQIVKCSHYLSTXSPPEHMARSNSEKHLL

SEQ ID NO: 2636 - protein, 417 aa, Streptomyces hygroscopicus
MTPQQRSAVLSRAAALLESRAEEFSALITSESGVCRKETLREVSRAAGNLKVAAAEAERIRGESIPLPDGTRLAVTLPEPVGVVLGITPFNRPLNQVVVKAAPALAAGCPLLLKPSEKTPLTALAFAELLIEAGCAKDMLGVVTGEPGELGPLLASHPDVAMVTFTGSVATGHSVAALAAGKRQLLELGGNDPLFVLPDADLPHAARLAAGGACATAGQSCRGIKRIFVWEEVADEFTDLLSTEVAGKQAGDPRRSDTDLGPLISEEAALVVERRIADAVRDGARLVTGGERDGALVHPAVLDRVPADTELVREETFGPVAPVIRVRGADEAVRLSNSTAYGLQAGVLTRDSARFWDLAARLRVGAVNLGEGPHFDSPHIPFGGVKACGIGREGIRYAIAEMTVTKTVTLPGPYGTG

SEQ ID NO: 2637 - protein, 481 aa, Citrullus lanatus var. lanatus
NSNSSPRSTARKLTPGVAYSVLMSEISEVSSTLQAPIFETPRADPKKIASIILGGGAGTRLFPLTSQRAKPAVPIGGCYRLIDIPMSNCINSGIEKIFVLTQFNSFSLNRHLARIYNFGNGVNFGDGFVEVLAATQTSGETGKKWFQGTADAVRQFIWLFEDAKTKNVEHTLILSGDHLYRMDYMDFVQRHIDTNADITVSCIPMDDSRASDYGLMKIDDTGRILHFAEKPKGSDLEAMKVDTTVLGLSNQDARKNPYIASMGVYIFRTDLLLKLLTWSYPSCNDFGSEIIPSAVKDYKVQAYLFNDYWEDIGTVKSFFDANLALTEQPPKFEFYDPKTPFYTSPRFLPPSKVEKCRIVDAIISHGCFLRECSVEHSIVGVRSRLEYGVELKDTMMMGADYYQTESEIASLLAEGKIPIGIGENTKIRNCIIDKNARIGRNVVIANSDDVQEADRPEDGFYIRSGITVTLKNATIKDGTII

SEQ ID NO: 2638 - protein, 344 aa, Oryza sativa
MACLHDHSCEDHNCAADWSLFNHIDVPKVVALNESVAGSVKSVFKPWEQRLDTSGGFLESNEGDPELLVFIPTAVVFRPKLFDVSLVRTCSIWTFSFHPLFVLLFSALTTRHPSCWLVLLYSALTPGLLIFPAVIYQSVCASFGLFLHILLSIVCAKASMLFKHACANCKPAFAHHELYICCERKVHVQIHLVLLIHLFLLSIACCVDLCMRFTSDVKIKSISVVGGADGTSPSRMRAFINREGIDFNDAQNMQPVQEWELAENLQGVLEYQTRYSRFQGVANLTLHFPENFGGDTTKIYYIGLRGEATQNKRDVVATIVYEIMPNPSDHKTKSETGGGFSHVE

SEQ ID NO: 2639 - protein, 91 aa, Oryza sativa
MAANFWTSSHWRVYTRKSMTEYDPRLVAPTCLYLASKVEESTVQARLLVFYIKKMCASDEKYRFEIKDILEMEMKLLEALDYYLVVYHPYR

SEQ ID NO: 2640 - protein, 351 aa, Mycobacterium sp. MCS
MHAMVYHGPGRRSWEQVPDPEVQRATDAIVRVDAVTICGTDLHILKGDVPEVQPGRILGHEAVGTVIEIGSAVEKLAVGDRVLVSCISACGSCRYCRDGQYGQCLGGGGWILGHLIDGTQAEYVRVPFADNSTHKVPAGVSDEQMVMLADILPTSYEVGVLSAAVRPGDTVAIVGAGPIGLAAVLTAKLFSPSHIVVIDIAESRLEAAKNMGADVVVNSTSQDARSVLDELTDGLGADVAMEAVGMPETFEQAVRLVRAGGHVANIGVHGKPATLHLEDIWIKNLTITTGLVDTHSTPSLISLVANHQIDTAAMITHHFGMEEFDLAYDVFSRAGETGALKVLLTRTAHSG

SEQ ID NO: 2641 - protein, 129 aa, Zea mays
MSSEKEAALAAVLDDSPTIFDKIIKKEIPSTVVYEDEKVLAFRDINPQAPTHILIIPKVKDGLTGLAKAEERHIEILGYLLYVAKVVAKQEGLEDGYRVVINDGPSGCQSVYHIHVHLLGGRQMNWPPG

SEQ ID NO: 2642 - protein, 322 aa, Escherichia coli B
MAKRNNDMDNLDVICIGAAIVDIPLQPVSKNIFDVDSYPLERIAMTTGGDAINEATIISRLGHRTALMSRVGKDAAGQFILDHCRKENIDIQSVKQDVSIDTSINVGLVTEDGERTFVTNRNGSLWKLNIDDVDFARFSQAKLLSLASIFNSPLLDGKALTEIFTQAKARQMIICADMIKPRLNETLDDICEALSYVDYLFPNYAEAKLLTGKETLDEIADCFLACGVKTVVIKTGKDGCFIKRGDMTMKVPAVAGITAIDTIGAGDNFASGFIAALLEGKNLRECARFANATAAISVLSVGATTGVKNRKLVEQLLEEYEG

SEQ ID NO: 2643 - protein, 273 aa, Phaeodactylum tricornutum
MKFATAATVTLLALSTVDALNVKKLFRFGKTSLPKDSSPKPAAKGGYDLDVSELFDGNNKFIADKLAGDPAYFDTLGTVHSPKYLYIGCVDARAPPNMIMGTEAGTMLTVRNIANMVVNNDLAVMSAIQFGINVLKIPNVILCGHYECGGVRASVANVDHAPPLSIWLRNIRDVYRLHAKELDAIKDPEERHRRLVDLNVIEQCVNLFKTGVIQAKRIESYKDGGVAIPQVHPVVFDPKTGEVKKLKVDFDKYMAEINGIYDLYDLENAKVPM

SEQ ID NO: 2644 - protein, 111 aa, Triticum aestivum
  misc_feature (11)..(11): Xaa can be any naturally occurring amino acid
  unsure (1)..(111): unsure at all Xaa locations
RGRGRGFNSHXYASCPLCGFKRKAKDIEGKETRYAVTAEDIRRELKIKAFVVLESAPNLDIVVQRSLTERACPECNHPELEFYTKQLRSADEGQTIFYECPECGHAFNENT

SEQ ID NO: 2645 - protein, 219 aa, Neorickettsia sennetsu str. Miyayama
MMRASVTTITAFVLFFCGVCCSHASVVFLQSQEGVLSYPEHVSFNKIQQMKEKNANPVVGLEIGAGAEMLGEIEIELAADVVPRTAENFLQLCTGKNGFGYKGSIFHRIIPSFMIQGGDFTQGNGTGGHSIYNNDVFPDENFVIKHTGPGKVSMANRGPNTNGSQFFITTVETPWLDGKHVVFGQVIRGMSVVKKIESYGSSNGRPSRIIKILDCWQVS

SEQ ID NO: 2646 - protein, 421 aa, Glycine max
  misc_feature (42)..(42): Xaa can be any naturally occurring amino acid
  unsure (1)..(421): unsure at all Xaa locations
MDGTFDDESEPAVTIGEYLEEVEERELEADLVLGGDDGKECXTYNKGYMKRQAIFSCLTCTPDGNAGVCTACSLSCHDGHQIVELWTKRNFRCDCGNSKFGEFYCKIFPNKDVENVENSYNHNFKGSYCSCGRPYPDLDAEEQVEMIQCCLCEDWFHEEHLGLESSAEIPKDDEGEPTYEEFICKACSHVCFFLKLYPEKIWAAGKQPDATVQISKDKGVLEDMPSTCGSEKPTCNTSCSSPKVDDAQATVDSKSISDGKSLSQGENCNGSMASNQCTKSIDLHVNCLLGVNIITVNPVLPGKPMFLSKNWRDALCKCNNCLEFYKQKQIAFLLDKEDSIAEYEQMAKQKREEKLQQQEGAELSFFNKLGHVEKVEILKGIEEMKDGLRAFLESADSSKPITAADVHQFFDDIKNKRRRVQ

SEQ ID NO: 2647 - protein, 138 aa, Ashbya gossypii ATCC 10895
MFATYSASILRSTLPLRSVGVRLLSQETRRAIEGAISSAPVVLFMKGTPEFPQCGFSKAAIEILGRQGVDPAKFAAFNVLEDSELRSGIKEYSEWPTIPQLYVNKEFVGGCDILTNMAQSGELTTMLEEASVLVPDTE

SEQ ID NO: 2648 - protein, 678 aa, Gluconobacter oxydans 621H
MTLFRSLYHQGFARIAACTLPVTLADPLKNGERVLGVLHDCDRQGVAAVVFPELGLTGYTLDDLRFQDVVLEGAVEALRQVVAGSRDLLSVAVVGLPLVRGGLLYNCAAVVHRGRVLGVVPKSHLPRYREFYEPRHFTSGLQTSGTIRLFGEDVPFGADLLFQAEDMRGLTLGVEICEDLWVASPPSGKLAEAGATVILNPSASPVTIGRTDDRSLLCQAQSMRTLTAYAYAAAGEGESTTDLAWDGQVSVHEAGRLLAQSDRFPQGERLVVADVDLDLLRQERMRTGQFGQAGQEFRTVGFTLAPPTTDLGLKREVVRFPFVPSDARTLARDCYEGWTIQVSALRRRLQASGAQRAVIGVSGGLDSTLALLVAVRAADELGWPRTHVLAYTMPGFATGTESRSLAHALMEALGVEVNELDIRPTAQTMLAGIGHPFAEGQPVHDITFENVQAGLRTDFLFRIANYRNGIVIGTGDLSELALGWCTYGVGDQMSHYNVNAGMPKTLIQHVIRWLARDGKLGDGVVGAVLERIVNAEITPELVPDTGQGVQSTEQTIGPYPLQDFTLYHILRHGFRPSRIAFLAEVAWSDASRGTWPEHYPQDRKIAYNLGEIRHWLEVFLRRFFGTSQFKRSAMPNGPKLVSGGSLSPRGDWRAPSDGTATAWLAELCDNVPETNTHP

SEQ ID NO: 2649 - protein, 968 aa, Oryza sativa (indica cultivar-group)
MAPPENPNGAGPAAPSDPAQPQPQPPAKSKWKKKDEKKDDDLSEEDLALKEQLELYVVRAQDADPGVQKLALESMRQEIRSATSSMTSVPKPLKFLRPHYGTLKSYFETMPESSDLKRYMADILSVLALTMSAEGERESLKYRLLGSEGDIGSWGHEYVRNLAGEIAQEFQKRQDDDMPIDALMELVQQIVSFHMKHNAEPEAVDLLMEVEDLDLLVEHVDSTNYKRTCLYLTSSSKYLPAPDDMLALDIAYTIYMKFEDLTSALRIALLLDNKSMQYVKQVYTATEDLQLKKQFSFIIARHGLAMEIDDEIAADGNDKEGLQEIVNNSKLSEGYLTLARDIEVMEAKSPEDIYKVHLIDGRGASSSLDSARQNLAATFVNAFVNAGFGQDKLMTAPSDSSSSGASGNWLFKNKEHGKASAAASLGMILLWDTDSGLAQLDKYLHSNDAHVVAGALLGIGIVTCGVKNDCDPALAILMEYINKDDTNIRIGAILGLGIAYAGSQKEELKSYLSTVLGDSEKSTLEVLIFSAIALGLVFVGSCNEEIAQSIIFALMERSEAELAEPIIRLLPVALGLLYLGKQESVEATAEVSKTFDEKIRKYCDVTLMSLAYAGTGNVLKVQKLLGICSQHLEKGETHQGPAVLGIALIAMAEELGAEMAVRSLERLLQYGEQNIRRAVPLALGILCISNPKVNVIDTLSRLSHDADADVSMAAIISLGLIGAGTNNARIAGMLRNLSSYYYKEAAHLFCVRIAQGLVHLGKGLLTLSPYHSDRFLLSPMALGGLVTVLHACLDMKSTILGKYHYILYIIVLAMQPRMLLTVDEDLKPLSVPVRVGQAVDVVGQAGRPKTITGFQTHSTPVLLAAGERAELATEKYIPLTSVLEGFVILKKNPEYNEERGILGNHAATWDRIFAYWVPSSAPPGVNRIGLLSLLPESRVLEQSSLNSEILFGCAMTDVTYHLYPNMGI

SEQ ID NO: 2650 - protein, 598 aa, Ralstonia metallidurans CH34
MAAIEVKVPQLSESVSEATLMQWKKQAGEAVKRDEILVELETDKVTLEVPSPADGVLAKIVQPDGATVHTDDVIAVVDTEGKAVAAASPVAAAAPASAPAPAPAPAPVAAVASGGAGAPASAKADFDVIVIGSGPGGYIAAIRAAQLGKTVACIEEWKDDAGKPRLGGTCLNVGCIPSKALLASSEYFEQAKHGLAEHGVQVKGVTLDLAQMIQRKAAIVDKFTGGVEFLFRKNKVTWIKGHGKFKGRAADGVITVEASNGGETTSHTARNVIIATGSKARHLSGVPVDNKIVSDNEGALSFDSVPKKLAVIGAGVIGLELGSVWRRLGSEVTLLEALPTFLGALDEAVAREAAKQFGKQGLTIHLGVDIGNIEATAKGVSIAYKDKDGAEQKLVADRLIVSIGRVPNTDNLGLDAVGLAADARGFIPVDDQCRTPVAGIYAIGDVVRGPMLAHKAEDEGVMAAEVIDGQKPHIDYNCIPWVIYTEPEIAWVGKSEAQLKAEGREFRSGQFPMMANGRALGIGHPDGFIKMIADAKTDEILGVHIISANASDLIAEAVVAMEFKAASEDIGMICHPHPSLSEVMREAALAVRKRALNM

SEQ ID NO: 2651 - protein, 341 aa, Oryza sativa (japonica cultivar-group)
MGERRSGYRDRGGGEQGRYWRPPRSHGNGNFSVPLWEKKFCTDACAIPWGKLCETKKLMSLYKNVVDWDDSAALETFNDAKARFCAVYHGQPCDIPLPDPNMYIDMVNQDEHVDPELVADLEKSRRSYPKRDNTAPDGWDSFIFTNKPVPATGWGDGETSNTPGQQYPTNWNNHVKQPTEANCMQSSVNWDNYVSQPPQATVQQSSGNWDMYVKQQDQANNWEAPTMPGTWDMKGDSLDAWKRDSGWGSAAIDSWDNHRENCYVPDSQGWSYGHWKRRNNESSRRNSRGRDRVGPISSKAMKPKYHSEERNGANNGWRHCRVRNNMQYSYENPGCNQSLAM

SEQ ID NO: 2652 - protein, 121 aa, Acinetobacter sp. ADP1
MRLVEDLSMTEQARDTEALIRDQIAKHAVLLYMKGTPQFPQCGFSARAVEALSQIGRPFAYVNILENPDIRATLPAIANWPTFPQLWVNGELIGGSDIMLEMFQNGELKPLVEQYSAAPDA

SEQ ID NO: 2653 - protein, 119 aa, Brassica napus
MEKSRESGFLFCNLCGTMLMLKSNKYAECPLCKTTRNAKEIVDKQIAYTVSDEDIRRELGISLFGEKTQEDTELPKIKKACEKCQHPELVYTTRQTRSADEGQTTYYTCPNCGHRFTEG

SEQ ID NO: 2654 - protein, 246 aa, Oryza sativa (japonica cultivar-group)
MSCEFFLPSPVAARGRWWWWGVCVWFISLFCRASEFLRDYDGAVIQMRMAYSAVAHFLVQWIDCKLAGALGLLKIMIYKVYADGTTALPEWEREASIRQFYGVIFPSLLQLPSGITELDDRKQRRLCLQKFRKVEERVSEVDLERELECGICLEVNAKIVLPDCAHSLCMRCFEDWNTKSKSCPFCRACLKKVNPSSLWLYTDDRDVVDMDTLTRENIRRLFMFISKLPLVVLHVVDLDIYEYRIK

SEQ ID NO: 2655 - protein, 113 aa, Mycobacterium smegmatis str. MC2 155
MNTLDFVDQASLRDDIPTFSPGDTVNVHVKVIEGSKERIQVFKGVVIRRQGGGISETFTVRKESYGVGVERTFPVHSPNIDHIDVLTRGDVRRAKLYYLRELRGKKAKIKEKR

SEQ ID NO: 2656 - protein, 648 aa, Mycoplasma genitalium G37
MKYLYATQHLTLNAIKHAKGGHVGMAIGASPILFSLFTKHFHFDPDQPKWINRDRFVLSAGHGSMALYSIFHFAGLISKQEILQHKHGQINTSSHPEYAPNNFIDASTGPLGQGFGMAVGMVLAQKLLANEFKELSDKLFDHYTYVVVGDGDLQEGVSYEVSQIAGLYKLNKLIVLHDSNRVQMDSEVKKVANENLKVRFENVGWNYIHTDDQLENIDQAIIKAKQSDKPTFIEVRTTIAKNTHLEDQYGGHWFIPNEVDFQLFEKRTNTNFNFFNYPDSIYHWFKQTVIERQKQIKEDYNNLLISLKDKPLFKKFTNWIDSDFQALYLNQLDEKKVAKKDSATRNYLKDFLNQINNPNSNLYCLNADVSRSCFIKIGDDNLHENPCSRNIQIGIREFAMATIMNGMALHGGIKVMGGTFLAFADYSKPAIRLGALMNLPVFYVYTHDSYQVGGDGPTHQPYDQLPMLRAIENVCVFRPCDEKETCAGFNYGLLSQDQTTVLVLTRQPLKSIDNTDSLKTLKGGYILLDRKQPDLIIAASGSEVQLAIEFEKVLTKQNVKVRILSVPNITLLLKQDEKYLKSLFDANSSLITIEASSSYEWFCFKKYVKNHAHLGAFSFGESDDGDKVYQQKGFNLERLMKIFTSLRN

SEQ ID NO: 2657 - protein, 334 aa, Mycoplasma hyopneumoniae 232
MANSDKIALNNIGAVTNALDLMMEKDSRVVLWGEDAGFEGGVFRATEGLQKKYGIERVWDSPIAEASICGVGVGAAIAGLRPVVEMQFQGFSYPAFQQLFVHAARYRNRSRSRFSVPMVMRMPMAGGVRALEHHSEAIEALFAHIPGLKVVMPSTPYDTKGLLIAAINDPDPVVFLEPKKIYRAFKQEVPAGIYEVPIGKANVIKEGSDLTLVTYGAQVHEAIAAIQQLPNTKGLEEVDVELIDLRTIKPLDTETIIESVKKTGRILIVHEAVKSFSVSAEIISRVNEKAFEYLESAPARLTGYDITVPLAKGENFHSITKEKIIDKIRKIMES

SEQ ID NO: 2658 - protein, 579 aa, Arabidopsis thaliana
MCGILAVLGCIDNSQAKRSRIIELSRRLRHRGPDWSGLHCYEDCYLAHERLAIIDPTSGDQPLYNEDKTVAVTVNGEIYNHKILREKLKSHQFRTGSDCEVIAHLYEEHGEEFIDMLDGMFAFVLLDTRDKSFIAARDAIGITPLYIGWGLDGSVWFASEMKALSDDCEQFMSFPPGHIYSSKQGGLRRWYNPPWYNEQVPSTPYDPLVLRNAFEKAVIKRLMTDVPFGVLLSGGLDSSLVAAVALRHLEKSEAARQWGSQLHTFCIGLQGSPDLKAGREVADYLGTRHHEFQFTVQDGIDAIEEVIYHIETYDVTTIRASTPMFLMSRKIKSLGVKMVLSGEGSDEILGGYLYFHKAPNKKEFHEETCRKIKALHQFDCLRANKSTSAWGVEARVPFLDKEFLNVAMSIDPEWKLIKPDLGRIEKWVLRNAFDDEERPYLPKHILYRQKEQFSDGVGYSWIDGLKDHANKHVSDTMLSNASFVFPDNTPLTKEAYYYRTIFEKFFPKQSAARATVPGGPSIACSTAKAVEWDATWSKNLDPSGRAALGVHVAAYEEDKAAAAAKAGSDLVDPLPKNGT

SEQ ID NO: 2659 - protein, 171 aa, Mycoplasma hyopneumoniae 232
MQINLEKYIRTVEDFPKKGISFKDISPLLADGKALNYTIVEMASLAKDVDIIVGPDARGFLFGTPTAAFLSKPFIMIRKAGKLPGEVEEFAYELEYGSAILEVQVDMIKPGQKVAIIDDVLATGGTVKAITKMIERAGAIVDKIIFLIELEQLQGRKKLENYDVISLIKIS

SEQ ID NO: 2660 - protein, 128 aa, Photorhabdus luminescens subsp. laumondii TTO1
MSYEINTNKAPAAIGPYVQGVDLGNMVITSGQIPVNPETGDVAEDIAAQARQSLENVKAIVERAGLTVGDIVKTTVFVKDLNDFGTVNATYEAFFKEHNASFPARSCVEVARLPKDVKIEIEAIAIRK

SEQ ID NO: 2661 - protein, 242 aa, Mycoplasma hyopneumoniae 232
MKKIIIGNWKMNKTVSETRDFIQKFDIFYQENVGKIKEDLDFAIAPSFISLSLISKSLTKKLEIAAQNLSQFDSGAFTGEISGKMLQDLGTKYVIIGHSERREIFKEKDEELKNKILQAQKYDLIPVFCVGESLLEFEAGLTKKVIISQINAIKSVLNFQKAIIAYEPIWAIGTGKTATAAIAEKVCGLIKENFGKNTMVIYGGSVNSKNINELVSQKSIDGALVGGASLDPEEFGKILVNS

SEQ ID NO: 2662 - protein, 608 aa, Malus x domestica
  misc_feature (381)..(381): Xaa can be any naturally occurring amino acid
  unsure (1)..(608): unsure at all Xaa locations
MDVRRRSTMDTPATKARSGPMKVKVVDHEGDVGVVGAKASDALPLPLYLTNAVFFTLFFSVVYFLLTRWREKIRTSTPLHVVNLSEIVAILAFVASFIYLLGFFGIDFVQSLILRPSNDVWAADDDEEEHERLILKDDARKVPCGAGLDCSPIPQIAPVAAAAPKAVAQKVFDKEVVLSTPCDFTAQPLTEEDEEVVKSVVAGTIPSYSLESKLGDCRRAAAIRREAPQRITGKSLGGLPLEGFDYESILGQCCEMPVGYVQIPVGIAGPLMLDGREFSVPMATTEGCLVASTNRGFKAINLSGGATNVLLKDGMTRAPCVRFNSAKRAAELKFYLEEPKNYDTLPTVFNRSSRFGRLQTIKCAIAGKNLYMRFTCSTGDXMGMNMVSKGVQNVLDFLQNDFPDMDVIGISGNYCSDKKPAAVNWIEGRGKSVVCEAVIKGDVVQKVLKTNVASLCELNMLKNLTGSAMAGALGGFNAHASNIVSAIYIATGQDPAQNVESSHCITMMEPINDGQDLHVSVTMPSIEVGTVGGGTQLASQSACLNLLGVKGANREAPGSNARLLATVVAGSVLAGELSLMSAISAGQLVNSHMKYNRSSKDVSAVASA

SEQ ID NO: 2663 - protein, 634 aa, Ustilago maydis 521
MCGILGCIHHPDAPAYRGKMLNMSRCIRHRGPDWSGCVVTQEEGSKGSILCHERLAIVGISTGAQPLVSTDGKLILAVNGEIYNHRQLRKNLKDQNAEFKTESDCEVILHLYREHGSDFVKMLDGMFSFILLDTTTTPHRVIAARDPIGITTLYQGASYKYPGAIYFSSELKAIHEECDRIRSFPPGHFYDSSLPEGKETVRYYTPSWLDGDAEGATIPTNPTDLKQIREALEKAVRKRLMSEVPYGVLLSGGLDSSLIASIAARETDKMADLQRKQWEERQARRSRGLTTPAGDANGAKLPVGLDEDADNEVENLAAWPRLHSFSIGLPGSPDLIAARKAAQFLGTVHHEYTFTVQEGLDAIADVIFHLETYDVTTVRASTPMYLLSRKIKAMGVKMVLSGEGSDEIFGGYLYFHAAPDKTSFHQECVRRVKNLHTADCLRANKSTMAWGLEARVPFLDKAFLDVAMNTDAADKMFSKGSLQQVDADGRPRMEKYILRKAFDVIPDDIEAGGDGSGSMLSASAPRKPYLPEDILWRQKEQFSDGVGYSWIDGIKDHAEKTVSDEKFQERAKRYPNDTPDTKEAYMIREIFESWFPSEAAASTAVRWIPRADWGCAADPSGRAVNIHESAYSTE

SEQ ID NO: 2664 - protein, 295 aa, Ashbya gossypii ATCC 10895
MSDLTNYKRLEKVGEGTYGVVYKAVDLRHGQRIVALKKIRLESEDEGVPSTAIREISLLKELKDDNIVRLYDIVHSDAHKLYLVFEFLELDLKRYMESVPKDQPLGDKIIKKFMMQLCKGIAYCHAHRIIHRDLKPQNLLINRNGNLKLGDFGLARAFGVPLRAYTHEIVTLWYRAPEVLLGGKQYSTGVDVWSIGCIFAEMCNRKPLFSGDSEIDQIFKIFRLLGTPNESVWPDIVYLPDFKPTFPKWQRRDLAQVVPSLNEHGLDLLDKLVTYDPIHRISAKRAVTHPYFKDE

SEQ ID NO: 2665 - protein, 351 aa, Ashbya gossypii ATCC 10895
MGSLSDISFFDHLQELARRDCCVNALLWCAFTVGAVKLTTFMLSLISIALETTVLPSASYKKYGARKGAYALVTGASDGIGKEFALQLASKGFNVLLVSRTEAKLLELKQEIMAKYKVDARVLSVDFGVDNRLTYTAISELCGELPVTVLVNNVGVSHSIPVSFLETTEEELRGIITVNNTATLMVTQTVAPLVIANARRLQCRGLVLTMGSFDGLLPTPLLATYSGSKDFVQAWSTALVVDLAPLNVDVQIVLSYLVTSAMSKVRRASALIATPRAFVRSTLASLGHRVGAQERYATCTPYWSHALYHFLIENTVGVHSRLANAINYRFHADIRKRALRKAARKAAEKQE

SEQ ID NO: 2666 - protein, 346 aa, Polaromonas sp. JS666
MKAAVLRAPKVLQLSDIATPEAAPGELVLRVRAAMVCGTDLRILTGRKTKGVRFPSVIGHEFAGEVVQVGDGVTQFKTGDRVCMDPVIPCRACAYCKTGHENVCLHRQAMGYEFDGAFAEYIRIPAIALTAGNVFMMPAQMSFESAALAEPLACCINGQRNAGVQVGDTVVVLGAGPIGLMHAALARLSGARQVIVSEPNAARRQAAVDRGVEHMCDPSTESVMEFVKARTDGLGADVVILAIGVPQLANESLNLVRKGGHVNLFAGFSAGETSNIDVNLIHYNEIVVTGASALRRRDYELALNMLSAGQIDANSLITHRYEVADSLAAFDEAGSGRALKVAIHNV

SEQ ID NO: 2667 - protein, 397 aa, Candida albicans SC5314
MRGIKGLVWEGSVLDPIEGIRFRGRTIPDIQKELPKAPGGEEPLPEALFWLLLTGEVPTDAQTKALSEEFAARSALPKHVEELIDRSPSHLHPMAQFSIAVTALESESQFAQAYAKGANKSEYWKYTYEDSIDLLAKLPTIAAKIYRNVFHDGKLPAAIDSKLDYGANLASLLGFGDNKEFVELMRLYLTIHSDHEGGNVSAHTTHLVGSALSSPFLSLAAGLNGLAGPLHGRANQEVLEWLFKLREELNGDYSKEAIEKYLWETLNSGRVVPGYGHAVLRKTDPRYTAQREFALKHMPDYELFKLVSNIYEVAPGVLTKHGKTKNPWPNVDSHSGVLLQYYGLTEQSFYTVLFGVSRAFGVLPQLILDRGIGMPIERPKSFSTEKYIELVKNINKA

SEQ ID NO: 2668 - protein, 189 aa, Ashbya gossypii ATCC 10895
MAEIAGNLQRILQSLDRQQFAGNKYLQEFERKTGFPKSYAIAGAGVAYLFIIFINVGGVGEILSNFLGFVLPCYYSLHAIKTTTTADDTELLTYWIVFAFFSVIEFWSKAILYWVPFYWFFKTIFLIFIALPQLGGASLIYHRVIAPLTDPYIAAGSQRKASGISSKMEQAAKGASARATGAASHQSSD

SEQ ID NO: 2669 - protein, 506 aa, Perilla frutescens var. crispa
MALYAALFLLSAAVVRSVLDRKRGRPPYPPGPFPLPIIGHLHLLGPRLHQTFHDLSQRYGPLMQLRLGSIRCVIAASPELAKECLKTHELVFSSRKHSTAIDIVTYDSSFAFSPYGPYWKFIKKLCTYELLGARNLAHFQPIRTLEVKSFLQILMRKGESGESFNVTEELVKLTSNVISHMMLSIRCSETESEAEAARTVIREVTQIFGEFDVSDIIWLCKNFDFQGIRKRSEDIQRRYDALLEKIITDREKQRRTHGGGGGGGEAKDFLDMFLDIMESGKAEVKFTREHLKALILDFFTAGTDTTAIVCEWAIAEVINNPNVLKKAQEEIANIVGFDRILQESDAPNLPYLQALIKETFRLHPPIPMLARKSISDCVIDGYMIPANTLLFVNLWSMGRNPKIWDYPTAFQPERFLEKEKAAIDVKGQHFELLPFGTGRRGCPGMLLAIQEVVIIIGTMIQCFDWKLPDGSGHVDMAERPGLTAPRETDLFCRVVPRVDPLVVSTQ

SEQ ID NO: 2670 - protein, 613 aa, Candida albicans SC5314
MSIKPLSITVPHPSTQRGHATHISYDPVNERLAYVNGKSVIIRPVDFKSTSPTVVFSKHIFPTTAVRFSPSGYYVASGDEAGNIKIWDASPKSEPDFEQPVIKSEFQVMSGPIRSIAWDADNSRIIAVGQGKEKFGHAFSWDSGNSIGDIQGHSSPINAVDIKPQRPYRAATVGDDHALVFFTGPPFKFDKSLRGNHNNVVRDVKFSPDGEYIVSVGSDRVIAIYQGKTGEFVKKIEKAHEGGIFAVAWLPDSKHFITASADNTLKKWTLDGENTQKFEISSTTSVGNQQVGLALTKEFVVSLSGNGNLNYFDHEGNLVQIVQGHQSPITKVEFHDGFLLSGGSDGKLFKWEVGTDGPKALPVLQDDDEHSNYVVDILTVDDVTYTTGWDDTLKSWRDGKVVSSVKLPSQPKQLGSIKGAVFVLFESALQLYTEVNFQLIAETKFDFTATYAAPTNDTHILITNTTSNTVEEFQVGNGEIRKTSKEFPKSRSPPTFITVSPSREFFAVADSAGKYTLFNTSDGTVVSTRWAFHNSKVFDAKWTSDSKYLISGGLDSSLLLYSVEKPSRVVKYLLAHPSGISSIDWVAYDSEKKTGTFVSAGLDATIRSWNISI

SEQ ID NO: 2671 - protein, 523 aa, Perilla frutescens var. crispa
MISAAVSLIICTSILGVLVYFLFLRRGGGSNGRPLPPGPRPWPIVGNLPQLGPKPHQSMAALARVHGPLMHLKMGFVHVVVAASATVAEKFLKVHDTNFLSRPPNSGAEHIAYNYNDLVFAPHGPRWRLLRKICALHLFSSKALDDFRHVREEEVGILIRNLASVGEMPASIGQMMYVCATNAISRVMLGRHVLGDEHRGAAGGGDTTAEEFKAMVVELMALAGVFNVGDFIPPLKGLDLQGVVAKMKKLHQRFDAFFSGILHDHKINGSNAAEGHVDLLTTLISLKDVDNNGEGGKLTDTEIKALLLNLFTAGTDTTSSTVEWAITELIRNPNILARVRKELDLIVGKDKLVKESDLGQLTYLQAVIKENFRLHPSTPLSLPRVAQESCEINGYYIPKDSTLLVNVWAIGRDPNVWPDPLEFRPERFLMGGEKPNVDVRGNDFELIPFGSGRRICAGMNLGIRMVQLLIATMVHAFDFELANGQLAKDLNMEEAYGITLQRADPLVVHPRPRLARHVYQAQV

SEQ ID NO: 2672 - protein, 1466 aa, Emericella nidulans
MGVPDELPPGSSETDTIVSSSQPTNRSPMDLISEAESLNLRRIATNQSKAQCRPGSAAVPSHDNPPNDDLEDATLDPNSASFSLEKWLRAAVSDASQQGLSTPSGGIPLQKSDRPRAQTAALQLQPTVGSVLTAPLRSRVCCDTGEYEPRRILHGFDGVMKTGELLLVLGRPGTGCSTFLKAVCGETNGLHIDADSVLHYNGVSQQRMMKEFKGEVVYNQEVDKHFPHLTVRQTLEFGAAARTPAHRFQNMSRDEFASYAASVVMAIFGLSHTHNTKVGNDFVRGVSGGERKRVSIAEMALAMTPFAAWDNSSRGLDSATALKFVQALRLSADLAGAAHAVAIYQASQSIYEVFDKVTVLYEGRMIFFGPTGTAKEYFERMGWVCPARQTTGDFLTSITNPLERKARAGMEDVVPKTPKDFEIYWRQSPEYKTLLGEMTGVRDQHPTGNDEQASAELRARKENSQSRNSRAASPYILSIPMQIKLNTKRAYQRIWNDMSSTMSTVVGQIVIALITGVVFYDSPNTTAGFQSKGGTLFYAVLLNALTAMSEITSLYSQRPIVEKQASYAFYHPATEAIAGVVSDVPVKFLLAVAFNVIMYFLANLRREPAQFFIYFLMSFTVMFVMSAVFRTMAAVTKNAAQAMGLAGVLMLALVVYTGYVLPVPSMHPWFEWIHYLNPIYYAFEAMIANEFHGRDFDCIAFVPSMQIWTGDSFSCSSLGSVAGERMVSGDSYINFNYTYTYSHVWRNFGVLLAFLIGFMAIYFLASELNSSTTSTAEALVFRRGHVPEYMRPGYTRPTDEEKAVTQSDIKPSSPSPTNPILPLPPQRDIFTWKDISYDIEIKGEPRRLLDDVSGWVKPGTLTALMGVSGAGKTTLLDVLAHRTTMGVITGDMFVNGKGLDASFQRKTGYVQQQDLHLETATVRESLRFSALLRQPASVSIREKHDYVESVIEMLGMGDFCRACCGTPGEGLNVEQRKLLTIGVELPPSPKLLLFLDEPTSGLDSQSSWAICTFLRKLADSGQAVLCTIHQPSAILFQEFDQLLFLAKGGKTVYFGPIGPNSRTLLDYFESNGARKCDEAENPAEYMIEVVNAEVNDHGTDWFDVWKGSKECQAVKEEIERIHEKKRGTAGAIEETDDGSTKSEFADAILVPAVCRHVRVFQQYWRMPEYIISKGALAIVAGLFIGFSFYDAKTSLAGLQTLVFSLFMVCALFAPLVNQIMPLFITQRSLYEVRERPSKAIPGKLPDCNILVEIPYQVLMGILTFVCYYYPLSVPAKDQTERALVLLFCIQFYVYASTFAHMCIAAMPNAETASPIVILLFSMCLTFCGVMQPPDALPGFWIFMYRVSPFTYWVAGMATTQVHGREVVCGENELSIFDPPTNQTCGQYMERYISVAGGQVLNPSATAGCEYCSLTVADEYLAASQIYWSDRWRNFGLIWVYIGFNIFVATAVYYLFRVKKWNGRRKK

SEQ ID NO: 2673 - protein, 1426 aa, Emericella nidulans
MSTLTVGDTALPRESRETMVSIQGIRIVNYSSRRGFRFHNKIQMSAVPMAGLLMPQVKEQNEREAESGFKRRELGVTWQNLSVEVVSADAAVQENFLSQFNVPKLARESRNKPPLRTILDNSHGCVKPGEMLLVLGRPGSGCTTLLKMLANQRLGYKAVQGDVRYGSMTAKEAEQYRGQIVMNTQEELFFPSLTVGETMDFATRLKVPNRLPNGVESPEAYREEYKKFLLQSMGISHTVDTKVGNEFIRGVSGGERKRVSIIECLGTRASVFCWDNSTRGLDASTALEWTKTIRTMTDVLGLSTIVTLYQAGNGIYDLFDKVLVLDEAKQIYYGPMTQARPYMETLDFVCREGSNVADFLTGVTVPTERKIRSGFEARFPRNADAMLEEYNKSAVKADMISEYDYPDSEYAKLRTEDFKQAIAEEKAKQLPKSSPFTVDFMNQVKICVTRQYQILWGDKATFIIKQVSTLIQALIAGSLFYDAPNNSGGLFVKSGALFFSLLYNSLLAMAEVTESFQGRPVLIKHKSFAFFHPAAFCIAQIAADIPVLIFQVTIFALPVYFMVGLEMDAGVFFTYWILVFATTMAMTAVFRACGAAFKTFDDASKVSGFLISALIMYTGYMIRKPEMHPWFVWIYWIDPLAYGFDALLSNEFHGKIIPCVGTNLVPAGPGYENATTQSCTGVGGSIPGRNYVTGDDYLASLSYSHGHVWRNFGILWAWWALFVVVTIIATSRWKGASENGPSLLIPRESVEKHRQHGHRDEESQSNEKTSTKGKSEGVQDSSDIDNQLVRNTSVFTWKDLCYTVKTPSGDRQLLDHVYGWVKPGMLGALMGSSGAGKTTLLDVLAQRKTAGTIQGSVLVDGRPLPVSFQRSAGYCEQFDVHEPYATVREALEFSALLRQPRTTPREEKLKYVDVIIDLLELHDIADTLIGRVGAGLSVEQRKRVTIGVELVSKPSILIFLDEPTSGLDGQSAYNTVRFLRKLADVGQAVLVTIHQPSAQLFGEFDSLLLLAKGGKMVYFGDIGDNGSTVKEYFGRHGAPCPPNANPGEHMIDVVSGSLSQGRDWHEVWKASPEHTNAQKELDRIISEAGSKPPGTVDDGHEFAMPLWQQTVIVTKRTCLGVYRNTDYVNNKLALHIGSALFNGFSFWKMGASVGELQFKLFVLFNFIFAAPGGIGQVQALFIERRDIYDAREKKSRIFSWVGFVTGLIVSELPYLVLCAVLYFVCFYYQTGLPTSSDKAGAVFFVMLLYEGLYTGIGQFISAYAPNAVFATLTNPLVIGTLVSFCGVLVPYGQIQEFWRYWIYWLNPFNYLMGSLLTFTIFDVDIKCRESEFATFDPPNGSSCIDYLSTIFKGWGVSANLINPDATSQCQVCQYTRGSDYLYSLNLKDYYYGWRDTAIVALFVLSSYALVYGLMKLRTKASKKAEE

SEQ ID NO: 2674 - protein, 291 aa, Gluconobacter oxydans 621H
MPADPRTRYPRPPFRGQTQKFPGLSEKMIPRPDYGEETYKGSGKLAGLAALITGGDSGIGRAVALAFAREGADVAISYLETEADDARDIGEQIKAEGRNCLLLPGDIRDGAHCREMISRTVETFGRLDILVNNAAFQKARAKLEEISDEEWKRHFSTNTDALFHLTKAALPHLQAGASIINTSSVNLKTAPELLVPYSMTKAAIANFTSSMAQQLAGRGIRVNAVMPGPIWTPFIATGMPEEEQEHLGSDVPLGRPGQPAELAGAYVYFADPLNSYTTGALLAVNGGVPMI

SEQ ID NO: 2675 - protein, 214 aa, Brassica napus
SGSWTVDPIPLTGHTASVEDIQWSPAEANVFASCSVDGTIALWDVRVGKTPALSFKAHNADVNVISWNRLASCMLASGSDDGAFSIHDLRVIKEGDAKVAHFEYHKHPITSIEWSAHESSTLAVSSGDNQLTIWDLSLEKDEEEEAEFKAQTKEQVNTPQDLPPQLLFVHQGQKDLKELHWHNQIPGMIISTAADGFNILMPYNIQNTLPDLAP

SEQ ID NO: 2676 - protein, 892 aa, Methanosarcina barkeri str. Fusaro
MTNERVVQLISVAKEKNLTNLNLSGNQLTQVPQEIGELKNLTMLDLSENTLTILPQEIGELKNLKTLDLSGNQLIQLPSEIGRLKNLTILNLYDNQLTQLPPEIKELKNLTALTLFNNKLTQIPPEIGKLKNLETLYIYCNQLTQLPPEIGELKNLSILALNKNKLTQLPSEIGNLKNLETLSLYRNQLIELPPEIGKLENLKTLYIDNNKLTILPPEISELKNLITLNLSANPLTSPPPEIVSRGLEAIFTYLNQSKTTENNEAKLVLVGNGEVGKTCLAYRLIYDNFLEDSKITEGINISKWKIPAPDSGNSEIKLNIWDFGGQEIYHATHQFFLTKRSLYLLLWNARKTKDYDNIYYWLHTIEAFGEDSPVILVMSKMNESNDDLNLKDLKNKFPQIVDYLKIDSKDGKGISILKEKISETAWDLPLMKAKWVDSWFKVRQKLEDLNENWINYYRFYDICKSEGLDEKNITVLDDYLNDLGVTLHFKDRLTLKNIVILKPEWATGAFYKILSTKSVLDNEGALPQSELSQIWNTKTYPPSVHPQLMELMNKFELSYELPDKSNYLIPELLPKNEPDNFEWNKEDDLCFYYCYDYFLPSGIITRFIVRMHENLVIKENGMPLCWREGAVLKFQNSSALVKMKPDERQIEIRIKGNNKRWVLGAICSHLDEINASIKKIKVSKQIPCNCSENCPQRYLYEDLLKAEVANLGNLICYKSFKSVPVSLLLDGYSRKEERLREYDYELYGNRPIFVITQKAEAQSKSLSTIKAEQRTNISVDVNIDLKIDLPEIQKEFNKLKKEIKTLNPELGSELDEIQDSLDEVSANSDTDKLNKPLNKVRRILEELNDPDSDYNKVIKGTEKGIEYAQKLGRTYNKFAPWIGIPKVPDPLL

SEQ ID NO: 2677 - protein, 248 aa, Zea mays
MTTLHMDPPAPPARRSVSTSCDLHPGEAFTGFCAACLRERLQGLEASAAAASAPGRKSTSAIRSLFARPFAAGSSSASGPAEPPDLRRCKSFSCGHGGDALAASVFSKKWQKWRRKQKLKKEAAVSKAAAAAMPPPEKPSKPSFLRRSRLRGEAGSELADGRRSCDTDPRFSLDAARMSIDDAGFSWDEPRASWDGYLFGGGAGIGLGRAPPPLSRLPPILSVLEDTPTDVVERSDGQIPVKDDFHPD

SEQ ID NO: 2678 - protein, 325 aa, Mycobacterium sp. MCS
MIDAVLARELLSGMVRVRRMEEECAKLYGDGKIRGFLHLYVGEEAVAAGSLRALRPDDAVVGTYREHAHALLRGVPMTSIMAEMFGKQEGCSGGRGGSMHLFDAGTRFYGGNAIVGGGLPLATGLALADAQQRRRRITACFFGDGAVAEGVFHESLNMAALWRLPVLFCCENNLYAMGTALERAQSQTDLAAKAASYKVPTATVDGMDVLACHTATVQAADHIRDTGGPFFIEFRTYRFRAHSMFDPELYRDKAEVDVWRTRDPITTFTDRCANEGVLDAQCVREIEQAAENEVQEAVSFAEAGTWEDIGDLERDVLTPAPRSIR

SEQ ID NO: 2679 - protein, 325 aa, Mycobacterium sp. MCS
MKTSYRAAVHDALRDALRDDDRVLLMGEDVGRYGGTYAASKGLLEEFGPERVRDTPLSELGFVGVGIGAALGGLRPIIEIMTVNFSLLALDQIVNTAAALRHMSGGQFSVPIVVRMATGAGRQLAAQHSHSLECWYAHIPGIKVVAPATVEDAYGMMTTALADPDPVIVFEHVALYNSSADGTTLHATDIRHAAVRRSGSDVTLITYGGSLPKTLDAADQLALAGIDCEVIDLRVLRPLDTATFVESVRRTHRAVVVDEAWKTGSLAAEISAQIVENAFYDLDAPVARVCGAEVPVPYAKHLEQAALPQAGQIATAVRDLCGGPA

SEQ ID NO: 2680 - protein, 833 aa, Photorhabdus luminescens subsp. laumondii TTO1
MLQKNLQSYVCDVSDNTTAHTENCARSSILELSHDTFSLKHQEATQVELLPRRHLYTYTEKARQKRLDYLAKHTGHTLKHVADTHLDATQLTKTIEGFIGSIEIPVGIAGPILIKGQYAQGVYYAPLATTEGALIASISRGSSAIMQSGGTTARVLGQRMIRAPRFEFCSVSHSIMFSDWINEHISELRYEIGRHSKHAQLVEVKPQIIGRSVHLQFIYNTAAAAGQNMTTICTWYACQWIQQQLAKMAFIPLRHFIIDGNTSGDKKVSYQSFIEGRGTRVVAEVYLEAESCQQILRVTPQQLVTAYHHVCEGAIASGMVGININAANVIAGMFTALGQDIACVHESSVAHLHMTLTADNRVYCSITLPSLIVGTIGGGTNLPHQRECLNMLGCTDENGTARLAEIIASYCLALDISTLSAVAADEFAQSHEKLGRYRPVTTNNITAHTPQELDLPFFQQANFNPVLQGAHLTTIKPKFSGDDGYSMLTHLSSNYAERLIGLFPFSMTTSAQNNLSVMLKLKPLGSEVVNMVLDIAKHCSSELFAVFQDFEHQLEFNQSHSRELAIMNQQDPRLMRYIPVIYGVIENEATGTYALIEELLHDMVLMNNINLETPWEQHHLEAAIRGVADIHSIWLGREEELTWKFSQLQIPNADTVSQMNPLWQKLGNFIHQTFPELFTAEQHEDFQHWVDNAATWWKEIEQMPRTLIHGDFNPRNIAFRQQETGLHLCAWDWELSTLHLPQRDLAELLAFSLDPQSDADKVAYYIELHRVELEQKSGLSLDPIIWRRGYELALHDLWMRRIPFYMMAHNVVGYPFMERTMKTLRWLISLTRN

SEQ ID NO: 2681 - protein, 738 aa, Legionella pneumophila str. Lens
MQQEDQAQIPQNSRSFSRNTARCFDTFMDTVDFLARIGWPVIDLAFRIWIAQQLLVSAILLTNHWDTAVYLAKNEYPVPWLSPEWEALLGILAQFVGGIFLLFGLFTRCGAAVIIGFAVMTQVYYQPIDLNLLWIALMLGYILRGPGPLSLDNLFEHGFSRSPLPFAMLIVTFVDRTREFFSSLYLFSLRMWLMISLLLINQHIQLISSDALPLLMPWLPLNSASIVFNNVSLFMAIFLGLGLATRVVAIFGLIVVLLSFTPGVTGFYLYWMMVMAILFISGPGILSLDHLIFHALKKHYPQLSGKPAFSLDGLPRVVIIGAGFGGISCAKALRHMPVKITLIDRHNYHLFQPFLYQIATGSLSPADIAISIRSIFLEQFNAEILLGNVTDINKEERLVIADNFTIPYDYLVIATGATHSYFGKDSWTPYAPGLKTINDGTSVRSRIIKSFELAEIAESEEERKQFLNFVIVGAGPTGVELAGALVELARFGIVKEFRHFDPASANIILVQAAPRILPTFSEQISQKAQHYLESMGVKVLVNSMVEQIDSDGVIINKERIYSKSVFWAAGVAASPASKWLQLEADPAGRVKVNDDLTVAGYSNIFVIGDTAASNAWNGKPVPGIAPAAKQGGAYVAKVISKRIYNNNSRYKPFKYIHYGSLATVGRKAAVAEFDRFKISGELAWWFWGGVHVFFLVGSRNRLSVILNWLWSYYTFRANNLLITDDSLNKKNKSGTSEV

SEQ ID NO: 2682 - protein, 130 aa, Arabidopsis thaliana
  misc_feature (119)..(119): Xaa can be any naturally occurring amino acid
  unsure (1)..(130): unsure at all Xaa locations
SCVSDQCRFVFYTGLKLISVERSFAEKHYEDLSSKSFFSGLVDYIVSGPVVAMIWEGKNVVLTGRKIIGATNPAASEPGTIRGDFAIDIGRNVIHGSDSVESARKEIALWFPDGPVNWXQSSVHPWVYET

SEQ ID NO: 2683 - protein, 375 aa, Ashbya gossypii ATCC 10895
MYGARAGNENSGAGAAGSRAGRRGSGGSGGPRVALGDVTAQVNNRGPRAGGKDARAGKPQGDAAVQGGENVEETVRAVGPVWDAAAEAAVAAAAAEYGGAPDPADEDTWDAVMVAEYAPEIFAYLRGLEVRFAPAADYMRGQPELRWEYRATLVDWLVQVHCRFQLLPETLYLTVNIIDRFLSRKTVTLNRFQLVGAAALFIASKYEEINCPTLRELLYMLDNAYTADEVLKAERYMIDTLEFEFGWPGPMSFLRRVSKADNYEYDIRTLAKYLLETTIMDPRLVAAPPSWLAAGAYYLSRIIIGYNTWTRQHVFYSGYTAEQLVSLATVILENCRHAETRHQAIFEKYSKSRHRRSAQVVARWIAMAEENLQPA

SEQ ID NO: 2684 - protein, 622 aa, Oryza sativa (japonica cultivar-group)
MGSVAMDSDYGVPRELSALQKARALYRPDLPPCLQGTTVKVEYGDAAIAADVAGAHVISHAFPHTYGQPLAHFLRKTAAVPDATVITEHPVVRVGVVFSGRQSPGGHNVIWGLHDAIKAHNANSKLIGFLGGTDGLFAQKTLEISDEVLSSYKNQGGYDLLGRTRDQIRTTEQVNAAMTACQALKLDALVIIGGVTSNTDAAQLAETFAESKCSTKVVGVPVTLNGDLKNQFVETTVGFDTICKVNSQLISNVCTDALSAEKYYYFVRLMGRKASHVALECALQSHPNMVILGEEVAASKLTIFDITKQICDAVQARAEKDKNHGVVLIPEGLVESIPELYALLQEIHGLHDKGVSVENISSHLSPWASALFEFLPPFIRKQLLLHPESDDSAQLSQIETEKLLAQLVEAEMNKRLKEGTYKGKKFNAICHFFGYQARGALPSKFDCDYAYVLGHVCYHILAAGLNGYMATVTNLRSPVNKWKCGAAPITSMMTVKRWSRGPAASQIGKPAVHMASIDLKGKPYELLRQNSSSFLMEDIYRNPGPLQFEGPGGETKPISLCVEDRDYMGRIKQLQEYLEKVKSIVKPGCSQDVLKAALSAMASVTEMLTIMSSPSFSGQATI

SEQ ID NO: 2685 - protein, 426 aa, Zea mays
MAARAADENRRPGVGRPAPCVRDMGSRRALTDIKNLVGVAPNPCAVAKKPVLQKSRKDEKKTALPSSRPMTRKFVASLASKEQPKCQPTGADPEPGVDQRKEPIVDGTVDIDVELGEPVDDSDGDIDMGDETENKDIMNQDESLMDIDSADSGNPLAATEYVEELYKFYRENEAKSCVNPDYMSSQQDINAKMRAILIDWLIEVHYKFELMDETLFLTVNVIDRFLEKEVVPRKKLQLVGITALLLACKYEEVSVPVVEDLVLISDRAYTKGQILEMEKLILNTLQFNMSVPTPYVFMKRFLKAADADKQFELVSFFMLELCLVEYQMLNYRPSHLAAAAVYTAQCAINRCQQWTKVCESHSRYTGDQLLECSRMIVDFHQKAGTGKLTGVHRKYSTYKFGCAAKIVPAQFMLESGGTAPPPSGAI

SEQ ID NO: 2686 - protein, 564 aa, Zea mays
MPSGDDSDPLLAPADGIRFAALDYRDHPADRGATGGWRSALFIIAVEISERFTFYGVSSNLINYLTGPLGEGTAAAAAAINTWNGVAQLLPLLGGALADKWLGRYRTIVVASLLYVIGAGMLAFSTLLSSGSGHQCTTAGGQTCAPSTIKVTFFYVSLYIVAVAQGGHKPCVQAFGADQFDQSDPKETVSRSSFFNWWYFGMCAGTAVTLLFLNYVQDNIGWGLGFGIPCAVMAAALAVFLLGTRRYRYYVTAGERGLFARAGEAFVEWRSRRKALQHGDRPVAEGAPGFSAGVDEEEQAAVSHDAGLVKETKDILRLFPIWATCLLYAVAFSQSSTFFTKQAATLDRRVGRHLQVPPAALQSFISITIVVFIPLYDRVLVPVARRYSGNPSGITMLQRIGTGMFLSLLSMVIAALVEKHRLRVAVDAGLVDKPMVPLPMSLWWMVPQYVLFGAADVYTMVGLQEFFYDQVPDKLRSLGLALYLSIFGVGSFISSTLVSIIDSVTTARGGSWFSNNLNRGHVDYFYWLLAALSALELLAYVFFAVTYKYKNKATVHATVVGQSL

SEQ ID NO: 2687 - protein, 439 aa, Bacillus clausii KSM-K16
MKYIIIGGDAAGMSAAMQLVRKDAQADITVLERGEHYSYAQCGLPYWIGGEIESDRKLIARDADTYRIKHGIDARINHEVKAVDTKQKTVSGDGFCLAYDKLLIASGASPVIPDWENGDLKGIYTLKTIPDAKKIIAALGTEKKTVTVIGGGSIGLEVAENLAKANHHVRILERAKRLAMNFDKEMADYIHEKAIDEGIELELNHEIIGFSGDKDGHVTGIRTNLTECPTDIVIVAVGVRPNTDFLRNTDIHLNNNGAIRVNRYMETNVPDVYAAGDCATQYHRLINKDMYYPLGTHANKQGRIAGLNMCGNTRVFMGIVGTQIYQFFDLALARTGLSSREIEEIGYPYKCVQAKLPHVAGYYPTNETIHIRLQFHAETGVVLGGQFIGTKGVDKRCDVLATALYHGMTMQDLEELDLGYSPPFNSVWDPLQQTARRRP

SEQ ID NO: 2688 - protein, 306 aa, Vibrio sp. Ex25
  misc_feature (213)..(213): Xaa can be any naturally occurring amino acid
  unsure (1)..(306): unsure at all Xaa locations
MKPTVEILTDILAEVRPLIGQGKVADYIPALAKVPSNKLGIAVYTNEGEVIKAGDADEPFSIQSISKALSLTLAMCLYKQEEIWSRVGKEPSGQAFNSLIQLEMEQGIPRNPFINAGAIVVADLLQTRLSAPRQRLLEFVRQLSGDTHIVYDKVVAASEMMHGDRNAAIAYLMRSFGNFENEVIPVLQNYFHACALKMSCVDLAKTFSYLANXGTSVQTGKPVVSPVQTKQLNALLATCGLYDGAGEFAYRVGMPGKSGVGGGIIAVVPGEMTIAVWSPELDPSGNSLAGTKALELLSERIGRSIF

SEQ ID NO: 2689 - protein, 511 aa, Triticum aestivum
MIARGLLRSNASSQASKLVKYLTSAGSLQGHADSLSDASVRHFSSASSPQTNSTEENGFKGHGMLAPFTAGWQSNDVHPLVIERSEGSYVYDINGNKYLDSLAGLWCTALGGSEPRLVKAATDQLNKLPFYHSFWNRTTKPTLDLADDLLSMFTASKMGKAFFTNSGSEANDSHVKLVWYYNNALGRPNKKKFIARSKAYHGSTLISASLTGLPALHQKFDLPAPFVLHTDCPHYWRFHLPGETEEEFATRLAKNLEDLILKEGPETIAAFIAEPVMGAGGVIPPPKTYFDKVQAVVKKYDILFIVDEVITAFGRLGTMFGSDMYNIKPDLVTLAKALSSAYVPIGATLVSPEIAAVVDSQSNKLGSFAHGFTYSGHPVACAVAIEALKIYRERNIPDHVKQIAPRFQEGTKAFAGSPIVGEIRGVGLILGTEFANNKSRDDPFPAEWGVGAIFGQECQKRGMLVRVAGDSIMMSPPLTMTPGEVDELVSIYGEAMKATEERVAELKSKKN

SEQ ID NO: 2690 - protein, 467 aa, Zea mays
MGKKGKWFGAVKKVFSPESKEKKEERLRRKSAGSNPTPVDLTPSTSLEVNLSVPPPPAPPPVLHQAEEVGVPEAEQEQSKHVAVEEAPAAAPAQASVLPPAVPTQELAAVKIQTAFRGYLARRALRALRGLVRLKSLVEGNSVKRQSASTLRCMQTLSRVQSQISSRRAKMSEENQALQRQLLLKQELENFRMGENWDDSTQSKEQIEASLISRQEAAIRRERALAYAFSHQWKSTSRSVNPMFVDPNNLQWGWSWLERWMAAKPWEGRNGADKESNIDRGSVKSMSLNLGEGEITKAFNRRDSKLEKPSPPTPRPARPTSRHSPLTPSARVAPIPARRKSVTPKNGLSQVDDDARSVLSVQSERPRRHSIATSTVRDDESLTSSPSLPSYMVPTESARAKSRLQGSAMANGAETPEKGGSTGPAKKRLSFQGGTAAASPMRRHSGPPKVEIAPPQPEALVVNGGSK

SEQ ID NO: 2691 - protein, 501 aa, Solanum lycopersicum
MASIWGLLSPWIPYFISFIAFLLLLEQISYIKKKRFLPGPTLVFPFLGNVIPLVTNPTKFWDLQSALAKSTSHGFSVNYIIGKFILYIHSTDLSHKVFANVRPDAFHLIGHPFGKKLFGEHNLIYMFGQEHKDLRRRIAPNFTPKALGTYTDIQQRIIIKHFKSWLDEASKSPNTPIPLRLLCRDMNLDTSQTVFVGPYLDGESRKRFNVDYNYFNVGLRKLPVDLPGFAFRNARLAVGRLVDTLSVCVEQSLNKMKNEEEPTCLIDFWMQENLREINEAKINGLQKPFQYSNKELGGYLFDFLFAAQDASTSALLWAIVLLDSHPQVLEKVRSDVARFWSPESEEPLTAEMLTEMKYLEAVAREIIRIRAPATMVPHIAGEEFRLTEDYVIPKGTIVFPSVFDSSFQGFPEPEKFEPDRFMEERQEERVYKKNFLALGAGPHACVGQKYAINHLMLIIAMFTALIDFKRHKTDGCDDISYIPTIAPKDDCKVFLAHRCTR

SEQ ID NO: 2692 - protein, 110 aa, Bradyrhizobium japonicum USDA 110
MDMSIEEFIANEVKSNDVVLFMKGTPQFPQCGFSGQVVQILDHLGVGYKGLNVLESAELRNGIKTFSNWPTIPQLYVKGEFVGGCDIVREMFQAGELQQLLSEKGVAVAA

SEQ ID NO: 2693 - protein, 254 aa, Triticum aestivum
MAGSRRALRFVLLLPAILGALLPPAAAAGPPKVSLALYYESLCPYCSRFIVTRLAGIFDSGLIHAVDLLLVPYGNAHVRGANNTISCQHGPDECLLNNVEACAINAWPDLNVHFGFINCVEDLVMNRKREEWKSCFQKQGLNPKPVMECYNSEHGHKLSLKYGKQTDALVPPHKYVPWVVVDGQPLYDDYENFEAYVCKAYKGHPPKICQGLGRDYPIVQQVVEAGTGVTYNSGDFELDEGVEDEIKMVQGDDN

SEQ ID NO: 2694 - protein, 546 aa, Escherichia coli O157:H7 EDL933
MTPGEVRRLYFIIRTFLSYGLDELIPKMRITLPLRLWRYSLFWMPNRHKDKLLGERLRLALQELGPVWIKFGQMLSTRRDLFPPHIADQLALLQDKVAPFDGKLAKQQIEAAMGGLPVEAWFDDFEIKPLASASIAQVHTARLKSNGKEVVIKVIRPDILPVIKADLKLIYRLARWVPRLLPDGRRLRPTEVVREYEKTLIDELNLLRESANAIQLRRNFEDSPMLYIPEVYPDYCSEGMMVMERIYGIPVSDVAALEKNGTNMKLLAERGVQVFFTQVFRDSFFHADMHPGNIFVSYEHPENPKYIGIDCGIVGSLNKEDKRYLAENFIAFFNRDYRKVAELHVDSGWVPPDTNVEEFEFAIRTVCEPIFEKPLAEISFGHVLLNLFNTARRFNMEVQPQLVLLQKTLLYVEGVGRQLYPQLDLWKTAKPFLESWIKDQVGIPALVRAFKEKAPFWVEKMPELPELVYDSLRQGKYLQHSVDKIARELQSNHVRQGQSRYFLGIGATLVLSGTFLLVSRPEWGLMPGWLMAGGLIAWFVGWRKTR

SEQ ID NO: 2695 - protein, 1065 aa, Desulfitobacterium hafniense Y51
MNAENGNRNTKKWNKVLVIGSGPIVIGQAAEFDYAGTQACRALQEEGVEVVLVNSNPATIMTDQEVADRIYIEPLTVEFLERIIERERPDGIIATMGGQTGLNLAFQLAEKGILQRCGVQLMGTSLDSITKAEDREHFRSLMKMLGEPVPPSVIVSDLEEALSFGEEIGYPVIVRPAYTLGGTGGGIAHNREQLREIAKSGLQASLIDQILVEKSVAGWKEIEYEVLRDSQGNCITICNMENMDPVGVHTGDSMVVAPCQTLTDREVQALRTSSRKIVAALGIEGGCNVQYALHPERLEYVVIEVNPRLSRSSALASKATGYPIAKVAAKIALGYTLPELTNAVTGKTSACFEPALDYVVVKIPRWPFDKFSDADRRLGTQMKATGEVMGLGRNLETALQKAVRSLEIKAFGLLLPEFQELADEEILERCQKPDDQLLFILAEGLRRGLSLEQIQKASSWNPYFLTAIERIVRMSDTLQSSPWDEELLLKAKRMGFADRELARLWQTTEKEIYAYRQEKGLQPVFKMVDTCAGEFEALTPYFYSSYDQEDEGMPSQRRKVVVLGSGPIRIGQGIEFDYCSVHSVLALKKAGVETIIINNNPETVSTDFDTADRLYFEPLTLEDVSAVLEREQPEGVIVQFGGQTAIGLAKPLAERGYKILGTSIEDIDRAEERGQFDEVLHTIGAKRPKGGQASSLAEAVEVAARIGYPLMIRPSFVLGGRAMEIVYSASELENVVNRAMADFPGQELWMDQYLVGKEVEVDAISDGKNVSLPGIMEHLERAGVHSGDSIAVYPPQTLSEPLIQRITLLTTEIARALNVIGLLNIQYVIFQDEVYVIEVNPRSSRTVPFISKVTGLSIVDYATEVILGKTLTELNLPLGLWPLPERVAVKVPVFSFSKLHRVEPSLGPEMKSTGEVMGVDRTYEKALYKALLAGGFNMSAHGSLLVTLADRDKTEGIPLVRKFADLGFRVLATEGTAKTLREEGIQVAPVAKLHQGSTEITDAIRQGVIQCVLNTTTHNKKQESDGFAIRRTAVEQGIPCFTSLDTASAWVQVLRSFLPSLMSLK

SEQ ID NO: 2696 - protein, 289 aa, Malus x domestica
MEGKEEDVRLGANKYSERQPIGTSAQSQDDGKDYKEPPPAPLFEPGELTSWSFYRAGIAEFIATFLFLYITILTVMGVVKSKSKCTTVGIQGIAWAFGGTIFALVYSTAGISGGHINPAVTFGLFLARKLSLTRAVFYIVMQTLGAIAGAAVVKGFEKSSTFEMLGGGANSVAHGYTKGQGLGAEIIGTFVLVYTVFSATDAKRSARDSHVPILAPLPIGFAVFLVHLATIPVTGTGINPARSLGAAIIYNKKHAWDDHWIFWVGPFIGAALAALYHVVVIRAIPFKSK

SEQ ID NO: 2697 - protein, 289 aa, Malus x domestica
MEGKEEDVKLGANKFSERQPIGTSAQTQDEGKDYKEPPPAPLFEPGELTSWSFYRAGIAEFIATFLFLYITILTVMGVVKSKSKCTTVGIQGIAWAFGGTIFALVYSTAGISGGHINPAVTFGLFLARKLSLTRALFYIVMQTLGAIAGAAVVKGFEKSSTFEMLGGGANSVAHGYTKGQGLGAEIIGTFVLVYTVFSATDAKRSARDSHVPILAPLPIGFAVFLVHLATIPVTGTGINPARSLGAAIIYNKRHAWDDHWIFWVGPFIGAALAALYHVVVIRAIPFKSK

SEQ ID NO: 2698 - protein, 2100 aa, Zea mays
  misc_feature (1712)..(1712): Xaa can be any naturally occurring amino acid
  misc_feature (1721)..(1721): Xaa can be any naturally occurring amino acid
  misc_feature (2059)..(2059): Xaa can be any naturally occurring amino acid
  misc_feature (2068)..(2068): Xaa can be any naturally occurring amino acid
  unsure (1)..(2100): unsure at all Xaa locations
MTRVIHDSGDDMQKEALDLVSSDVNFPKGHFPDYRIGPNNQIIDPEETHEAVPLKEIVAKETAQLLEQHKRLSVRDLKEKFEKGLSGASKLSEEAKRREAASLDRQVLLKKLRDVLDTLKGRVAGRNRDDAEEAISLVEALAVQLTQREGELIYEKAEVKKLANFLKQATEDARKVAEEERALALAEIEKARAAIEKVEKAWRVHDFASSSREKAEIEELRKEVREARRIKMLHQPSKVMDMEFELQALRTLISEKTQLCNQLKKELAMIKRLEDDSSGLFELEGSNTLGSQLCIIPRVDGASNITNCPIQWYRVISGGTRELISGATKFMYAPEPFDVGRLLQAEIVLNADKIIVQTDGPVDNVLSEPTLAVSRAVMWGRTYMRARDARRAEARAFKVGANSNSPKEGSSKESGNSSTKEAMGDSNDFKAFAEALKSLQACVVANAQAIASLTADRTSASGHKIGYDEHHGDRPPRFQKLDFPRYDGKTDPLIFINRCESYFHQQRIMEEEKVWMASYNLEHGAHMWYIQVQTDEGTPSWRRFKELLNLRYDPPLRAAPLFELADCRRTGSVADYRDLFQALLPRAGPLDEAQWVQLFTGGLRPPLSLDVQRYTRGHNRVCTRIFYINDVELDTADESATGDDHDTETPMFSLDAVAGVFVGNTVQLQVVVGAATFVALIDTGSTHIFIGEAAARRSGLTIEPRPRLTTTVANGERVACPGVLRQAPVDMGSMVFGVDLFVMPLAGSRTGRGASASTPRALNALTVKDAFPIPIVDELLDELHGARLFTKLDLRSGYHQVQMRQEDVHKTAFCTHDGLYEFLVMPFGLCNAPATFQALMNDVLRTYLRRFVLVFFDDILIYNTSWADHLRHLRVVLNTLRQHRLFVKRSKCSFGVDFVAYLGHVISAAGVAMDPAKVQAIHDWPQPRSARAVRGFLGLAGYYRKFVHNYGAIAAPLTTLLKKEGFVWPDEATAAFSALKGAVTTTPVLTLPDFTKSFVVECDASTYGFRVVLIQEAHPIAFFNRPVAPRHRSLAAYERELIGLVLAVRHWWSYLWGRRFIVKTDHYNLKYLLDQRLATISQHHWVGKLLGFDFSVEYKSGATNTDFVRACPTCQRYKSEHLHPAGLLTPLPIPTVVWADIGLNFIEALPRVNVKSVILSVVDRFSKYCHFIALGHPYTAESSDGQTEAANRVIIMYLRCFTGDRTRQWLRWLPWAEYVYNTAYQSSLRETPFRVVYGRDPPSIRSYEPGETRVDAVARDMEEREAFLADVRHRPEQAHAVQKRHYDKQHRPVTYAVGDWALLRLRQRAPSSLPQQTMGKLKPRFLGPYRVIELINNVVVRLELPPHARIHDVFHVGTLKFVLVQWRGEPTTSATWEDLDKFRATYPDFQLEDELDLEGGRDVMWGRTYMRARNARRAEARAFKVGANSSSPKEGSSKESGSSSTKEVSSKEESGSSSTKEAAGLERYVDSLMKRTDIEFNVVVTQMNGKDYSSNSVHVFHIGKLRIKLRKGWSTKARESYSTTMKLCGSRGGGNAAARAVFWHPRKGSSYTLAFETDRDRNAAIMIARKFASNCNHFDSLCHFDTPNGWDLHKDMVVKYKRGCFGSGSAVAAHAGGEEESRAARLQSFFASVLSGLFGQAEAEDEDEDEEMPTRNHNAAAAAAPQHHHHNRGGAPALGKSKAVPGRADAMNRRAPLGDIGNLVSVRPAEGXLSCRSRSIXPITRSFGAQLVKNVQANAAIKNAAILPARHAPRQERKAPAKQPPPEDVIVLSSDSEQSRTQLESSASSVRSRKKVINTLSSVLSARSKAACGITDKRRQVAVIEDIDKLDVNNELAVVEYIEDIYTFYKIAQHDRRPCDYIDTQVEINPKMRAILAGWIIEVHHKFELMPETLYLTMYIIDQYLSLQPVLRRELQLVGVSAMLIACKYEEIWAPEVNDFILISDSAYSREQILSMEKGILNSLEWNLTVPTVYMFLVRFLKAAALGNKVEKEMENMVFFFAELALMQYGLVTRLPSLVAASVVYAARLTLKRAPLWTDTLKHHTGFRESETELIECTXCWSAHTRPXADSKLRSVYKKYSSEQFGGVALRPPAAAVEIK

SEQ ID NO: 2699 - protein, 457 aa, Mortierella alpina
MAAAPSVRTFTRAEVLNAEALNEGKKDAEAPFLMIIDNKVYDVREFVPDHPGGSVILTHVGKDGTDVFDTFHPEAAWETLANFYVGDIDESDRDIKNDDFAAEVRKLRTLFQSLGYYDSSKAYYAFKVSFNLCIWGLSTVIVAKWGQTSTLANVLSAALLGLFWQQCGWLAHDFLHHQVFQDRFWGDLFGAFLGGVCQGFSSSWWKDKHNTHHAAPNVHGEDPDIDTHPLLTWSEHALEMFSDVPDEELTRMWSRFMVLNQTWFYFPILSFARLSWCLQSILFVLPNGQAHKPSGARVPISLVEQLSLAMHWTWYLATMFLFIKDPVNMLVYFLVSQAVCGNLLAIVFSLNHNGMPVISKEEAVDMDFFTKQIITGRDVHPGLFANWFTGGLNYQIEHHLFPSMPRHNFSKIQPAVETLCKKYNVRYHTTGMIEGTAEVFSRLNEVSKAASKMGKAQ

SEQ ID NO: 2700 - protein, 1194 aa, Oryza sativa (japonica cultivar-group)
MGFFFFASRAAARFLGEARIIHPGVSTAALLVAAASGGGLVAYADSAGENASSETSQEAPRKKKVVVLGTGWAGTSFLKDLDCSKYEVKVISPRNYFAFTPLLPSVTCGTVEARSIVEPIRKMLEKKRKDVAFYEAECFKIDASKKAVHCRSAVGTNFDGNGDFMVDYDYLVVALGATVNTFNTPGVMENCYFLKEVEDAQKIRRNVIDCFEKASLPNISEEEKRKILHFVIIGGGPTGVEFAAEMHDFLVEDLVKLYPAIQDFVKITIIQSGEHILNMFDQRIATFAEMKFQRDGIEVNTGFRVVKVSDDLITMKSKSLGETNRRVLATNEWLRVHECDNIYAIGDCASITQRKIMDDISTVFKMADKDNSGTLTLKEINDVLEDICIRYPQVELYMKSMHMLDIRDLIKDAIGDSHKESMVVNIEEFKKALSHVDSQVKSIPATAQVAAQQGHYLAECFNKMDQCKEHPEGTSILGNLHPWVESKLLQSSQATGFPWAIALSGSGTLYMQVLFAPTATWLSLTVTERCSSALRQTIRIRDVFHTEIRLMLGAQQQEELLFQMPGHGIHACKIPMEEESIKSGGVTRGQIKGDEMGEAAEEGAVDGSCHGEAAAEALEVLRSMAMASSSLTCSIPQFPAKWQSIKDKLRQLCSGLDSLCGSVGFGVDVGGDEERHGVLVQLVASASATVRSIQAMASQCGDGTYKGGRLRLRSDLDNLSSKLEAHMKQLREMASSGMPSPSQAIVAVRPSADAGAGEKMFYMRDLFSRVRIGGSVQRSQSLATIGELLAEDEVCVKIVAVDIDDGVALLTGFLESSDARLQEEAAGAVAMVASFDSYRGMLVKAGVIAPLVQLLDDAAATAAVAAGGGATAVAKERAAQALRELTENSDNVWAVCAHGGLTTLLHACGDAGSGGKLVASSFAVLRNLSRVEEVKVFMAEQGVVTELVKLSQKKEEARKLGAVELLHAMALDDADVREEAVSMGVIQSLLQLIYPDLPYSYKAREVALAAIWFFCFSSVNSIDDLISSDVLGWLLFYLNNGDYAVLECTLKILRHLSEVSEEYNRMMGRAGYLSALSSLLGAKSCRVREMAAQVLSSLLLLHPNRVIFIQDGDNLNRLLQLLDPAEGKLVAKDLILSAILSLADTNSGRKKIISSEHFSSLKELADTGDFDAKKVVKKLGTNRFQTIFSKIWSV

SEQ ID NO: 2701 - protein, 180 aa, Mycobacterium smegmatis str. MC2 155
MPKFLDALAGFAVTLGSMFKKPITEGYPEKPGPVAPRYHGRHQLNRYPDGLEKCIGCELCAWACPADAIYVEGADNTADERYSPGERYGRVYQINYLRCIGCGLCIEACPTRALTMTTEYEMADDNRADLIWGKDKLLAPLQEGMQAPPHDMAPGKTDDDYYLGNVTPITPVPSGTEDAR

SEQ ID NO: 2702 - protein, 441 aa, Brucella melitensis 16M
MVTPENISGISKAAIFQMDAANSPHIVVVGAGFGGLQLIRDLDGAKVRITLIDQRNHHLFQPLLYQVATTILSTSEIAWPIRNLFRDRAEVTTLLGTVIDVDTARKSVFLENGDEVSYDMLVLATGARHAYFGNDQWEKLAPGLKALEDATTIRRRLLLAFERAEREPDMARRQALLTFSIVGGGPTGVELAGIIAELARRTLWPEFRNIDTRQARVLLLEVGPRILSAFPEDLSAYARRALEKLGVEVRLGIPVKDITQEGVTVGDEFIPCHTTVWAAGVAASPAALWLDAESDRAGRVKVLSNLSVPGHEDIFAIGDTAWVEGDDGRPVPGIAPAAKQQGAYVAKVIRSRVENKTPPLPFRYKHQGNLATIGKGAAVVDMGRIRLKGTIAWWFWGIAHIFFLIGTRSRAAVAWSWLWTYITGQHSARLITQGKPSDEFR

SEQ ID NO: 2703 - protein, 75 aa, Arabidopsis thaliana
  misc_feature (29)..(29): Xaa can be any naturally occurring amino acid
  misc_feature (62)..(62): Xaa can be any naturally occurring amino acid
  unsure (1)..(75): unsure at all Xaa locations
MASSMLSSIGVVTSPAQATMVVPFTGLKXSVSFPAARKGNRGLTSIKGNGGRVSCLKVGPPXWKAQILQTRARLP

SEQ ID NO: 2704 - protein, 333 aa, Solibacter usitatus Ellin6076
MNLGKLGQALTAREIFDLIQDDLEQVEKKITAESVASVDAVTAIGQYLQSAGGKRLRPALLLLSAKLVGNGGPSAIQLGAVVELIHAATLVHDDVIDTAQTRRGRPSTNVKWGNHTCVLAGDWLYMQAFQIALRERSFQMLDLLIGLTQMMVEGELLQLERIGRINVSEADCMELVDRKTACLFSVCARLGGLCGHTDPQTQEKLGEYAWNLGMAFQLVDDVLDFTSREKVLGKPVGGDLREGKVTLPLVYALERAAPEERKLVETILEDRTYDRVPFQRILALLEKYQGIERVKERAQAFTDKARQTIAEFPESPYQRALLAVTELVTERDH

SEQ ID NO: 2705 - protein, 429 aa, Brucella suis 1330
MRLGGRLQAAIEVLGEIEAGKRPASDVLKEWGAAHRFAGAGDRAVIGNIVYDALRRKLSILWRMDADDARALAFGGLLADDGMDIEMVDAALHGDRFAPEGLDAARRAAWQSRDLATAPAHIQADVPEWCIPSLEELFGERWVSEGKALATRPPVDLRVNSLKATPEKTLAALEKAGAAPAPFLAQALRIPPIEALGRHPNVQGEQAFLDGWFEVQDLGSQLAALFAGVKPGEQVLDYCAGAGGKTLALAAAMGNSGQIHAYDAERARLSPMHERLQRAGVRNTQVYGGLDELGPLAGKMDLVLTDAPCTGSGTWRRRPDAKWRLNEQQLERRVQDQQDVLDSARRFVKPGGRLAYVTCSLFAEENTRQVARFLGENPDFKEIAPQTLWGTVVQDDSAGKPVFLSHGSVFSPLSTGTDGFYVSILQRQN

SEQ ID NO: 2706 - protein, 641 aa, Solibacter usitatus Ellin6076
MKYYLTTPLYYVNAAPHIGHTYTTMAAETIARFKRMQGYDAVMFTGTDEHGQKVERSAEAAGKTPQEFTDTIAREFQQQWEKLNIRVDRTIRTTDPRHHKVVQRLFQMCMDNGYIYKGSYSGQYCVYDELYANDAKPGDPCPICGRITETVTEENYFFKLSAFTEKLLELYESQPDFIQPEARRNEVISFVKQGLNDLSISRTTIKWGIPLPVEGNHVFYVWFDALIGYMSAVDGEDLWPADLHLMGKEITRFHAVFWPAFLMAGGVPLPKRIVAHGWLLFENDKMSKSRGNIVRSEPIRQVMGADALRYFLLREIVFGQDGSFSYDALIGRYNSDLANGLGNLASRTLTMINQYRGGAVPEGSDAEIAGIANQTIRTVQETFDRFEFSKGLEAVWGLISAVDKFIVQNAPWKLARQNDQESQTLLSTTLYTAAEALRVATALLSPVLPQSAPKIWAQLGLPESIEAVRFATLEWGSLQPGQKIGEIAGVFPRIELKEAVGKMRELEEQVTAEQNKLLGKTAAPVEPAAPATPKIAIDDFVKVDLRVGQVVSAERVKGSDKLMHMKVDIGEPEPRTIVAGIAEAYSPEQLLHRKVVIVANLQPRKLKGIESNGMIVAASVEGGKPVLTGFHEEIPVGARLK

SEQ ID NO: 2707 - protein, 524 aa, Glycine max
MAAVKPEEISHPPMDQLQGLEYCIDSNPSWAETIALGFQHYILALGTAVMIPSFLVPVMGGSDDDKVRVVQTLLFVEGINTLLQTLFGTRLPTVVGGSYAFMVPVISIIRDPSFATIEDPHLRFLSTMRAVQGALIVASSIQIILGFSQIWAICSRFFSPLGMVPVIALVGFGLFDRGFLVVGTCVEIGIPMLILFIAFSQYLKNFQIRQVPILERFALLISTTVIWAYAHLLTASGAYKHRPDLTQHSCRTDRANLISSAPWIKIPYPLEWGAPTFDAGHAFGMMAAVLVSLVESTGAYKAASRLASATPPPAHVLSRGIGWQGIGILLNGLFGTLTGSTVSVENVGLLGSNRIGSRRVIQVSAGFMIFFSMLGKFGALFASIPFPMFAAVYCVLFGIVASVGLSFLQFTNMNSMRNLFICGVSLFLGLSIPEYFREYTIRAFHGPAHTNAGWFNDFLNTIFFSSPTVALIVAVFLDNTLDYKDSAKDRGMPWWAKFRTFKGDSRNEEFYTLPFNLNRFFPPS

SEQ ID NO: 2708 - protein, 520 aa, Brucella suis 1330
MSTTAYPDTILIIDFGSQVTQLIARRVREANVYCEIVPFQSADEAFKRLQPKGVILSGSPHSTTDIGSPRAPQAIFDAGIPVLGICYGEQTMCAQLGGNVESGHDREFGRAFLDVQEDSPLFAGIWAKGTRHQVWMSHGDRVTSLPDGFTIIGTSPNAPYAVIADEKRKYYGVQFHPEVVHTPDGAKLLQNFVHRIVGVKPGWTMGAYREQAVEAIRKQVGSGKVICALSGGVDSSVAALLAHEAVGDQLTCILVDHGLMRKDEAQQVVEMFREHYNLPLILVDASDRFIGALEGESDPEKKRKTIGRLFIEVFEEEARKLGGADFLVQGTLYPDVIESVSFTGGPSVTIKSHHNVGGLPERMKMQLVEPLRELFKDEVRLLGKELGLPDSFIGRHPFPGPGLAIRCPGGVTRGKLEILREADAIYLDEIRKAGLYDAIWQAFAVLLPVQTVGVMGDGRTYEFVCALRAVTSVDGMTADFYHYDMNFLGNAATRIINEVRGINRVVYDVTSKPPGTIEWE

SEQ ID NO: 2709 - protein, 203 aa, Brassica napus
MDMQGEIERLMFFEHARKAAEATYIKNPLDGDNLLRWGGALLELSQFQNPTASKQMLLDAISKLEEALSIDPKKHAALWCIGNVHTSYGFMIPDEIVAADHFQKASHYFQQALDEQPENELYRKSLELTSKAPELHKAAHSHGSGPQALGGVAGPSSTASTSENVKKKKSSDLKYDVMGWVILAAGIATWISFAKSQMPPPRQ

SEQ ID NO: 2710 - protein, 127 aa, Bacillus licheniformis ATCC 14580
MNKVESIFEAGNLKSNGHYALAVIHQNTVYVSGQFAIDPITQEKKFGTIEEETLQVLSNIEYILKKAGSHKGKILKITLYLHDINLLDRVDNVCQGFFHDYRPARSVVSTTELHYGFQVEIEAIASL

SEQ ID NO: 2711 - protein, 670 aa, Vibrio sp. Ex25
MYSGADMSSRKHLANAIRALSMDGVQQANSGHPGAPMGMADIAEVLWRSHLNHNPSNPEWADRDRFVLSNGHGSMLIYSLLHLSGYELSIDDLKNFRQLHSKTPGHPEYGYAPGIETTTGPLGQGITNAVGMAIAEKALAAQFNKEGHDIVDHFTYVFMGDGCLMEGISHEACSLAGTLGLGKLIAFWDDNGISIDGHVEGWFSDDTPKRFEAYGWHVIPAVDGHDPEAINAAIEAAKADPRPTLICTKTIIGFGSPNKSGSHDCHGAPLGHDEIQAAREYLGWEYGPFEIPADVYAEWDAKEAGAAKEAAWNEKFEAYAAAYPAEAAELKRRLNGELPAEWEEKANQIIADLQANPANIASRKASQNALEAFGQMLPEFMGGSADLAPSNLTMWSGSKSLETDDFSGNYIHYGVREFGMTAIINGIALHGGFVPYGATFLMFMEYARNAMRMAALMKIQNIQVYTHDSIGLGEDGPTHQPVEQMASLRVTPNMSTWRPCDQVESAVAWKLAIERKDAPTALIFSRQNLAQQDRTAEQVANIAKGAYILKDCEGKPELILIATGSEVELAVEAATQLTAEGKKVRVVSMPSTDAFDKQDAAYREAVLPSDVTARIAIEAGIADFWYKYVGFDGRIIGMTTFGESAPAGQLFEMFGFTTENVVNTAKELLA

SEQ ID NO: 2712 - protein, 398 aa, Desmarestia viridis
MSLKKKVFSKKLQHFTINFGPQHPAAHGVLRLILELNGEVVQRADPHIGLLHRGTEKLIEAKTYFQALPYFDRLDYVSMMCQEHTYALAVENLLQVSIPKRAQYIRVLFAEITRILNHLLAVGCHAMDVGAMTPFLWAFEEREKLMEFYERVSGARMHASYFRPGGVSQDISIGLIDDIYSFAVQFGQRLDEMEEMLTENRIWQERLVDIGVVTAQEAIDWGFSGVMLRGSGVRWDLRKNEPYEVYSDLKFCEVVGKTGDCYDRYLVRVEEMRQSLSLIHQCLNKMPQGSVKIDDAKISPPSRTEVKQSMESLIHHFKLYTEGVLVPAGETYTATEAPKGEFGVFLVSDGSNRPYRCKIKAPGFAHLQGLNFMANSHMLADVVTIIGTQDIVFGEVDR

SEQ ID NO: 2713 - protein, 305 aa, Yarrowia lipolytica CLIB122
MNSKYAGKAYTETTVHKYHRNLIGIEHPTRYGAPHTNTVVFIGGLGDGITTVPYVKPLADALDKAGWGVVELLTTSSFGGWGTGSLERDAEEVEKAVEYLTTKLEAGGLPNKQKVVLLGHSTGCQDIMYYLTRGKERAKIDGAILQAGVSDRDATVLNIGEKKWKETVAAAQKLVDEGKGDTVLSGEFAEIMHNTPISASRFVALNAPRGDDDFFSIDLPDSDLEKSFGQIKVPLLFLMSGSDAFVDPKQDKQKIVDRYESFVKGGNWSELSGVIDGASHNVGRDSKEGAVDAVVEKIESFVKSI

SEQ ID NO: 2714 - protein, 664 aa, Ashbya gossypii ATCC 10895
MLKSVEKLTLPQVISQRLTFHYRLRRKPEEIEENCISSETSDEKHSKGCNDQKNASHYEQPVMVTDLRDDSEGFSIQETELERPAMRQSNKMSILVGIFVAVGGFLYGYDTGLINSITEMSFVKKHFAPNHVNFTSMEMSILVSFLSLGTFIGALAAPLLADSYGRKSTVIFSTFIMFLEGTLLQVSATSMALLVAGRVASGVAVGLISVVVPLYQGEAAQKWCRGAIICTYQWAITWGLLVSSAVSQGTYLRNDASSYRIPIALQYVWCIILGSGMLLLPESPRYYVLRDQLDKAALSLSFLRGVPHDDAGLLEELVEIKANYDYEMSLKSSSYLDCFRTSEHRPKQQIRMLSGILLQAFQQFSGINFIFYYGVNFFSSTGISKSYLVSFVTYAVNVVFNIPGLFLVEYAGRRKLLLVGGVLMTISNFIIAIVGVSTDSVIAKKVMIVFICMFIAAFSATWGGVVWVMSAEMYPLGVRSKCAAICAASNWLVNFVCAMITPYLIDISSYTSRLGSTIFFVWGSLNAIGVMVVYLTVYETSGLTLEEINELYRRCPSSLASCAWNRRIKSSPEDYHLTVTGRCAPSEHQDHVDLGNGLCLATYHRAPPSIISESSNSSSDSVVNSGAGAGGPAAAPAGINAYMSDLMNNIVVNTHSTPAAGTST

SEQ ID NO: 2715 - protein, 315 aa, Vitis vinifera
MEIDSIECVSSTDGIYEEEIHHHHHQFSSSSKPHSNVVSPAISPATSVHELLECPVCTNSMYPPIHQCHNGHTLCSTCKSRVHNRCPTCRQELGDIRCLALEKVAESLELPCKYCSLGCPEIFPYYSKLKHEAQCNFRPYNCPYAGSECAVVGDIPFLVSHLRDDHKVDMHTGCTFNHRYVKSNPREVENATWMLTVFNCFGQYFCLHFEAFQLGMAPVYMAFLRFMGDEIEARNFSYSLEVGANGRKLIWEGTPRSIRDSHKKVRDSHDGLIIQRNMALFFLWWGQEGAEASGHRTNMEGTTKSRCRGVHTQSL

SEQ ID NO: 2716 - protein, 361 aa, Glycine max
VSLISFPKKKTRPKKRIDIWFCLFLWWIRVLTPVRHWLGRFRFSGLDMDSEDFRSILESAGVDVWALMDAAIAVASADHAHELKRRRDGIVERLYAASSPPPLCRNCDAGDGGEIRTQSSPSAEEEKDPYGGLFDDEQRKILDIKEQLEDPHQSEDSLVELLQNLADMDITFQALEETDIGRHVNRLRKHSSNDVKRLVKLLVRKWKEIVDEWVKLKAPGEPGTAVMADEDSPQQRILQNGHRQIPDFAYSPNPHYGSFGSERNNIEAERKPKAIPRKEAPPKPSPSVTTPASPPQNRQREGNFDPDRFASARKRLQENYKEAANAKKQRTIQVMDLHELPKPKNAFLGKNKGGTGQGRHW

SEQ ID NO: 2717 - protein, 331 aa, Vibrio vulnificus CMCP6
MTIKVGINGFGRIGRFVFRAAQERADIEVVGINDLIDVDYMAYMLKYDSTHGRFNGTVEVEGGNLIVNGKTVRVTAERNPEDLKWDAIGVDVVAEATGLFLDDATARKHITAGAKKVVLTGPSKDATPMFVMGVNHTSYAGQDIVSNASCTTNCLAPIAKVLNDKFGIESGLMTTVHATTATQKTVDGPSAKDWRGGRGASQNIIPSSTGAAKAVGVVLPELNGKLTGMAFRVPTANVSVVDLTVNLKNGASYEAICAAMKEASEGELKGVLGYTEDAVVSQDFIGEVQTSVFDAKAGIALTDNFVKVVSWYDNEIGYSNKVLDLIAHISK

SEQ ID NO: 2718 - protein, 315 aa, Vitis vinifera
MAPGGSTYKEVLESHSTVTDYDIAMTKADTNLTPAKTTAGLSGKKGISSPNGVHELLECPVCTSLMYPPIYQCPSGHTLCSNCKSRVHNCCPTCRHELGDIRCLALEKVAESLELPCRYQSLGCHDIFPYYSKLKHEQQCRFHPYNCPYAGFECSVTGDIPTLVEHLKGDHKVDMHDGCTFNHRYVKSNPQEVENATWMLTVFNCFGKQFCLHFEAFQLGTAPVYMAFLRFMGDDNEAKKFSYSLEVGGNSRKLIWQGVPRSIRDSHRKVRDSQDGLIIQRNLALYFSGGDRQELKLRVTGRIWKESELWKDNGC

SEQ ID NO: 2719 - protein, 386 aa, Vibrio sp. Ex25
MSVIKMTDLDLAGKRVFIRADLNVPVKDGKVTSDARIIASLPTIKHCLEAGAKVMVTSHLGRPTEGEYAEEFSLQPVVNYLNDALDCEVKLAKDYLDGLELNAGELVVLENVRFNKGEKKNDEELSKKYAALCDVFVMDAFGTAHRAQASTHGVGMHAPIACAGPLLANELEALGKAMDNPARPMVAIVGGSKVSTKLTVLESLSKIADQLVVGGGIANTFIAAAGHNVGKSLYEADLVDTAKKLMDECAIPVATDVACAKAFDENAEAEIKHVSEVQDDDMIFDLGPDSTAELAEILKNAKTILWNGPVGVFEFKNFEAGTKGISEAIAASEGFSVAGGGDTLAAIDKFGIKADVSYISTGGGAFLEFVEGKVLPAVEMLEARAK

SEQ ID NO: 2720 - protein, 294 aa, Vibrio vulnificus CMCP6
MDLNSLPALTVLSDCVTIVEKDNVKIVRVIHEKATAGISLFGGHVVSYQPTGTADVIWMSDKAVFDGKTALRGGIPVCWPWFGRIAAPAHGFARTSEWELVEHRENDNGVIVELALFPTEESHNLWPHMFDVRLIVEIGDELKVSLNILNIDDDAFTFSGALHTYLNVGDIEQTQTMGMGSEYIDSLKAGELCNGGEVLQLTDTIDRVYTQPEKEIVVKDPVIERTLCIENQGHNSAVLWNPWAQGAAGMADMSDDGYKTMLCVESTLHADSITQGKTLNPGESHQLITVLSAR

SEQ ID NO: 2721 - protein, 224 aa, Triticum aestivum
  misc_feature (40)..(40): Xaa can be any naturally occurring amino acid
  misc_feature (206)..(206): Xaa can be any naturally occurring amino acid
  unsure (1)..(224): unsure at all Xaa locations
MAALLARQAAMALRARQTARLGPSATAMQGHLRTYMDAGXPKRFKEDEEKEQLAKELAKDWSAVFERSINTLFLTEMVRGLMLTLKYFFERKVTINYPFEKGPLSPRFRGEHALRRYDTGEERCIACKLCEAICPAQAITIEAEEREDGSRRTTRYDIDMTKCIYCGFCQEACPVDAIVEGPNFEFSTETHEELLYDKEKLLENGXTRWETEIAENLKSEALYR

SEQ ID NO: 2722 - protein, 275 aa, Bacillus clausii KSM-K16
MEFWFTEKQTERFGITMKIKRTLHTEKTDFQQLDMVETEEFGNMLLLDGMVMTTEKDEFVYHEMVTHVPLFTHPNPKHVLVVGGGDGGAIREILKHPSVEKATLVDIDGKVIEYSKTYLPTIACALEDERVDVKVADGFMHIAQSANEYDVIMVDSTEPVGPAAKLFERGFYEGISKALKEDGIFVAQTDNPWFHQELVSNVYKDVKEIFPITRLYTANIPTYPSGMWTFTIGSKKHDPLAVEATRFHDVQTKYYTPDIHRAAFVLPKFVQDLLK

SEQ ID NO: 2723 - protein, 352 aa, Oryza sativa
MAEEREVPFGGYPREEIQWRRGGPVAQRIRARGYEPRCRGFESLLAHSLPKGKGLYFPPEGRKTMIGIADVKLLNLEKYMKKKGGRKIFGFMVKEEKEENWGSVEFQVFSFTNKIRRLASHLELHKKDFSSERGLRRLLGKRQRLLAYLAKKNRNPIFLERVEGVGFISGEEAVNWGLSGPMLRASGIQWDLRKVDLYESYNQFDWKVQWQKEGDSLARYLVRIGEMRESIKIIQQAVEKIPGGPYENLEVRCFKKAKNSEWNDFEYRFLGKKPSPNFELSKQELYARVEAPKGELGIYLVGDDSLFPWRWKIRPPGFINLQILPQLVKKMKLADIMTILGSIDIIMGEVDH

SEQ ID NO: 2724 - protein, 245 aa, Arabidopsis thaliana
  misc_feature (27)..(27): Xaa can be any naturally occurring amino acid
  unsure (1)..(245): unsure at all Xaa locations
MSTGLDMSLDDMIAKNRKSRGGAGPAXRGTGSGSGPGPTRRNNPNRKSTRSAPYQSAKAPESTWGHDMFSDRSEDHRSGRSSAGIETGTKLYISNLDYGVMNEDIKELFAEVGELKRYTVHFDRSGRSKGTAEVVYSRRGDALAAVKKYNDVQLDGKPMKIEIVGTNLQTAAAPSGRPANGNSNGAPWRGGQGRGGQQRGGGRGGGGRGGGGRGRRPGKGPAEKISAEDLDADLDKYHSGDMETN

SEQ ID NO: 2725 - protein, 230 aa, Blastopirellula marina DSM 3645
MPKPTGFSQITRQQVRAVDQIAIEQYGVPGVVLMENAARGCVDILAARTAQCVRICCGKGNNGGDGLAMARHLDLLGIPTQTLLFCPAEEITGDAAIQLNIVRKSELPLEIIPADVTDETLHRLLLDADWIVDALLGTGIKGNPRAPMDRVIRAINRSNAQRMAIDLPSGLDCDTGTPGDPTVEATVTVTFVAPKIGFTAEAAKPYLGEVVTVGIGAPRQAIEQAMGAGH

SEQ ID NO: 2726 - protein, 515 aa, Bacillus cereus G9241
MIILKKQHDTIIVLDFGSQYNQLIARRIREFGVYSELHPHTITAEEIKAMNPKGIIFSGGPNSVYGEGALHCDEKIFDLGLPIFGICYGMQLMTQQFGGTVERANHREYGKAVLKVENESKLYANLPEEQVVWMSHGDLVTGLPEGFVVDATSESCPIAGMSNEAKNLYGVQFHPEVRHSEHGNDLIKNFVFGVCGCSEGWNMENFIEVELEKIRETVGDKKVLCALSGGVDSSVVAVLIHKAIGDQLTCIFVDHGLLRKGEAEGVMKTFSEGFHMNVIKVDAKERFMNKLKGVEDPEQKRKIIGNEFIYVFDDEASKLEGMDFLAQGTLYTDIVESGTATAQTIKSHHNVGGLPEDMQFKLIEPLNTLFKDEVRVLGSELGIPDEIVWRQPFPGPGLGIRVLGEITEEKLEIVRESDAILREEIIKAGLDREIWQYFTALPGMRSVGVMGDERTYDYTVGIRAVTSIDGMTADWARIPWDVLEKISVRIVNEVKHVNRIVYDVTSKPPATIEWE

SEQ ID NO: 2727 - protein, 892 aa, Ralstonia metallidurans CH34
MAPVMPISSASDNDIDTQETREWLDALEGVIAHEGPERAHFLIEQLIRRAHDAGIYLPFSANTAYVNTIPLDNQAHSTGDQGLEHRIRSFIRWNAIAMVLRAGRDTNVGGHIASFASAATLYEVGFNHFWHAPSAQHGGDLVFFQGHSAPGFYARAFLEGRLSEAQMDKFRQEVGGQGISSYPHPWLMPDFWQFPTVSMGLGPIMGIYQARFMKYLQDRGFGDHRARKVWVFCGDGEMDEPESRGALGMAGREQLDNLVFVINCNLQRLDGPVRGNGKIIQELESEFRGAGWNVIKVVWGSKWDALLARDKDGILAQRMMACVDGDYQTFKSKDGAYVREHFFNSPALKALVADWSDDDIWQLNRGGHDPHKVYAAYHAAAHHTGQPTVILAKTIKGYGMGEAGEAQNITHQQKHMRVETLGQFRDRFGLPLTDEQLADLSYLKFEEGSPEHAYLHQRRQALGGYLPSRRRTGPELPVPPLSAFDGQLKASGEGREFSTAMSFVRILNTLLRDKALGKRIVPIVSDESRTFGMEGLFRQIGIWSQQGQTYTPQDASQLSFYKESKDGQILQEGINEAGAMADWIAAATSYSTHGEPMIPFFIFYSIFGFQRFGDLAWAAGDQRARGFLLGGTAGRTTLNGEGLQHEDGHSLVWGGTIPNCVCYDPTFAFELAVIIQDGLRRMLQMQEDVYYYITVMNENYEHPAMPEGAEQDILKGMYAFRRTSNGEAPRVQLLGAGTIFREVIAASAMLEQHWGVQADLWGCPSFTELARQGNEVIRWNLLHPDEAPRTSHVEHCLADTRGPVIAATDYVRALAEQIRPFVPRAYTVLGTDGYGRSDTREQLRDFFEVDRRWITLAALKALVDEGTLERGVLSQAIAKYGIDPEKPYPLRA

SEQ ID NO: 2728 - protein, 311 aa, Erwinia carotovora subsp. atroseptica SCRI1043
MANKIWVMGDAVVDLIPEDTERYLKCPGGAPANVAVGIARLGGNSAFVGRVGDDVFGHFLKTVLEEENVDTHYMAYDRHHRTSTVVVSLDDAGERTFTFMVRPSADLFLQPEDLPVFNRREWLHLCSIALSQEPSRSTAFEAMRQIKAALGRVCFDPNIRDDLWQSEQELRDCLTQALMLADVVKLSCEELTFLCPTSDVEEGIQQFMLRYPTRLLLVTLGSEGVWLHDRHQLQHFAAPSVTPVDTTGAGDAFVAGLLHGLAEYDDLSQPLSWDPIIEQAQRCGALATTAKGAMTALPYAQQLYTLPLAKV

SEQ ID NO: 2729 - protein, 199 aa, Escherichia coli O157:H7 EDL933
MMSAPDIRHLPSDTGIEVAFAGRSNAGKSSALNTLTNQKSLARTSKTPGRTQLINLFEVADGKRLVDLPGYGYAEVPEEMKRKWQRALGEYLEKRQSLQGLVVLMDIRHPLKDLDQQMIEWAVDSNIAVLVLLTKADKLASGARKAQLNMVREAVLAFNGDVQVETFSSLKKQGVDKLRQKLDTWFNEMQPVEETQDGE

SEQ ID NO: 2730 - protein, 340 aa, Mycobacterium smegmatis str. MC2 155
MTIRVGVNGFGRIGRNFYRALATQKAEGKNTDIEIVAVNDLTDNATLAHLLKFDSILGRLPQDVSLEGDDTIVIGDTKIKALEVKEGPAALPWGDLGVDVVVESTGIFTNAAKAKGHLDAGAKKVIISAPATDEDITIVLGVNDDKYDGSQNIISNASCTTNCLGPLAKVLNDEFGIVKGLMTTIHAYTQDQNLQDGPHKDLRRARAAALNIVPTSTGAAKAIGLVLPELKGKLDGYALRVPIPTGSVTDLTAELAKSASVEDINAAMKAAAEGPLKGILKYYDAPIVSSDIVTDPHSSLYDAGLTKVIDNQAKVVSWYDNEWGYSNRLADLVALVGKSL

SEQ ID NO: 2731 - protein, 134 aa, Glycine max
EGGWDNWDADDGFGSARGGSDLRRNQSTGDVRGFGGGGNVARSKSTQDIYTRAELEASAANKEEFFARKRAENESRPEGLPPSQGGKYVGFGSGPAPPQRGNQQNDYFSVVSQGLGKLSLAAASAANVVQAGTN

SEQ ID NO: 2732 - protein, 931 aa, Arabidopsis thaliana
MMLNTLFLPIFLFFLITFDYVSTQTCFNGYFKPNGTYDLNRRRILSSLASKVTAHNGFYSSTIGQNPNQMFIISMCIPGTKPERCSDCIKGSTDGLLRSCPNQTVGYVWPDCCMVRYSNISFSGSLIMEPSQPVSDPAPIGVDLTLFDRIWDELMSRTITTASRTHGSLSFGHKYYAADVASLTTFQTIYTMVQCTPDVSSGDCEFCLKRTVLDYKKCCRGHIGGAFVRPFCFIRWDLYPFAGAFENITLPSPPPPLSLTPPHEAKDFVFTNFLIFLISLDSVTAQEICFSGFFKPNSTYDLNRRQILSTLSSNVTSHNGFFNSKFGQAPNRVFINGMCIPGTKPETCSDCIKGASDKISESCPNKTDAYTWPDCCMVRYSNVSFSGSLVMEPSETLYHTGDIEDTGTNLTVFDRIWEELMLRTITAASLSSSNGSSFGQKYFAAEVASLTTFQTMYAMMQCTPDVSSKDCEFCLKTSVGDYESCCRGKQGGAVIRPSCFVRWDLYPYAGAFENVTFPPPPPQSLPQPPVSLIPPPVSDRANTTIKGIIVAIVVPIIVILVSLVVLLVVCRRKKSYKTTEVQATDEITTTHSLQFSFKTIEAATDKFSDSNMIGRGGFGEVYRGKLSSGPEVAVKRLSKTSGQGAEEFKNEAVLVSKLQHKNLVRLLGFCLEGEEKILVYEFVPNKSLDYFLFDPAKQGELDWTRRYNIIGGIARGILYLHQDSRLTIIHRDLKASNILLDADMNPKIADFGMARIFGVDQSQANTRRIAGTFGYMSPEYAMRGHFSMKSDVYSFGVLVLEIISGKKNSSFYNIDDSGSNLVTHAWRLWRNGSPLELVDPTIGESYQSSEATRCIHIALLCVQEDPADRPLLPAIIMMLTSSTTTLHVPRAPGFCLSGRDLEQDGVEYTESTSRSIPGSINDASITEFYPR

SEQ ID NO: 2733 - protein, 299 aa, Clostridium acetobutylicum ATCC 824
MYSECPYFRETNNCPVPPTNFPPQHQNRQPGIESVMRPRPIYNNPCYYASGKLRNKVALITGGDSGIGRAAAVAFAKEKADVAIVYLYERNDAMETKRVIESLGQRCLTIEGDVRRDGFCREAVERTIRTFGNLNILVNNAAVQFPQDSILNITNEQLENTFRTNIFSMFYITKAALPYLKYGSSIINTASITAYEGEKTLIDYSSTKGAIVSFTRSLSKSLVDKGIRVNAVAPGPIWTPLIPASFSAARVATFGKDTPMKRAGQPYELAPAYVYLASDDSSYVTGEVIHINGGRMVTT

SEQ ID NO: 2734 - protein, 169 aa, Candida albicans SC5314
MLCQVGLNVKVPFHFLFYSLTFGGSAFYSFIVSPLVFKKLPREEFSNLQNKVFPTYFTGQTLAPIILGLAQPFAYCPFTLGLLALSSVGGALNYLWLLPVCQKIKEDRNKLIADKKDVGADGQPTEELKALNKQFGKYHGISTLVNITSILSLGVYGVVLAKGLSKIKF

SEQ ID NO: 2735 - protein, 340 aa, Legionella pneumophila str. Lens
MKSLVKAKKEPGIWMQDIPVPEYGVNDVLIKIKRTAICGTDIHIYSWDEWAQATIPVPMTVGHEFYGEIVEVGKEVQGLKVGQRVSGEGHITCGFCRNCRAGKRHLCRNTLGVGVNRPGCFAEYLALPATNVIALPDNITEEQAAILDPFGNAAHCALAFDVVGEDVLITGAGPIGIMAAAIVRHIGARHVVITDVNDHRLELARKMGVSRAVNVKYQKLSDVANELGMLEGFDVGLEMSGNPMALNDMMKAMNHGGHVALLGIPPQETPIDWNQVIFKGLVIKGIYGREMFETWYKMIAMLQSGLNISPVITHNFPVDEYQHAFQIMASGQSGKVILNW

SEQ ID NO: 2736 - protein, 348 aa, Triticum aestivum
  misc_feature (291)..(291): Xaa can be any naturally occurring amino acid
  misc_feature (310)..(310): Xaa can be any naturally occurring amino acid
  misc_feature (326)..(326): Xaa can be any naturally occurring amino acid
  unsure (1)..(348): unsure at all Xaa locations
MDHAADTFRTDLMTITRHVLNEQSRHPESRGDLTILLSHIVLGCKFVASAVNKAGLAKLTGLAGETNVQGEEQKKLDVLSNEVFVNALVSSGRTCVLVSEEDEKVTFVDPKLRGKYCVCFDPLDGSSNIDCGVSIGTIFGIYMIKNQDTVTLEEVLQPGKDMIAAGYCMYGSSCTLVLSTGNGVNGFTLDPSLGEFIMTHPDIKIPPKGKIYSVNEGNAKNWDTPTAKYVEKCKYPTDGSSPKSLRYIGSMVADVHRTLLYGGIFLYPADKKSPSGKLRVMYEVFPMSFLXMEEAGGQSFTGKGRSLGTXSPPTSTEKSPIFLGSXRTDVEEIKGTVTRRRPKKAGSA

SEQ ID NO: 2737 - protein, 445 aa, Clostridium acetobutylicum ATCC 824
MEEINAKVVTKVPGPKSRELLKKREKYVAKGVSCSYPVFVEEAKGALVKDIDGNVFVDFAGGIGVQNIGHRDDGVVEAVKEQLDKYIHACFHVNMYEPYVDLAEKLTEITPGNFAKKAMFANSGAEAVENAIKIARAYTKKSGIISMNGSFHGRTNMTMSITSKYKPYKNGFGPFVCETYKADYAYCYRCPLGCKFKDCGIACAEKLKTMLKTVVSPDMIACLIVEPVQGEGGFVVPPKDYFKALQQICNENNIVFIVDEVQAGFARTGKFFAHEYFDVDADIITMSKSIANGLPISAVVGKAEIMDAACVGGIGGTYGGNPLSCVAAIKVIDKIKEANLNEKSIELGKSIMNRLNEMKEKYNVIGDVRGLGAMIGVEFVKDKDTKEPNKEIVSSILDYCFKHGVIFLNAGLLGNVLRFLPPVVMTDEQLKYGLDTLEEAIRIAI

SEQ ID NO: 2738 - protein, 349 aa, Symplocarpus foetidus
MMKSQLVGTALRHLGQYLFSSSVPAARAAEPVRTLLNEGLVQTPTGPVAVWLLRLPGAASLRSVSTLSAPLAVAGEEKEGKKAEVAAPKAGARVEDKAVVSHWGIPPSKATKEDGSEWRWSCFRPWETYEADLSIDLKKHHAPTTFLDKLAFWTVKSLRYPTDVFFQRRYGCRAMMLETVAAVPGMVGGLLLHLKSLRRFEHSGGWIKTLLNEAENERMHLMTFMEVSEPRWYERALVLAVQGVFFNAYFLGYLLSPKFAHRVVGYLEEEAIHSYTEFIKEIDNGTIENVPAPAIALDYWRLPQGSTLRDVVMVVRADEAHHRDVNHFASDIHYQGHELKKSPAPLGYH

SEQ ID NO: 2739 - protein, 201 aa, Ashbya gossypii ATCC 10895
MQEETEFEQFEENDPRINYKVRAKKTLEEYKQLDAEDESLAKWKESLGLSSDVLPLEFPGDTRKVVIKAIQLLVDTDAEPITFDLSTEESIKELASKRYKIREKSVYKLKITFKVQHEIITGLRYVQYIKKAGIAVDKIDDHLGSYAPNTAKKPVYEVELPESEAPSGFLARGNYNAVSKFIDDDQANHLTLNWSVEIVKK

SEQ ID NO: 2740 - protein, 494 aa, Acinetobacter sp. ADP1
MKNPVTFSQRLLRRKPINFLVQETQQGGKTLKRSLTLFQLTMFGVGATIGTGIFFVLSEQVPVAGPAVLISFILAGITAGLTALCYAELSSMIPASGSSYSYAYATLGEGVAFLVAACLILEYGVSAAAVAIGWSEYLNNLIHNVFGVHLPNWLLSAPFVADGYKLHLGGTGLINLPAAILVFLCCMLLMRGVTESARINAVMVLIKLCVLILFISIAATAFNAEHLTPFSPHGFAGISAAAGSIFFTFIGLDAVSTAGEEVENPRRNLPLAIISALFVVIIFYILVALTALGAQEQGLFKGQQAGLAVILQEITGSTWPAIILAAGAVISVFSITLVVLYGQTRILFAMSRDGLAPKIFHRVSTQTLTPNANTLIVAVIVSIIAGFVPADVLWDLTSMGTLIAFTVVSIGVLVLRYRMPDAPRGFKVPFFPALPVLSICACLYLISSLSAIVYVIAAIWAVIAATYYFSCASKNSVLEAGSEAYSHQNGDDHQ

SEQ ID NO: 2741 - protein, 142 aa, Thiobacillus denitrificans ATCC 25259
MAVQRTFSIIKPDAVAKNVIGKIVSRFETNGLKVVASKMKHLSRQEAEGFYAVHKDRPFFKDLVDFMVSGPVVLQVLEGEDAIAKNRTLMGATDPKKAEPGTIRADFAESIDANAVHGSDAPETAAVEIAYFFPASEVYAGR

SEQ ID NO: 2742 - protein, 529 aa, Blastopirellula marina DSM 3645
MTMTAPAPDHNSDASRISDEKILVLDFGSQYAQLIARRVREQNVYCEIVRHDISVERIAAHNPRGIILSGGPSSVYEEGAPQCDPGIFAMGIPVLGICYGMQLICQAFGGQVKNTSQREYGHAKISISPNEDLFGGLPSETDVWMSHGDQVTNVTESFEPLASTSTCPIAAMRHKELPLYAMQFHPEVTHTPLGFQILRNFVISVCDCEGLWKLHDFAQQTIAEIRERVGDNRVICGLSGGVDSAVVAALLYQAIGPQLSCILVDNGLLRKQEAESVIAEFTKHFKTDLHVVDAKDQFLKELAGITEPQEKRRRIGYQFVECFKAEALKIKDAKFLAQGTLYPDVIESGAALDGPAATIKLHHNVGGLPKELGFELIEPLRDLFKDEVRKLGLELGLPEDLVWRHPFPGPGLAVRCLSDITEEKLSVLREADSIVVSEIKAAGLYRQTSQAFAVLLPVQSVGVMGDARTYENAVAVRCVNTDDFMTATWSYLPYEVLARISTRIINEVKGVNRVCYDISTKPPATIEWE

SEQ ID NO: 2743 - protein, 372 aa, Thiobacillus denitrificans ATCC 25259
MPQNLLDFDLAGLTAWFGERGEKPFRARQVFHWIHQAGVTDFAQMTDIAKSLREKLQNEAVVQAPAINFAHLSADGTRKWLFDVGVGNGIETVFIPEDDRGTLCVSSQVGCALECTFCSTGRQGFNRNLTVAEIVGQLWVAQHSLKREPNRTASDHGAGEIAERPVTNVVMMGMGEPLANFENVVTALGVMLDDHAYGLSRRRVTVSTSGLVPAMDRLAERCPVALAVSLHAPNDALRDQIVPINRKYPLAELMAACRRYLVHAPRDFITFEYVMLAGVNDQPEHARQLIALTRDVPCKFNLIPFNPFPDSGYEKPRAEAMRVFREILQDAGYVVTTRKTRGDDIDAACGQLAGRVADRSGRVMKRVHREAA

SEQ ID NO: 2744 - protein, 403 aa, Acinetobacter sp. ADP1
MSIHHLNRQDFNQFMVPVFAPAQFIPVRGQGSRLWDQDDKEYIDFAGGIAVNALGHAHPIAVNALIEQGQKLWHIGNGYTNEPVLALAKQLVDHTFADKVFFCNSGAEANEAALKLARKIGLSKNKSKIVAFNNAFHGRTLFTVTAGGQPKYSQDFAPLPAGIEHVAFNDLNAAAAVIDDQTCAVIVEPIQGEGGVLPADLEFLKGLRRLCDETGAVLIFDEVQTGVGRTGALYAYMNTGVVPDILTTAKALGGGFPIGAMITTDQYANVFVVGDHGTTYGGNPLACAVAGAVFNFINTADVLDGVKQRSQQFIDELEQLNHTYAVFQEIRGQGLLLGCVLRPEYAGKAKDIVTLAGAEGLLALIAGPNVVRFTPSLVISEQEISEGLQRFGRALSQFVAVHQ

SEQ ID NO: 2745 - protein, 552 aa, Oryza sativa (japonica cultivar-group)
MDSKPTRPHRRPPPLPSKTSGVWPVALLVVLCFAALPLFLALSRARPTLSDVSQMGVTVTVHDEDPAGTPPESSPANRDRLLGGLLSPDIGESACLSRYKSSLHRKPSPHSPSPYLVSRLRKYEALHRKCGPGTLFYKKSLMQLTSAYSMGLVECTYLVWTPCGGSHLGDRMLSMASAFLYALLTHRVFVVHVTDDMAGLFCEPFPAASWELPAGFLVHNLTQLGRGSEHSYANLLGAKKIKTDDPAGVRSESLPSYAYVHLEHDYQQSDQLFFCDDDQTVLAKVNWLILRSNLYFTPGLFLVPQFEDELRWMFPARDTVFHHIGRYLFHPSNKVWELITRYHTSYMAKFEENIGIQITTFAGSKVSSEEYFKQIVACTSQEKILPEIDPNATSSANEAALATTASKAVLVSSAQPSEYAEKLKAMYYEHATVTGEPVSVLQPAGAGKQAPNQKALVEMFLQSYCDVSVVSGRSTVGYVGHGLAGVKPWLLLTPTNRTASANPPCIQTTSMEPCFHAPPSYDCRAKKDGDLGAVLRHVRHCEDVGDGLKLYD

SEQ ID NO: 2746 - protein, 167 aa, Zea mays
MEYGQQGQRGHGATGHVDQYGNPVGGVEHGTGGMRHGTGTGGMGQLGEHGGAGMGGGQFQPAREEHKTGGILHRSGSSSSSSSEDDGMGGRRKKGIKEKIKEKLPGGHKDDQHATATTGGAYGQQGHTGSAYGQQGHTGGAYATGTEGTGEKKGIMDKIKEKLPGQH

SEQ ID NO: 2747 - protein, 152 aa, Prochlorococcus marinus str. MIT 9303
MAVERTFVAIKPDGVQRGLVGEILGRFERKGFKLVGLKQLAPSRELAGEHYGVHRERPFFAGLVDFITSGPVVAMVWEGDGVIASARKLIGATKPLEAEPGTIRGDLAVNIGRNVIHGSDGPDTAQFEINLWFSPEELNAWTPSDQSWRVES

SEQ ID NO: 2748 - protein, 469 aa, Escherichia coli O157:H7 EDL933
  misc_feature (222)..(222): Xaa can be any naturally occurring amino acid
  unsure (1)..(469): unsure at all Xaa locations
MSAEHVLTMLNEHEVKFVDLRFTDTKGKEQHVTIPAHQVNAEFFEEGKMFDGSSIGGWKGINESDMVLMPDASTAVIDPFFADSTLIIRCDILEPGTLQGYDRDPRSIAKRAEDYLRSTGIADTVLFGPEPEFFLFDDIRFGSSISGSHVAIDDIEGAWNSSTQYEGGNKGHRPAVKGGYFPVPPVDSAQDIRSEMCLVMEQMGLVVEAHHHEVATAGQNEXATRFNTMTKKADEIQIYKYVVHNVAHRFGKTATFMPKPMFGDNGSGMHCHMSLSKNGVNLFAGDKYAGLSEQALYYIGGVIKHAKAINALANPTTNSYKRLVPGYEAPVMLAYSARNRSASIRIPVVSSPKARRIEVRFPDPAANPYLCFAALLMAGLDGIKNKIHPGEAMDKNLYDLPPEEAKEIPQVAGSLEEALNELDLDREFLKAGGVFTDEAIDAYIALRREEDDRVRMTPHPVEFELYYSV

SEQ ID NO: 2749 - protein, 323 aa, Photorhabdus luminescens subsp. laumondii TTO1
MNLETIIKLTADDMAAVNETILSQLNSDVTLINQLGYYIISGGGKRIRPIIAILASRVLGYQGDKHITVAALIEFIHTATLLHDDVVDESDMRRGKATANAMFGNAASVLVGDFIYTRSFQMMTALNSMRVLKLMSEATNVIAEGEVLQLMNCNDPNISEDDYMRVIYSKTARLFEVAAHSSAILSNATPEQEMALQNYGRYLGTAFQLIDDLLDYNADSDTLGKNTGDDLNEGKPTLPLLHAMNHGTPEQSALIREAIEKGNGRHLLETVLTTMKQCGSLEYTRKRAEEEADKAIAALQALENSPYKQALVGLAHIAVQRLS

SEQ ID NO: 2750 - protein, 356 aa, Helianthus annuus
MRPMSLVHSCSIFTGSSFIKTTPINNKPTFKIHQRPTIRSTISAAIVEEEVVELQQKPKPTFNFNAYMLGKGNSVHKALDESIMIKNPPTIHEAMRYSLLAGGKRVRPILCIAACELVGGEEATAMPAACAVEMIHTMSLIHDDLPCMDNDDFRRGKPTNHKVYGEDVAVLAGDSLLAFAFEYVSSRTEGASPARVLAAIGELAKSIGTEGLVAGQVVDIASTGGQDIGLDQLEFIHIHKTAALLEASVVLGAILGGGSDAQVEKLRTFARCIGLLFQVVDDILDVTKSSEELGKTAGKDLLVDKTTYPKLLGLDKSRQFAEELLAEAKQQLEEFESQAAVAPLLALAEYIAYRQN

SEQ ID NO: 2751 - protein, 322 aa, Bartonella sp.
TYIDGDKGLLLYRGYPIDQLAEKGDFLESCYLLLYGELPTKQEKNDFDRCIMQHTMVHEQFARFFHGFRRDSHPMAVMVACLGAMSAFYHDSIDITDPQQRMIASVRLISKVPTLAAMAYKYSIGQAFVYPRNDLSYAANFLRMCFSVPCEEYKTNPVLTRAMDQIFILHADHEQNASTSTVRLAGSSGANPFACIAAGVACLSGPAHGGANEACLKMLQEIGSVKRIPEFIARAKDKNDPFRLMGFGHRVYKNYDPRAKIMQKTCHKVLKELNIQDDPLLDIAIELEKIALNDEYFVEKKLYPNVDFYSGITLKALGFPTE

SEQ ID NO: 2752 - protein, 128 aa, Erwinia carotovora subsp. atroseptica SCRI1043
MSRTISTEHAPAAIGPYVQGVDLGSMIITSGQIPVNPKSGLVADNITAQTRQSLENVQAIVEAAGLKVSDIVKTTVFVKDLHDFTLVNTAYEAFFNEHGAPFPARSCVEVARLPKDVKIEIEAIAVRR

SEQ ID NO: 2753 - protein, 334 aa, Photorhabdus luminescens subsp. laumondii TTO1
MKTLGEFIVEKQQDFSHATGELTALLSAIKLGAKIIHRDINKAGLVDILGTSGVSNVQGEVQMKLDLYANEKLKAALKARGEVAGIASEEEDDIVIFEGDRAENAKYVVLMDPLDGSSNIDVNVSVGTIFSIYRRITPIGQPVTEKDFLQPGHRQVAAGYVVYGSSTMLVYTTGCGVHAFTYDPSLGVFCLSHEKVQFPPNGNMYSINEGNYIKFPMGVKKYIKYCQEQDEATQRPYTTRYIGSLVADFHRNLLKGGIYIYPSTASHPSGKLRLLYECNPMAFLAEQAGGKASDGANRILDITPSKLHQRVPFFVGSKSMVEKAESFMAEFPDE

SEQ ID NO: 2754 - protein, 227 aa, Clostridium acetobutylicum ATCC 824
MAKDNLKKISAKKALEYIKDNTVIGLGGGETIGYLCDYLKEKIKSGFNIKVVTPSIKTRNTCIENGIEVLYTSSVEHLDVAFDGCDQLDEKLNALKSCGGIHSKEKIIASMADKYILLTNESKFVKKLDSTYPIVLEILEESAGYVKRRISEIGGKATFRSSAAKDGFTITDSGNLLLDVFFDELGDAKELQKGLKGITGVVETSLFVDLVSQAIIAYEDDIKIISK

SEQ ID NO: 2755 - protein, 252 aa, Delftia acidovorans
MVDTNFKDHFSSGSAGYAAYRPTYPTELVDALANISPGLERALDCGCGTGQLSVLLAERFAEVVATDASAAQIDKAQPYDGVTYRAALAEESGLPDASVDLITVAQAAHWLDLDRFYAEVQRVARSQAAVALITYGVLHVEGAVDGAIQRFYYDTIGPYWPTERRHVEDGYRSLPFPFKEVALPPLAIEVQWRLDDLIGYLNTWSAVKAAEKALGSNPVDALAETLHKEWGDPALRHRVTWPLSVRAGHVQK

SEQ ID NO: 2756 - protein, 139 aa, Solibacter usitatus Ellin6076
MSVERTFSIIKPDAVKAGQAGEILAMIQKAGFKIIGLRMTRLTELQAGGFYAVHKERPFYQGLVKFMTEGPIIVMALEREDAVKGLREVMGATNPANAAEGTIRKKFAENIERNCIHGSDAPETAAVELAFFFSSAELL

SEQ ID NO: 2757 - protein, 994 aa, Candida albicans SC5314
MAPSQEQSKEQIQSQTSKDQQPTKSDKSKVQKEEELSEEDQHLKDELELLVERLNEPNQDRALYNKYLDALKTFIKESTTSMTAVPKPLKFLRPHYPSLTELYTNWSNQFSAKDVIVIKLADILSVLATTYSDEGNRDSLKYRLLASDDTISDWGHEYMRHLALEIGESFQENLGVDEELVNKLVKLALQIVPFFLKHNAEADAVDLLLEIECIDKLPQFVDENTFARVCLYVTSCVPYLAPPDDVSFLNTAYSIYLSHNQLTQALTLAIKLDDNELIKQVFDSTTDESLHKQLGFILSQQNSNFKYPGENPEVQECISNVKLAEYFQYLVKELNLLDPKVPEDVYKSHLENSKFGLGTSGSIDSAKQNLAASFVNGFLNLGFGNDKLVQTEEDNKSWIYRTKGSGMASTTASLGSIHQWNINEGLQVLDKYTYSEDSEVKAGALLGTGVVSANVHDEVDAAFALLQEYVHEPNKLYQTAAINGLGIAFAGSANEDVLNLLLPLVSDLDISLEISCLAALALGHIFVGTCHGDVTSTILQTLLERDYTQLTNKFIKFMSLGLGLLYMGRTEQAEDVLETIDAIEHPISKTLKVLVNICAFAGTGNVLQIQALLQMCTAKPKDQLEEEKKLEQSEEEQQQQQQNKDTKSNGEGGEEEEDVEMEDAESKNETSENTTASATSTTSSSKEKGDSSSSAAAAAAAGDEKAQEGGDDKEDEEEIDEEEELYQGIAVLGLACIAMGEDIGQDMSLRHFGHLMHYGNSLIRRAVPLAMGLVSTSNPQMKVFETLSRYSHDPDLEVAQNSIYSMGLVGAGTNNARLAQLLRQLASYYIKSPDTLFMVRIAQGILHLGKGTLTLTPYNSERTILSKVSLASLLTIAIALLDPRSFILNDSTTETTHQLLYYLTPAVKPRMLVTVDEELKPIKVNVRVGQAVDVVGQAGKPKTITGWVTQSTPVLLNYGERAELENTDEWISLSSSLEGVVILKKNPEYMEIDS

SEQ ID NO: 2758 - protein, 265 aa, Bacillus clausii KSM-K16
MNKKKVMLTLSVVMVAFVLAACNTNEPITAESTGFWNSFFVYPMSFLITFFSDLTGGHFGWGIIIVTILIRLLILPLALKSQKSTRAMQVLRPEMQEIQEKMKKAQGNPEKQREVQAEMLSLYQKHGVNPAAGCLPALVQIPIVMALYFAIMRTEEIGVGPASAFLWFNLGSPDYILPVIAGITTFVQFKMSMSQMPANPLGEGMPNPMNIMLYIMPVMIVIAGITLPSALALYWVVGNLFMIVQTYFIIVRPNMTKEEVQKDKA

SEQ ID NO: 2759 - protein, 1414 aa, Penicillium digitatum
MDGSEKGPGASSDDIQFDTESAMTITGEETPDKESSNLKGNDWRMMTKLQDDNDRNLAAGFKKQELGITWRDLSVQVTSSEAAVNETVLSQFNFPTIIKESRRKLPLRTILNKSHGCVKPGEMLLVLGRPGSGCTTLLKILANRRGGFKSVEGDVRFGSMQPKEAENFRGQIVMNTEEEIFFPSLTVGQTMDFATRLKVPFHLPDGMTALEYQEASKKFLLESVGISHTEDTKVGNEYVRGVSGGERKRVSIIECMATRGSVFCWDQSTRGLDASTALEWTKAIRAMTDTLNLSTVVTLYQAGNGIYDLFDKVLVLDEGEQIFYGTREQARPFMEDAGFICREGSNIADYLTGVTVPTERRIRDGFESRFPRNAEAVRAEYEKSPIYTQMIAEYSYPESDLARERTEEFKQGVAFETSKNLPKNSPFTVGFVDQVKICVQRQYQILWGDKGTFIIKQVATLCQALIAGSLFYNAPDNSGGLFVKSGALFFSLLYNSLLAMSEVNESFSGRPVLIKHKGFAYFHPAAFCLAQIAADIPVLLFQISMFGLVIYFMVGLSMSAGAFFSYWIIVFTTTMAMTALFRAVGALFSTFDGASKVSGSLIMFTVLYTGYMIPKPTMHPWLGWIFWIDPLAYGFEALLSIEFHDKTFIPCVGKNLIPTGPGYENAQAHQACAGVAGAISGQNFVVGDNYLASLSYSHSHVWRNFGINWAWWVLFVAVTMVATSNWQTPSESGSTLVIPREYLHKHVQNQQKDEEGQSLGKHVSQTKDEAPKSDNKLVRNTSVFTWKNLSYTVQTPSGDRLLLDNVHGWVKPGMLGALMGSSGAGKTTLLDVLAQRKTEGTIKGSIMVDGRPLPVSFQRSAGYVEQLDIHERMATVRESLEFSALLRQPATIPREEKLAYVDVIIDLLELHDLADSMIGSVGAGLSVEQRKRVTIGVELVSKPSILIFLDEPTSGLDGQSAYNTVRFLRRLADAGQAVLVTVHQPSAQLFAEFDQLLLLAKGGKTVYFGPIGENSQDIKSYFSRYGAPCPSETNPAEHMIDVVSGQLSQGRDWNKVWMESPEHSAMLKELDEIIETAASKPQATTDDGREFACTLWEQTSLVLKRTSTALYRNSDYINNKFALHISSGLVVGFSFWKIGDSVADLQSVLFFVFNAIFVAPGVINQLQPTFLERRDLFEAREKKAKMYSWKAFTIALIVSEFPYLVVCAALFFNCWYWTAGMTVDSSKSGSMFFVFFLYEFLYTGIGQFIAAYAPNAQMAAMTNPLILGTMISFCGVLVPYAQIVSFWRYWMYWINPFNYLMGSLLVFGLFDREVHCKEQEFAKFDAPNGTTCGEYLSEFMQTIGARMNLTNPEATEGCRVCEYTRGSDYLFTINLKDYYYGWRDAGIVALFVVSSYGLVFGLMKLRTKASKTAQ

SEQ ID NO: 2760 - protein, 151 aa, Cucumis sativus
MLVVGCVAYRYKTTKKSTLDNIEELEVLVISSQKGKGMLFPKGGWETDESITEAASRETLEEAGVRGIVQGELGSWSFKSKTYDTFYEGYMFPLLVKEQLEFWPEKNFRQRVWMSAHEAREVCQHWWMKEALDILVGRLSSQKKQHIPPPT

SEQ ID NO: 2761 - protein, 321 aa, Bartonella sp.
YIDGNAGVLLYRGYPIDQLAEKGDFLESCYLLLYGELPTKQEKNDFDRCIMQHTMVHEQFARFFHGFRRDSHPMAVMVACLGAMSALYHDSIDITDPQQRMIASVRLISKVPTLAAMAYKYSIGQAFIYPRNDLSYAANFLRMCFSVPCEEYKTNPVLTRAMDRIFILHADHEQNASTSTVRLAGSSGANPFACIAAGVACLWGPAHGGANEACLKMLQEIGSVERIPEFIARAKDKNDPFRLMGFGHRVYKNYDPRAKIMQKTCHEVLKELNIQDDPLLDIAIELEKIALNDEYFVEKKLYPNVDFYSGITLKALGFPTE

SEQ ID NO: 2762 - protein, 358 aa, Acinetobacter sp. ADP1
MTKVKGAFTELPVINIQGLNSENLAERQAVADAIGQASRKVGFFYITGHGIAPELIAGVRAAAKKFFALPMQEKMNYYIGQSKSHKGYVPEGEEIYGSGKPDLKEAFDVGFQAPEDHPFVVSKTPLIGANEWPELAEFKSQVLDYYQAVFALGHRLFDAFALALGLPEGYFKSMVTCPPSKLRLIHYPFDATAEDKPGIGAHTDYECFTLLLADQPGLEVLNEDRVWIDAPPSKDINGEEAFVINIGDMLEVLSAGTFIATAHRVRKVPQERYSFPLFFACDYHTLIRPLPHFLKANEADQYKELSIGEHMWSQALQTYRYLREKVAKGELQLSERARATHTFGHLKQQAKQKTTSNL

SEQ ID NO: 2763 - protein, 361 aa, Cucumis sativus
MDSWHSYDYLAGLNPIPAPKQDIIDPSLAKPASHGKSKNNSGVIAGVVCGAVVLALIIGFFVFAKRRRGRGKDSSTVEGPSGWLPLSLYGNSHSAGSAKTNTTGSYTSSLPSNLCRHFSFSEIKSATRDFDESLLLGVGGFGKVYNGEIDGGTTKVAIKRGNPLSEQGVHEFQTEIEMLSKLRHRHLVSLIGYCEENCEMILVYDYMAHGTLREHLYKTHKPPLSWRQRLEICIGAARGLHYLHTGAKHTIIHRDVKTTYILLDEKWVAKVSDFGLSKTGPTLDHTHVSTVVKGSFGYLDPEYFRRQQLTDKSDVYSFGVVLFEVLCARPALNPTLPKEQVSLAERAAHCYNKGILDQIIV

SEQ ID NO: 2764 - protein, 516 aa, Francisella tularensis subsp. tularensis SCHU S4
MTDIHNHKILILDFGSQYTQLIARRVREVGVFCEIFPHDVAADFIKNYQAKGIILSGGPESVYDSDVKAPEIVFELGVPVLGICYGMQTMVMQHGGEVKGADQSEFGKAIINILNSTNNIFSNMEHEQLVWMSHSDKVTQTGEHFEIIASSTNAPVAAVAHKNKPFFGVQFHPETTHTENGKQIIENFVVNICGCDTLWNIENIIENDIKEIKQKVGTDKVILGLSGGVDSSVVAAILHQAIGDQLTCIFVDTGLLRLNEGDQVMQVFAEHMDINVIRINAKNRFLDALRGICDPEQKRKIIGKLFVDIFDEEAAKIENAKWLAQGTIYSDVIESAGNNQSKAHVIKSHHNVGGLPKEMKLKLLEPLRELFKDEVRKLGLGLGLPYNMLYRHPFPGPGLGVRILGEIKKEYVETLQKADAIFTEELYKHNLYHDVSQAFGVFLPVKSVGVVGDQRRYEYVIALRAVVSIDFMTATWANLPYDFLSLVSNRIVNEVKQVSRVVYDVTGKPPGTIEWE

SEQ ID NO: 2765 - protein, 515 aa, Thalassiosira pseudonana
MRAVWALLWALQLGTLVGCALVLGVHHFSGDNLTKQSAIPTKSSKAKPISDQKAAVTSGSTCAVREKARKDGLVLLDGNWYNVEKFVHHHPGGVEVLEQYLGADISFVFRVMHRNPTQIMKYRKPVRAATPEELEALTSRRQEVCLDMMDDFVTNSIDIASPEMLPKPTQFDLKSFEKDFIDLYEEFVAQGYFKPSTTWLLWNTAVLISIIALSVISMKVLPPTSFVLPGALLGLFWHQSGFLMHDAEHHNLAGNERLNDILGWIYGTVFLGVNGAWWREEHREHHAFLNTYDDESGFKDPQMREDVWIQNKKLIPFFGDEIIHFLTNFQHILFLPIIFIVGRVGIVVDSTLTERKFRPWTILGNVCHILLHYAILSQTSRPIPVYIIGSLWQAILSLQLLGNHYVKPWNRLNDATEGNFCVWQILSTQDFACPRWSRWLYGGLNFHYSHHLFPTLSREYFHITSPRIRRLCEKHGLPFIEIAFIDCVVGMVNNFNEVRKDFATKGHGSVAFMYT

SEQ ID NO: 2766 - protein, 300 aa, Escherichia coli O157:H7 EDL933
MTMIRVACVGITVMDRIYYVEGLPTESGKYVARNYTEVGGGPAATAAVAAARLGAQVDFIGRVGDDDTGNSLLAELESWGVNTRYTKRYKQAKSSQSAIMVDAKGERIIINYPSPDLLPDAEWLEEIDFSQWDVVLADVRWHDGAKKAFTLARQAGVMTVLDGDITPQDISELVALSDHAAFSEPGLARLTGVKEMASALKQAQTLTNGHVYVTQGSAGCDWLENGGRQHQPAFKVDVVDTTGAGDVFHGALAVVLATGGDLAESVRFASGVAASKCTRPGGRAGIPDCDQTRSFLSLFV

SEQ ID NO: 2767 - protein, 292 aa, Shewanella sp. MR-7
MTDMPSVTTPALDRYAVFGNPIGHSKSPFIHGQFASITQQPLSYEAILAPIDGFEASLRAFFQAGGKGANVTVPFKEQAFALCDSLSAEATLAGAVNTLSLLADGTIYGDNTDGLGLVADLIRHLGSLQHKRVLLVGAGGAARGCILPLLKAEVGQLVITNRTQSKAQALVEIFSQVQQGRYSDKLQSMPMPELSGEFDLVINSTSASLAGELPPLPQSIIGNKTACYDMMYGAKPTAFNQWAVQQDAAQVIDGLGMLVGQAAKSFALWRGVEPDTSGVLKLLRDKLQADAQ

SEQ ID NO: 2768 - protein, 272 aa, Brucella suis 1330
MITGHTKLYGIVANPIAHVKTPEEVNKHFAALGHDGVLVPFHVLPENLAQFVNSLRKLENPGGLVVTVPHKTAILSLCDRLEGDAAAIGAANVIRRESDGTLVGVMLDGKGFVSGLVASDIDVTGMNACLFGAGGAASAIAFALAEAGVARLTIVNRSEDKARDLAARVSERYPAVQIDAGAPQTASRDLIINATSLGLRAGDPLPLDDLAFHAGQIVAEVIMEPEVTPLLAAARDKGARIHFGRPMLRQQIRLMAEHMGAKANADVQKPTE

SEQ ID NO: 2769 - protein, 772 aa, Medicago truncatula
MLETVQEIAVYLHRFHNLDLFKQGWYRIKIKVRWEDSENINSFGIPARVVQYEAPDLDQSSIYGAWKIDDTENSFSTQTFRIKYARQDVHLCMMISFDLSRSRSMDLTTNGVILKFELIYASTLEDGDDLDASPAAIHEFRIPPKALLGLHSYCPVHFDALHAVLVDVSVHVSLRRAASYSSASKVPRRMFFVPVQRFRGVTSLDVKDIMLVRALLTSRDLLLEELHKMNKAIGEAIDTSDFVSKMNNADLINFAAQANGFAIDGEVLEQGKPQNGLEGGNGAQDIPNAENLHSLSQSELLNCFHSLGDQLHYLWKIFLKIHRENKTEILGLLHNTWAKDRKAEWSIWMIYSKVEMPHHYINSGSDDSSRRAMHKRVSSLWKLPDEPLETAISCAELHRRSIAQMRINGRSIQDMQIFGDPLRIPVVLVERVMNVPRRSTSEIPLLGHVGLVDSHSLTNGLGSHTFRKKSAPKSNVRVLKIVVFVHGFQACLENFIAKLYTVFYGHHLDLRLVRNQWLLIDPKVEFLMSEANEDKTNGDFKEMGHRLAQEVISFVKSKMDRVTRYGKLGDIKLSFVGHSMGNLIIRTAIADKMMQPYLRHLHTYVSVSGPHLGYLYSSNSLFNSGMWFLKKLKNTQCIHQLSCTDDPDLQKTFLYKLCKKKTLEHFRNVILISSPQDGYVPYHSARIESCQAASHDTSKKGKMFLEMLNACLDQIRANPSEHRVFMRCDVNFDASAHGKNLNSFIGRAAHIEFLDSDIFAMFIMWSFPDLFR

SEQ ID NO: 2770 - protein, 688 aa, Escherichia coli CFT073
MINANWKIFLPPNYKPATECYMSRKDLANAIRALSMDAVQKANSGHPGAPMGMADIAEVLWNDFLKHNPTDPTWYDRDRFILSNGHASMLLYSLLHLTGYDLPLEELKNFRQLHSKTPGHPEIGYTPGVETTTGPLGQGLANAVGLAIAERTLAAQFNQPDHEIVDHFTYVFMGDGCLMEGISHEVCSLAGTLGLGKLIGFYDHNGISIDGETEGWFTDDTAKRFEAYHWHVIHEIDGHDPQAVKEAILEAQSVKDKPSLIICRTVIGFGSPNKAGKEEAHGAPLGEEEVALARQKLGWHHPPFEIPKEIYHAWDAREKGEKAQQSWNEKFAAYKKAHPQLAEEFTRRMSGGLPKDWEKTTQKYINELQANPAKIATRKASQNTLNAYGPMLPELLGGSADLAPSNLTIWKGSVSLKEDPAGNYIHYGVREFGMTAIANGIAHHGGFVPYTATFLMFVEYARNAARMAALMKARQIMVYTHDSIGLGEDGPTHQAVEQLASLRLTPNFSTWRPCDQVEAAVGWKLAVERHNGPTALILSRQNLAQVERTPDQVKEIARGGYVLKDSGGKPDIILIATGSEMEITLQAAEKLAGEGRNVRVVSLPSTDIFDAQDEKYRESVLPSNVSARVAVEAGIADYWYKYVGLKGAIVGMTGYGESAPADKLFPFFGFTAENIVAKAHKVLGVKGA

SEQ ID NO: 2771 - protein, 226 aa, Rhizobium leguminosarum bv. viciae 3841
MQAKDIMTTNVVSIGPAVGIRHAVAVMMQNNVSGLPVIDDEGRVCGLLTEGDLLLRREIRFAPRAARAPEIISEIDLERYISSNGWCVADVMSQDVIVASPDSEVSDIAESLQAHRIKRLPIVEDGRLVGIVSRRDILGLIIDAQTPPLPKEDESIRLAVRTRLRSDLGITPQKVQVTVKNGQVTLDGNVESELKQKAVRTLVESLGVGAYRDRLQIARLTGTEVG

SEQ ID NO: 2772 - protein, 470 aa, Mycobacterium bovis AF2122/97
MTLSSGEPSAVGGRHRVVIIGSGFGGLNAAKALKRADVDITLISKTTTHLFQPLLYQVATGILSEGDIAPTTRLILRRQKNVRVLLGEVNAIDLKAQTVTSKLMDMTTVTPYDSLIVAAGAQQSYFGNDEFATFAPGMKTIDDALELRGRILGAFEAAEVSTDHAERERRLTFVVVGAGPTGVEVAGQIVELAERTLAGAFRTITPSECRVILLDAAPAVLPPMGPKLGLKAQRRLEKMDAEVQLNAMVTAVDYKGITIKEKDGGERRIECACKVWAAGVAASPLGKMIAEGSDGTEIDRAGRVIVEPDLTVKGHPNVFVVGDLMFVPGVPGVAQGAIQGARYATTVIKHMVKGNDDPANRKPFHYFNKGSMATISRHSAVAQVGKLEFAGYFAWLAWLVLHLVYLVGYRNRIAALFAWGISFMGRARGQMAITSQMIYARLVMTLMEQQAQGALAAAEQAEHAEQEAAG

SEQ ID NO: 2773 - protein, 233 aa, Gibberella zeae PH-1
MPRPKKSSSTEITIHVYDLLPPGRLSSVLWTVGASLLHSGVVINGKEYAYGGHDKRGLTGVYWTKPKTEPPGGTFRCEILHGFTLATEQEIEATLRAASDEFLGTSYNLLTKNCNHFTSYLCKRLTGQSGPGWLNRAASIGVALPCVVPRDWIEPPEYDTSEGALLDDYDNSNETTGMLKSTNPHLLTDSNDDSGDDDWNSEDERRRGGSGKGKQALRDTAGRRLPPAERALR

SEQ ID NO: 2774 - protein, 610 aa, Francisella tularensis subsp. tularensis SCHU S4
MWAIVGSSGFESFDDFEIIEELPRETPFGLCSNGLFKIKVEDKEVLFLNRTGLGQNILPHQINYKANIYALKKYGATSIIALSSVRSLREELKPGDMVIPYQFIDRTKSLREFTFCEQGLLNYVSLSKPITESIAEEIRAKKKEFDFEIHFKQSYVCIEGPQFPTIIDAKCFQSMGGGVIGMTAFPEFALAREAGLNYISCNFIVDYVPWSYDVRNLYNVLEIRETNNLKAEKLVKWLVNNLPFYAENDCHELGIARYLSTPIESLPPNKKAWLKVIAKDNSEHEEALEAEILKKVPDLYGGIKTIPAKLQDLLTFIGKYDREGNRKDLEATRKAAASLDLYSYPKVDLENVEDIQITHDDGHNIPVRVYNPKVDEKLKVIIFSHGGGFVSGTLDSFDAFCRKLALTTNRVVFSVDYRLAPEHKFPAGLNDVEFVAEHIFKHSKKFGVSKKKFTLMGDSAGANLTVLATYNLLQKDTVKIANNIILYPSVDLSHMPTKSLEDFASGYILTKAKTMWYSELYVPENIDKRSPEVSPFYIKELDNMPRTLVMTVGYDPLRDEGLLFAERLLRHDVEVQHYHFDSLVHGFINFSKLIPKEMDVLHSRVVKFLG

SEQ ID NO: 2775 - protein, 119 aa, Zea mays
MAVSSGMVFSVRPPAPARPCACSATARARPVGDGAKWWAPLLGWSGQPDYIDARPASEDEPLPRGPASASASARRFGVLTEDKARRLRVQMMETESFHDAMYHSAIASRLASAAPDARP

SEQ ID NO: 2776 - protein, 426 aa, Brucella melitensis 16M
MGYFPSWRLTSNAVVLPDERLPAAAAVPMGIQHLLAMSGSTIVAPLLMGFDPNVAVFFSGIGTLLFFLITAGRVPSYLGSSFAFIAVVIAATGYSGSGPNPNIAIALGGIIACGALYSLIGLIVMFLGTGWVEKLMPPAVTGAIGVSIGLNLAPVAIGQLKGTGAHTSIALLTVLCMAMISAYGPRGTRRLSVLFALLFGYLLVLIAGNGLGIVPGIDFTAVKNAAWFGLPHFTTPAFNWQAVTLIAPVAIVLVAENLGHIKALGSITGRNMDGYIGRGFFSDGLATMISGAGGGTGVTTYAENIGVMAMTKVYSTLIFVIAAIMALILGMSPKFGAILQTIPAPVLAGLAVSVFGLIASAMARIWIVNKVDFADSRNLFTVGVALIFGAGDFTLNIGNFALGGIATSTLAALVLYQLLGIGRSDS

SEQ ID NO: 2777 - protein, 476 aa, Brucella suis 1330
MYPNLTLIVGGEERNKGSAGTLCLTDPADGRELTIAPRAGRAEALQAAAAEKGFAEWSALSALERSKIMRRAADIMRERADAAARIMSMEQGKPLAEARGEWLGSADLLDWFAEEGRRVYGRIVPSRAPNIQIQVLKHPIGPVAAFTPWNFPAWNTMQKVAPALGAGCSVVIKPASDTPGTAWLIGKCLLEAGLPPKAVSVIWGTTSELSDALIKAPEFRKVSLTGSTRVGRIVAAQAGEYLKKVTMELGGHGPVIVAADADLDHLIPLAVQWKFRNCGQVCVSPTRFIVEASIHDEFIRRFSEKARELKVGKGVEEGTQMGPLTSQNQLETVLSMVEDALTKGAKIETGGNRIGDTGNFYEPTILSGMTAEMLAMNEEPFGPLALVMRVHSLDEAIAESNRLPVGLGAYLFTSSMTTAHRVQNHLQAGMLGVNHFALALPETPFGGVRDSGFGSEGGLEGIEAYLTTMTVTTMMV

SEQ ID NO: 2778 - protein, 514 aa, Shewanella sp. MR-7
MTTTKRPIALLILDGWGYRENTHMNAIYHANTPVLDRLNAQYAHGLISGSGLDVGLPDGQMGNSEVGHINLGSGRIVYQELTRISKAIADHEFEQNPALCDAVDAAVKAGGAVHIMGLLSPGGVHSHEEHIEAMCRMAVARGATKVYLHAFLDGRDTPPRSAKGSLSHFDDLFTTLGHGRIASIIGRYFAMDRDNRWDRVSQAYDLITQGKAKFQYDNAVTALEAAYERNENDEFVSSSAITDSEGKVASLNDGDALIFMNFRADRARQITRSFINADFDGFERAVTPKVNFVTLTEYAADIKAPIAYPSENLVNTLGEVLQNRGRTQLRISETEKYAHVTFFFNGGKEEPFNGEDRILINSPKVATYDLQPEMSSTELTDKLVAAIESAQYDVIICNYPNGDMVGHTGNFDAAVKACEAVDACIGRVVDALAKVGGECIITADHGNAEQMTDETTGQAHTAHTSELVPFVFVGRDATIDEGGKLSDVAPTILHLMGETIPAEMTGKPLIHVKE

SEQ ID NO: 2779 - protein, 375 aa, Brucella suis 1330
MKFKAAVLDRHGVERPYNQTKPLVIREIELREPKADEVLVKLAASGLCHSDLSVINGDRSRQIPMVLGHEAAGVVEKIGEGVTDLVPGDHVVCVFVPNCGHCQPCAEGRPALCEPGAAANGKGEMLSGGLRLFCDDGDVYHHCGVSAYAEYAVMSRYSIIRIEKDIPLHIAALMGCAVLTGTGSIFNTGLVKPGSRVAIAGLGGVGLAAVMGAVAAGATEIIALDMFDDKLALAEQLGATKTFNVQSEGVVEAVKEYTKGGVDAAFEYAGSGAALAMCYALTKRGGEVVTAGLPNPKNMLSIPAVSLVAEEKSIRGSYLGSGVPTRDIPLFLDLYRKGKLPVEKLLTHRIKLEEINEGFERLAAGKAIRQVVEFN

SEQ ID NO: 2780 - protein, 510 aa, Zea mays
MATAMGAMAATCMASMPAAATFPGDLGVGRRRAAVPGWRAGGRRLRATPPARRPFLFSPKGVSDSRSSQTCLDPDASTSVLGIILGGGAGTRLYPLTKKRAKPAVPLGANYRLIDIPVSNCLNSNVSKIYVLTQFNSASLNRHLSRAYGNNIAGYKNEGFVEVLAAQQSPENPNWFQGTADAVRQYMWLFEEHNIMEFLILAGDHLYRMDYQKFIQAHRETDADITVAALPMDEQRATAFGLMKIDDEGRIVEFAEKPKGEKLRSMMVDTTILGLDPERAKELPYIASMGIYVFSKDVMLRLLRENFPAANDFGSEVIPGATEIGLRVQAYLYDGYWEDIGTIEAFYNANLGITKKPVPDFSFYDRFAPIYTQPRHLPPSKVLDADVTDSVIGEGCVIKNCKINHSVVGLRSCISEGAIIEDSLLMGADYYETEADKKLLAEKGGIPIGIGKNSCIRRAIIDKNARIGDNVKILNADNVQEAAMETDGYFIKGGIVTVIKDALLPSGTVI

SEQ ID NO: 2781 - protein, 453 aa, Brucella melitensis 16M
MNLFTSQFRNSQLLASKAHALIPGGCHTYAKGDDQYPVLAPGFIQRGSGAHVFDVDGHEYIEYGMGNRAVGLGHAYPPVVRAVREALQDGCNFTRPSAIELDCAESFLELIEGAEMVKFCKDGSDATSGALRLARAYTGRDMVACCADHPFFSTDDWFIGTTKMSAGIPASVSALTATFRYNDIASVEALFEDYPGCIAAIIMEPARADEPQDNFLHEAMRIAQENGALFILDEMITGFRWHMRGAQKLYGIVPDLSCFGKALGNGFAISALAGKAEYMRLGGLHHTDFPRVFLLSTTHGAETHAMAAAIATMAIYRDEPVIERLYEQGAKLAAGINEAIAGHRLQDHVRLSGRPCCLTYSTLDGNGMPSQAFRTLFLQETIRRGVLMPSLVVSYTHSDADIARTIDAVHGALGIYVRALNDGVESCLVGRPSQVVYRRFNEDPASSCPPPRL

SEQ ID NO: 2782 - protein, 424 aa, Aspergillus oryzae
MTEAHARKLAAELQGATREQAMAKVMEDADQNQLDASVVKITRSTNLRPVPEPGSPEELSHSYCTDHMVTARWTVANGWETPEVKPFENLSIPPTASCLHYATECFEGMKVYRGYDGKLRLFRPDCNGERLLSSAQRASLPSFRYEELKVLIAKLMQIDGPRWLPKDQPGRFLYLRPTMIGSGPHLGVQTPKEALLFIIAVPWPDPSKLKKPEEGTKPGLKLLASTPDTIRAWPGGFGYAKLGANYGPSLVAHGKAQAIGFDQILWLFGQDRQVTEAGASNFFIVWENKETGKIELVTAPLENQLILPGVTRRSVLQLARTELSKPTGSLAPVEVVERDFTISEVEQAWKEGRIIEAFVCGTAFFVTPVKLIRNGDVDMDMLEAGAARGGYAVQIKSWLEAIMYGKDGKENDEWSYIIEGESEK

SEQ ID NO: 2783 - protein, 568 aa, Medicago truncatula
MFHPNLIADLNLNHSLHNEEEENLSSEICTTNGFRFNINHDDDEENSCWESIFKFIINNDDDEENNRRNLNSLSIVSKQFLSITHRFRFSLNVYHPKELRSLKRYTNLNSLNLARYYNYHTDIDQFLRKISRFPLKLTSLNLSKQLTFPTNGLRVFSQKITTLTSLTCSHIDAYRSLNSSHLLLIAECFPLLEELDLSYPTYCNKNSSSFRDGIQALSLALFKLRKVNFSGCPINNQSLFHLLCNCKLLQDVIMFDCDQITNAGVTSALRERPTLTSLSFSTTPNNSVFNNIHFIDSLVSLKGLTSLDLKRLKISDELLYSIAREGLLLKRLVLQICTGYSYAGIICLVSNCQRLKHLDLQDAGFLNDIHVVNLSLFLSNLVSINLSGCPKLTKSALLTLARYCPSLGEIKMENIGTDCVENSDSLVDFGVYPQLKSLYLGENTWLSDESIIMFASIFPNLQLLDFNSCNRISKGVCEVLRRCSKIRHLNLSECSRVKLLGMNFAVPKLEVLDLSFTKVDDKTLYAISKNCCGLLQLLLEHCDNVKEKGVKHVVENCTQLREQDRLLY

SEQ ID NO: 2784 - protein, 438 aa, Triticum aestivum
  misc_feature (358)..(358): Xaa can be any naturally occurring amino acid
  misc_feature (367)..(367): Xaa can be any naturally occurring amino acid
  misc_feature (388)..(388): Xaa can be any naturally occurring amino acid
  misc_feature (392)..(392): Xaa can be any naturally occurring amino acid
  unsure (1)..(438): unsure at all Xaa locations
MASGKHFKYIVLGGGVSGGYAAREFAKQGVQPGELAIISKEAVAPYERPALSKAYLFPQSPARLPGFHVCVGSGGERLLPEWYSEKGIELILSTEIVKADLPSKTLTSAAGATFTYEILLIATGSSVIKLSDFGTQGADSNNILYLREIDDADNLYAAIQAKKGGKAVVVGGGYIGLELSAVLKMNDLDVTMVFPEPWCMPRLFTAEIAAFYETYYTNKGVKILKGTLAVGFDADANGDVTAVKLKDGTVLEADIVVVGVGGRPLTTLFKGQVAEEKGGIKTDASFETSVPGVYAIGDVATFPLKMYNELRRVEHVDHSRKSAEQAVKAIKGKEPGEQVPEYDYLPYFYPRLFDLAWXQFYGDNVGXTILFGDSDPLQQPKAGRRDKXEKKXFKCVGAFLEGGSPDEKPPIPKLGRAQPPAPNPEEFKAPGLQFPSKI

SEQ ID NO: 2785 - protein, 256 aa, Mycobacterium sp. KMS
MQVAIVTGASSGIGFGCATTLAEQGMAVLGTGRDEERLAELEKAVGSDRIATVAVDLTDDDGPARVVAAALERWGRIDFLVNNAGVGSPKPLHETDDESLDYFLNLMLRAPFRLSRDVIPHMQPGSAIINVTSTFAVVGGLRGGAYSAAKGGLTALTAHIACQYGAQGIRCNAVAPGVTLTPMVATRLEDERFRKINTEMTPHQRLGRVEDIAATVAFLCSEGGSFINGQTIVVDGGWSSTKYLSDFALNSDWVPR

SEQ ID NO: 2786 - protein, 652 aa, Gibberella zeae PH-1
MAFPHNKDDDVVAGDGPSAYDNYDSTRLNDTSEFGSIDPDSGVKRGLKNRHLSMMALAGIIGPGLLVGAGGALNVGGPAALLIGFGVVGIIAFCIMQSLGEVTTLYPGGGSFISLAERMVDKSFSVAVGWNYFVIWAAVLANEYNVICSILTYWGPVVPLWGYFLIFWTVFMAFQLLGVEAFGEAEFWLALMKLLGLTAYFIFAIIYAAGGLVGQDEPLGFRYWSDPGAFNGNGFRGVAAVFVFCATFYSGVESIAVAATETRNPGVAVPQAIRQVFWRIIFVYMGSALFFGITCPANASGLVNGGSKALQSPMTIAIENAGWQGGVHLINAFILLTCLSAINSSIYFGSRTVFYMAQSGKAPKIFAWTNKRGVPVWAILITNAVGAISMMNVSTGASKAYSYIVNLSGVSAFLVWGSICFIHIRFRRAWVAQGRSLDELPYKALGFPYLAWFGLAACIFLALVQGWTTLSPFDAGNFVDAYILVPLFGIIYVFCKILWRGSDPLKRSWSIDLDSGRRTDLDQKSGPTSRDLPGQMPWWRKRNDGDKLSRYRTESHSHLFPFYHRNLGNFTAGILGRSLESRLCDGNSVWMPAAAIWRHSVGDVRWAVLKGLYCERICCDFDGYIDVFQSTEIALISVPFFYYSKQRTTTNR

SEQ ID NO: 2787 - protein, 779 aa, Thiobacillus denitrificans ATCC 25259
MSRDYIVPLDALSMADVPRVGGKNASLGEMISRLADAGVKVPGGFATTAQAFWDFLDHNGLRARIGAVLDALDVTDVTALAAAGAEIRAAVEGGRLPPALESGLREAYAALGDDVSVAVRSSATAEDLPDASFAGQQETYLHVRGAEALLAHLKKVFASLYNDRAIAYRVHHGFAHADVALSAGVQRMVRADTGCSGVLFTLDTESGFRDVVFITAAYGLGETVVQGAVNPDEFYVHKPTLALGFPALVRRERGEKAIRMVWRDGKTVIEDTPPELRQRFALSDAEVLELARQAVQIERHYGRPMDVEWAKDGVSGELFIVQARPETVKARAAAGGERYVLGGTGEVRVSGRAIGQKIGAGPVRVIATPAEMNRVQRGDVLVTDMTDPDWEPVMKRAAAIVTNRGGRTCHAAIVARELGIPAVVGAGDATTVLRDDEAVTVSCAEGDTGFVYAGRLPFEVETLASESLPTPPVKLMMNVGNPERAFEFAQIPNHGVGLARLEFIIARMIGVHPLALLDHAGQPQGVRDEIAARAAGYADPVAFYVDKLAEGIATLAAAFWPQPVIVRLSDFKSNEYANLVGGERYEPKEENPMLGLRGAARYVSTLFRPAFELECRALKKVRETLGLGNVEVMIPFVRTVEECAAVVALLAANGLRRGEHGLRLIMMCEIPSNVLLADDFLRHVDGFSIGSNDLTQLTLGIDRDSGLVAEGFDERNPAVRKLLAEGIAACRRNGKYIGICGQGPSDHPDLAQWLVEQGIGSISLNPDTVVATWKRLAHG

SEQ ID NO: 2788 - protein, 464 aa, Gibberella zeae PH-1
MDEETLKEALKSFPNAEKPAAPSAAASGLNINALFDNPLFAGGIGLASLGAAAAFARKGAVSALGAARRRLLVNLEISKQDPAYPWILAWLSQPRETPGFIASRLTRIHNVSITTTNASRTAGSSGPQHAQFYVQPGYGRHIVKTGNVYIAVNREKHNTANMNTGEPHEIVQLTTLWAHRHVFEQVFKEARALAAKANEGKTIVYSARGMDWLPLGDPRKKRPLDSVILDDGVKENIVNDVQDFLNRHQCGKTSFIQALAGELDFSVAMINLSEMGMTDDKLAYLLTKLPKRSLLLLEDADAAFVNRRQRDTDGYNGATVTFSGLLNALDGVAAGEERIAFLTTNHVDRLDPALIRPGRVDLMLRIGEATRYQAEKMWDRFYGDIDKDHSGRERFLSRLEELGLFGVGPNGEPSNRHTSTAAIQGLFLFNKNDTQGAIDMAEGLIPRKFEASDEIPEGAIKTPA

SEQ ID NO: 2789 - protein, 298 aa, Escherichia coli CFT073
MHRGWPMFTGSIVAIVTPMDEKGNVCRASLKKLIDYHVASGTSAIVSVGTTGESATLNHDEHADVVMMTLELADGRIPVIAGTGANATAEAISLTQRFNDSGIVGCLTVTPYYNRPSQEGLYQHFKAIAEHTDLPQILYNVPSRTGCDLLPETVGRLAKVKNIIGIKEATGNLTRVNQIKELVSDDFVLLSGDDASALDFMQLGGHGVISVTANVAARDMAQMCKLAAEGHFAEARVINQRLMPLHNKLFVEPNPIPVKWACKELGLVATDTLRLPMTPITDSGRETVRAALKHAGLL

SEQ ID NO: 2790 - protein, 526 aa, Zea mays
MGNCCPGSSSSAEPAPPQPPDPSGSSRPVASPASVSPTAAPAPARPPAPIGPVLGRPMEDVRATYAVGKELGRGQFGVTSLCTHKATGHRFACKTISKRKLSTKEDVEDVRREVQIMYHLSGQPGVVELKGAYEDKGSVHLVMELCAGGELFDRIIARGHYTERAAASLLRTIVEIVHTCHSMGVIHRDLKPENFLLLSKDEDAPLKATDFGLSVFFKEGEVFRDIVGSAYYIAPEVLKRSYGPEADIWSVGVIVYILLSGVPPFWAGKLSIYKLPLLLHHHPIMGQVDFTSDPWPRISQGAKDLVRKMLNPDPKQRISAYDVLNHPWIKEDGEAPDTPLDNAVLGRLKQFRAMNQFKKAALRVIAGCLSEEEIRGLKEMFKSMDSDSSGTITVDELRRGLANKGTKLSEAEVQQLMEAADADGNGTIDYEEFITATMHMNRMDRDEHLYTAFQYFDKDNSGYITMEELEQALREKGLLDGRDIKEIVAEVDADNDGRINYTEFAAMMRKGDPEPSNPKKRRDIVL

SEQ ID NO: 2791 - protein, 511 aa, Yarrowia lipolytica CLIB122
MSTVFADGSLFSNVLILGTGFSGLATSIKLRTSWKEADFHLYDRDHSWGGTWAANTYPGCGSDIPAIWYCLTSDPKGDWSKAFPPRDEIYDYIQKLVAKYELRHMATFRTEIEGCKWNADEKLWYVNVRSLETGKKWVHKCRVLFTCKGGLVEPNRVQIEGLYTDFKGPVMHTARWDHSVDYTNKNVVVIGNGCSAIQVIAAIHDQTKTLTQFARTPQWITPRPEFVPGRITRFIFTRFPFVLHLLRTIVFFVIEAAYPMFKKGWLGTFIRRIRAHHATQNIRKKSPEKYWKVLKPDYEFACKRLIFDCGYLGPALNNPNMELTFDRVVKVESNKVITKDGNSYPADIIIDATGFDLSGGFTNIPFIGEHGVSLEDFWANGRVSAYETVLVPNFPNNFLIFGPNSATGHNSVLFAIENAIKFCESVGVKKLISGETDYIGVRAEAYDRWIHDVDSSHAQGLLQQGGCQSWYLADNGRNATTYPWSQLTAWLRARWIDKNAIVIGNGEKKTK

SEQ ID NO: 2792 - protein, 427 aa, Thiobacillus denitrificans ATCC 25259
MSAIIDVIAREILDSRGNPTVEADVLLESGVIGRAAVPSGASTGSREAIELRDGDKSRYLGKGVLKAVEHVNTEICEAIIGLDVEDQAFIDQTMIELDGTENKSRLGANALLAVSMACARAAAEQAGLPLYRYLGGAAPMQLPVPMMNIINGGAHANNNIDMQEFMVIPVGAPSFREALRYGAEVFHALKKLLDDAGMTTTVGDEGGFAPNLESHEAALKLIVQAIEKAGLQPGIDVAIGVDCASSEFYKDGLYHIDSENLKLTSAAFTDYLAAWCDKYPIISIEDGMAEGDWDGWKILTDRLGRRVQLVGDDLFVTNAKILKEGIEKDIANSILIKVNQIGTLSETFQAIEMAKQAGYTSVISHRSGETEDTTIADLAVATNARQIKTGSLSRSDRMAKYNQLLRIEEELGDTASYPGRDAFRQRG

SEQ ID NO: 2793 - protein, 420 aa, Francisella tularensis subsp. tularensis SCHU S4
MRKIIVIGAGFVGINFLNKIAKQSKNKYHIILFDKNNHHVFQPMLYQTATAFIPLNNVVVPIRKLFTQENIEFKMQEVIDILPEEQLVKTAANILYSYDYLIVATGIEYDYLGNDQWREYTFCLKSAYDAQKIKSHILSQFELAEVAQTDEEKRYHLSFIIIGAGATGVEITGALLDLLHTDFLKTYHNFSIDDISILLIEGGENILSAFPKELSNHAYDSLKARRVNIHLKEPVTNILDSRVTTEKDSYRGATIIWSTILKGKGIGNWMSSQIEKGKIAVLDNLTHRDFKNIYFAGDISYIKNNPLPGLAAVAKQQGKYIAKTIIKRDKNKAYNDFKYKDLGTMAIIKKHEAIANIFGMKFKGKLGWFIWGGVHITFLISIRNKFVVSFNWLSYYICKRIGSIEFIKSKKTKKVNKFEN

SEQ ID NO: 2794 - protein, 509 aa, Xanthomonas axonopodis pv. citri str. 306
MNALASAKSLNNDPHSIFKPRYDNFIGGQWVAPHSGQYFDNTTPINGKVFTSIARSTAPDIEAALDAAHAAKDAWGKTSTTERSNVLLKIADRIEQNLELLAYAETWDNGKPVRETLNADVPLCVDHFRYFAGAIRAQEGGISEIDSDTIAYHFHEPLGVVGQIIPWNFPLLMACWKLAPALAAGNCVVMKPAEQTPASILVLMELIGDLLPPGVLNVVNGFGLEAGKPLASNPRIAKIAFTGETTTGRLIMQYASQNLIPVTLELGGKSPNIFFADVMAEDDDFLDKAVEGFVLFAFNQGEVCTCPSRALIQESIYDAFMEKALSRVAAIKQGNPLDPNTMVGAQASSEQLEKILSYIDIGKQEGAEVLIGGERNTLDGDLAEGFYVKPTVFKGHNKMRVFQEEIFGPVVSVTTFKDEADALAIANDTLYGLGAGVWSRDASRLYRMGRAIQAGRVWTNCYHAYPAHAAFGGYKQSGIGRENHKMMLDHYQQTKNLLVSYSPKALGFF

SEQ ID NO: 2795 - protein, 452 aa, Bacillus clausii KSM-K16
MTTQAPTRESLIETIRETIEKKNVELLHMQFVDLEGMLKHVTITAEQLDQAVNGKTMFDGSSITGFTPINQSDLYLSPDLTTFAVLPWTEEEGYSEARFLCSVKNPDGSDFEGDPRNILKKTVKRAADKGYSISVGPELEFFLFDTDEHGEPTMRTQDAGGYFEPSPKDDGEKVRLAIYKALRMMGFTIEASHHEVAVGQHEINFKYSDALGSADAATTYKWVVKTVAKQFGLHATFMPKPLGGANGNGMHVNMSLFDIEKQENSFYNEDDKNALSKTAYHFIAGLLDNVKDFVAITNPLVNSYKRLVPGYEAPCYIAWSASNRSALVRIPATRGPGTRVEIRCPDPSANPYLAFAVIASAGLDGVENEIECPASVDADIFSMSSAEIKERAIENLPTSLEDAINRFETGAIGRKTLGDHAFEEYIELKRSEWDDFRTSVHPWEVASYQSKF

SEQ ID NO: 2796 - protein, 443 aa, Escherichia coli CFT073
MCVPEMIKKELVMVSLEKNDHLMLARQLPLKSVALILAGGRGTRLKDLTNKRAKPAVHFGGKFRIIDFALSNCINSGIRRMGVITQYQSHTLVQHIQRGWSFFNEEMNEFVDLLPAQQRMKGENWYRGTADAVTQNLDIIRRYKAEYVVILAGDHIYKQDYSRMLIDHVEKGARCTVACMPVPIEEASAFGVMAVDENDKIIEFVEKPANPPSMPNDPSKSLASMGIYVFDADYLYELLEEDDRDENSSHDFGKDLIPKITEAGLAYAHPFPLSCVQSDPDAEPYWRDVGTLEAYWKANLDLASVVPELDMYDRNWPIRTYNESLPPAKFVQDRSGSHGMTLNSLVSGGCVISGSVVVQSVLFSRVRVNSFCNIDSAVLLPEVWVGRSCRLRRCVIDRACVIPEGMVIGENAEEDARRFYRSEEGIVLVTREMLRKLGHKQER

SEQ ID NO: 2797 - protein, 657 aa, Escherichia coli CFT073
MTQLAIGKPTPLGAHYDGQGVNFTLFSAHAERVELCVFDANGQEHRYDLPGHSGDIWHGYLPDARPGLRYGYRVHGPWQPAEGHRFNPAKLLIDPCARQIDGEFKDNPLLHAGHNEPDYRDNASIAPKCVVVVDHYDWEDDAPPRTPWGSTIIYEAHVKGLTYLHPEIPVEIRGTYKALGHPVMINYLKQLGITALELLPVAQFASEPRLQRMGLSNYWGYNPVAMFALHPAYACSPETALDEFRDAIKALHKAGIEVILDIVLNHSAELDLDGPLFSLRGIDNRSYYWIREDGDYHNWTGCGNTLNLSHPAVVDYASACLRYWVETCHVDGFRFDLAAVMGRTPEFRQDAPLFTAIQNCPVLSQVKLIAEPWDIAPGGYQVGNFPPLFAEWNDHFRDAARRFWLHYDLPLGVFAGRFAASSDVFKRNDRLPSAAINLVTAHDGFTLRDCVCFNHKHNEANGEENRDGTNNNYSNNHGKEGLGGTLDLVERRRDSIHALLTTLLLSQGTPMLLAGDEHGHSQHGNNNAYCQDNQLTWLDWSQASSGLTAFTAALIHLRKRIPALMENRWWEEGDGNVRWLNRYAQPLSTDEWQNGPKQLQILLSDRFLIAINATLEVTEIVLPAGEWHAIPPFAGEDNPVITAVWQGPAHGLCVFQR

SEQ ID NO: 2798 - protein, 500 aa, Oryza sativa (indica cultivar-group)
MALPLLRLLLLLVLSSVPLSCQLAHSTAADTQNWGQTSVVHLRNAHTRKLLGLLDDISGRTGSLHALLLEESPKQAPPHHHNRHGGHHRAAHTPAPSPAPSPSPFTAPPKSASPAAITIPISPSTPQPKAESNPAVEDAPAQPRHSWRNYGLVTAGSAVFLVMTIASVIYCRAKKVGTVRPWATGLSGQLQRAFVTGVPSLKRSELEAACEDFSNIIGSTSSCMLYKGTLSSGVEIAVLTSSTESGKEWSKECESQYRKKITNLSKVSHKNFMNLLGYCEEENPFTRAMVFEYAPNGTLFEYLHVREAENLDWMARVRISMGIAYCLEHMHQLNPPVVPRNFNSTTIYLTDDFAAKVSDLDFWNDSKGSFNSATSDETVMVEIDSMVHQYGIILLEILTGRVPYSESDGPLEHWASGYFEGKMTLAELIDPSLGSFPEDAARALCDVARWCIEPEPSKRPLMSQVAGRMKEITSLGPEGATPKVSPLWWAELEIMSGQAT

SEQ ID NO: 2799 - protein, 454 aa, Glycine max
  misc_feature (182)..(182): Xaa can be any naturally occurring amino acid
  unsure (1)..(454): unsure at all Xaa locations
MGNSHAKKRDTQFSRNVVKGRVPSPKDKTLSSLQSPSSPSQSPSPSLEPPREPPPPVMFFNTGSGKLSAKEKYALIPDNFTTLEQVTTALRKEGLESSNLVLGIDFTKSNEWTGSVSFNNKSLHAIGSTANPYEKAISIIGKTLAPFDDDNLIPCFGFGDATTHDQEVKMYRRKLSFPILKXFNFCLYSARAHDQEVFSFHSDNSPCHGFEEVLACYQKVVPNLRLSGPTSYAPVIEAAIDIVEKSHGQFHVLVIVADGQVTTSAASEHGELSPQEARTIKAIVDASSYPLSIILVGVGDGPWEDMKKFDDKIPARDFDNFQFVNFTDIMAKKSSPSEKEAAFALAALMEIPFQYKAATELGLLGRATGRSNKIVPRPPPAPYSQLVPPARVLSNTPTFMDDERNQMPCAICLTNKQDLAFGCGHMTCRDCGSRLTDCPICRQRITNRLRVFSS

SEQ ID NO: 2800 - protein, 1016 aa, Escherichia coli O157:H7 EDL933
  misc_feature (95)..(95): Xaa can be any naturally occurring amino acid
  misc_feature (196)..(196): Xaa can be any naturally occurring amino acid
  misc_feature (388)..(388): Xaa can be any naturally occurring amino acid
  unsure (1)..(1016): unsure at all Xaa locations
MQVSRRQFFKICAGGMAGTTAAALGFAPSVALAETRQYKLLRTRETRNTCTYCSVGCGLLMYSLGDGAKNAKASIFHIEGDPDHPVNRGALCPKXAGLVDFIHSESRLKFPEYRAPGSDKWQQISWEEAFDRIAKLMKEDRDANYIAQNAEGVTVNRWLSTGMLCASASSNETGYLTQKFSRALGMLAVDNQARVXHGPTVASLAPTFGRGAMTNHWVDIKNANLVVVMGGNAAEAHPVGFRWAMEAKIHNGAKLIVIDPRFTRTAAVADYYAPIRSGTDIAFLSGVLLYLLNNEKFNREYTEAYTNASLIVREDYGFEDGLFTGYDAEKRKYDKSSWTYELDENGFAKRDTTLQHPRCVWNLLKQHVSRYTPDVVENICGTPKDAFXKVCEYIAETSAHDKTASFLYALGWTQHSVGAQNIRTMAMIQLLLGNMGMAGGGVNALRGHSNIQGLTDLGLLSQSLPGYMTLPSEKQTDLQTYLTANTPKPLLEGQENYWGNYPKFFVSMMKAFFGDKATAENSWGFDWLPKWDKGYDVLQYFEMMKEGKVNGYICQGFNPVASFPNKNKVISCLSKLKFLVTIDPLNTETSNFWQNHGELNEVDSSKIQTEVFRLPSTCFAEENGSIVNSGRWLQWHWKGADAPGIALTDGEILSGIFLRLRKMYAEQGGANPDQVLNMTWNYAIPHEPKSEEVAMESNGKALADITDPATGAVIVKKGQQLSSFAQLRDDGTTSCGCWIFAGSWTPEGNQMARRDNADPSGLGNTLGWAWAWPLNRRILYNRASADPQGNPWDPKRQLLKWDGTKWTGWDIPDYSAAPPGSGVGPFIMQQEGMGRLFALDKMAEGPFPEHYEPFETPLGTNPLHPNVISNPAARIFKDDAEALGKADKFPYVGTTYRLTEHFHYWTKHALLNAILQPEQFVEIGESLANKLGIAQGDTVKVSSNRGYIKAKAVVTKRIRTLKANGKDIDTIGIPIHWGYEGVAKKGFIANTLTPFVGDANTQTPEFKSFLVNVEKV

SEQ ID NO: 2801 - protein, 469 aa, Agrobacterium tumefaciens str. C58
MSAVAFMGVRSVMNEVSKPMSNLAAIDAAHHLHPFSDMGKLNAAGTRIIERAEGVFIYDSTGKKYLDAFAGLWCVNIGYGRREIADVVQRQMNELPYYNAFFGTTTPPATLLAQKIASRAGPKMNHVFFTNSGSEATDTWFRMARVYWKALGHPTKTRVIARRNGYHGSTVAGASLGGMKWMHEQGNLPIEGIAHIGQPYWYAEGGDLSPAEFGLKVARELDAKIDELGEENVAAFVAEPIQGAGGVIVPPETYWPEIARICKARNILLVSDEVICGFGRLGSWFGYQHFGVEPDLAPVAKGLSSGYLPIGGVIVSDRVAEVMLSEVGDFNHGFTYSGHPVCAAAALENLRIIEDEGLVERVRDDIGPYFSEGWKSLADHELVGEAVNVGLMGGLQLTADKATRRRFAKPDDIGTAVRNHCLANGLVMRATGDRMLASPALTVSRSEVDEIIETLRQGLNHLRDTREHF

SEQ ID NO: 2802 - protein, 386 aa, Candida glabrata CBS 138
MLGITGLRSLARTSTLRVAARAPGRLTPVTPSWRVMMPRYMSSNGKPISEITTQLPAVDELGATAADAVTQTVGTVGELSTHVGYLESIGLAQTWYWPSDLVQHALEYVHAYSGLPWWGTIITVTLLVRLALVPLYVKSSDTIARNSRIKPELDKINKQLMGTTDMTEGQKVAMKRKKLLADNGIKNRWLAAPMVQIPMAIGFFNGIRHMANFPVQGFQDQGILWFNDLTQADPYLGLQVITAAVLISFTRLGGETGAQQFSPTMKKFFTIMPLLSIPATMNLSSAVVLYFAVNGSFSVLQTLFLRNKWVRRKLNIADVVQRPLDPAQANKGIMDTFRENMANARAQAERKQKMQEKEMEMQELSKKLRENQRIKIVSRKQLNKNH

SEQ ID NO: 2803 - protein, 164 aa, Triticum aestivum
MEITINSLTYKGSIPDAINQSRRKKKLFVIYISGQDETSSSLEQSTLVDEHVAAVISRCCIFLQLKQGDVDALQFSAIYPQKSVPSISVVGLSGAMLWNHEGYISPEDLKESIDKAWAALQLQIWKPHCMSVLKPARPLLSFQIVNLLKWQGTNRHCHPVIWIA

SEQ ID NO: 2804 - protein, 580 aa, Oryza sativa (indica cultivar-group)
MKKKKNGMGAAADRGRLLALAHHDKLNPTKPSEAQRRFKPSIQQLPFFFFFFFLEAAFLGLFLLSPLPSFLGQGQMQMQQRRKPPPAAAPVAAKQPSPRRTPGPLSFAGALLSLLVVATFLYINDHGNMMPPHASPDPNLRLLQEAAHQKVNSILLSRHAPAPPPRTNTNTSSSDQHLRLINIPMSSDLDLELGGNSTSSSGVEIQFEQQEEKNLRGCELYKGRWVYDAAGREAPLYRESECGFLTEQVTCMRNGRRDDSYQRWRWQPEGCDLPSFDARALLERLRNKRMMFVGDSLNRNQWESMVCLVQSAIPYGQKTLTKFVNNGSLNVFRAHEYNATVEFYWAPFLVQSNSDDPQVHSVRDRVIAWRSIAKHAANWKGVHYLVFNTYIWWLNNFQIKVLKSRGAPFAGSGGWSSRYALVDRAIAYREVLKTWAKWVDRRIDPNKTHVFFMAMSPNHFMPEAWGGSAGAVKCAMETQPIVNRTSGGLDIGTDWRLHGVARGVLRSMRRVGVRFVDITALSELRKDAHTSVHTLRQGKLLTPEQQADPRTYADCIHWCLPGLPDTWNHFLYAHIVAHAA

SEQ ID NO: 2805 - protein, 493 aa, Thalassiosira pseudonana
MPPSIKDTLDEPFVSPASTKSPTTKPLLPRRKPLKRYSPSQISQHNTPTDAWLIYKSQVLDISKWISHHPGGEQTLLRFAGMDATDELRAFHDDWVLEEKLPHFVIGEVDWTTTGGAENTVTKDGQVSELIKDFRELGEHFDRLGYFHVSPWYYVRKVATVFAIFGCALGLLFNTDSIPAHMLAAVLLGIFWQQFAFVGHDCGHMSARTHARDHIDVPKLGALVTFFNGISVAWWKATHNVHHAVPNSVDCDPDIAHLPVFALHEHMFTSLFNKYHGRVMEFDWLARNVFVPFQHFWYYPIMAVARFNLYIQSALFLASKNDGHAGRTTLDLMAFIGFFSWLAVLVSCIPSWPERIAFVFVSHAVAGLLNVQITLSHFSRPIFDTNKEGPRFGGDFYSRNVLASLDVACPTYLDWFHGGLQFQTLHHCYPRLGRQHLRKTEPLIASLCKKHSLPYTSKSFVECNMEVFNTLKDAARSAKKWSPLIYESMCAQG

SEQ ID NO: 2806 - protein, 243 aa, Arabidopsis thaliana
  misc_feature (94)..(94): Xaa can be any naturally occurring amino acid
  unsure (1)..(243): unsure at all Xaa locations
MSTGLDMSLDDMIAKNRKSRGGAGPARGTGSGSGPGPTRRNNPNRKSTRSAPYQSAKAPESTWGHDMFSDRSEDHRSGRSSAGIETGTKLYISXLDYGVMNEDIKELFAEVGELKRYTVHFDRSGRSKGTAEVVYSRRGDALAAVKKYNDVQLDGKPMKIEIVGTNLQTAAAPSGRPANGNSNGAPWRGGQGRGGQRGGGRGGGGRGGGGRGRRPGKGPAEKISAEDLDADLDKYHSGDMETN

SEQ ID NO: 2807 - protein, 163 aa, Escherichia coli CFT073
MMGVSGSGKSAVASEVAHQLHAAFLDGDFLHPRCNIEKMASGEPLNDDDRKPWLQALNDAAFAMQRTNKVSLIVCSALKKHYRDLLREGNPNLSFIYLKGDFDVIESRLKARKGHFFKTQMLVTQFETLQEPGADETDVLVVDIDQPLEGVVASTIEVIKKGK

SEQ ID NO: 2808 - protein, 461 aa, Desulfitobacterium hafniense Y51
MEQYQVGILGGGPGGYVCALRAAQLGLSVVLVEKERLGGTCLNKGCIPTKTLVKSAELWREIKHAEEFGIQLGGALLHYPQIAARKKEVVNTLVSGIEQLMKAKKITVLKGWGEVKEANRIEVTTETGKVELHVENLVLATGSIPTKIPVPGVDLPGVVTSEELLEQETLPDSLVVIGGGVIGLEFASIYHEFGVKVSVVEMLPSLLPNIDEEIPKRLAPLLKRSGLEILTKAFVREIKPKEEGLVVIVEDGKGLKELPAQQVLLATGRRPSLSGIHGDALGLELDRGAIKVNSQMQTSVPKVYALGDVVGGAMLAHVASMQGMVAAEHMAGQQVSMEGRAIPSAIFTYPEIAAVGETEQALKASGQNYKVSKFPFSANGKALALGEIMGLVKLLADEEGVVIGASIMGPQASSLIQECVLAVEKKIKAEDLAKIIHAHPTLPEAIMEAAHGISAKPLHLA

SEQ ID NO: 2809 - protein, 505 aa, Pseudomonas putida KT2440
MTTSPSTSPAKRPEDENLGLGANLAYGLQHVLTMYGGIVAVPLILGQAAGLNGAEIGMLIAASLFAGGLATLLQTLGLPFFGCQLPLVQGVSFAGVATMGAILSSEGGGGLPGVLGAVMAASLIGFLITPVFSRITKFFPPLVTGIVITTIGLTLMPVAARWVMGGNSASPEFGSMANIGLAALTFAIVLLLSKLGSATISRLSILLAMVVGTLIAWALGMTDFSKVGEGPMFAFPTPFHFGMPEFHIAAILSMCIVIMVTLVETSADILAVGEIIDTKVDSKRLGNGLRADMASSILAPIFGSFTQSAFAQNVGLVAVTGVKSRYVVATGGVILVVLGLLPVMGRVIAAVPTPVLGGAGIVLFGTVAASGIRTLSKVSYKNNVNLIIVAASLGFGMIPIAAPTFYHHFPNWFETIFHSGISSAAIMAILLNLIFNHFTTGNSENQSVFAAAYERTIQYSDISALRDGDYFKDGKLFDAEGNEVPMLELDEHGNETVRRTAVAEH

SEQ ID NO: 2810 - protein, 380 aa, Zea mays
MISPTNLLPAPKITPVSNGFAATASPSSPSVAARPRRLPSGLQSVTGRGKVSLAAITLDDYLPMRSTEVKNRTSTDDITRLRLITAVKTPYLPDGRFDLEAYDSLINMQIEGGAEGVIVGGTTGEGHLMSWDEHIMLIGHTVNCFGSRIKVIGNTGSNSTREAVHATEQGFAVGMHAALHINPYYGKTSAEGMISHFEAVLPMGPTIIYNVPSRSAQDIPPEVILAISGYTNMAGVKECVGHERVKHYADKGITIWSGNDDECHDSKWKHGATGVISVTSNLVPGLMHSLMYKGENATLNEKLSPLMKWLFCQPNPIALNTALAQLGVARPVFRLPYVPLPLEKRAEFVRIVESIGRENFVGQKEAQVLDDDDFVLISRY

SEQ ID NO: 2811 - protein, 353 aa, Burkholderia xenovorans LB400
MSSTHTGFKHLPIVDVSGLFSDDIDRRLATARELDRAAREAGFFYVTGHQVSRGQQGALIEQAKRFFAAGHDWKMRYYIGNSSAHRGYVPEGEEVFAGGKRDRKEAFDTGRELPADDPDVIAGTPMLGSNSWPEQPGFREAVGGYYEASFELGRALFRGFSLALGLPEQHFERYLRKPPSQLRLIHYPLDPSAEDRPGIGAHTDYECFTILLPTAPGLEVMNGRGEWIDAPPVGNAFVVNIGDMLEVWTGGTYVATSHRVRKVREERYSFPLFFACDYHTVVAPLPQFATPEAVAKYPPVSAGDHLYAQTAQSFTYLKARLERGELVLPDGSKALASFGQQARYASAEQDAEG

SEQ ID NO: 2812 - protein, 419 aa, Triticum aestivum
  misc_feature (92)..(92): Xaa can be any naturally occurring amino acid
  misc_feature (118)..(118): Xaa can be any naturally occurring amino acid
  unsure (1)..(419): unsure at all Xaa locations
MSISTASRRALSRIGGALRRSLSSSSSSVPDASGYHVSGGPSFMRAAVFWEPGRPLTMEEFRMPRPKAGEVLVKTKACGVCHSDLHVMKGEXLPFASPCVVGHEITGEVVDHGAHTPXAEIVNRFPVGSHVVGAFIMPCGNCFYCVKGQEDLCESFFAYNRAKGTLYDGETRLFLRSNGKPVYMYSMGGLAEYCVVPANALAILPNSLPYTESAILGCAVFTAYGALRHAAEMRAGDSVAVIGVGGVPPGRLQIARAFGASEVIAVDVLDEKLQNAKTLGATHTVNAAKEDAVERIKEITGGRGVDVAVEALGKALTFSQCTQSVRDGGKAVMIGLAATNVVGEVDITRLVRRQVKIIGSYGARARQDLPQIVKLAESGAFNLENAISRKCKFEEANSAYEDLNQGKIVGRAVVEIMQC

SEQ ID NO: 2813 - protein, 482 aa, Thiobacillus denitrificans ATCC 25259
MFRPPPRCRAMSPLSAPLSPPLYTTAELRAVETRFAADGLMERAGAAAAELAASLAGEAGGPVLVLVGPGNNGGDALVAARLLAAEGSPVHAVGGADPARLPADAARAHAAWRQAGGTLQREIPSRRFGLVVDGLFGAGLQRDVAGNEAHWIAQANALGCPRLALDVPSGLDSDSGRARGCAFRADHTLTFLGLKPGLLTADGPDYAGQVHLDTLGIDPADMPSVKGIALTGLDARHRLPPRAQNSHKGQFGHVAIVGGAPGMVGACLLAGRAALAQGAGSVSVAVLDDRVAVDYGAPRLMFASAEALVEASLDVLALGPGLGRSPRARALLQTALGADCPLVLDADALNLIATDPELGLAAAQRNAATVLTPHPGEAGRLLGVDTQAVQADRVGAAHELSTRFGAHVALKGAGTVIAHPGGRYAINTSGGPWLAQAGSGDRLTGMVAALLGQGMETGNALEAAVWLHGADRPEHQHIRVLR

SEQ ID NO: 2814 - protein, 468 aa, Bacillus cereus G9241
MIIGGGITGLIAMYNLQKNIHEKNLPIDTLLIEASGKLGGKIQTVRKDGFTIERGPDSFLARKESAARLVKELGLGDELVNNQAGQSFILVNNRLHKMPNGSMMGIPTQITPFLFSGLFSPIGKLRAGFDLLMPRSKPVSDQSLGQFFRHRLGNEVVENLIEPLLSGIYAGDIDEMSLMSTFPQMYQIEQKHRSISLGMRTLAPKEEKAEPKKGIFQTVKTGLESIVESLEAKMHEGTIIKGTRIEKIAKLGDGYTITLSNGKEIEADAVVVATPHKVLPSMFAQYKQFRFFRNIPSTSVANVAMAFQESAIQRDIDGTGFVVSRNNDYTITACTWTHKKWPHTTPEGKMLLRCYVGRPGDEAVVEQTEEELVQLVLEDLRKTMDITEDPEFTVVSRWKEAMPQYTVGHNERMKKLTTFMEKELPGIYLAGSSYAGSGLPDCIDQGERAAKRVLSHLEKVMDAELIAQ

SEQ ID NO: 2815 - protein, 443 aa, Escherichia coli CFT073
MSKAPITHNTEDNTMTRRAIGVSERPPLLQTIPLSLQHLFAMFGATVLVPVLFHINPATVLLFNGIGTLLYLFICKGKIPAYLGSSFAFISPVLLLLPLGYEVALGGFIMCGVLFCLVSFIVKKAGTGWLDVLFPPAAMGAIVAVIGLELAGVAAGMAGLLPAEGQTPDSKTIIISITTLAVTVLGSVLFRGFLAIIPILIGVLVGYALSFAMGIVDTTPIINAHWFALPTLYTPRFEWFAILTILPAALVVIAEHVGHLVVTANIVKKDLLRDPGLHRSMFANGLSTVISGFFGSTPNTTYGENIGVMAITRVYSTWVIGGAAIFAILLSCVGKLAAAIQMIPLPVMGGVSLLLYGVIGASGIRVLIESKVDYNKAQNLILTSVILIIGVSGAKVNIGAAELKGMALATIVGIGLSLIFKLISMLRPEEVVLDAEDADITDK

SEQ ID NO: 2816 - protein, 345 aa, Prochlorococcus marinus subsp. pastoris str. CCMP1986
METHVERISNLQDFKKAKLDRETGLFLYEDMTLGRRFEDKCAEMYYRGKMFGFVHLYNGQEAISTGVIGAMKRKHDWFCSTYRDHVHALSAGVPSFEVMSELFGKATGCSKGRGGSMHLFSKEHHLLGGYAFIGEGIPVALGSAFSSKYKKEVVGDNQSDSVTAAFFGDGTCNNGQFFECLNMAQLWKLPIIFVVENNKWAIGMAHDRATSNPEIWRKASAFGMHGEEVDGMDVLAVRGAAQRAVERARAGEGPTLLECLTYRFRGHSLADPDELRAEEEKEFWAKRDPIKKLANQIIEGNFAQEEELKSIEKKIDLEISESVKNALDAPEPPSNELTKYIWAED

SEQ ID NO: 2817 - protein, 521 aa, Prochlorococcus marinus subsp. pastoris str. CCMP1986
MKEIGWPTIDSKHLVVYSKQMLDLENEIFSQGMPQEALMEKVGIQLSKWLLKRKSLLKKGVIVFLGPGHNGGDGAVIAKELFLKGYLVKLWCPFPLKKTITINYVNYLTSLGVEILGDSPNPEGKDLWIDAIFGNNQKRKVDEELIELFNKKFEKRSGKVVSIDVPTGLCPNSGKPFLKNAVKADFNLVVGLNKIGLLQDTALPYVGELHHIDIGICRSQLCKLESKILKISYQDLRTIKLPLLPKNSSKYKRGRTLVIAGSEKYPGAAYLAIKGAISSGAGFVSAIIPNLVSNSIWQVEPEVVVTGSLSSDKNGNSILFNALKNVDFSAYDSIVIGPGIGLNEEDWEKSTQYLLDLKGLLILDADALNRISKSNLGPKFFLERKSKTWITPHNKEFMRLFPEIDCTNKVELAKKAAKAFDISILLKGANSVIANNENAWQLFGTDAETSRAGLGDLLSGFIGGCSSIELSSRDYTKTESLAKYVFLHSFAASKCKKGSNASLIGAQLSKLMRKTKTRLMS

SEQ ID NO: 2818 - protein, 200 aa, Glycine max
MKRHWRNRSHDDDGLPDSDSDTRSSRRFPLTRLMALFFFSIFLFSLTFLLPHPPIQSASTAKTLLQLKQTQQGDVSDSVELQKDKLLGGLLADGFDEQSCLSRYHSATYSKGLSGNPSSYLISRLRKYEALHKKCGPYTESYNKTVKDLRSGHVSESPECKYVVWISYSGLGNRILTLASVFLYALLTDSCSIGLIPGVD

SEQ ID NO: 2819 - protein, 883 aa, Gibberella zeae PH-1
MEEGVGMQLLLEGKKKLTIGADGLEFNGPIAKKASRSSCAPLTSTGSSKDAIPFYNVLWAEFANNHITIDYAIHASKTLIKPGKWEFELAAKDDDDDDDDDEGNGATPVETFVKTLLSRAYGDAPPRKRAYVLVNPNSGPGKAVKQWENEVKPLFNAAKMQLDVVILKRGGEAVELAQNVDLSRYDTIMACSGDGTPHEIFNGLAKRPDAAKALSTMAVSHIPCGSGNAFSCNLYGSHRPSFAALAIIKGIVTPLDLVSVTSGNNRIISFLSQTLGLIAECDLGTENMRWMGSARFEVGVVQRMYKKKCYPFDLAVKVEIEEKEGVKAHYKHHASTTSLSQLTKSAGAKSVPDGAGLPELKYGTIKDELPEGWELIPYNKVGTFYAGNMAYMSPDAPFFAASLISDGLMDLVTIDGDLPFLTAIKVLLDVEAERLFDNPHVTYKKISAYRIIPRDQDDGYISIDGEKCPFGPFQAEIHQGLGRVISKSGKYEASGPKGWDKHKIPQYIGSKGFLLQLFLVLNILKKYPRYAPSRPRCTTMPAYLYSGRLTRILRLLNHKTQEWYYNQIISRFLAFCTEAGDRDSIIRSFEALDIRAVDSTPATQYTKHPPGYVPVSAATSTAVVSSATSSTLTRDTTGIPKATHLPTHDSVASLPSSLTGPLKALRSIIPSSGPTTAMLAAIEDPDNTKSLQDVLMALRKLREGLVATKRADLFSIQAYIFSIRLSILAKHPESYHPAILHLLRYMAVWTPMVQSEIEEIAGYFMLDAACRRRDLTEAYFIRQDFNIRNKKLDHILKALAHDNYISWQATKQQVDRHCLKLMEWADNDMRLHTLKCFGRSYLHVDLPYLEFSAGRKWNQLKEKDNVGWELEDEKVTIKRVRAR

SEQ ID NO: 2820 - protein, 325 aa, Francisella tularensis subsp. tularensis SCHU S4
MQQLKDIQALIKEDIQNNNQFIVDSLCSDVVLINQISHYIINSGGKRLRPLLVMLFARALNYNGDKHLACAAIIEFIHTATLLHDDVVDDSQLRRGKQTANNVFGNAASVLTGDFLYSRAFQMMVSLDNMQIMQILADATNKISEGEVLQLLNARNSELSEEEYIKVIYCKTAKLFEAACELAGVISLDKQDYTKYQGRIKNYGVYLGNAFQIADDVLDYVSDAESLGKNIGDDLDEGKMTLPTIYALANVTEQQQQILKKAIEKGEYRIDEIIAMVKDSGAVDYSYKVACQYADLAKQQIDFLPDSEYKQAMILLCDLAVNRKN

SEQ ID NO: 2821 - protein, 136 aa, Glycine max
GGGGGESASNVRATYHYYEPKQHGWDLNAASAYCSTWDASKPYSWRMKYGWTAFCGPVGPSGRDCCGKCWQVTHTGTGAYTLVRIVHQCSNGRLDVYEGVHPHFDTHGPRYLQAHIIVNNIIVDCVNELYLIESAL

SEQ ID NO: 2822 - protein, 91 aa, Synechococcus sp. RS9917
MAADPLTPSVSDRICRHMNADHAEAVLQYARHYGGVAEPQAATMLAVRPDAMELEVDGVKLEIRFDHELSDSEDAHRTLVAMLRSMASGES

SEQ ID NO: 2823 - protein, 729 aa, Triticum aestivum
  misc_feature (120)..(120): Xaa can be any naturally occurring amino acid
  unsure (1)..(729): unsure at all Xaa locations
MARHFASAGAGAVQRYYCGGACDGGDDGAVQAMLQCQRVSDFLIAASYLSIPLELLYFASCAGPAPLKWLLLQLAAFAVLGGATHLLAVFPLAHPHSSGLLLASTAAKLLAALVSFATAXVSLVALIPRLIRAKLREAFLRAKARQLDRDLGLIRRRVEATSRVVRMLTHRIRSSPLDAHSVLHTTMLHLADALELHSCAVWMPGQDAGADLHLVHQLSLRGKGPVRVVLGSQAPISPDDPDVVDVMASEAAKVLRPGSELATASSGELQPPGAVAAIRIPMLKVSNFDGGKTPVASSYAILVLALRSKASGSGYREWSGHDMEVVQVIADQVAVALSHAAVLEEWQAMSNRLAEQNRALLHAKQDAMMATEGINSIQSAMCEGMRRPMYSIIGLLSMVRQAKDMRPEQRLVADAIARTSTLSLALMNDVDTETLTVNRMPFDLHSLMREAMSVAGCLASCGGAGFSYQLENGLPEWVVGDETRVFHLLLQMAGDVLGQRRDGAGRLSFSIKSCSADQKNCIPVWPNLSAGCSICVEFQVAMERSTGCSQPPSSPASSQINMCKKIVQMMNGTMWSALDGESITLILHFQLQQSHVCRRTSSSIPHFNGLRILLADGDDMSRAVTQKLLEELGCQVISVSSGTHCLALLGSAGSSFQLLLLDLDMDAFEVALQIRGLKNRRWLLIVAALAVTVDDNIREMCRHSGINGLIQKPLTLTALGGQLHRVLRN

SEQ ID NO: 2824 - protein, 197 aa, Synechococcus sp. RS9917
MSAPLNRLVRLLCGSFTNEAQAFENPPLYAHINVTVRPLPHLEAGMLLLEQAYALAPAEPYRIRVLEARQVGDALHVRNHSLSDAQRFWGATLNPHQLTAIGSDDLQLLEGCTYVVSPKGDGFSGEVEPGCRCMVERKGRTTYLVSQFEIDAAGMSTIDRGHDPETHEQVWGSLAGPFQFQRLETYAGEIPADWNLG

SEQ ID NO: 2825 - protein, 158 aa, Triticum aestivum
MAPTVMASSATSVAPFQGLKSTDGLPVSVSNGGRIRCMQVWPIEGIKNFETLSYLPPVSTEALLKQVDYLIRSKWVPCLEFSKVGFIFREHNASPGYYDGRYWTMCKLTMFGCTDATQVINEVEEVKKEYPDAYVRIIGFDNMRQVQCVSFIAFKPPG

SEQ ID NO: 2826 - protein, 319 aa, Shewanella sp. MR-7
MTVLLSFGEVLVDLLPTDISGKSHQAIAGGAPANVAVGYAKLGGKSYFAGGISTDDYGAMLKQALANEGVVTDYLTQVPEAPTATVVVNLDEHGERTFEFNRQGTADLCYSQRHFDAIPWQQMDIFHLCSNTFTEAAIFNASLYGARCANSFNKIVSFDVNLRLSLWPDIALLAERVEQCFRYTQVLKMSREEAEYLALTRNKSFEDYLQFCLAQGVEVILITDGANPVQCITVNERFSVPVPQIKAVDTTAAGDSFMAGFLFALGSELAFDLEHLTLKHRLACQTQLRKAIEFAVRCGAVTCGQKGAFPALPTLSQVS

SEQ ID NO: 2827 - protein, 213 aa, Coprinopsis cinerea okayama7#130
MAQTPKTVFSEEKNPRGIPKAPFIADVEEYLGGPDGDVEATLRTFQDAIAKYRYMDGSLTQRRASLEEKIPDIKKTLDMVEFIRDRKAGKSKSEDDEDDLDDEEDDGEPQPFKTTFELNDTLYAEAEIQDTDTVYLWLGANVMLSYPIPEAISLLQSKLDAANLTLSNTIEDLEFLREQLTIMEVNTARVYNWDVKRRRERRLAKEAEEKEKA

SEQ ID NO: 2828 - protein, 561 aa, Aspergillus oryzae
MPVSSQYPPVDIPNVDLWTFLFERKDRTFPDDNIIYQDADTQRFYTYKTLKDAALAFGQGLKAIYDWRKGDVLALFTPNSIDTPVVMWGAHWAGGVVSPANPAYTTEELAFQLKNSGAKAVITQVPQLSVVREAAKQANIPEDRIILIGDKRDPEARLKHFTSIRNISGATRYRKTKINPDKDLSFLVYSSGTTGVPKGVMLSHRNIVANSLQLAAGEAGHLTWNGGADGKGDRVLAFLPFFHIYGLTCLVHQTLYQGYRLVVMERFDIEKWCAHVQNYRITFSYVVPPVVLLLSKHPIVDKYDLSSLRMMNSGAAPLTRELVEAVYARIKCGIKQGYGLSETSPTTHTQPWEEWRTSIGSVGKLLPNMEAKYMTMPEDESEPREVSVGEVGELYMKGPNIFQGYHNNPAATADCLTDGWFRTGDVGYQDKNGNFYITDRVKELIKYKGFQVAPAELEGILVDHEAIDDVAVIGIESEAHGTEVPLAFVVRSAKSKASGASAEQEAANIIKWLDGKVAYHKRLRGGVRFVDAIPKSVSGKILRRVLKAQAKEAAAAPKAKL

SEQ ID NO: 2829 - protein, 341 aa, Clostridium acetobutylicum ATCC 824
MEKKNIDWANLGFGYVKTDKRFVSNYKDGKWDDGALVSDATIAISECAGVLQYSQACFEGMKAYTTEDGHIVTFRPDLNAQRMEDSCKRLEMPAFPKESFVDAVVKTIEANSEWVPPYGSGATLYIRPFMFASGPVIGVKPADEYQFRVFATPVGPYFKGGVKPLTLRVSDFDRAAPNGTGHIKAGLNYAMSLHAIVTAHEEGFDENMYLDAATRTKVEETGGANFLFVTKDNKVVTPKSNTILPSITRRSLMTVAKDYLGLEIEERTVYLDEVKDFAECGLCGTAAVISPVGKIVDHGKEICFPSGMSDMGPITKKLRDTLTGIQMGHIEAPKGWLKIIK

SEQ ID NO: 2830 - protein, 294 aa, Streptococcus acidominimus
YHPDINKDPGAEDKYKEVQEAYETLSDPQKRSAYDQYGSAGANGGFGGGAGGFSGFDGAGFGGFEDIFSSFFGGGGATRNPNAPRQGDNLQYAINLKFEEAIFGVEKEVSYHREAVCRTCTGSGAKPGTSPVTCGRCHGTGVINVDTQTPLGTMRRQMTCDVCHGRGKQIKEPCQICRGTGHEKQAHTVTVKVPAGVETGQRIRLAGQGEAGFNGGPYGDLYVVVQVQASDKFEREGTTILYKLDLNFVQAALGDTVHVPTVHGDVDMVIPEGTQTGRTFRLKGKGAPSIRGGA

SEQ ID NO: 2831 - protein, 1127 aa, Arabidopsis thaliana
MDFFTSSKAKKDSKKSSGLFGKKTVSKSTPGSPAHPPGARSPPPSYLSNKRAETEYDFPMSNEQRPYWKQPASERVPNSHPRPPVYGYGTPDHRRDHGRERMEAMSYEPETNAPSSPYHPAGNRTPERPRKSTEYRREHQDRMYEADTRSNASPFHPFRSPSPSPFHTPDRRRDHYDMYEPEANTMLQNSAPGSPFHPAGSRSPPPYRTPDRRSNYDKEQFEDLYEQDGDVTPRNSSPPSPFHPAAYKTSDQRSNHGKEQIEDFYEQDDDVTPRNSSPPSPLHPAASHSPPPPQPYRTPDHRRSHQDNEDFEAMYELDGDLIHQKSAPPSPVHGPYYSSSDDDNHSTYLYPEIRSPLRSRIVSENSTPVHHNYQIVAAETYEQDKQFEPPELPDESQSFTMQEITKMRGLKNYESGKEESQSMISEAYVSVANYRVRQSVSETLQAIIDKHGDIAASSKLQAMATRSYYLESLAAVVMELKKTVLRDLTKTRVAEIAAVVKDMESVKINVSWLKTAVTELAEAVEYFGQYDTAKVEKEVCERDLTAKKGEMEEMTAELVKREKEIKECREKVTVVAGRLGQLEMKGSKLNKNLDLFQSKVHKFQGEAGSGMSGIVHHDCPNSGNPYHECHDQCFKRISSGDVPKKEKKRFGFGKPACSKETPLTSPVRVIAGNRSPLPSYYGKRMDESDESPSFSSSDDSFNANLPTPRSTLHGNETAPGINWLPMSPSFAVYCKKDCFSSRIDHREGEAPILDEMPSKTRLKTPLSPDTRPRKSEHRTRNQGPRSKTPEPRGSYLEPPRSRIPQTQPVPHRSLESAGLKSPQKGETRPHIPQTQPTSFNIGGNYHYAAQASKYHANKADSVYTKDRDKCVILYPDILLSPQENLTSRSITMLPQKSRTPLDKQSKEPLQLPVECHSFTPSEIECMKALKIYETGEEMKSMISESYVSVGSYKVRASVSSTLQKILDKHGDIASGSKLQSLRTKSYSLETLAAVVLELQSTPLKKLKQARVLEMLSVVIDAESVKIRAGWLREILNEILEAAHHYDGHETTVVEKEGRERDMLLEREEMKKIQEEVRLKEKEAKDFRKGVMEMAGRLGELKMKRARLEKRLAFLSSKRWGFMVAIKT

SEQ ID NO: 2832 - protein, 791 aa, Xylella fastidiosa Temecula1
MNENILWLHELRLTDLARVGGKNSSLGEMIGNLTALGVSVPGGYATTAAAFKAFIAYNNLSKRIYDKLATLDVEDVKALTAAGKEIRDWVIDAPLQPELEKDIRDAYDTLSKDNSGNDVAVAVRSSATAEDLPDASFAGQQETFLNVIGADQVVHKIKEVFASLYNDRAIAYRVHHGFKHEDVFLSAGIQLMVRSDISASGVLFTLDTESGFREVVFVTASFGLGEMVVQGAVNPDEFYVYKKTLKAGKPAILRRTLGTKLVRMVYSDAPGERVKIEDTPTELRHCFAISDADVQELARQALIIEQHYGRPMDIEWAKDGISGKLFIVQARPETVKSRSHTTQIERFALQQPGQILTEGRAIGQKIGSGTARVVNSLEDMHHMQPGDVLVADMTDPDWEPVMKRASAIVTNRGGRTCHAAIIARELGVPAVVGTGNALSIIQDGQPITVSCAEGDTGYIYAGKLPFERTTTDLGHMPPAPLKIMMNVANPERAFDFGQLPNAGIGLARLEMIIAAHIGVHPKALLEYHKQDADTKQKIDAKIAGYPDPVSFYVNRLAEGIATLTASVAPHTVIVRLSDFKSNEYAHLIGGQHYEPQEENPMLGFRGASRYVDPSFSDAFALECKAVLKVRNEMGLDNLWVMIPFVRTLEEGRKVIDVLRQNGLKQGENGLKVIMMCEVPSNALLADEFLDIFDGFSIGSNDLTQLSLGLDRDSSIVAPLFDERNPAVKKLLSMAIKAARSKGKYIGICGQGPSDHPDLAEWLMQEGIESLSLNPDTVVDTWLRLAKLKTVH

SEQ ID NO: 2833 - protein, 222 aa, Prochlorococcus marinus subsp. pastoris str. CCMP1986
MQVVILTGILAGFIHVVSGADHLIAMAPSSITSPKIAARNSISWGLGHSSGIIFLAFLAIFIKDITPLSKFSIFAEFLVGISLLIVGFFAIRNSLHLNLHSHSHQHNGVAHHHLHFHSEDQKKHNKHSHALTGLGLLHGLAGGSHFLAVLPALALPLPNAFAYLISYLSGSLASMVLFTCLISVTTLNAGQKFIRRLIAFAGGLSFSMGLFWVQKSTSLFLT

SEQ ID NO: 2834 - protein, 1175 aa, Aspergillus oryzae
MVLTTRCGQATASLLRQRCLAESRRSTLALRPFSSQTTAHSAASSLRLQQKTPSPWRPQQLRSFSSAISRLASESTNAPSAESYLASGIVKPGRNLVDVKKVLVIGSGGLSIGQAGEFDYSGSQALKALKEAGVESVLINPNIATIQTDHKLADEVYYLPVTPEYVTYVIERERPDAIFLSFGGQTALNLGVQMNRMGIFERYGVRVLGTSIKTLETSEDRDLFAKALNEINIPIAESIAVNTVDEALKAAEEVGYPIIVRSAYALGGLGSGFANNPEELRNLASRSLTLAPQILVEKSLRGWKEVEYEVVRDADNNCITVCNMENFDPLGIHTGDSIVVAPSQTLSDEEYHMLRTAAIKIVRHLGVVGECNVQYALQPDGLDYRVIEVNARLSRSSALASKATGYPLAYTAAKIGLGHTLPELPNAVTKTTTANFEPSLDYIVTKIPRWDLSKFQHVNRDIGSAMKSVGEVMAIGRTFEESFQKAIRQVDPRFVGFQGDKFENLDEVLQNPTDRRWLAVGQAMLHENYSVDKVHELTKIDKWFLYKLQNIVDCHNELKEIGSLFGIQKETMLKAKKLGFSDKQISLLVGASEDDVRARRKSFGITPWVKKIDTLAAEFPADTNYLYTTYNATSHDVTFDDHGIIILGSGVYRIGSSVEFDWCAVNATLSLRNMGKKTVMINYNPETYSTDFDTADKLYFEELSYERVMDIYELETASGVVVSVGGQLPQNIALRLQETGGANVLGTDPVDIDKAEDRHKFSSILDSIGVDQPAWKELTSVADAERFAESVGYPVLVRPSYVLSGAAMNVIYSQDELKEKLLNASAVSPDHPVVITKFIEGAQEIDVDAVASNGKLLLHAVSEHVEPAGVHSGDATLVLPPAYLDESVMGRVKEIAEKVAKAWNITGPFNMQIIKADQEGAQPELKVIECNLRASRSFPFVSKVLGTNFIDTATKALVGRDVPEPVDLMTEKRDYVATKVPQFSWTRLAGADPFLGVEMSSTGEIACFGKDLVEAYWASLQSTMNFRVPEPGEGILLGGDIKNPALAKIVEYLQPLGYKFFAASASVKDHIESTAKESVSVQVIEFPKKDKRALREVFEKYNIRGTFNLAKTRGKTLLDEDYVMRRNAVDFGVPLFMETKTALLFAQAMSEKLPRAEGMPSEVRSWSEFAGGKLL

SEQ ID NO: 2835 - protein, 340 aa, Gibberella zeae PH-1
MQMATERHFYYHGKEGYQEECSNCHWCQIRSFPTHSTLPVTVVNEQDFEVLPDDFRFIKNVVLGVGVRQAEDSFHSGCSCDNDAECQFTGCHCLADLDEEDSSEDDDDPFGDFINGMDIDRPRRKAYAYHAHGAKAGLLRSKFHNSKMPIYECHQSCACSINCPNRVVERGRTIPLEIFRTEDRGWGVRSPVSIRKGQFVDRYLGEIITSTEADRRRSQSAISQRKDVYLFALDKFTDPDSLDTRLKGPSLEVDGEFMSGPTRFVNHSCEPNMRIFARVGDHADKHIHDLALFAIKDIPRGEELTFDYVDGVSHEGEEPGEKSHMTPCLCGSKNCRKFLW

SEQ ID NO: 2836 - protein, 284 aa, Streptococcus agalactiae
QRKNDKEVKKLMKPWSDTQKRAAYDQYGAAGANGGFGGFDGGGFGGFEDIFSSFFGGGGMRNPNAPRQGDDLQYRVNLSFEEAIFGAEKEVSYNRESSCHTCSGSGAKPGTSPVTCQKCHGSGVINVDTQTPLGTMRRQVTCDVCQGSGQEIKEKCPTCHGTGHEKKTHKVSVKIPAGVETGQQIRLTGQGEAGFNGGPYGDLFVIINVLPSQQFERNGSTIYYTLNISFVQAALGDTIDIPTVHGAVEMSIPAGTQTGKTFRLRGKGAPKLRGGGQGDQHVTV

SEQ ID NO: 2837 - protein, 368 aa, Blastopirellula marina DSM 3645
MVNLAATMKDVIHLSIGQPDFQCPQHIVEAHIDALRAGHLGYTMDAGLPELLTELAKYYTARTEREITEDNILITTGATEAMYLAISVTSAPGRQFLIPDPTFPLYAPLVRMHGGEVKAIPTRAENGHQLDPQEVIDAIGPRTFAIILNSPSNPTGTVYPPETIEAIVQEAAYQGIRVISDEVYDHLILDDLEYASVLRHTSDLDHVMIASSFSKTYAMPGLRIGWIISSQGAIKMLRRYHMFTTTVANTPAQWAGVAALQGTTACVDEMVREYRRRRDRVVQLVSETPNLTGYWPQGGFYIFPSLPRTCNGSTLALRMLEEIGVCVVPGEAFGESCINSLRISYSTSMETIEEAFQRMIPWMAKQEM

SEQ ID NO: 2838 - protein, 417 aa, Prochlorococcus marinus subsp. pastoris str. CCMP1986
MELVDAPHSKCGTFGYVGSSPTAPTLMNTYTRFDISFKKGNGCWLWDEKGKKYLDAVAGIATCSLGHSNRILRKKLSAQLKKVQHISNLYKIEEQEELSKYLTKQSCAESVFFCNSGAEANESAIKLIKKYGNTVHKGKESFILAAESSFHGRTLATLSATGQPKYQKGFEPMVKGFKFFKYNDIASVKKLFEELKANNQKASGILVEPIQGEGGVIPGDKKFFKELREICNKYNSLLILDEVQSGVGRTGKMWGYENLEIEPDGFTLAKGLGGGHAIGALLVQKKANIFTPGDHASTFGGNPFACRAAITVLEEIKRRKILKNVLERGNQLNEGFTKISAKFPKIISGIRGLGLIQGLVINDSYTDAKTITLKAFDKGLLLVPAGGNVVRFVPPLIISRNEINILLKKLDLIFEEM

SEQ ID NO: 2839 - protein, 796 aa, Vibrio vulnificus CMCP6
MFLEKDMQKNTLWFNSLSMEDVDKVGGKNASLGEMVSNLANAGVSVPNGFATTSYAFNQFLDYEGLDERIHQLLDELDVDDVDALRKTGATIRQWVLEAPFPADLEQDIRENYSTLTDGNDEISVAVRSSATAEDLPDASFAGQQETFLNVRGIDAVLEATKHVYASLFNDRAISYRVHQGFDHRGIALSAGIQRMVRSDKAASGVMFTLDTESGFDKVVFITSAWGLGEMVVQGAVNPDEFYVHKPLLEAGQAPIVKKTFGSKLSKMIYANSQVIGKQVEIVDTSEAERNQFSLTDAEIVELAKQAMIIEKHYQRPMDIEWAKDGIDGQLYIVQARPETVCSQSDANVIERYELSHKAEVLIEGRAIGQRIGSGVVRLVDSLDQMSLVQTGDVLVTDMTDPDWEPVMKKASAIVTNRGGRTCHAAIIARELGIPAIVGCGNATSQLTDGDLVTVSCAEGETGYVYQGQLDFEVRRSSVDELPMLPTKVMMNVGNPDRAFDFAQIPNEGVGLARLEFIINKMIGIHPKALLNFDQQSESLKAEITQRIRGYQDPIDFYVSKLTEGIATIASAFWPKRVIVRMSDFKSNEYSNLVGGKAYEPHEENPMLGFRGASRYISPVFEDCFELETQAIKRVRNEMGLKNVEIMIPFVRTPSEAAQVVDLLAKFDLRRGEQGLKVIMMCELPSNAVLADEFLKYFDGFSIGSNDMTQLTLGLDRDSGDVAHLFDERNPAVKAMLKMAIDAATKAGKYVGICGQGPSDHEDFAEWLMEQGISSVSLNPDTVIDTWIQLGKANHK

SEQ ID NO: 2840 - protein, 370 aa, Francisella tularensis subsp. tularensis SCHU S4
MQQDKVNLLGLNQKAIEDFFISIGEKKFHARQVFKWIHKKGVIDFDAMTDLGKNLRHKLKEKAQITIPKVVFSKASKDGTHKWLIDVGGSAVETVFILAEGRGTLCVSSQVGCTLNCSFCSTGKQGFNRNLSAAEVIAQLWIAARTLSKTDGEHDFTVTNIVMMGMGEPLMNFENVVPAMDIMMDDLAYGLSRRKVTLSTSGVVPRIYDLLEQSGVSLAVSLHAPNDMLRNEIVPINKKYNIDELLEACKLYAQKGPHKHITFEYTLIEEVNDNLSDAEELVALLKSREVPAKINLIPFNPYPGTPYKKPSNNRIHRFKEFLQHNGFVTTVRKTRGDDIDAACGQLAGDVMDKTNRKQRYLKKLGDTNAN

SEQ ID NO: 2841 - protein, 107 aa, Synechococcus elongatus PCC 7942
MTPELQERLTSIINGDKIVVFMKGNKLMPQCGFSNNVVQILNILGVPFTTVDVLADYDIRQGIKEFSNWPTIPQVYVNGEFIGGSDILIELYQNGELQQMLEVALAS

SEQ ID NO: 2842 - protein, 428 aa, Blastopirellula marina DSM 3645
MSFIVDIRGLQVLDSRGNPTVEVEVTLDDGAMGRAAVPSGASTGVHEANELRDGDKSVYVGKGVTKAVENVNTVLAEVLLGEDALNQAEIDRKMIELDGTPNKSKLGANAILGVSLAVAKAAAQSSGLPLYRYLGGVGARLLPAPMMNILNGGSHADNNVDVQEFMVMPLGFDNFSDALRCGVEVFHSLKGVLKGKGLNTAVGDEGGFAPNLGSNIEALDLIMESIEKAGYKPGEQVFIALDCASSEYYNGETKKYTIDGKEFDSAAMVDFLADWASKYPIVSIEDGCDEDDWEGWKLLTEKLGDKVQLVGDDLFVTNTERLARGIQEGIANSILIKVNQIGTLTETINAITMAHNNGYTSVSSHRSGETEDSFIADLAVALGCGQIKTGSASRSDRMAKYNQLLRIEAELGENAMYGGPIFPTLKNK

SEQ ID NO: 2843 - protein, 509 aa, Clostridium perfringens str. 13
MRDLVLVVDFGGQYNQLIARRVRECGVYCEIIPYTYSIEKIKEKNPKGIIFTGGPNSVYGENTPTLDKEIFNLNVPVLGICYGDQLMAHLLGGKVDTAPVREYGKTNVTLDNSSKLFAGIEADETCWMSHTDYIAEAPEGFKIIAHTDVCPVAAMENEERRLYGVQFHPEVEHTPFGQNMMRNFLYNICGLENSWSMASFAEEKIAEIKKIVGDKKLICALSGGVDSSVAAVMVHKAVGKQLTCIFVDHGLLRKDEGDQVEKIFKEGFDMNLIRVNAQDRFLGKLKGVSDPETKRKIIGEEFIRVFEEEAGKLGDIKFLVQGTIYPDVVESGTDTSAVIKSHHNVGGLPEDMEFSLIEPLRELFKDEVRAVGEELGIPHHLVWRQPFPGPGLAIRVLGEVTEDKLEVVREADAIFREEIALAGLESEIWQYFAVLPNIQSVGVMGDERTYCHTVGLRAVTSSDGMTSNWAHIPYEVIDKVSRRIVNEVKGVNRIVYDVTSKPPATIEWE

SEQ ID NO: 2844 - protein, 795 aa, Aspergillus nidulans FGSC A4
MAPTVATQPPPPKRRRIGVLTSGGDAPGMNGAVRAVVRMAIHSDCEAYAVYEGYEGLVEGGDMIRQLHWEDVRGWLSQGGTLIGSARCMSFRERSGRLRAAKNMVLRGIDALVVCGGDGSLTGADVFRSEWPGLLDELVKNGELTAEQVEPYRVLNIVGLVGSIDNDMSGTDATIGCYSSLTRICDAVDDVFDTAFSHQRGFVIEVMGRHCGWLALMAAISTGADWLFIPEMPPKDGWEDIMCANITKNRRERGKRRTIVIVAEGAQDRNLNKITSDRVKDILTERLGLDTRTTILGHTQRGGAACAYDRSLSTLQGVEAVRAVLDMTPDSPSPVITIRENKIMRTPLMDAVKATQEVTAHIKNREFEKAMLLRDSEFKEYHFAYLKTATPDHPKLSLTQEKRMRIAIVHVGAPAGGMNQATRAAVTYCLTRGHTPIAIHNGFPGLIRHHADQPISSVREVKWQETDAWVNEGGSDIGTNRGLPSEDYDEVARCFKEHKFDALFVVGGFEAFTAVSQLRQARDKYDAFKIPMVVLPATISNNVPGTEYSLGSDTCLNALIDFCDAIRQSASSSRRRVFVIETQGGKSGYIATTAGLAVGAVAVYIPEEGIDIKMLARDIDFLRENFARDKGANRAGKIIMRNETASSTYTTQVIADMIKEEAKGRFESRAAVPGHFQQGGKPSPMDRIRALRMAIKCMMHLEGYAGKSKDEIANDEMSATVIGIKGSQVLFSVMGGEHGLEKVETDWARRRPKAEFWLQLQDTVNILSGRAGAKAMWTGYEDESRTRPSSPAHLS

SEQ ID NO: 2845 - protein, 239 aa, Aquifex aeolicus VF5
MENLNIVTLTGAGISAESGIPTFRGKDGLWNKFKPEELATPEAFFRNPKLVWEWYDWKRQLIAKAQPNEGHKILTKMEEEFPNFYLITQNVDGLHQRAGSKKVIELHGNIWKVRCVECGNERYEYTTPLPEIPPKCEKCGGLLRPGVVWFGESLPVDALSRAYELSREAHVFIVVGTSGVVYPAAELPFVAKENGAQVIEVNPEETPITKIADMHFKEKASTGLKKVYDYLREKYGSKG

SEQ ID NO: 2846 - protein, 138 aa, Brassica napus
DEDWYHPLKQILKVIDYYGIQLSQVSSFHWVNMFDDYPLSKLIHVPLSLIPMSVYEQSLDFINTLPFETLPAVVLWASDLILTEWPGVVKVEQLNSDLSKVATFVVLAMVLRTKPDALTLVLPKLRDRPTYQGRTSFP

SEQ ID NO: 2847 - protein, 453 aa, Brucella suis 1330
MNLFTSQFRNSQLLASKAHALIPGGCHTYAKGDDQYPVLAPGFIQRGSGAHVFDVDGHEYIEYGMGNRAVGLGHAYPPVVRAVREALQDGCNFTRPSAIELDCAESFLELIEGAEMVKFCKDGSDATSGALRLARAYTGRDMVACCADHPFFSTDDWFIGTTKMSAGIPASVSALTATFRYNDIASVEALFEDYPGRIAAIIMEPARADEPQDNFLHEAMRIAHENGALFILDEMITGFRWHMRGAQKLYGIVPDLSCFGKALGNGFAISALAGKAEYMRLGGLHHTDFPRVFLLSTTHGAETHAMAAAIATMAIYRDEPVIERLYEQGAKLAAGINEAIAGHRLQDHVRLSGRPCCLTYSTLDGNGMPSQAFRILFLQETIRRGVLMPSLVVSYTHSDADIARTIDAVHGALGIYVRALNDGVESCLVGRPSQVVYRRFNEDPASSCPPPRL

SEQ ID NO: 2848 - protein, 231 aa, Magnolia praecocissima
ENKINRQVTFAKRRNGLLKKAYELSVLCDAEVALIIFSNRGKLYEFCSSSSMLKTLERYQKCNYGAPELPVSTRETQSYHQEYLKLKARVEALQRSQRNLLGEDLGPLSGKELETLERQLDISLRQIRSTRTQCMLDQLGDLQRREHMLSEANKTLTRRLEEGAQANQNQVWEPNAHAVDSYNRQQPQQQGDGFFHPLECEPTLHIGYQPDQITIAAPGPSVNNYMPGWLV

SEQ ID NO: 2849 - protein, 212 aa, Magnolia praecocissima
  misc_feature (20)..(20): Xaa can be any naturally occurring amino acid
  misc_feature (180)..(180): Xaa can be any naturally occurring amino acid
  misc_feature (201)..(201): Xaa can be any naturally occurring amino acid
  misc_feature (204)..(204): Xaa can be any naturally occurring amino acid
  unsure (1)..(212): unsure at all Xaa locations
ENKINRQVTFAKRRNGLLKXAHELSVLCDAEVALIIFSTRGKLYEFCSSPSMLQTLERYQKCSYSTLEVSAPTNETQSSYQEYLKLKARVEILQRTQRNLLGEDLGPLSTKELEQLENQLEMSLKQIRSTKTQFMLDQLLDLKEGQCWRKQQGLKRKLEEMVEKSSSAVVGHRCTKHVFXKIANLLILRDSSSLWIANQHXRWXTIPCMKIR

SEQ ID NO: 2850 - protein, 324 aa, Streptococcus anginosus
YHPDINKEPGAEEKYKEVQEAYETLSDEQKRAAYDQYGAAGANGGFGGGAGGFGGFDGSSFGGFEDIFSSFFGGGGASRNPNAPRQGDDLQYRVNLKFEEAIFGTDKEIKYNREATCHTCHGSGAKPGTNPVTCSRCHGAGVINVDTQTPLGMMRRQVTCDVCHGRGQEIKDPCQTCHGTGHEKQAHSVHVKIPAGVETGQQVRLSGQGEAGFNGGPYGDLYVVVQVESSDKFERDGSTIYYKLNLNFVQAALGDSVEIPTVHGDVELTIPEGTQTGKRFRLRGKGAPSLRGGSMGDQYVTVNVVTPTGLNDKQKAALKEFAEA

SEQ ID NO: 2851 - protein, 323 aa, Streptococcus canis
HPDINKEAGAEQKYKDVQEAYETLSDSQKRAAYDQYGAAGANGGFGSGAGGFGGFDGAGFGGFEDIFSSFFGGGGMRNPNAPRQGDDLQYRVNLSFEEAVFGVEKEVSYNREATCGTCAGSGAKPGTSPVTCRKCHGSGVMTVDTQTPLGMMRRQVTCDVCHGSGQEIKEPCPTCHGTGHEKKVHKVSVKIPAGVETGQQIRLQGQGEAGFNGGPYGDLFVILNVLPSKKFERNGSTIYYSLNITFTQAALGDTVDIPTVHGDVEMAIPAGTQTGKTFRLKGKGAPKLRGGGQGDQHVTVNIVTPTKLNEAQKEALRALLRQG

SEQ ID NO: 2852 - protein, 321 aa, Streptococcus criceti
DINKEPGAEEKYKEIQEAYDTLGDEQKRANYDQFGPEGAANGGFGGGAGGFSGFDSAGFGGFEDIFSSFFGGGGASRNPNAPRQGDDLQYRVNLKFEEAIFGTEKEVHYNREVTCHTCDGSGAKPGTSPVTCSKCHGSGVINVDTQTPLGMMRRQMTCDVCHGSGKEIKEPCPTCHGSGREKQRHKMAVTIPAGVETGHQVRVVGQGEAGFNGGPYGDLYVIINVLASDKFERDGSTIYYNLDINFVQAALGDTVEVPTVHGAVDLKIPAGTQAGKVIRIKGKGAPRLNGNGQGDQRVTVNVVTPTKLNEAQKEALQALLS

SEQ ID NO: 2853 - protein, 568 aa, Xylella fastidiosa Temecula1
MSSSSIEDIKGKSHRLRGSLLESLANPTTGALGESDQTLIKYHGSYQQDDRDLREERRRQKLEPAYQFMIRTRTPGGVITPQQWLQLDAIATRYANHSLRVTTRQAFQFHGVIKRELKTTMQAINAALIDTLAACGDVNRNVQVAANPLLSRAHADLYTDAAHLSEHLLPNTRAYYEIWLDEKKVAGAGEEEEPIYGPHYLPRKFKIGFAAPPINDVDVFANDLGFIAVIVDNTLLGYNVTIGGGMGTTHGDPDTWPRVGNIIGFITRADLITISTAIVTTQRDFGNRTLRKRARFKYTIDDRGLDCIVGEIQQRAGITLQPARPFVFEHNGDRYGWIEGEDGHWHLTLSLPAGRIADTEGSTLLSGFREIAQLGIGEFRMTPNQNVVIAGISPGQRAAIDALVTQYGLDTGNRAPTALGRHAMACVALPTCGLAMAEAERYLPDFNAKLQPILEKYGLAEAPILLRISGCPNGCSRPYLAEIALVGKAPGRYNLMLGGDQRGQRLNTLYRENITETEILAALEPLLGRYQQKRLPSEGFGDFLHRTGIIALPPYPTHRHVISSTLQA

SEQ ID NO: 2854 - protein, 156 aa, Cryptococcus neoformans var. neoformans B-3501A
MFARTLRLAPTLLKTPFARTLTATSRMSAPYQVIATDKAPAAIGPYVQAVTYNGLIYSSGAIPLDPQSMEVVPGGIEAQATQVFKNISGLLTASGITPAQVLKTTCFLKDMNDFVAFNKIYAEFFGETKPARSCVEVARLPKDVLVEIEFIAVSKQ

SEQ ID NO: 2855 - protein, 298 aa, Streptococcus cristatus
GAEEKYKEVQEAYETLSDDQKRAAYDQYGAAGANGGFGGAGGFGGFDGAGGFGGFEDIFSSFFGGGGASRNPNAPRQGDDLQYRVNLTFEEAIFGAEKEVKYNREASCRTCNGSGAKPGTSPVTCGRCHGAGVINVDTQTPLGMMRRQVTCDVCHGRGKEIKDPCTTCHGTGHEKQAHSVHVKIPAGVETGQQIRLAGQGEAGFNGGPYGDLYVVVSVEASDKFEREGTTIFYKLNLNIVQATLGDTVEIPTVHGDVELVIPEGTQTGKKFRLRGKGAPSLRGGAVGDQYVTVNVVTP

SEQ ID NO: 2856 - protein, 303 aa, Streptococcus dysgalactiae subsp. dysgalactiae
EIKKAYRKMSKKYHPDINKEAGAEQKYKDVQEAYETLSDSQKRAAYDQYGAAGANGGFGGGAGGFGGFYGGGFGGFEDIFSSFFGGGGMRNPNAPRQGDDLQYRVNLSFEEAVFGVEKEVSYNREATCGTCSGSGAKPGTSPVTCHKCHGSGVMTVDTQTPLGMMRRQVTCDVCHGTGQEIKEPCPTCHGTGHEKKVHKVSVKIPAGVETGQQIRLQGQGEAGFNGGPYGDLFVILNVLPSKKFERNGSTIYYSLDISFTQAALGDTVDIPTVHGDVEMAIPAGTQTGKTFRLKGKGAPKPRG

SEQ ID NO: 2857 - protein, 102 aa, Arabidopsis thaliana
  misc_feature (21)..(21): Xaa can be any naturally occurring amino acid
  misc_feature (47)..(47): Xaa can be any naturally occurring amino acid
  unsure (1)..(102): unsure at all Xaa locations
MASSMLSSANMVASPAQASMXARFNGVRASAGLRGTGRGSCDMNSVXEDGGRDNCVLVGAPSVKTKFETRGYIPDLTDAAWAWGAEGLIRHWGSPLRKHSKC

SEQ ID NO: 2858 - protein, 332 aa, Thermotoga maritima
ARVAINGFGRIGRLVYRIIYERKNPDIEVVAINDLTDTKTLAHLLKYDSVHKKFPGKVEYTENSLIVDGKEIKVFAEPDPSKLPWKDLGVDFVIESTGVFRNREKAELHLQAGAKKVIITAPAKGEDITVVIGCNEDQLKPEHTIISCASCTTNSIAPIVKVLHEKFGIVSGMLTTVHSYTNDQRVLDLPHKDLRRARAAAVNIIPTTTGAAKAVALVVPEVKGKLDGMAIRVPTPDGSITDLTVLVEKETTVEEVNAVMKEATEGRLKGIIGYNDEPIVSSDIIGTTFSGIFDATITNVIGGKLVKVASWYDNEYGYSNRVVDTLELLLKM

SEQ ID NO: 2859 - protein, 143 aa, Oryza sativa (japonica cultivar-group)
MPVPLAPYPTPPVPFTPPNGAQSQLVCSGCRNLLMYPAGATSVCCAVCSTVTAVPAPGTEMAQLVCGGCHTLLMYIRGATSVQCSCCHTVNLAMEANQVAHVNCGNCRMLLMYQYGARSVKCAVCNFVTSVGASPGTDQKPSS

SEQ ID NO: 2860 - protein, 348 aa, Arabidopsis thaliana
MIDNNCLYKEELNRNSYSGLAKEASESILLPSESGFDGSRSPVCSSPDPNLNYRPVIGILSHPGDGASGRLTNDTSSTYIAASYVKFAEAGGARVIPLIYNEPEEVLFQKLELVNGVIFTGGWAKKYDYFEIVKKIFTKALERNDAGEHFPVYGICLGFELMSIIISQNRDILERFDAEDNASSLQFVDNVNNDGTLFQRFPPELLKKLSTDCLVMQKHKYGITPANFQANPALSSFFEILTTCIDENSKTYVSTVKAKRYPITGFQWHPEKNAFEWGSSAIPHSEDAIQVTQHAASYLVSEARKSLNRPESQKVLSNLIYNYKPTYCGYAGRGYDEVYIFTQPRSRF

SEQ ID NO: 2861 - protein, 484 aa, Thalassiosira pseudonana
MGKGGDAAAATKRSGALKLAEKPQKYTWQEVKKHITPDDAWVVHQNKVYDVSNWYDHPGGAVVFTHAGDDMTDIFAAFHAQGSQAMMKKFYIGDLIPESVEHKDQRQLDFEKGYRDLRAKLVMMGMFKSSKMYYAYKCSFNMCMWLVAVAMVYYSDSLAMHIGSALLLGLFWQQCGWLAHDFLHHQVFKQRKYGDLVGIFWGDLMQGFSMQWWKNKHNGHHAVPNLHNSSLDSQDGDPDIDTMPLLAWSLKQAQSFREINKGKDSTFVKYAIKFQAFTYFPILLLARISWLNESFKTAFGLGAASENAKLELEKRGLQYPLLEKLGITLHYTWMFVLSSGFGRWSLPYSIMYFFTATCSSGLFLALVFGLGHNGMSVYDATTRPDFWQLQVTTTRNIIGGHGIPQFFVDWFCGGLQYQVDHHLFPMMPRNNIAKCHKLVESFCKEWGVKYHEADMWDGTVEVLQHLSKVSDDFLVEMVKDFPAM

SEQ ID NO: 2862 - protein, 886 aa, Haemophilus influenzae R2846
MSEILKNDVDPIETQDWLQSLDSLIREEGVERAQYIVEQVIGQARTSGVSLPTGVTTDYVNTIPVAEQPAYPGDHAIERRIRSAVRWNAIAMVLRSQKKDLDLGGHISTFQSAATMYEVCYNHFFKATTEKNGGDLIFFQGHAAPGMYARAFLEGRLTEEQMDNFRQEAFTDGLSSYPHPKLMPEFWQFSTVSMGLGPVNAIYQARFLKYLDNRGLKDTKDQKVYAFLGDGEMDEIESKGALTFAAREKLDNLIFTISCNLQRLDGPVNGNGKIVQELEGLFTGAGWEVIKVLWGSDWDKLFAKDTSGKLTQLMMEVVDGDYLTFKSKDGAYIREHFFGRYPETAALVADMTDDEIWALRRGAHDSEKLYAAYVKAQNATKPVVILAHQVKGYKIPEAESKNTAHQSKKMSYESLKGFRDFFELPLTDEQVEKLEYIKFAEGTPEYEYLHGHRKALNGYVPARRTKFDVEYKVPALEEFKALLEEQPRGISTTMAFTRALNILLKDKNIGKTIVPMIADEARTFGMEGLFRQVGIYNPHGQNYVPSDRDLVAYYREAKDGQVLQEGINELGATASWLAAANSYSVNNQPMIPFFIYYSMFGFQRVGDLMWAAGDQLARGFMVGGTSGRTTLNGEGLQHEDGHSHIQAGVIPNCVTYDPSFAFEVAVIMQDGINRMYGEKQEDVFYYMTTLNEVMDQPAMPAGAEEGIRKGLYKFETVEGKKGKGHVQLLGSGAIMRHVREAAQILANDYGVTADVFSAPSFNELAREGHDAARWNLLHPTETQRVPYVAQVLADLPTVASTDYVKGYADQIRAFVPSKHYHVLGTDGFGRSDSRANLREHFEVDARYVVVAALSQLAKEGTVSNQVVADAIAKFGLNVDRINPLYA

SEQ ID NO: 2863 - protein, 294 aa, Zea mays
  misc_feature (44)..(44): Xaa can be any naturally occurring amino acid
  misc_feature (225)..(225): Xaa can be any naturally occurring amino acid
  misc_feature (228)..(228): Xaa can be any naturally occurring amino acid
  unsure (1)..(294): unsure at all Xaa locations
NIQNSRTESPPLLRNPIPVPDPHSPQPRAAPSPPPSPWSAPPPXPPPSGKPTQDELKRLAAHRAVELVEPCMTLGLGTGSTAAHALDRLGDLLRAGALPGVSGVPTSLKTEAHAARVGIPLLPLDAASIALSIDGADEVDPDLNLVKGRGGSLLREKMVEGAGARFAVIVDESKLVPRLGCTGAVPVEVVPFGAPHTLGLIRGLFHGLPGFHARLRTTTVPEGEXAPXQQPFVTDNGNYIVEMFFDGGIRGDLRDISDRLLRITGVVEHGMFLGMATVAIVAKKDGTVAVMERK

SEQ ID NO: 2864 - protein, 474 aa, Haemophilus influenzae R2846
MSKEIKTQVVVLGAGPAGYSAAFRCADLGLETVIVERYSTLGGVCLNVGCIPSKALLHVAKVIEEAKHANKNGIYFSEPRIELDEVRAGKEAVVAKLTGGLAGMAKARKVTVVEGLAAFTDPHTLVVRDRDGNPTTVKFDNAIIAAGSRPVQLPFIPHEDPRIWDSTDALKLKEVPKKLLIMGGGIIGLEMGTVYNALGSEVEVVEMFDQVIPAADKDVVGIYTKQVEKKFKLMLETKVTAVAAKDDGIYVSMEGKACNDTKRYDAVLVAIGRVPNGKLIDAGKAGVEVDDRGFIHVDKQMRTNVPHIYAIGDIVGQPMLAHKGVHEGHVAAEVIAGQKHYFDPKVIPSIAYTEPEVAWVGKTEKECKQEGLNYEVAKFPWAASGRAIASECSEGMTKLIFDKDTHCVLGGAIVGSNGGELLGEIGLAIEMGCDAEDIALTIHAHPTLHESVGLAAEVFEGSITDLPNAKAKKK

SEQ ID NO: 2865 - protein, 180 aa, Haemophilus influenzae R2846
MTTQLDLIKSSIKSIPNYPKEGIIFRDITTLLEVPAAFKATIDLIVEQYRDKGITKVLGTESRGFIFGAPVALALGLPFELVRKPKKLPRETISQSYQLEYGQDTLEMHVDAISQGDNVLIIDDLLATGGTVEATVKLVQRLGGTVKHAAFVINLPELGGEKRLNHLGVDCHTLVNFEGH

SEQ ID NO: 2866 - protein, 121 aa, Triticum aestivum
MNARGYRSTRTALFDGIEEGGIRASAYSSHEIDEHENERAMDGLQDRVSILKRISGDINEEVEAHNRMLDRMGNDMDSSRGFLSGTVDKFKTVFETKSSRRMGTLVASFVALFMLVYYLTR

SEQ ID NO: 2867 - protein, 426 aa, Brucella suis 1330
MGYFPSWRLTSNAVVLPDERLPAAAAVPMGIQHLLAMSGSTIVAPLLMGFDPNVAVFFSGIGTLLFFLITAGRVPSYLGSSFAFIAVVIAATGYSGSGPNPNIAIALGGIIACGAFYSLIGLIVMFLGTGWVEKLMPPAVTGAIGVSIGLNLAPVAIGQLKGTGAHTSIALLTVLCMAMISAYGPRGTRRLSVLFALLFGYLLVLIAGNGLGIVPGIDFTAVKNAAWFGLPHFTTPAFNWQAVTLIAPVAIVLVAENLGHIKALGSITGRNMDGYIGRGFFSDGLATMISGAGGGTGVTTYAENIGVMAMTKVYSTLIFVIAAIMALILGMSPKFGAILQTIPAPVLAGLAVSVFGLIASAMARIWIVNKVDFADSRNLFTVGVALIFGAGDFTLNIGNFALGGIATSTLAALVLYQLLGIGRSDS

SEQ ID NO: 2868 - protein, 849 aa, Myxococcus xanthus DK 1622
MATPEIQAPLAALLPKKGEPPLDADEILNRFVGYVAANGLSLYSAQEEAILELLAGKHLFLKTPTGSGKSLVATALHFKAMAEGKVSFYTCPIKALVNEKFFALCDAFGAENVGMLTGDASINRDAPIICCTAEILANLALRDASARVDYVVMDEFHYYSDRERGVAWQLPLIALPDTTFLLMSATLGPTHVIEESLTKLTGREVATVRSAERPVPLDFDYRESPLHETIEDLIARGKYPIYLVNFTQRTAAEQAQNLMSVDFSTKEEKEAIRLALQDAPFDTPYGKEFQRFLRHGIGMHHAGLLPKYRLLVEKLAQHGHLKVISGTDTLGVGVNIPIRTVLFTQLFKFNGEKLTTLSVRDFQQIAGRAGRKGFDTQGSVVAQAPEYVIENIKLAAKEAAGKKKTPKAKPPQKNFVQYDRSTFERLQNGMPEPLESRFAVSHGMILNLLQSDHQTEGNGGYKRLVTLVQRSHDSDYLKRRHLKEAARDFRTLRGAEIIEVEKGQGGSGATVKVAGEMQHDFSLNHTLSLYLLDTLELLDPTTDTYALDVVSLVEAILENPDVVLYAQLNQLKGEKINELKAQGVEYDDRMAELEKLEWPKPNRDFIYGTFNKFAQKHPWVGEENIRPKSIVRDMFERFMSFPDYIREYGLQRSEGVLLRYVNDTYKTLVQTVPERFRTEEVEDFIDHLRATLRQVDSSLLDEWERMRNPDAAVEAKPVVELKPKELTDDPKAFAARVREELHRLLKALGQKRYMDALAMLDNALGEWTAPKLEQAMAPYFEEHKVVVLTPQARKPANTFLKESGTRLWETQQRIIDPEGHGDWMIDCEIDLRDRRLDEGPILMLRRIGV

SEQ ID NO: 2869 - protein, 297 aa, Streptococcus equi subsp. equi
EAYETLSDSQKRAAYDQYGAAGANGGFGGGAGGFGGFDGGGFGGFEDIFSSFFGGGGMRNPNAPRQGDDLQYRVNLSFEEAVFGTEKEVSYHRESTCSTCAGSGAKPGTSPTTCRKCHGSGVINVDTQTPLGMMRRQVTCDVCHGSGQEIKEPCHTCHGTGHEKKVHKVSVKIPAGVETGQQIRLQGQGEAGFNGGPYGDLFVILNVLPSKQFERNGSTIYYSLNISFVQAALGDTVDIPTVHGDVAMSIPAGTQTGKVFRLKGKGAPKLRGGGQGDQHVTVNIVTPTKLNEAQKEA

SEQ ID NO: 2870 - protein, 180 aa, Hordeum vulgare subsp. vulgare
MFPMVTGFMSYGQQTIRATRYIGQSFITTLSHTNRLPITIHYPYEKSITPERFRGRIHFEFDKCIACEVCVRVCPIDLPVVDWRFEKDIKRKQLLNYSIDFGVCIFCGNCVEYCPTSCLSMTEEYELSTYDRHELNYNQIALSRLPISIMGDYTIQTIRNSSESKINEEKSSNSRTITDY

SEQ ID NO: 2871 - protein, 323 aa, Streptococcus equi subsp. equi
HPDINKEPGAEQKYKDVQEAYETLSDSQKRAAYDQYGAAGANGGFGGGAGGFGGFDGGGFGGFEDIFSSFFGGGGMRNPNAPRQGDDLQYRVNLSFEEAVFGTEKEVSYHRESTCSTCAGSGAKPGTSPTTCRKCHGSGVINVDTQTPLGMMRRQVTCDVCHGSGQEIKEPCHTCHGTGHEKKVHKVSVKIPAGVETGQQIRLQGQGEAGFNGGPYGDLFVILNVLPSKQFERNGSTIYYSLNISFVQAALGDTVDIPTVHGDVAMSIPAGTQTGKVFRLKGKGAPKLRGGGQGDQHVTVNIVTPTKLNEAQKEALKAFAEAR

SEQ ID NO: 2872 - protein, 378 aa, Cryptococcus neoformans var. neoformans B-3501A
MHFDEPISPRSQPSNLPGFESRRAFSLPSITMPFNNYGNNNAPLLPLTRHSFSGPSSRRSAARRLSYGIKNRASQYPYSVTIGGILTLALFFFVYTSPGSDLGRYNSAASRLHIRTPNEDILPLPTSERVIHRPDSKMDNGVMLLTVDENELIAEDDLFWDTYTEAEPLSAEEAAAEAELQAHKQNVQAQNVAQSLRALVWWLAEGGVLPNDFEVPSKSHLKKIGSSGFEKLLSSIDAGEGDEIIFEDGWADFANKRYRIVVFSKTYCPYSKNAKSILGKYHLSPAPFIIELNQRSDMEALQGLLQRFTNRRTVPNVLLDFICIGGSDDITLLHSEGGLHRKFEEMGAFPGLVRRATSLLPDSEENRRDEFEDHEDRS

SEQ ID NO: 2873 - protein, 998 aa, Thiobacillus denitrificans ATCC 25259
MNHYAITMPQLSDTMTEGVVVTWEKQPGDRVERGDIVATVETDKAIMDVEVFKAGYLAGPLADVGATIAVGAALGYITDTAGDVAIAADEVVAEQAQTEMIPHHAGTPIVMPQLSDTMTEGVVVTWEKQPGEAIKRGDIVATVETDKAIMDVEVFQEGFLSGPIADIGSVVEVGHPMAFIVDDAAKANDTGVTISADHKVKDTHKVAPPAADKPAHLPIPKTAPSQVAAAGNAVPVPRPQGRQASPYARKVAAQLGVNLTGLAGSGPSGVLVAADVARARPSMQEVAHALPQVDVPGQGRPMTSMEKAVSHAMTASLTLPTFNVTVNIDTAALTAATKAKKVSVTVAIAKACSVAMAKFPRMNWAYQPVDKLVERANHDFGVAVMSNDGGLVVPILHGVEKKSLEALQGDWTGLVERARVRKLAPPEYSNPTFTISNMGMLGVSHFTAIPTPGISAILAIAANGPQGTPFTITGDHRVLNGADVALYLTTLKQTIEAPDAWLSGGTAAETAGAAATTSAPVSPIPEGNWDVQVVVVGGGPGGEDCARDLADHGVKVMMVNNEPFPGGECLWRGCIPSKAWRAAADNIRNRAHDAEMGVDGTANPKLNWAQVEKHRRWVQTSRGEMALKADKGMKIDVREGYGEFVDAHTLKITPPEGEAYTVSFGAAVIATGAPAFVPPIPGARENLATGGVVTSDTIWNLANPPKKLGIVGGGVIGVEMAQIFRDFGTEVLMLERHDRILAEIEEEIGKVLIASLEKEITVVTSADIREVGGKPGKMTLRYADKEGAESTFDCDVVLMATGKRPDTSRLNLDKVGVALDGAAIKVDARCCTSTPNIYAVGDVIGGYMLAHTAATQGRVAASNLLGHASEYDQDRDCGVTFSRPQAGFVGLSVAQAKAKGIDAVEAKMPMSIDAKAMITGETEGMIKLVADKTTGRIIGVHYLADHTDTLIGTGVMMVAGEMTLTQVAKAIFPHPTQTELFGELARRLLNRLRRTAKK

SEQ ID NO: 2874 - protein, 393 aa, Hordeum vulgare subsp. vulgare
MSLPLTKKDLMIVNMGPQHPSMHGVLRLIVTLDGEDVIDCEPILGYLHRGMEKIAENRTIIQYLPYVTRWDYLATMFTEAITVNAPEFLENIQIPQRASYIRVIMLELSRIASHLLWLGPFMADLGAQTPFFYIFRERELIYDLFEAATGMRMMHNYFRIGGVAADLPYGWIDKCLDFCDYFLRGVVEYQQLITQNPIFLERVEGVGFISGEEAVNWGLSGPMLRASGIQWDLRKVDPYESYNQFDWKVQWQKEGDSLARYLVRVGEMSESIKIIQQAIEKIPGGPYENLEVRRFKKEKNSEWNDFEYKFLGKKPSPNFELSRQELYVRVEAPKGELGIYLVGDDSLFPWRWKIRPPGFINLQILPQLVKKMKLADIMTILGSIDIIMGEVDR

SEQ ID NO: 2875 - protein, 305 aa, Streptococcus equinus
VQEAYETLGDEQKRAAYDQYGPAGSNGGFNGGAGGFGGFDGAGFGGFEDIFSSFFGGGGGMRNPNAPRQGDDLQYRVNLTFEEAVFGVEKEVAYNRESTCSTCSGSGAKPGTSPVTCSRCHGSGVINVDTQTPLGMMRRQVTCDVCHGTGKEIKEPCHTCHGTGHEKKTHKVSVKIPAGVETGQQIRLQGQGEAGFNGGPYGDLFVIINVLPSNKFERNGSTIYYTMNISFVQAALGDTVEVPTVHGDVEMTIPAGTQTGKTFRLKGKGAPKLRGGGQGDQHVTVNIVTPTKLNDAQVEALKQFA

SEQ ID NO: 2876 - protein, 143 aa, Escherichia coli CFT073
MAIERTFSIIKPNAVAKNVIGSIFARFEAAGFKIVGTKMLHLTVEQARGFYAEHDGKPFFDGLVEFMTSGPIVVSVLEGENAVQRHRDLLGATNPANALAGTLRADYADSLTENGTHGSDSVESAAREIAYFFGEGEVCPRTR

SEQ ID NO: 2877 - protein, 327 aa, Thiobacillus denitrificans ATCC 25259
MANIMYWEAIQRAHDEEMARDPLVICLGEDIGVAGGTYKATKGLYEKYGPLRVMDTPISEGGFTGLAVGASFLGVRPIVEIMSVNFAWLAMDQMFNSAAKVRYMSGGQLTAPCVFRSAGGAAHQLGAQHSARMEKVFMGIAGLRVVTPSNPKQAYGLLKSAIRCDDPVFINEHELMYNMKGEVPDGEYFHPLEGSEVARAGTDVTLFGYNISVHWCLKAAEILDKQYGISAEVVDLYSLAPLDRAGIKASVTKTHRAVVVEEDEAPVGVGSEVIAIINEECFFELDAAPVRVHSALVPQPYNHTLEKAAIPDHEDVVKAVLKMFGRA

SEQ ID NO: 2878 - protein, 301 aa, Streptococcus ferus
DINKEAGAEEKYKAIQEAYETLGDEQKRAAYDQYGPAGASGGFNGGGGFSGFDGGGFGGFEDIFSSFFGGGASRNPNAPRQGDDLQYRVNLKFEEAIFGAEKEVRYNREATCHTCDGSGAKPGTSPVTCSKCHGSGVINVDTQTPLGMMRRQVTCDVCHGSGQEIKEPCQTCHGSGHEKQSHKVSVKIPAGVETGQQIRLAGQGEAGFNGGPYGDLFVIINVLKSDQFERDGSTIYYDLNINFVQAALGDTVEVPTVHGAVEMAIPAGTQTGKTFRLKGKGAPRLRGNGQGDQHVTVNVVT

SEQ ID NO: 2879 - protein, 333 aa, Thiobacillus denitrificans ATCC 25259
MKIEDKKRVLREMVLHRRFEERCYQAYIERKIGGFLHLYPGQEACCNGVMEAARPGHDYVITGYRDHVHAIKCGADPKEVMAELYGKETGSSKGRGGSMHIFDAGKRFMGGYALVGGPFPLAAGIAKAIQLKGGDEIAICFLGDAANNQGTFHETMNMAALWKLPVLFVCENNLYGIGTSIERSTAVVHQHKRVAAYNIPADECDGQDIEVVYEHARKAVDHVRAGNGPFFLELMTYRYRGHSMSDSRGYRTREEEELWKQRDPIFILRDRLIKEGATTMAEFEALEKETDAYIENEVIKFAEASPEPSVDELEKYVLADRESQLPWLTGKAA

SEQ ID NO: 2880 - protein, 257 aa, Schizophyllum commune
MPESREDSVYLAKLAEQAERYEEMVENMKRVASSDQELTVEERNLLSVAYKNVIGARRASWRIVSSIEQKEESKGNEAQVSMIKGYREKIEGELAKICEDILDVLEKHLIPSAASGESKVFYHKMMGDYHRYLAEFATGDKRKDSADKSLEAYKAASDVAVTELPPTHPIRLGLALNFSVFYYEILNSPDRACHLAKQAFDDAIAELDTLSEESYKDSTLIMQLLRDNLTLWTSDMQDSGEKPADSKDEAPEAPGDE

SEQ ID NO: 2881 - protein, 371 aa, Zea mays
  misc_feature (128)..(128): Xaa can be any naturally occurring amino acid
  misc_feature (140)..(140): Xaa can be any naturally occurring amino acid
  unsure (1)..(371): unsure at all Xaa locations
MTEAARFHGMIGGGGGKGMQDNVINGFDNIPYYQKFGEGSHMSVDSVDGFNLTNCAGGSVAMSVDSSSVGSNESRTVILKHPGLRDAPTASYSVNNSVFRPNRVAAHTLNEDALAQVLMDPNHPTEVXMGGPFAQGAFGXLYRGIYNGEDVAIKLLEKSENDPERAHSMEQQFVQEVMMLSRLSHPNIVRFIGACRKSVVWCTITEYAKGGSVRQFLARRDLKSDNLLISADKSIKIADFGVARIEVKTEGMTPETNLPVDGTHRPYDHNVDVYSFGIVLWELITGMLPFTNMTAVQAAFAVVNKGARPVIPQDCLSSLSHIMTRCWDANPEVRPPFTEIVCMLESAEMELLNNVRKARFRCCISEPMTTD

SEQ ID NO: 2882 - protein, 739 aa, Cryptococcus neoformans var. neoformans B-3501A
MEEGRIWSVGVLEGAEQQNAPSEIERLFYDFLHGFRIEDQWTYRDALRSALLLKHHTLEVDLRDLVAWNEELAQKVQEKPGEMIPLLEAALLKYARDLVRPTSEADRERERERAQNGQPSLAAEEVPDMQVAIKSGMNLLQFRQLNANTLTTLVRLPGIVINASQLTSRATELALQCKGCRSVKHVKVSGAIGGERAALPRRCDAEPVEGQRKDCPLDPYVILHDRCRFVDQQNIKLQEAPDMVPVGELPRHMMLHAERNLTGKVVPGSRIIATGIYSTFAPNHKSQKTSGAPALRQPYLRVLGIELDSSAASSGTRVFTPEEEEEFQQLARSDDLYERFANSVAPSIYGNLDIKKAVTCLLMGGSKKILPDGMRLRGDINVLLLGDPGTAKSQLLKFVEKVSPISVYTSGKGSSAAGLTASVQRDPVTREFFLEGGAMVLADGGVVCIDEFDKMRDEDRVAIHEAMEQQTISIAKAGITTILNSRTSVLAAANPVFGRYDDMKSPGENIDFQTTILSRFDMIFIIKDEHNEQRDRTIAKHVMNIHMNRQTENEAVGEIDIEKMKRYIGYCKSRCAPNLSGEAAEMLSSHFVSLRKEVAQVERDNDERSSIPMTVRQLEAIIRISESLAKITLSPRVLPHHVEEAIRLFKFSTMHAVSVGSGVEGLSRTELNEEIDRIEKELKRRLPIGYSTSYQSLVREFVSGQGYSQHALERCLYILEKREVVKYTGMRRVVQRIGV

SEQ ID NO: 2883 - protein, 328 aa, Streptococcus gallolyticus subsp. gallolyticus
HPDINKAPGAEEKYKEIQEAYETLGDEQKRAAYDQYGAAGANGGFGGGFGGGSGGFGGFDGGAGFGGFEDILSSFFGGGGGMRNPNAPRQGDDLQYRVNLSFEEAIFGVEKEVVYNRESTCSTCSGTGAKPGTSPVTCSRCHGSGVINVDTQTPLGMMRHQVTCDVCHGTGKEIKDPCPTCHGTGHEKKTHKVSVKIPAGVETGQQIRLKGQGEAGFNGGPYGDLFVIINVLPSKQFERNGSTIYYNMNISFVQAALGDTVKVPTVHGDVEMTIPAGTQTGKTFRLKGKGAPKLSGGGQGDQHVTVNIVTPTNLMMLKSKRLKTRSSR

SEQ ID NO: 2884 - protein, 306 aa, Prochlorococcus marinus str. MIT 9303
MVSPLPVSSATNRQQRLWAAVKAHREPLPAKQRRLKWGTTSFMLAMHVAATFALLPRFWSWQGLVAFAVLYWTTVLGVTLGLHRLVAHRSFVVPVWLERVLVIMATLACQSGPIEWVALHRHHHRYSDQTNDHHDAGRGLWWAHSEWMLHEIPALDHMDRFAGDLLADPFFRWLDRWFLLLQIPLGLGLYWYGEVAQVHGGGLGLVLWAIPLRLVVVYHVTWFVNSATHAFGYRNFDSPDLSRNCWWVAVLSFGEGWHNNHHAYPSSARHGLRWFEFDITWQHVKALRRLGLARRVQQARYVSGAS

SEQ ID NO: 2885 - protein, 677 aa, Prochlorococcus marinus subsp. pastoris str. CCMP1986
MNDIKVGKPLPLGSSITSGGVNFSLIATNAEYIEILLFEKEDSVAPKTIFKLDHSHKTGSYWHAEINNLKEGSIYAFRVKQNDNGLNKNYSKTVLIDPCSRGITGWSNYKRKNALNNIDNMDCCLKSVVCDRKSFNFKDFPRPKHSWKETIIYELHIKAFTQSSNEEESCFKKFLKKIPYLKKLGITSIELLPVFCFDPNDAPNGLENFWGYSPINWFTPHFQYLSNNTAKGNREEFRKFVEECHKANIEVILDVVYNHTSEGDYQGPAISWKGIDDNLYYFIDKDKNYQDVSGCGNTIAANRGLVRKLILESLKCWVNELGVDGFRFDLGIALSRGEDLIPLDNPPIFDDIECDPELADIKFISEPWDCGGLYKLNDFPSKKTFTWNGHFRDDLRRFWKGDKDTAWNMSDKIKGSPSHYKENNFLPKSINFITSHDGFTLKDLVTFNKKHNFANKEQNRDGDNHNNSWNHGVEGPTSDLSIKKLRKRQQKNLLLSLFISRGVPMLLMGDEIGRSQGGNNNSWCQNNSLGWMNWDENQQDLELLNYLKYLIKIRKKFINFFNPISSTNKKEIDNLANYYWHGPKLESPDWSSWSHTVALSINKGENNPLIWAGLNAYSKSIDFYLPKSKSKWLKIIDTNHSENTKPIPITDTFIKVDNRSSVLIISEEVFGTKNNII

SEQ ID NO: 2886 - protein, 321 aa, Prochlorococcus marinus str. MIT 9303
MYSLRSFDRSLMASRVIPTPSTISRPVASHKALSLSTKLQRPFTSKAIGPPKESRRWGTIGFMIAIHALSILALLPRFWSWQAITTLLVLYWVTACLGVTIGYHRLLSHRSFRVPRWLERFFATCGTLSCQHGPLDWVGLHRHHHKFSDTDPDHHNSHKGFWWSHMGWMFEPIPAMRTVPRLTVDLADDPYYRWLNKYFLLLQLPLAGLLFWIGSVSGAGGWTLVLWGIPLRLTIVYHITWLVNSASHCWGTVAFDSGDNSRNNPWVAALTFGEGWHNNHHAFPYSAIHGLQRGQIDLTWQHIRLMRALGLARKIRLPITS

SEQ ID NO: 2887 - protein, 498 aa, Arabidopsis thaliana
MVIHKSITPIALMLLLLLAIHAHIQVVGSTTVTSVSLANLKHETSSEINFPVWRRELRGGGGGGRGGGGGHGGGGGEDFALLLRSKNLELLTMETSIACYSRGILPPSVSSQRSSTLVSPPSYSTSSSFKRLKSSSIFGDSLRLAPKSQLKATKAKSNGASTVTKCEIGQSLEEFLAQATPDKGLRTLLMCMGEALRTIAFKVRTASCGGTACVNSFGDEQLAVDMLADKLLFEALQYSHVCKYACSEEVPELQDMGGPVEGGFSVAFDPLDGSSIVDTNFTVGTIFGVWPGDKLTGITGGDQVAAAMGIYGPRTTYVLAVKGFPGTHEFLLLDEGFGLVLFYQDSFFGKWQHVKETTEIAEGKMFSPGNLRATFDNSEYSKLIDYYVKEKYTLRYTGGMVPDVNQIIVKEKGIFTNVTSPTAKAKLRLLFEVAPLGLLIENAGGFSSDGHKSVLDKTIINLDDRTQVAYGSKNEIIRFEETLYGTSRLKNVPIGVTA

SEQ ID NO: 2888 - protein, 990 aa, Glycine max; identical to SEQ ID NO: 1326

SEQ ID NO: 2889 - protein, 152 aa, Triticum aestivum
PKEGLRVLLEYIREWNTKPKFCHVAQFVLFRVLRSLPPTDILEIKGISELLEGLIPYSQRHFSRVDRLVRSTFLLDYTLTRMSVVDPDVDAGTTKDVTNDSSMDNVEITPAEPALETPEKPGKKRKSSKTSQSSKKSSKKVKASSNAVSVEA

SEQ ID NO: 2890 - protein, 329 aa, Oryza sativa (japonica cultivar-group)
MRTTARPTAAATALALIVVLVFSPSPATAATARMFKTIDARRSQHLDLTGSLVGPESVAFDGKGHGPYSGVSDGRVMRWNGEAAGWSTYTYSPSYTNNKCAASTLPTVQTESKCGRPLGLRFHFKTGNLYIADAYMGLMRVGPGGGEATVLATKADGVPLRFTNGVDIDQVTGDVYFTDSSMNYQRSQHEQVTATKDSTGRLMKYDPRTNQVTVLQSNITYPNGVAIGVDRTHLIVALTGPCKLMRYWIQGSKAGKSEPFAELPGYPDNVRPDGKGGYWVALHREKYELPFGPDNHLVAMRVSAGGKLVQQMRGPKSLRPTEVMGEEGW

SEQ ID NO: 2891 - protein, 203 aa, Zea mays
  misc_feature (42)..(42): Xaa can be any naturally occurring amino acid
  misc_feature (62)..(62): Xaa can be any naturally occurring amino acid
  misc_feature (93)..(93): Xaa can be any naturally occurring amino acid
  misc_feature (102)..(102): Xaa can be any naturally occurring amino acid
  misc_feature (120)..(120): Xaa can be any naturally occurring amino acid
  misc_feature (143)..(143): Xaa can be any naturally occurring amino acid
  misc_feature (150)..(150): Xaa can be any naturally occurring amino acid
  misc_feature (156)..(156): Xaa can be any naturally occurring amino acid
  misc_feature (175)..(175): Xaa can be any naturally occurring amino acid
  unsure (1)..(203): unsure at all Xaa locations
GLPSFNDFLHCLCQKNLKFNPYALVPEAIDILTEMRSCAVPXAVSSFSILLSCLGRIRRVKXAGCSPDLVSYYLVVRVLYIALARRGKWLVEXDAMLERGVXPTVKFFHRLIGVVCGTEXVEHALDIFKLMKRCELVYARIVXLLIENIXRIGRFXIGRELWDEATKSGLVLGCXQDLLDPLKTEEQEQDFGVLLKQGAEGGA

SEQ ID NO: 2892 - protein, 468 aa, Pseudomonas taetrolens
MSKSVQLIKDHDVKWIDLRFTDTKGTQHHVTMPARDALEDDFFEVGKMFDGSSIAGWKGIEASDMILLPDDDTAVLDPFTEDATLILVCDIIEPSTMQGYDRDPRAIAHRAEEYLKTTGIGDTVFAGPEPEFFIFDEVKFKSDISGSMFKIYSEQGSWMSDQDIEGGNKGHRPGVKGGYFPVPPFDHDHEIRTAMCNALEEMGQTVEVHHHEVATAGQNEIGVKFNTLVKKADEVQTLKYVVHNVADAYGRTATFMPKPLYGDNGSGMHVHMSIAKDGKNTFAGEGYAGLSETALYFIGGIIKHGKALNGFTNPATNSYKRLVPGFEAPVMLAYSARNRSASIRIPYVNSPRGRRIEARFPDPAANPYLAFAALLMAGLDGIQNKIHPGDAADKNLYDLPPEEAKEIPQVCGSLKEALEELDKGRAFLTKGGVFSDDFIDAYIALKSEEEIKVRTFVHPLEYELYYSC

SEQ ID NO: 2893 - protein, 70 aa, Brassica rapa subsp. pekinensis
VCYENPSPTAGIHRVVFILFRQLGRQTVYAPGWRQNFNTREFAEIYNLGLPVAAVFYNCQRESGCGGRRL

SEQ ID NO: 2894 - protein, 881 aa, Streptococcus agalactiae 2603V/R
METKFVYHFDEGCKEMKELLGGKGANLAEMTSIGLPVPQGFTITTQACNDYYDNACHIRESILSQIDQAMAQLEVEQNKQLGSVDDPLLVSVRSGSVFSMPGMMDTVLNLGLNDRSVQGLVKKTEDERFAYDSYRRFIQMFADVVTGIPKYKFDTILDRLKTDKCYQDDTELTGSDLKRLVEFYKELYQKEAGEKFPQDPKRQLLLAIEAVFKSWNNPRAKIYRKLNDIPETLGTAVNIQAMVFGNMGNNSGTGVAFTRNPSTGAANLFGEYLINAQGEDVVAGIRTPQSISKLAEQMPIIYQEFVSVTQKLEAHYRDMQDMEFTIENGNLYMLQTRSGKRTAKAAIKIAVDQVNEGLISKEEAILRIEPKQLDQLLHPSFDLKSLKKAIILTTGLPASPGAAYGKVYFHAEDVVKEMKKGNPVLLVRQETSPEDIEGMVSANGIITARGGMTSHAAVVARGMGKPCVAGCSQLLVDEVRREISIGHQTIKEGEMLSIDGATGNVYIGQVPMAETSVDRDFEIFMKWVDENRDMMVCSNADNPRDAQKALDFGAEGIGLCRTEHMFFDDERIPVVREMILADEILSRRKALERLLSFQRDDFYQIFKVLKGKACTIRLLDPPLHEFLPHDKESIESMARQMGISTLAIEKRIQTLEEFNPMLGHRGCRLAITYPEIYQMQVRALVQGAILAMKEGYEAKPEIMIPLVTAHEEISIIRDLIEETIVEESKSKKINLSFPIGTMIETPRACMIADDIAKFADFFSFGTNDLTQMSFGFSRDDAGKFLGEYVDKGLLKKDPFQVLDQKGIGRFIGQAVRLGKEVKPNLKIGICGEHGGEPSSIEFCYQLGLHYVSCSPFRIPIAKLAAAQAKIKQSRNDITIDK

SEQ ID NO: 2895 - protein, 285 aa, Streptococcus gallolyticus subsp. gallolyticus
AYETLGDEQKRAAYDQYGAAGANGGFGGGAGGFGGFDGGAGFGGFEDIFSSFFGGGGGMRNPNAPRQGDDLQYRVNLSFEEAVFGVEKEVAYNRESTCSTCSGTGAKPGTSPVTCSRCHGSGVINVDTQTPLGMMRRQVTCDVCHGTGKEIKDPCHTCHGTGHEKKTHKVSVKIPAGVETGQQIRLQGQGEAGFNGGPYGDLFVIINVLPSKQFERNGSTIYYNMNISFVQAALGDTVEVPTVHGDVEMTIPAGTQTGKTFRLKGKGAPKLRGGGQGPTCNRQYC

SEQ ID NO: 2896 - protein, 603 aa, Xylella fastidiosa Temecula1
MNITTALPLPTHLLSEKVTAPLLGARKIYVTGSRQDIRVPMREIALTPSSARYGGNENLSLVLYDTSGIYTDPQATIDLACGLPRLRTAWIDERADTVEAKLHFKVPESVSVTAPPFPTPPQPLRARDNVAVTQLEYARRGLVTPEMEFVAIREQQRREQTVENLRGQRHAGDAWGALVGTPITPEFVRDEIARGRAILPNNINHPESEPMIIGRNFLTKINANIGTSALSSSIAEEVEKLVWAIRWGADTIMDLSTGRDIHATREWILRNSPVPVGTVPIYQALEKVDGHVDALSWDVFRDTLIEQAEQGVDYVTVHAGVLRDFIPLTASRLTGIVSRGGSIMARWCQAHRSENFLYTHFEELCEIMRAYDVAFSLGDGLRPGCIADANDAAQFAELEILGKLTHIAWNHQVQVMVEGPGHVPMQLIKANMDKQLAACGEAPFYTLGPLTTDIAPGYDHITSAIGAAMIGWYGTAMLCYVTPKEHLGLPNLQDVHDGIIAYKIAAHAADLAKGHPAAQARDDALSKARFEFRWQDQFHLSLDPEKALALHDESLPKEAHKRAAFCSMCGPQFCSMKISQEVRDASSSELSDANTDINTSDGI

SEQ ID NO: 2897 - protein, 555 aa, Mesembryanthemum crystallinum
MQASSCLVKGNLGFEVQNRRRGVLAVAGLGGFKNSSPILSSNLRFVNGVINKKSSSCKLTTSGSVLMGAGLARMGLDHVFQSTAKYRSVKAQAASGDYEDPAPVKFQGKSSASVLPYVGVACLGAILFGYHLGVVNGALEYLSPDLGIAGNTVLQGWVVSILLAGATVGSFTGGSLADKFGRTRTFQLDAIPLAIGAYLCATAQSVQTMMIGRLLCGIGIGISSALVPLYISEISPTEIRGALGSVNQLFICIGILAALVAGLPLAGNPLWWRTMFGIAAIPSVLLALGMAMCPESPRWLFQQGKVAEAEKASAALYGKERVPEVMNDLKASVQGSSEPEAGWFDLFSSRYRKVVSVGAALFLFQQMAGINAVVYYSTSVFRSAGIESDVAASALVGAANVFGTAIASSLMDRQGRKSLLITSFSGMAASMLLLSLSFTWPVLAPYSGTLAVLGTVLYVLSFSLGAGPVPALLLPEIFASRIRAKAVALSLGMHWASNFVIGLYFLSVVTKFGISRVYLGFASVCMLAVLYIAGNVVETKGRSLEEIERALSPAV

SEQ ID NO: 2898 - protein, 356 aa, Myxococcus xanthus DK 1622
MTGPDSARGGLPVIDMASLFDASRVTERARVAREIEQACRDSGFFYVTGHGVSGEVLARLERESHRFFALPRVAKEAIAMSMGGVAWRGWFPLGGELTSGRPDRKEGLYLGTELGSEHPRVKAGWPLHGANLWPAEVPELRAAVLDYVAACTRAAHALMEGMALSLGLDADYFRRHYTADPTVLFRIFHYPAEPQHEEVSWGVGEHTDYGLLTLLAQDDNGGLQVKTPRGWVEVPPLPGTLVCNIGDMLDRMTGGWYRSTPHRVKNVSGKDRLSFPLFFDPDFAAEVHPLPRGAGADVDDDRARRWDGASVHAFQGTYGDYLLGKVSKVFPELVRRVWERAPTALPEETPRGPLPR

SEQ ID NO: 2899 - protein, 312 aa, Streptococcus gordonii
PDINKDPGAEDKYKEVQEAYETLSDEQKRAAYDQYGAAGANGGFGGGAGGFGGFDGSGFGGFEDIFSSFFGGGASRNPNAPRQGDDLQYRVNLKFEEAIFGTEKEIKYNREASCRTCSGSGAKPGTSPVTCGRCHGSGVINVDTQTPLGMMRRQVTCDVCHGRGKEIKEPCTTCHGTGHEKQAHSVHVKIPAGVETGQQVRLAGQGEAGFNGGPYGDLYVVVNVEPSDKFERDGSTIYYKLNLNFVQAALGDSVDVPTVHGDVELNIPEGTQTGKRFRLRGKGAPSLRGGSMGDQYVTVNVVTPTGLNDKQK

SEQ ID NO: 2900 - protein, 540 aa, Nostoc punctiforme PCC 73102
MNTVVTLPTEQAPQTLENVGRFDRPLIIILDFGSQYSELIARRIRETQVYSEVLSYRTTSEQLRQLNPKGIILSGGPSSVYGDNAPHCDPEIWNLGIPVLGVCYGMQLMVNQLGGEVAKADRGEYGKASLYIDDPTDLLTNVEDGTTMWMSHGDSVTQMPSGFELLAHTENTPCAAIADHERKLYGVQFHPEVVHSIGGIALIRNFVYHICDCEPTWTTAAFVEEAIREIRTRVGEKRVLLALSGGVDSSTLAFLLYKAIGEQLTCVFIDQGFMRKYEPERLVKLFQEQFHIPVEYVNARDRFLAKVAGVTDPEEKRRRIGHEFINVFEETSKRLGHFDYLAQGTLYPDVIESADTNADPQTGERVAVKIKSHHNVGGLPKDLRFKLVEPLRKLFKDEVRKVGRSIGLPEEIVQRQPFPGPGLAIRILGEVTSERLNILRDADLIVRQEINQRGMYHDFWQAFAVLLPIRSVGVMGDQRTYAYPIVLRIVTSEDGMTADWARVPYDVLEVISTRIVNEVKGVNRVVYDITSKPPGTIEWE

SEQ ID NO: 2901 - protein, 961 aa, Arabidopsis thaliana
MTPFRWRLLGGGIHYNTLKVEHNESGPLSLKGLFGSVSGNFTFFTFLGSHLMVRISLLLLCLLVSTCLFTSSSAQAGFVSLDCGGAEPFTDELGLKWSPDNHLIYGETANISSVNETRTQYTTLRHFPADSRKYCYTLNVTSRNRYLIRATFLYGNFDNSNNVYPKFDISLGATHWATIVISETYIIETAELVFLASSPTVSVCLSNATTGQPFISTLELRQLSGSMYGSMLSEDRFYLSVAARINFGAESEASVRYPDDPYDRIWESDLQKKPNYLVDVAAGTVRVSTTLPIESRVDDRPPQKVMQTAVVGTNGSLTYRMNLDGFPGFGWAFTYFAEIEDLAEDESRKFRLVLPEQPEYSKSVVNIKENTQRPYRVYAPGYPNITLPFVLNFRFAKTADSSRGPILNAMEISKYLRKSDGSVDATVMANVASLYSSTEWAQEGGDPCSPSPWSWVQCNSDPQPRVVAIKLSSMNLTGNIPSDLVKLTGLVELHLENNRLTGKIPSSLTKLPNLKELYLQNNVLTGTIPSDLAKDVISNFSGNLNLEKSGDKGKKLGVIIGASVGAFVLLIATIISCIVMCKSKKNNKLGKTSAELTNRPLPIQRVSSTLSEAHGDAAHCFTLYEIEEATKKFEKRIGSGGFGIVYYGKTREGKEIAVKVLANNSYQGKREFANEVTLLSRIHHRNLVQFLGYCQEEGKNMLVYEFMHNGTLKEHLYGVVPRDRRISWIKRLEIAEDAARGIEYLHTGCVPAIIHRDLKTSNILLDKHMRAKVSDFGLSKFAVDGTSHVSSIVRGTVGYLDPEYYISQQLTEKSDVYSFGVILLELMSGQEAISNESFGVNCRNIVQWAKMHIDNGDIRGIIDPALAEDDYSLQSMWKIAEKALLCVKPHGNMRPSMSEVQKDIQDAIRIEKEALAARGGISDEFSRSSAHSSSLNMGMLDLAGSQSYVSIDESVLQPTAR

SEQ ID NO: 2902 - protein, 338 aa, Streptococcus hyointestinalis
EIKKAYRKMSKKYHPDINKEPGAEEKYKEVQEAYDTLGDEQKRAAYDQYGPAGANGFNGGAGGFGGFDGAGGFGGFEDIFSSFFGGGAAQRNPNAPRQGDDLQYRVQLKFEEAIFGTEKEVTYNREATCHTCGGSGAKPGTSPVTCHKCHGQGVITVDTQTPLGTMRRQVTCDVCHGTGQEIKDPCPTCHGTGHEKEKHTVSVKIPAGVETGQQIRLAGQGEAGFNGGPYGDLFVMITVQPSDKFEREGSTIYYTLNLNIVQAALGDVVDVPTVHGDVELSIPAGTQTGKTFRLRGKGAPKLRGGGQGDEHVTVKVVTPTKVNSAQKEALRALQKLGD

SEQ ID NO: 2903 - protein, 324 aa, Streptococcus hyovaginalis
HPDINKEAGAEQKYKDVQEAYETLSDSQKRAAYDQYGAAGAQGGFGGGAGGFGGFDGAGGFGGFEDIFSSFFGGGGASRNPNAPRQGDDLQYRVNLKFEEAIFGAEKEVTYSREATCHTCHGNGAKPGTQPVTCSRCHGQGVINVDTQTPLGMMRRQVTCDVCHGTGKEIKDPCPTCHGSGHEKETHKVDVKIPAGVETGQQIRLQGQGEAGFNGGPYGDLFVIINVMKSDKFEREGSTIYYTMDVSFVQAALGDVVDIPTVHGDVELTIPAGTQTGKTFRLKGKGAPRLRGNGQGDQHVTINIVTPTKLNDAQKEALHALQKL

SEQ ID NO: 2904 - protein, 278 aa, Streptococcus infantis
EVQEAYETLSDEQKRAAYDQYGAAGANGGFGGAGGFGGFDGAGGFGGFEDIFSSFFGGGGSSRNPNAPRQGDDLQYRVNLTFEEAIFGTEKEVKYNRESSCRTCNGSGAKPGTSPVTCGRCHGSGVINVDTQTPLGMMRRQVTCDVCHGRGKEIKDPCTTCHGTGHEKQAHSVHVKIPAGVETGQQIRLAGQGEAGFNGGPYGDLYVVVSVEASDKFEREGTTIFYKLNLNIVQATLGDTVDIPTVHGDVELVIPEGTQTGKRFRLRGKGAPSLRGGA

SEQ ID NO: 2905 - protein, 183 aa, Escherichia coli
MVNNMTDLTAQEPAWQTRDHLDDPVIGELRNRFGPDAFTVQATRTGVPVVWIKREQLLEVGDFLKKLPKPYVMLFDLHGMDERLRTHREGLPAADFSVFYHLISIDRNRDIMLKVALAENDLHVPTFTKLFPNANWYERETWDLFGITFDGHPNLRRIMMPQTWKGHPLRKDYPRARYRILAV

SEQ ID NO: 2906 - protein, 358 aa, Glycine max
MNRGVLQSSPVQQMMARNPNNWWNINTMRPPPPSQASAPFFSTPSNFLTPYYTPTSLPLPSWHDNNQELPESWSQLLMSGMVSEEEKGGMCQIQSKKLENWEQQMLSQAPSAPIVDVKQESSVNSYVYGHGTNEEFQAAKPITWSQIVPASSPKSCVTSFSSSMLDFSNNNADARPPPPDPSSECNSSTATGGAFKKARVQPPTTQSTFKVRKEKLGDRITALHQLVSPFGKTDTASVLLEAIGYIRFLQSQIEALSLPYLGSGSGNMRQQQSVRNNTNPPFLVQGENNCIFPEDPGQLLNENCLKRKAASSEQDSQEEPKKDLRSRGLCLVPVSCTLQVGSDNGADYWAPAFGGGFR

SEQ ID NO: 2907 - protein, 179 aa, Escherichia coli
MTLKELLVGFGTQVRSIWMIGLHGSPNQTRMYPEEPVYLPPRYRGRIVLTRDPDGEERCVACNLCAVACPVGCISLQKAETKDGRWYPEFFRINFSRCIFCGLCEEACPTTAIQLTPDFEMGEYKRQDLVYEKEDLLISGPGKYPEYNFYRMAGMAIDGKDKGDRRTKPSLSTFKSLLP

SEQ ID NO: 2908 - protein, 571 aa, Oryza sativa (japonica cultivar-group)
MATCRSRGVERGGAPHVLAVDDSSVDRAVISGILRSSQFRVTAVDSGKRALELLGSEPNVSMIITDYWMPEMTGYELLKKVKESSRLKEIPVVIMSSENVSTRINRCLEEGAEDFLLKPVQPSDVSRLCSRVLRGRWLIGDQGMCRLCVCWPGAVRLRGRASSVSPTCPWELGADVSAHIAYDDRNQKMRANDIISDSKTEFSGRDNNSSNHPKLSFKAILPTAPQTPFPLLLRATSPTRHHRRRIGRRGDRGSGSGGNSGKGGGGGSGSGGGDDDDDYEEAEFGPLLGFDEVLGFAAARGVSLPADMMEAAKDAGIREVLLLRYFDLQAGPWPLAAMIRAFSMLRNRMLADPSFLFKVGTEVVIDSCCATFAEVQKRGEDFWAEFELYAADLLVGVVVDIALVGLLAPYVRFGKASASTGPFGRFNRMAGSLPSSVFEAERPGCRFTVQQRIGTFFYKGVLYGSVGFVCGIIGQGIANMIMTAKRSVKKSDEDIPVPPLIKSAALWGVFLAVSSNTRYQIINGLERVVETSPIAKRVPPVAMAFTVGVRFANNIYGGMQFVDWARWSGVQ

SEQ ID NO: 2909 - protein, 375 aa, Exophiala dermatitidis
MEEEVAALVIDNGSGMCKAGFAGDDAPRAVFPSIVGRPRHHGIMIGMGQKDSYVGDEAQSKRGILTLRYPIEHGVVTNWDDMEKIWHHTFYNELRVAPEEHPVLLTEAPINPKSNREKMTQIVFETFNAPAFYVSIQAVLSLYASGRTTGIVLDSGDGVTHVVPIYEGFALPHAISRVDMAGRDLTDYLMKILAERGYSFSTTAEREIVRDIKEKLCYVALDFEQEIQTASQSSRLEQSYELPDGQVITIGNERFRAPEALFQPSVLGLESGGIHVTTFNSIMKCDVDVRKDLYGNIVMSGGTTMYPGIADRMQKEITALAPSSMKVRIIAPPERKYSVWIGGSILASLSTFQQMWISKQEYDESGPSIVHRKCF

SEQ ID NO: 2910 - protein, 321 aa, Francisella tularensis subsp. tularensis SCHU S4
MQKSVLEQLKQVTMVVADTGDFELIKKYKPVDATTNPSLILKAVKEQKYSNLVAETISKVKANNPDLNSDDLVKEIAIEILVSFGIKILDVIEGKVSSEVDARVSFNSATTIDYAKRIIARYESNGIPKDRVLIKIAATWEGIKAAKLLQKEGINCNLTLIFDKAQAKACAEAGVYLVSPFVGRITDWQMQQNNLKTFPAIADDDGVNSVKAIYKLYKSHGFKTIVMGASFRNVEQVIALAGCDALTISPVLLEELKNRDEHLEVKLTKNDDVVTQSPQISEADFRWLMNENAMATHKLAEGIRLFTKDTIELENIIKQNL

SEQ ID NO: 2911 - protein, 400 aa, Bacillus thuringiensis serovar konkukian str. 97-27
MMTYTLATRMKAFQSSIFSELGAYKKEKIAAGHKMIDLSIGNPDMPPADFVREEMVHTANQKESYGYTLSGIQEFHEAVTEYYNNTHNVILNADKEVLLLMGSQDGLVHLPMVYANPGDIILVPDPGYTAYETGIQMAGATSYYMPLKKENDFLPNLELIPEEIADKAKMMILNFPGNPVPAMAHEDFFKEVIAFAKKHNIIVVHDFAYAEFYFDGNKPISFLSVPGAKEVGVEINSLSKSYSLAGSRIGYMIGNEEIVGALTQFKSNTDYGVFLPIQKAASAALRYGAAFCEKNRAIYQERRDTLVDGFRTFGWNVDKPAGSMFVWAEIPKGWTSIDFAYALMDRANVVVTPGHAFGPHGEGFVRIALVQDKEVLQQVVENIRNSGIFALEKVDELVKN

SEQ ID NO: 2912 - protein, 204 aa, Staphylococcus xylosus
MTDTIKIGVGGPVGAGKHELIEKIVKRLAKDMSIGVITNDIYTKEDEKILVNSGVLPEDRIIGVETGGCPHTAIREDASMNFAAIDELKERNDDIELIFIESGGDNLAATFSPELVDFSIYIIDVAQGEKIPRKGGQGMIKSDFFVINKTDLAPYVGASLERMAEDTKVFRGNRPFTFTNLKTDEGLDEVIEWIEQYVFLKGLA

SEQ ID NO: 2913 - protein, 561 aa, Corynebacterium glutamicum ATCC 13032
MTTTTGSARPARAARKPKPEGQWKIDGTEPLNHAEEIKQEEPAFAVKQRVIDIYSKQGFSSIAPDDIAPRFKWLGIYTQRKQDLGGELTGQLPDDELQDEYFMMRVRFDGGLASPERLRAVGEISRDYARSTADFTDRQNIQLHWIRIEDVPAIWEKLETVGLSTMLGCGDVPRVILGSPVSGVAAEELIDATPAIDAIRERYLDKEEFHNLPRKFKTAITGNQRQDVTHEIQDVSFVPSIHPEFGPGFECFVGGGLSTNPMLAQPLGSWIPLDEVPEVWAGVAGIFRDYGFRRLRNRARLKFLVAQWGIEKFREVLETEYLERKLIDGPVVTTNPGYRDHIGIHPQKDGKFYLGVKPTVGHTTGEQLIAIADVAEKHGITRIRTTAEKELLFLDIERKNLTTVARDLDEIGLYSSPSEFRRGIISCTGLEFCKLAHATTKSRAIELVDELEERLGDLDVPIKIALNGCPNSCARTQVSDIGFKGQTVTDADGNRVEGFQVHLGGSMNLDPNFGRKLKGHKVIADEVGEYVTRVVTHFKEQRHEDEHFRDWVQRAAEEDLV

SEQ ID NO: 2914 - protein, 221 aa, Yersinia enterocolitica
MNSHSTDKRKKITRIGIGGPVGSGKTAIIEVITPILIKRGIKPLIITNDIVTTEDAKQVKRTLKGILDEEKILGVETGACPHTAVREDPSMNIAAVEEMEERFPDSNLIMIESGGDNLTLTFSPALADFYIYVIDVAEGEKIPRKNGPGLVQADILVINKIDLAPYVGASLDVMESDTKVVRGERPYILTNCKTGQGIEELVDMIMRDFLFTHVQPQGEHA

SEQ ID NO: 2915 - protein, 559 aa, Oryza sativa
MLPTYGCGAGRVGGLGMAMSATSSNLIVYLVHKYNVKAIHAAQISNVVRGCMQLAPVLAAALSDAFFGPYPIAVAGLVFSLLSFVLFTLTAALPSLLPPPCQRGAGGGGATATSCEPPNAAQSAVLYAALCLLAAGNGGTRYNMAALGADQFAGEGQPRRRRQGGGFFSCYFAFLYASYATGDTVLVYVQDGVSWALGFGVCVATTGLALAALLLGSRHYRRPVPKGSPFTAMARVAVAAARKATVDLGSRVQYYHGCNRDDAVPRADQAPSDRFRFLNRAAMVVAGETREEDGSVAKPWRLCTVQQVEDVKSVVRVLPLWSSGILVSVTVNAQVSLTVLQALTMDRAVGPRFAVPAASITVTVLAAFVLAAALFDRVAAPLCAAAGKLAITPLRRVGLGHALNVASMAVAALVERRRIGAARGRAAAAAAVVPMSVLWLVPQLALTGAEEALHLPGNTALFYGELPASLRGTATAMPPLFIAAGSYLSAAAVDAVKRGTTWLPDDLNASRLDCVYWTLAVLAAVNLGYFLLCATTYKYNNYGGDDGNVKAQTQTDDVS

SEQ ID NO: 2916 - protein, 415 aa, Oryza sativa (japonica cultivar-group)
MASLAVPLRASATPAIAGTGSGGGSRAADPVKVSCVRSKVTCGFPSVGASSSLASSVEPVRATATQAPLATHQSSSTEKTKVGINGFGRIGRLVLRIATNRDDIEVVAVNDPFIDAKYMAYMFKYDSTHGPFKGTIKVVDESTLEINGKKISVTSKRDPSDIPWGNFGAEYVVESSGVFTTTEKASAHLKGGARKVVISAPSADAPMFVVGVNEKNYNPSMNVVSNASCTTNCLAPLAKIVHEEFGIAEGLMTTVHATTATQKTVDGPSMKDWRGGRGASQNIIPSSTGAAKAVGKVLPALNGKLTGMAFRVPTPNVSVVDLTCRLEKSASYEDVKAAIKEASEGSLKGILGYTDEDVVSNDFIGDTRSSIFDAKAGIGLSSSFMKLVSWYDNEWGYSNRVLDLIGHMALVNAKP

SEQ ID NO: 2917 - protein, 515 aa, Triticum aestivum
  misc_feature (56)..(56): Xaa can be any naturally occurring amino acid
  unsure (1)..(515): unsure at all Xaa locations
EYRVECGQWGARFPHVAGIAGQSEHGAQSVALSGGYIDDEDHGEWFLYTGSGGRDXLSGNKRTNKEQSSDQKFDKMNAALRLSCKKGYPVRVVRSHKEKRSSYAPETGVRYDGVYRIEKCWRKIGVQGTYKVCRYLFVRCDNEPAPWTSDLHGDRPRPLPRIKELQGATDITERAGSPSWDYVENEGWKWVKPPPISKKPAQSGDPETDKQFRKYQKRAHMSMNERLLKEFGCSICKNLMKEPLTTPCGHNFCKACLTAAFGDEGSMRERSRGGRTLRAQKIVKNCPSCPTDICDFLENPQINIEMKDLIDNLLAKAAKEKPDAEGSAEENDDEEDALEKEEEDDSSLNEEENDDGAENKAGEEDAVVTIVVEAKDELKKPLKRQGDQEEEAKDEKKIQTTAAADAENAAEEDAEMVENKEEEGAQKVQKKRKGRAETATAAAGGGKRKRAGPAAAEEKAAAAGGGKRKKASPAAAAEETPAAASTPRRATRSGGVVVAGGSPASRTRSNTKADN

SEQ ID NO: 2918 - protein, 430 aa, Agrobacterium tumefaciens str. C58
MQDKILLIEDSVALSMLLRTRLSDETEAEVVHCASMAEADALMQANNFTLALTGLNLPDAPKGEILTLLSERKVPAIVFTATVDEEARKRYAEKKIIDYIVKDGHRTVDAVVKTVDRIMTNKRFSVLVVDDARTARSGLVEILERQNFKVSEAHSGNRALEILSQDPSIQLVITDYHMPDMDGYELTRRIRDSRSSEDLRVIGISSSTDRLLSASFLKAGASDFVYRPFVPEELQCRIDNNIETLKQLKRLRELAERDHLTGLPNRRSFFERTRALMDVINDNDESGAVAILDIDHFKKINDTLGHDAGDRALKKLAELLQGMCDEQRHIPARLGGEEFAVFLRGLDARAAYAFCEELREQVEKNGRQLSGSSLALTISLGVVEIEKGEPFDNQLNAADQLLYLAKANGRNRVYSDIMIQEGLQKIGLNG

SEQ ID NO: 2919 - protein, 390 aa, Pseudomonas putida KT2440
MAQPYSARSRAIEPFHVMALLARANELQAAGHDVIHLEIGEPDFTTAAPIVAAGQAALAAGHTRYTAARGLPALREAIAGFYGQRYGLNIDPERILITPGGSGALLLASSLLVDPGKHWLLADPGYPCNRHFLRLVEGGAQLVPVGPDVNYQLTADLVERYWDKDTVGALVASPANPTGTVLGREALACLARTTHERHGHLVVDEIYHGLTYGMDAPSVLEVDDSAFVLNSFSKYFGMTGWRLGWLVAPPGAVADLEKLAQNLYISAPSMAQHAALACFQPEALAIFEERRAEFARRRDYLLPALRELGFRIAVEPQGAFYLYADISAFGGDAFAFCRHFLETQHVAFTPGLDFGRHLAGHHVRFAYTQSLPRLEEAVQRIARGLQSWQG

SEQ ID NO: 2920 - protein, 183 aa, Gloeobacter violaceus PCC 7421
MSDWQTVRTWLAGTYSNRAQAMAEPVWFIPVTLWYVEVAGLFGEGAGFFTEQVSEHTPNQPYRSRVLQLLDNPLRLENYRLKDQKVWAGAAKDPERLGRLRADDCEQLPGCTLYLERRGETFTGKMQPGGGCRLFPGDASYVEIEFELGERLFFTLDRGFEATTGEQTWGSRAGAYRYLKQLH

SEQ ID NO: 2921 - protein, 339 aa, Burkholderia xenovorans LB400
MDTRSELQATIKAMVQPGKGLLAADESGPTIAKRFKTIGLESSEENRRAYRNLLLTTPGLGEFVSGVILYEETLGQKADDGTPFPQLAAKNGIVPGIKVDLGKIALALAPGDEITEGLDGLARRFVDYKRQGARFAKWRAVYNITASLPSRLAIEANADSLARYAAISQEAGIVPIVEPEVLMDGEHTIERSAEVTEAVLHAVFHALHRHRVVLEHILLKPSMVIAGSEHAQQSSTADIAAYTVRVLKRTVPSAVPGIVFLSGGQSPEEATANLDAMNRLGALPWNLSFSYGRALQEPPLQAWKGERSHVEQAQQALLKRARLNSAAALGKYEAAQEKS

SEQ ID NO: 2922 - protein, 328 aa, Burkholderia xenovorans LB400
MDPTGHADPDMKAVLDALRSLDPKPIEDCTVAEARQQPTPADAVRKLMSDPAFSARPSLELEAVRTEDIMIPGATGSNPARVYTPQGEGPFPLILYFHGGGWVLADLDTYDATPRSIAAQSRAIVVSAHYRQAPEHRLPAAHEDAFAAWRWVVEQAPKLCGDAGKIAVMGESAGANLAINVAIHARDTGVRMPMHQALIYPVASNNIVSISYEENRNARPLNKPMMLWFLHNVINSESDLTSSLIDVVSADLSRLPPAVVVTAGIDPLRSDGEKLAQKLHSAGVPVEHRNYRGATHEFFGMAAVVQAARDAQAFVSLAQRQAFGGAPL

SEQ ID NO: 2923 - protein, 95 aa, Brassica napus
MSSFNLNVDVNQNGDTLDDIDDIDFSKLLEKPRPLNIERLRSLDERSLTELSGSPQLRNADNASRVHDHADYVASPSVGRWSGFNTPRSVHGFES

SEQ ID NO: 2924 - protein, 347 aa, Listeria monocytogenes EGD-e
MKNTIKWIAIGFAGIILLPLLIVFFIYKKAVGKKDYNPEVLENLDKASQEFVKNTSPLSDVDSRYKYMRLATKALPSAKDIEIGDVENKKIDGPAGKIPIRIYTPQEDGPFEIIVYYHGGGFVLGGLQTHDAIARKLVQTTGARVVTVDYRLAPENPFPAAVEDAYAALLWVQNHRTSLRAKSSDIIVAGDSVGGNLATVVTQIAKSKGKPNITAQILLYPATDIFSRDASVLYPSMDEFAEGYVLTKESLDKFFKLYIANASDRKYDPLVAPIRSKDLVGLPKTFIATAEFDPLRDQGEAYAKKLKDAGVEVFAKRFEKVPHGFMTTNSEATDETYELISEFLEEK

SEQ ID NO: 2925 - protein, 126 aa, Medicago truncatula
MGGQQQHKKSKVVKIDSRKSWEHHIFEATNKGYPVMVHFSAYWCVPSIAMDPFFEELASTYQDVLFLKVDVDEVKEVASKLEINAMPTFLLMSGGTPVEKAVGANPDEIRKRMDHFINQTHSSKSL

SEQ ID NO: 2926 - protein, 292 aa, Streptococcus agalactiae 2603V/R
MNSLNGETLLTGLIANPARHSLSPLMWNTSFQEKNMNYAYLTFEVEEGKLTEAVRGVRALGIRGVNVSMPFKQSVIPLLDDLSPQAKLVGAVNTIVNQGGTGRLVGHMTDGIGCFKALAAQGFSAKNKIITIAGIGGSGKAVAVQAAMEGVAEIRLFNRNSSNYDKVIDLSDKIKKQFQIKVVVDYLENKTAFKDAIRTSHFYIDATSLGMRPLDNYSLINDPEILTPNLVVVDLVYKPKETALLRFVRQNGVKHAYNGLGMLIYQGAEAFQLITNQEMPISSVERVLQTEN

SEQ ID NO: 2927 - protein, 944 aa, Cryptococcus neoformans var. neoformans B-3501A
MSSLASAPPTASIPASDSYNSPVQSSGPGLGNGNSTPSKWKSVFKLGRTATIGRGKENRSALGGESFVLDNKEQQSFAGEVSPAVPTEPYLPPRKTQLRAHTDPYPPKSPSVKNNPGSVSVEHFDSKVLHEEGMPKTREEGSSESFNVHLNSSNGNLQTTSTSGEQSRPYSSVTDSASASTTERTSHSSGGHFLPGDGSLHGVASSNTYGTASTRSPTGGPLGIGNLKSRFFSAPLSAPAGKNKHDKSKSEKYRGLGKVATDFPQSTAPPSSAGGASSSGGGRKKSDGSSSLSSRGAASPRTPAKSKREPSANSSRRMPFGQTNDNGSNSGSVAARFLRRVVSAPNTKALFSNNLFSNAPDVPPLPAPKNQPNSSTSSKEKSSSPVVIVGNSGGHIDLTSSPDSDHPPSISPLSNSSTMYTSQTSHTPSASASATPTPSPLKQKNHFLSPTASPSPGQGSGLSAKGTRASRSLTTGTAPVLKNIRQLQGYSGSSPGGGGYMDGESRHKQVFKRTYSSNSIKTKQVEVTASSFQKIKLLGKGDVGKVYLVREKKTDKLFAMKVLSKKEMIKRNKIKRALAEQEILATANHPFIVTLFHSFQSQDYLFFVLDYCMGGEFFRALQTRPGKCLSEEHAKFYAAEVTAALEYLHLNGYIYRDLKPENILLHQSGHIMLSDFDLSKQSGEAGGAPAAIRHGGPNGQTILVDTRSCIADFRTNSFVGTEEYIAPEVIKGHSHSSAVDWWTLGILVYEMIFATTPFKGPNRNATFANVMKNEVLFPESVPVSSNCKSCIRKLLIKDENKRLGSASGASEVKQHKWFASVNWGLLRNMTPPIIPEESNGIDTINFRPLRESKSIDFDRDDITTDIIHAKAGSPSVSGNSTPGMLTPKELVQTTSSSSPIGGGAGGTSGHSSSAMPIPGSMRGYDKEKNPFGEFSSVTRDFGEC

SEQ ID NO: 2928 - protein, 521 aa, Burkholderia xenovorans LB400
MPTLARRVAQLSQLRSDRAERVMVDGEPILLIRDGDTVHAYSADCPHAGAPLEEGALCHGRIICPWHKGTFDVATGDVLEPPALVALDRYPVVVAGDDVMLTPEKLPRPVRNASAQEPHYVVIGAGAAGAAACATLRECGFGGRLTLIGAEPHAPYDRTALSKFVPSGEMSAADVPPLLAPDWLARHDVERIVAKVARLDVPARTIHFETGGQLTYDTALLATGSIPKQPPIPGVELGGVHVLRSLDDAAALVDAIGDDAAQTRVAILGSSFIGLETASALRKRGTPVTVISPEKVPFAKQFGERAGTMFRKLHETNGVMFRFEAKVASLEGDEGNVHEVMLENGEHVEADLVLLGTGVAPATGFVEGLPLQKDGGVIVNAGMQAAPGLYAAGDIAAFTLHEDQEPLRIEHWRVAQQHARVAAENMCGARHRYGGVPYFWTYHFGKRFEYLGHASEWDEIVMDGELDRQQFVALYLKDDKVVAVLACEREAQTARLIDAMSRGVSRADALAIINGASCLAQ

SEQ ID NO: 2929 - protein, 301 aa, Streptococcus iniae
KYKDVQEAYETLSDSQKRASYDQYGAAGAQGGGFGGGFGGGFDGGGFGGFEDIFSSFFGGGGASRHPNAPRQGDDLQYRVNLDFEEAVFGTEKEVSYHRESTCGTCSGSGAKPGTSPVTCGRCHGAGVINVDTQTPLGMMRRQVTCDVCHGSGKEIKEPCHTCHGTGHEKKTHKVSVKIPAGVETGQQIRLQGQGEAGFNGGPYGDLFVVLNVLPSKKFERNGSTIYYDLNISFVQAALGDTVDIPTVHGDVEMSIPAGTQTGKTFRLKGKGAPKLRGAGQGDQHVTITVVTPTKLNHEQK

SEQ ID NO: 2930 - protein, 793 aa, Chara corallina
MAAVAEGLNAMTTIPTTTAPADLALAAVTGNTIVSETAVLIFIPAACVIGILFAVLQWSVVGKISVRPSGGGMNYPLMGDEGLEDSSVVTRCAEIQEAISEGAVSFLMTEYKYLSYFMVGFFIVIFAFLGATEDFGTDRKPCEWDATKLCGSGVMNALLSAVAFALGAITSTLCGFLGMKIATFANARTRSRRGGGVGPAFKAAFRSGAVMGFLLTSLGLIVLYFTILIFQRYYGDDWIGLYESIAGYGLGGSSVALFGRVGGGIYTKAADVGADLVGKVERNIPEDDPRNPAVIADNVGDNVGDIAGMGADLFGSLAESTCAALVVSSLSDFGKEMNYVAMSFPLLITGAGILVCLITTLVATDLTSGVSNIKGIEPALKQQLVISTVLMTPVIALLAWGCLPDTFEIINGAETKVVKKWYMFFCVACGLWAGLLIGYTTEYFTSHQFTPVRDVADSCRTGAATNVIFGLALGYKSVIIPILAIAFTVFVSHTLAAMYGIACAALGMLSTLSTCLAIDAYGPISDNAGGIAEMAEMGPAIREKTDALDAAGNTTAAIGKGFAIGSAALVSLALFGAYINRAGITSVDVILPKEFVGLIVGAMLPYWFSAMTMKSVGKAALAMVEEVRRQFNTIAGLMQGTVKPDYKRCVEISTDASLREMIPPGCLVMLTPLVVGGLLGKETLAGILAGALVSGVQIAISASNTGGAWDNAKKYIEAGGNDHARTLGPKGSDCHKAAVIGDTVGDPLKDTSGPSLNILIKLMAVESLVFAPFFKTYGGVLFVLWDKFVAGKY

SEQ ID NO: 2931 - protein, 350 aa, Streptococcus macacae
EIKKAYRKMSKKYRPDINKEPGAEEKYKEIQEAYRTLGDDQKRANYDQFGPEGAANGGFGGGAGGFSGFDSAGFGGFEDIFSSFFGGGGASRNPNAPRQGDDLQYRVNLKFEEAIFGTEKEVHYNREVTCHTCDGSGAKPGTSPVTCSKCHGSGVINVDTQTPLGMMRRQMTCDVCHGSGKVIKEPCPTCHGSGREKQRHKMAVTIPAGVETGHQVRVVGQGEAGFNGGPYGDLYVIINVLASDKFERDGSTIYYNLDINFVQAALGDTVEVPTVHGAVDLKIPAGTQAGKVIRIKGKGAPRLNGNGQGDQRVTVNVVTPTKLNEAQKEALQAFAKASNMNPVHPKKKAS

SEQ ID NO: 2932 - protein, 340 aa, Triticum aestivum
MANQLLSTVAHRDTLPEGYTRPENDRPQLADVVTDSNIPLIDLASPDKHRVIAEIDQACRTYGFFQIINHGISEELLEKVMAVGLEFFRLPPEEKAKLYSDEPSKKIRLSTSFNVRKETVHNWRDYLRLHCHPLEVFVPDWPSNPETFKEIISTYCREVRLLGLRLLGAISLGLGLEEDYIENVLGEQEQHMAVNYYPRCPEPDLTYGLPKHTDPNALTILLMDPHVSGLQVLKDGAQWIAVDPRPNALVVNLGDQLQAVSNGAYKSVWHRAVVNAARERLSVASFLCPCNSAVIGPADKLVGDGDEPVYRSYTYDEYYKKFWSRNLDQDHCLELFTGQK

SEQ ID NO: 2933 - protein, 348 aa, Streptococcus mitis
KSKKAYRKLSKKYHPDINKEPGAEEKYKEVQEAYETLSDDQKRAAYDQYGAAGANGGFGGAGGFGGFDGAGGFGGFEDIFSSFFGGGGASRNPNAPRQGDDLQYRVNLTFEEAIFGAEKEVKYNREASCSTCNGSGAKPGTSPVTCGRCHGAGVINVDTQTPLGMMRRQVTCDVCHGRGKEIKDPCTTCHGTGHEKQAHSVHVKIPAGVETGQQIRLAGQGEAGFNGGPYGDLYVVVSVEASDKFEREGTTIFYNLNLNFVQAALGDTVDIPTVHGDVELVIPEGTQTGKKFRLRGKGAPSLRGGAVGDQYVTVNVVTPTGLNERQKAALKEFAAAGDLKVNPKKKGF

SEQ ID NO: 2934 - protein, 347 aa, Streptococcus mutans
EIKKAYRRMSKKYHPDINKEPGAEEKYKEIQEAYDTLGDEQKRAAYDQYGPAGANGGFGDGSGFSGFDSSGFGGFEDIFSSFFGGGASRNPNAPRQGDDLQYRVNLQFEEAVFGTEKEVHYNREASCHTCNGSGAKPGTSPVTCSKCHGSGVINMDTQTPLGMMRRQVTCDVCHGTGQEIKEPCPTCHGTGHEKQSHKVSVKIPAGVETGQQIRLAGQGEAGFNGGPYGDLFVIINVLKSDKFERDGSTIYYSMDINFVQAALGDTVEVPTVHGNVELAIPAGTQTGKTFRLKGKGAPRLRGNGQGDQHVTVNVVTPTKLNDAQKEALQDFAKASGINPVHPKKKGF

SEQ ID NO: 2935 - protein, 348 aa, Streptococcus oralis
EIKKAYRKLSKKYHPDINKEPGAEEKYKEVQEAYETLSDDQKRAAYDQYGAAGANGGFGGAGGFGGFDGAGGFGGFEDIFSSFFGGGGASRNPNSPRQGDDLQYRVNLTFEEAIFGTEKEVKYNREASCRTCNGSGAKPGTSPVTCGRCHGAGVINVDTQTPLGMMRRQVTCDVCHGRGKEIKDPCTTCHGTGHEKQAHSVHVKIPAGVETGQQIRLAGQGEAGFNGGPYGDLYVVVSVEASDKFEREGTTIFYKLNLNIVQATLGDTVEIPTVHGDVELVIPEGTQTGKKFRLRGKGAPSLRGGAVGDQYVTVNVVTPTGLNDRQKAALKEFAAAGDLKVNPKKKGF

SEQ ID NO: 2936 - protein, 279 aa, Desulfovibrio desulfuricans G20
MTIPRIPRQLYGIIGYPLGHSMSPLLHNWGFELLGEQAAYMAFPVAPEKLAEFICCARMLPVSGLSVTIPHKQAVMPLLDAVTPRAQAAGAVNTLFYDDGKLTGDNTDVYGFLHPLDSCGTAHAAALVLGAGGAANAVLAALTARGMCNVTVTNRNGDRARILAERFGVRCVAWEERHAVDADLVVNTTPLGMAGDRQAQTPLDPAFFSSRPAGLAYDLIYNPAQTFFLASAQAAGWRVLNGLDMFVAQGAEQFRIWRGRELPFAQARALIADALASGC

SEQ ID NO: 2937 - protein, 275 aa, Xanthobacter autotrophicus Py2
MLTQLHPSATREASAGQAFEGHRPDAPFPAACAGVRADTHAFFLDVDGSLIDIADHPDAVEVPEDLPQLLAALAEQADGALALVSGRTIQALDILLHPFGFAAAGSHGAQMRLEPDGRILSAPALDTALADAVKEVADGFDGVFAEDKGTAIAVHYRAVPDAAPSLRRALLELLRARQDVRLMPGHCVFEVKPASLDKGTAVADFMARAPFAGRVPVFIGDDVTDEAGFGAVAARGGLALAVGSPRPGTQGVLADPRSVRAFLTHLAAVPQQRRR

SEQ ID NO: 2938 - protein, 128 aa, Brassica napus
MKAICGRFLPSKCSSSNADENLDQSPTSLVSDSTLPLVSQTLREASTSEHQPVCTPHNGWTVILKTASMASGAIKRLQDRVLGPSRTGIPSSTSEIWLLGVCYKISESESSEVVDAFRQDFSSLVLMT

SEQ ID NO: 2939 - protein, 130 aa, Desulfovibrio desulfuricans G20
MTADLPDFVPDFEKTGGLVPAIAQDAVSGEVLMMAWMNEEAWHRTLTTGEAHYFSRSRGSLWHKGGTSGHTQHIRAVRLDCDSDTILLLVDQIGGAACHKGYKSCFFRELKDGEISVCSPLVFDPEEVYK

SEQ ID NO: 2940 - protein, 123 aa, Dianthus caryophyllus
MITIHHPWVFAFGLLGNFISFMVFLAPLPTFIRVYKKKSTEGFQSFPYVVAIFSAMLWIYYALLKGNSLLLITVNVTGVIIETIYVIIFITYAPRQARISTMKLLLFMNFGGFCMIVPRPRPR

SEQ ID NO: 2941 - protein, 137 aa, Cryptococcus neoformans var. neoformans B-3501A
MGGEGWLFLFAVLMAAVLLFTMVFFIIMFSDLECDYINPIDLCNKLNQFVLPEMIAHAFLTLCFLLSGQWLAFLLNAPLVAYNVNKIMSKNHMYDATEIFRTLSGHKKESFIKLGFYLISFFYYLYRMILALISESD

SEQ ID NO: 2942 - protein, 451 aa, Arabidopsis thaliana
  misc_feature (439)..(439): Xaa can be any naturally occurring amino acid
  unsure (1)..(451): unsure at all Xaa locations
MGKENAVSRPFTRSLASALRASEVTSTTQNQQRVNTKRPALEDTRATGPNKRKKRAVLGEITNVNSNTAILEVVKTIAKNSKQIKKGRGHGLASTSQLATSVTSEVTDLQSRTDAKVEVASNTAGNLSVSKGTDNTADNCIEIWNSRLPPRPLGRSASTAEKSAVIGSSTVPDIPKFVDIDSDDKDPLLCCLYAPEIHYNLRVSELKRRPLPDFMERIQKDVTQSMRGILVDWLVEVSEEYTLASDTLYLTVYLIDWFLHGNYVQRQQLQLLGITCMLIASKYEEISAPRIEEFCFITDNTYTRDQVLEMENQVLKHFSFQIYTPTPKTFLRRFLRAAQASRLSPSLEVEFLASYLTELTLIDYHFLKFLPSVVAASAVFLAKWTMDQSNHPWNPTLEHYTTYKASDLKASVHALQDLQLNTKGCPLSAIRMKYRQEKXQICGGSHVSKAT

SEQ ID NO: 2943 - protein, 115 aa, Zea mays
MAFWQTRDFLFCGICGTLLTFDSVRSASCPLCGFKRDAKEIEGKEIQYTMTAEDIRRGLKTQTEDVVGQRPVTNKACPKCDHPKAEFYNIQMRSADEGETTFYMCKGCGCNFKDE

SEQ ID NO: 2944 - protein, 258 aa, Synechococcus sp. RS9917
MSISRPSLLVFDFDGVIVDGMEEYWWAARGAYLQLSQASAGGLPSAVPSLFRQLRPWVHHGWEMVLIAAQLLEAESPLRRRGAEAYAADYDRQTALALEERGWSSLQLQEALEAVRREAIANDRAAWLGRHRPFPGVVDRLRHLAEEGVDWAVLTTKGAAFTAELLQAFALQPARLLGHEAGPKPQVLLQLQEAWRLRGFVEDRRATLETVRGTAGLEALPCFLASWGYLRPSDRQGLPRGIDLLEPDRFAAPLATWA

SEQ ID NO: 2945 - protein, 554 aa, Pseudomonas putida KT2440
MAYYRTPHDVTALPAWQALQKHRDAMQSFSMREAFAADAKRFDQFSLSACGLFLDYSKNLITEQSRDLLVNLANEVGLQDAIKSMFSGEIINASEGRPVLHTALRRPVGDKLSVNGVNVMPEVHKVLNQITELVGRIHDGLWRGYSEKPITDVVNIGIGGSFLGPELVSEALLPYAQRGVRCHYLANIDGSEFHELSANLRAETTLFIVSSKSFNTLETLKNAMAARTWYLAQGGSEAELYRHFIAVSSNKAAAVAFGIREENIFPMWDWVGGRYSLWSAIGLPIALAIGTANFKELLSGAYTMDQHFQTAPFDKNMPVLLALLGVWYGNFWDANSHAILPYDHYLRNITKHLQQLDMESNGKSVLQDGTPVKTDTGPVIWGGVGCNGQHAYHQLLHQGTQLIPADFIVPVVSFNPVADHHQWLYANCLSQSQALMLGKTREEAEAELRAKGLNEADIEKLAPHKVIPGNRPSNTLVVERISPRRLGALVAMYEHKVFVQSVIWGINAFDQWGVELGKELGKGVYQRLVGSLEDSAEDGSTQGLINYFRGRHRG

SEQ ID NO: 2946 - protein, 547 aa, Synechococcus sp. RS9917
MSTERITDDLDRLLALLPADVGEALQPEARRDQLLEVVLDLGRVPEARYPGRSLALGERCLTREDLQSTVERLGQFGADNRAGIERTLHRISAIRNRRGDVVGLTCRVGRAVFGTVALVRDLLDSGQSLLLMGRPGVGKTTALREIARVLADELEKRVVVIDTSNEIAGDGDIPHPAIGRARRMQVARPELQHQVMIEAVENHMPEVIVIDEIGTELEAQAARTIAERGVMLVATAHGNALANLIKNPTLCDLVGGIESVTLGDEEARRRRSQKTVLERAAEPTFPLAVEMHSRHRWAVHADVGRTVDLLLRGQTPRPQERSLAADGSVQLVESPDPVIGASRPRARPMRQLRQAHAAAPQLAAVPTPDPVATSLPEAVDSVSPAEDALQVLCCGLTPRLVEEASRRHRWPVRLVDDLAEADVVLSVRQGLGRQPGLRRQAREARVPILVIKADTLPQVERALERLLSRRAGAEPPAVSEDQADALAALEECRLAVERVVVPQGRPVELLPRTEDVRRMQADLVARYRLRSDVFGRADQQRLRVFPP

SEQ ID NO: 2947 - protein, 437 aa, Coprinopsis cinerea okayama7#130
MTDLFVQASGPLRTKRNFKGLALSAEPPSPPPPGGKKRPPPLGAAMALGGGPAPLGGLPLLDDLPGESPATGRHSAMQATLSDKLAKLELKKRIKDLKNDDLKKLSDLGQGNGGSVEKVEHLPTGTIMAKKSVLIDAKSSVRKQILRELDIMHECQSDYIISCFGSFLAEPNICICMEFMDKGSFDGIYKKLGPLQVEVVGMVALSVLEGLTYLYDVHRIMHRDIKPSNILFNSQGQIKLCDFGVSGEVINSIANTFVGTSVYMSPERIQSHGDGYSVKSDVWSLGMSLVELALGAFPFTDPPDDDDDDLSDLEGDSSSPSPSDAQHQRTPTHRDSFLLSKKTAKRASKRRSKLTYNPDGQLSTMSIFELIHQIVQEPSPRLPSDKFPADAVDLVDICLLKNPEERQTPKALLVRNHPWIVAIRESDFDIQAFAATV

SEQ ID NO: 2948 - protein, 130 aa, Candidatus Desulfococcus oleovorans Hxd3
MATALMDYISTDAAPAAVGPYSQAVKSGNLLFCSGSIGLVPGAKMLAGTDTASQARQALENMGAVLKAAGLGPDQVVKTTIFLVDMADFALVNDIYAGFFGGHKPARSTVQVAGLPLGARVEIECMAVFS

SEQ ID NO: 2949 - protein, 1457 aa, Aspergillus nidulans FGSC A4
MDNDGPPEKEQTPASNLHQVYSQEKRVADSHDTLVVPPGTPTGATSTETLALAHPYPPTTSTAPVKNTTWRLTDQVVKNRDRDRAAGYKPRELGVTWQGLSVEVPTAEASVNENLFSQFNIPQVAKDYFRKPPVRPILSDSHGCVKPGEMLLVLGRPGSGCTTLLNLLSNRRQGYRMIKGDVRFGTMDPKEAERYRGQIVMNTEEELFYPHLQVGATMDFATKLKVPAHLPDGADSIDGYVKETKDFLLESMGISHTAHTKVGNEFVRGVSGGERKRVSIIECLATRGSVFCWDNSTRGLDASTSLEWAKALRAMTDVNGLATIVTLYQAGNGIYNLFDKVLVLDEGKQIYYGPAAEAKPFMEELGFVYTEGGNIGDFLTGVTVPTERRIKPGYESRFPRNADEIRALYEKSPIYSQMIAEYDYPQTPLAKERTEAFKESVAWEQAKELPKGSSLTVGFWSQLLACTIRQYQILWGEKSTFLMKQVLSLAMALIAGSCFYDAPDDSSGLFIKGGGVFFAVLYNNIVAMSEVTESFKGRPVLVKHKSFAMYHPAAFCLAQIMADFPVLLFQCTIFSVVMYWMIGLKHTAAAFFTFWAILFTITLCLTAMFRCIGAAFKTFEAASKISGTAVKGIVMYAGYMIPKPDVRNWFVELYYTNPFAYAFQAALSNEFHDQHIACVGENLIPSGPGYEDVGAGHQACAGVGGALPGAAYVTGDQYLGSLHYKFTQLWRNYGVVWGFWGLFAVLTIIFTTFWNAGAGSGSTLFVPREKIKQHQRHKDEESQSQVGAATARDGGDTSLDEGNISRNTSIFTWQNLTYTVNTPTGERVLLDKVNGYVKPGMLGALMGSSGAGKTTLLDVLAQRKTDGTIKGSIMVDGRPLPVSFQRSAGYCEQLDIHEEYATVREALEFSALLRQPRTTPREEKLKYVDTIINLLELQDLADTLIGGVGNGLSVEQRKRVTIGVELVAKPSILIFLDEPTSGLDGQSAYNTVRFLRKLADIGQAILVTIHQPSAQLFAEFDTLLLLARGGKTVYFGDIGENGRTIKQYFGKYGAQCPVEANPAEFMIDVVTGAIPEVKDNDWHQIWLESPENAKMIKDLEDMIADAASKPPGTHDDGFEFSMPLWEQIKIVTHRMNVSLYRNTNYINNKFSLHIISALLNGFSFWRAGPKTGVSDLNLKMFSIFNFVFVAPGVINQLQPLFIQRRNIYDAREKKSKMYSWISFVIGLIVSEFPYLCVCAVLYFLCWYYCVKLPYDSSRAGSTFFIMLIYEFIYTGIGQTIAAIAPNATFAALVNPLIISILVLFCGVFVPYTQMNVFWKYWLYYLNPFNYVVSGMLTFGIWGNNVICNDDEYARFDPVNGTCAEYLKDYVTGSGWAINLANPEATSDCRVCQFRDGSDFLTTLNIKHYYYGWRDAGICVIFAISGLHRVLALGIQRISVQVSAMNTRDVTCFRALLP

SEQ ID NO: 2950 - protein, 738 aa, Burkholderia xenovorans LB400
MSSQVNYSTRIAEGTPFPLGATWNGSGVNFALFSAHATKVELCLFDETGENEIERIELPEYTDEVWHVFVPNLKPGAVYGYRVHGPYEPEKGHRFNPNKLLLDPYAKAHIGELKWAPEIFGYTLDSEEGDLSFDERDSAPFVPKCKVVDANFSWSHPERNALPWERVIFYEAHVRGFTKRHPEVPENLRGTFAGLGQQVVLDYIKNLGVTSVELMPIQTFVNDSYLLDKGLTNYWGYNTIGFFAADPRFFASSIDSVGEFKEMVDRFHNANLEVILDVVYNHTAEGNERGPTISFKGIDNASYYRLMPDEPRYYINDTGTGNTLNLSHPRVLQMVTDSLRYWVTEMKVDGFRFDLATILGRELHGFDEGGGFLDSCRQDPVLSSVRLVAEPWDCGPGGYQVGGFPPGWAEWNDRFRDTVREYWKGDEGKVPDLATRLTGSGDKFNHRGRRPWASVNFIAAHDGFTLNDLVSYNDKHNEANGEDNKDGHSDNKSWNMGVEGPTDDPDIRQQRERQKRNLLATLLLSQGTPMILAGDEFGRTQKGNNNAYCQDNEISWVDWEAIDDDGRALIEFVRNLTTLRHRLPVLRRGRFLTGEYNEALDVTDARWISPDGKDLSQEQWDDASMRCFGLVIDGRAQASGIRRPASDATLLLVLNAHHDVVNFTLPDIPEGQRWTCLLDTNMPVRSELPHFAAGDAYQVTARSLLLLALEAPSRATQRVFDRLEEQLTTEDSEPPAQA

SEQ ID NO: 2951 - protein, 484 aa, Agrobacterium tumefaciens
MIKLKNAALLRDACLVNGRWLKAADGKTIAVENPANSMIIGHVPSLSADEVEAAVESANKAFSEWSRRAAKDRAAILRRWFDLMVANADDLGALMTAEQGKPFAEARGEALYAASFVEWFAEEAKRVYGDTIPSPTTDKRITILKQPIGVCAAITPWNFPAAMITRKAAPALAAGCTMIVKPAEQTPLTALALGVLAEEAGVPAGVFQVVTGAARDIGKVFTESDTVRKISFTGSTEVGRLLMAQSAPTIKKLSLELGGNAPFIVFDDADLDAAVEGAIVSKYRNAGQTCVCSNRIYVQDGVYDAFAEKLVKRVESLSVGEGTEPGVLIGPLIDQDAVAKVEDHVADALGKGAKIVTGGKRHALGGTFYEPTVLTGATQAMKVAREETFGPVAPLFRFGTEDEAVAMANDTEFGLAAYFYTENVRRTWRVAEALEYGMVGHNTGLISNEVAPFGGVKQSGLGREGSHYGIDEYLEIKYLCSAIG

SEQ ID NO: 2952 - protein, 325 aa, Streptococcus parasanguinis
YHPDINKEPGAEEKYKEVQEAYETLSDDQKRAAYDQYGAAGANGGFGGAGGFGGFDGAGGFGGFEDIFSSFFGGGGASRNPNAPRQGDDLQYRVNLTFEEAIFGAEKEVKYNREASCSTCNGSGAKPGTSPVTCGRCHGAGVINVDTQTPLGMMRRQVTCDVCHGRGKEIKDPCTTCHGTGHEKQAHSVHVKIPAGVETGQQIRLAGQGEAGFNGGPYGDLYVVVSVEASDKFEREGTTIFYNLNLNFVQAALGDTVDIPTVHGDVELVIPEGTQTGKKFRLRGKGAPSLRGGAVGDQYVTVNVVTPTGLNERQKAALKEFAAAG

SEQ ID NO: 2953 - protein, 296 aa, Streptococcus parauberis
PDINKEAGAEQKYKDVQEAYETLSDSQKRAAYDQYGAAGAQGGFGGQGGFGGGFDGAGFGGFEDIFSSFFGGGGGMRNPNAPRQGDDLQYRVNLSFEEAVFGAEKEVTYNRESSCSTCNGSGAKPGTSPVTCGRCHGAGVINVDTQTPLGMMRRQVTCDVCHGTGKEIKEPCQTCHGTGHEKEVHKVSVKIPAGVETGQQIRLQGQGEAGTNGGPYGDLFVILNVLPSKQFERNGSTIYYTMNISFVQAALGANVDIPTVHGEVEMSIPAGTQTGKVFRLKGKGAPKLRGAGQGDQ

SEQ ID NO: 2954 - protein, 288 aa, Burkholderia xenovorans LB400
MSDTQRPTPPFPKQQQNHTPGHTAEMQPQPDHGERSYRGSGRLAGKAAIVTGGDSGIGRAVAIAFAREGADVLISYLDEDDDARETARWIEEAGRKAVLLPGDITNPAHCKAIVERAIEAFGRLDVLVNNAAYQMSYPSLDAISDQEWDKTFDTNIGAMFRITRAAVKHMKPGAAIVNTTSINADHPNPGLIAYAATKGAIQNFTGGLAQLLAEKGIRANCVAPGPIWTPLIPSTMPPEKVEQFGAQVPMKRPGQPAELAAAYVMLASDEASYISGATIAVTGGSPII

SEQ ID NO: 2955 - protein, 315 aa, Zea mays
MACSTASLAATLLAFALMFQACVAGRRRLTALVQEPAITMKYHKGALLSGPIAVNFIWYGDFTAPQRAVITDFVSSLSAAPRAAAQSQPEPSVSTWFKTARKYYDTSKARFPALRLGSHAVDRNCSLGRRLTERDLLRLAARGAPSRAINLVLTAADVAVDGFCASRCGTHGASPRSRAGRFAYVWVGNPASQCPGQCAWPFHQPVYGPQAPPLTPPNGDVGVDGMVISLASMIVGTVTNPFGNGFYQEGSADAPLEAATACAGVYGKGAYPGYAGALLVDPASGASFNANGAHGRKYLVPALVDPDTSSCATLG

SEQ ID NO: 2956 - protein, 326 aa, Streptococcus peroris
IHPDINKEPGAEEKYKEVQEAYETLSDEQKRAAYDQYGAAGANGGFGGGAGGFGGFGGGAAGFGGFEDIFSSFFGGGGSSRNPNAPRQGDDLQYRVNLTFEEAIFGTEKEVKYNREASCRTCNGSGAKPGTSPVTCGRCHGSGVINVDTQTPLGMMRRQVTCDVCHGRGQEIKDPCATCHGTGHEKQAHSVHVKIPAGVETGQQIRLAGQGEAGFNGGPYGDLYVVVSVEASDKFEREGTTIFYTLNLNFVQAALGDTVDIPTVHGDVELVIPEGTQTGKRFRLRGKGAPSLRGGAVGDQFVTVNVVTPTGLNERQKAALKEFAAA

SEQ ID NO: 2957 - protein, 311 aa, Streptococcus phocae
KNTRMFQEAYETLSDSQKRAAYDQYGAAGSQGGFGGGAGGFGGFDGAGFGGFEDIFSSFFGGGGGMRNPNAPRQGDDLQYRVNLSFEEAVFGVEKEVSYHREATCSTCSGSGAKPGTSPITCRKCHGSGAITVDTQTPLGMMRRQVTCDVCHGSGQEITDPCQTCHGSGQEKKKHTVSVKIPAGVETGQQIRLQGQGEAGFNGGPYGDLFVILNVLPSKKFERNGSTIYYSLNISFVQAALGDTVDIPTVHGDVEMSIPAGTQTGKIFRLKGKGAPKLRGGGQGDQHVTVTVVTPTKLNDQQKEALKAFAH

SEQ ID NO: 2958 - protein, 348 aa, Streptococcus pneumoniae
KSKKAYRKLSKKYHPDINKEPGAEDKYKEVQEAYETLSDDQKRAAYDQYGAAGANGGFGGAGGFGGFNGAGGFGGFEDIFSSFFGGGGSSRNPNAPRQGDDLQYRVNLTFEEAIFGTEKEVKYHREAGCRTCNGSGAKPGTSPVTCGRCHGAGVINVDTQTPLGMMRRQVTCDVCHGRGKEIKYPCTTCHGTGHEKQAHSVHVKIPAGVETGQQIRLAGQGEAGFNGGPYGDLYVVVSVEASDKFEREGTTIFYNLNLNFVQAALGDTVDIPTVHGDVELVIPEGTQTGKKFRLRSKGAPSLRGGAVGDQYVTVNVVTPTGLNDRQKVALKEFATAGDLKVNPKKKAS

SEQ ID NO: 2959 - protein, 474 aa, Arabidopsis thaliana
MVFFRSVSAFTRLRSRVQGQQSSLSNSVRWIQMQSSTDLDLKSQLQELIPEQQDRLKKLKSEHGKVQLGNITVDMVIGGMRGMTGLLWETSLLDPEEGIRFRGLSIPECQKVLPTAQSGAEPLPEGLLWLLLTGKVPSKEQVEALSKDLANRAAVPDYVYNAIDALPSTAHPMTQFASGVMALQVQSEFQKAYENGIHKSKFWEPTYEDCLNLIARVPVVAAYVYRRMYKNGDSIPSDKSLDYGANFSHMLGFDDEKVKELMRLYITIHSDHEGGNVSAHTGHLVGSALSDPYLSFAAALNGLAGPLHGLANQEVLLWIKSVVEECGEDISKEQLKEYVWKTLNSGKVIPGYGHGVLRNTDPRYVCQREFALKHLPDDPLFQLVSKLYEVVPPVLTELGKVKNPWPNVDAHSGVLLNHYGLTEARYYTVLFGVSRSLGICSQLIWDRALGLALERPKSVTMDWLEAHCKKASSA

SEQ ID NO: 2960 - protein, 608 aa, Orobanche densiflora
SGKPFYAIIHRVTGSLIIDFEPVKPHEVPMTAAGALQSYKLAAKAIACLQALPGGSMERLCDTMVQQVFELTGYDRVMIYKFHEDDHGEVFTEITKPGLEPYVGLHYPATDISQAARFLFMKNKVRMICDCRANHVKVVQDDNLPFDLALCGSTLRAPHGCHLQYMENMNPIASLVMSVVVSEGDEDGPNSSSSLDKRKRLWGLVVCHNTCPRFIPFPLRYACEFLVQVFSIHVNKELELKNQMLEKNILHTQTLLCDLLLRDVPLGIVSQSPNVMDLVKCDGAILLHKRTKYRLGLTPTDFQIRDIVSWLDEYHQDSTGLSTDSLYDAGFPGALALGHALCGMAAVKITDEDWLFWFRSHTAAEIRWGGAKHELGEKDDGKKMHPRSSFRAFLEVVKTRSLPWKDYEMDGIHSLQLILRNAYKESEEKDLESREIHARLNELQIGGVKEIEAVTSEMVRLIETATAPIFSVGLDGLVNGWNTKISDLTGLNVDEAIGMHFLALVEDSSADTVSKMLGLALQGKEEHDVQFEVKTHGQRRESGPISLIVNACASRDVNENVVGVCFIAQDITTQKSMMDKFTRIEGDYQSIIQNPNPLIPPIFGTDEF

SEQ ID NO: 2961 - protein, 611 aa, Orobanche fasciculata
SGKPFYAIIHRVTGSLIIDFEPVKPHEVPMTAAGALQSYKLAAKAITRLQALPSGSVKRLCNTMVQEVFELTGYDRVMVYKFHDDDHGEVFAEITKPGLDPYVGLHYPATDIPQAARFLFMKNKVRMICDCKAYHVKVVQDDNLPFDLTLCGSTLRAPHSCHLQYMENMNSIASLVMSVVVNEGDEDVPDSSSGPDKRKRLWGLVVCHNTSPRFVPFPLRHACEFLTQVFAVHVTKEWELENQLLEKNILRTQTLLCDLLLRDSPLGIISGSPNVMDLVRCDGAVLLHKNTIYRLGQTPTDLQIRDIVSWLDEYHRDSTGLSTDSLYDAGFPGALALGNAVCGMTAAKVTDKDWIFWFRSHTAAEVHWSGAKHEPGEKDDGRKMHPRSSFKAFLEVVKTRSLPWKDYEMDAIHSLQLILRNASIENVEKESEGGETHARLNELQLNGVKEIEAVTSEMVRLIETASVPIFAVDLDGLVNGWNTKIADLTGLGVNEAIGRHFLALVEDSSADTVSKMLDLAMQGKEEQNVQFEIKTHGRRSESGPITLIVNACASRDVQENVVGVCFIAHDITTQKSMMDKFTRIEGDYRSIIQSPNPLIPPIFGTDEYGWN

SEQ ID NO: 2962 - protein, 1112 aa, Arabidopsis thaliana
MTMMSDLSLDLVEEILCRVPITSLKAVRSSCKLWNVLSKNRILCKTEARNQFLGFTIMNHRLYSMRFNLHGIGLNENSEEFIDPSIKPIGNLLNQVEISKVFYCEGLLLCVTRNHSSKLVVWNPYLGEIRWIKTRNDYHIGVTYALGYDNNKNHMILRFFSEQGYYEIYDMNSSDSWDCFYGIPNKGLKCYQPGASLNGNAYFLTEGREVMEGYDCLLGFDFTTKKFGPLLSLSFSHDFIETGRLSCVKGEKLAVLYQRCYTYEMEVWVTTKIEPNAVSWSKFLAVEMEPLTSLKFNDDSGSFFIDEEKKIVVVFDIDESERNNTAYIIGDYGCLKEVDLDEVVNPQESVEVGDRIYSFSPFVCSCSYVPSLVKFKEDAEHERKDKKRKSKRKRTNKDGYDFILCFDFTTERFGQILPLPFKHSFRDTWTLSSVKEEKLAVAVLYWKNTCVMIEIWMTIKIDPNVESWSKFLRVDRKPCIDLRFDDRNDSFFIDEEKKVVVFFSSDKVKTSTAYVIGDNRYLRTVDLEKAANSQESVEVGERVYCFSPLVCSCSYYVPSLVKINHNAGRKRKEKKTKRKSKDKQMKLSNKVPGFCFPQCYVLISSNTWYRDVDGEPIVDFDDFGNDREPSTEPLQDFDEDLADDIGDWDGEGSQTPVYDNDKVAKPRKRLVKKSSSERVTIDVPELIDEDVDDAEFDEFMGGRGGGSTDYDDKVGRKRKKEKERSSSGSGKEKRHKFPNRGERKSEEIDEMWKSIAHNPENDEEGVRTMDDDNFIDDTGLDPSERYGGDAGDRSPTHYPQAEEGEDEDEVNNLFKMGKKKKKTERNPAEIALLVENVMAELEVTAEEDAELNRQGKPAINKLKKLSLLTDVLGKKQLQTEFLDHGVLTLLKNWLEPLPDGSLPNINIRAAILRVLTDFPIDLDQYDRREQLKKSGLGKVIMFLSKSDEETNSNRRLAKDLVDKWSRPIFNKSTRFEDMRNLDEDRVPYRRPPVKNFSSCSTGDRPSNKATMESRDGDFDLEIRERKTGLTSGQSSRGDRQMTMRPEATPLDFLIRPQSKIDPDEIIARAKQVSQDQRRVKMNKKLQQLKGTKKKRLQATKVSVEGRGMIKYL

SEQ ID NO: 2963 - protein, 387 aa, Cryptococcus neoformans var. neoformans B-3501A
MGKGVLKAVENVNKVIAPALIDSKLPVTSQKEIDDLLIKLDGTENKGKLGANAILGVSMAVSEAAAADKGVPLYGYLAQLAGVSEPYVLPVPAFNVINGGSHAGNALAFQEFMLLPTGASSFTEAMKMGSETYHTLKKVITKKYGIDAANVGDEGGFAPNVSGAEESLDLLTEAIKQAGYTGKVQIGLDVASSEFFKEGKYDLDFKNPNSDSSKWLSGKELADLYHGYCEKYDICSIEDPFHEDDFDAWAAYNQTAKIQIVGDDLLVTNPRRIKMAIEKKACNALLLKINQIGTISESIQAVQLAQSNGWGVMTSHRSGETESTYIADLAVALRTGEIKTGAPCRSERMAKYNQLLRIEEQLEGKSIFAGGKGLSKGTTAPELHSSK

SEQ ID NO: 2964 - protein, 937 aa, Ralstonia eutropha JMP134
MNALTRAERALVESTEPSVTFTLNGREVSAQPGESLLKVAQREGFDVPHLCYKDGLDTAGNCRACMVEIQGERVLAPSCCRYPSQGMTVQTESERALRAQRTVLELLQSDMPETDYTRHNELDQWSARLDVGKPRFAPRERLAADLSHPAIAVNLDACIQCTRCVRACRDEQVNDVIGLALRGDAARIVFDMDDPLGASTCVACGECVQACPTGALMPARDAALAVPDQQVDSVCPYCGVGCQLTYNVKDNRILYVEGRDGPANHERLCVKGRYGFDYVQHPQRLTMPLIRREGVPKRGDFVMDPDHVMDVFREATWEEALALASGKLAQIRDTHGKRALAGFGSAKGSNEEAYLFQKLVRTGFGSNNVDHCTRLCHASSVAALLEGIGSGAVSNPVMDVDRAELVIVIGANPTVNHPVAASWIKNAVKNGTKLVVADPRRSDLARFAWRFLQFTPDADVALLNAMMHVIVSDGLVDQHFIDSRTIGFEELQRNVAAFSPELMAPICGIDAQTIREVARAYATSKASMILWGMGVSQHVHGTDNARCLIALALMTGQIGRPGTGLHPLRGQNNVQGASDAGLIPMMYPDYRRVDDPDAIASFEALWGMPLDRQPGLTVVEIMDAIGRGEVRGMYIMGENPAMSDPDAEHAREALAALDHLVVQDIFLTETAYLADVVLPASAFPEKTGTFTNTDRTVQLGRQALLPPGQARQDLWIIQQMAQGLGLDWHYGNVAEVFDEMRQAMPSIGGVTWERLEQDGAVTYPCHAEGDPGEPVIFTDRFPTPTGRGRFVPADIIPADERPDTDYPMVLITGRQLEHWHTGSMTRRAGVLDAIEPDAVALVHPLDLGLLGGQPGDVITLASRRGEVSLYARADAGTPRGAVFVPFCYYEAAINKLTNAALDPFGKIPEFKYCAIRMTLGGVAPAQSSYGGGKVLGA

SEQ ID NO: 2965 - protein, 429 aa, Yersinia pestis CO92
MSHRELEQRRKEATPRGIGVLCDFYAVRAENATLWDEQGREYIDFTAGIATLNIGHRHPKVMAAVRQQLDQFTHTAYQVVPYASYVTLAEKINSLAPISDSNMTAAGNSKTAFFTTGVEAIENAVKIARAATGRPGVIAFSGAFHGRTLLAMALTGRAVPYKVGFGPFPASIFHALYPNELYGVSVEEAISSVERLFRCDISPTQVAAILFEPIQGEGGFNIAPPEFVSALRTLCDEHGILLIADEVQTGFARTGKLFAMEYYPDTKVDVITMAKSLGGGMPISAVTGRADIMDAPLPGSLGGTYAGNPLAVAASLAVLDIIAEEKLCERALILGAKLVDVLEKAQMSNAAIVGIRARGSMVAVEFNDPVSGKPSPELTRAYQRQALEEGLLLLSCGVHSNVIRFLYPLTIPDKQFKQAMNILTRLLAS

SEQ ID NO: 2966 - protein, 295 aa, Listeria monocytogenes EGD-e
MEKKVGTDRVKRGMAQMQKGGVIMDVVNAEQAKIAEEAGAVAVMALERVPSDIRAAGGVARMADPRIVEEVMKAVSIPVMAKARIGHITEARVLEAMGVDYIDESEVLTPADDEFHLLKSDFTVPFVCGCRDIGEALRRIGEGAAMLRTKGEPGTGNIVEAVRHMRQVNGQIRQIAGMTDDELMVAAKNFGAPYELIKEIKTLGKLPVVNFAAGGVATPADAALMMELGADGVFVGSGIFKSDNPAKFASAIVQATTYYTDYELIGKLSKELGSPMKGIEMSRLNPEDRMQDRSF

SEQ ID NO: 2967 - protein, 293 aa, Thellungiella halophila
MLKVPEHQVAGHIAIDGKLGPLVDDQGRFFKPLQDDARGENEAKFYESFSANKNVPDHIHRYFPVYHGTQLVEASDGSGKLPHMVLEDVVSEYSNPSIMDVKIGSRTWYPDVSEEYFKKCIKKDRETTTVSLGFRVSGFKIFDHQESSFWRPEKKVVLGYKVDGARLALKKFVSSNSPVESKSMPNCAFASEVYGGPNGILAQLLELKAWFETQTIYHFNSCSILMVYENDSMLMKGGDDAQMPRAQVKLVDFAHVLDGNGVIDHNFLGGVCSFIKFIQDILETDTSQLENGH

SEQ ID NO: 2968 - protein, 518 aa, Gloeobacter violaceus PCC 7421
MERSCRYCLEGAVANPIEKIKDEKPGLAVKAELIEFARLGWEAISKGDLERLKWIGWFFRKKTPGRWMVRLRVPGGILSSEQLRVVGGILAEFSDVKQLDITTRQNLEMRGLRIEDSVSIQERLEAVGLTTVQSGMDNVRNIVGSPVAGIDPDELIDVRPLVQQMQDLITEGGRGSFAFSNLPRKFNISITGDRENSAHAEINDIGFIPARREERIGFNVLVGGVLNSQRATPALPLDAFVLPEQVAPLCAAVLRIYSDHGPREARTRARLIYLLEDWGISKFRAAVEADLGFALPPAAHEEFIDYDKRDHVGVWPQKQAGYCFVGLHVPIGRLWAHQALEVADLAEVYGQGEVRLTVEQSFLIPHVAEEKLEALLVEPLLAVFSPEPNPLLRGLVSCTGAQFCNLAIIETKERALKLAHVLASELDLPQPVRIHWSGCPNSCGQPQIGDIGLIGTRTKVAGQSVDAVDILMGGQVGREARFGEVVREGVPCDELAAVLKGLLIEHFGAEERPVALAS

SEQ ID NO: 2969 - protein, 251 aa, Pseudomonas putida KT2440
MRRPMVAGNWKMHGTRASVAELTKGLSNLALPSGVEVAVFPPALFINQVIDGLAGKEITVGAQNSAVQPEQGALTGEVAPEQLVEAGCKLVLIGHSERRQIIGETDEVLNRKFAAAQAKGLKPVLCIGETLEEREAGKTLEVVGRQLSSIIEAFGVKAFADAVIAYEPVWAIGTGLTATPQQAQDVHAAIRGQLAAEDAEVAAKVQLLYGGSVKAANAAELFGMPDIDGGLIGGASLNADEFGAICRAAGN

SEQ ID NO: 2970 - protein, 549 aa, Xanthobacter autotrophicus Py2
MLHRTDGGAVAYAPVPELLDTSVAEFGDRTALSFFGRKWTYAQLGKLVDQVAAGLQAQGVRKGVKVGLCLPNTPYSVIFFFAIMKAGGTVVNFSPLYVERELRHQIRDSGTMIMVVPDLKLIHSRVAAVAQEAGLKTIVVCPMSGILPFPKGLLFNLFKRKEKAEFSLGDGLHLAYGALLRHGDRPQPVEVDVENDVAVLQYTGGTTGVPKGAMLTHANISANAEQVITHADCRRIGVKRVLGVLPLFHVFAMQTVMLIPICLGAEIILVPRFQLSDLLDRIEREKPTMFPGVPTIYAAINGVADIDKRDLKSLTLCISGGAPLPAEVRERFEDLTGCKLVEGYGLSETSPVVTANQPLGRVKDGSVGTALPQTVIEIRDLEDVRRIVPQGQKGEVCVRGPQVMKGYYNRPDDTASAFIDGALRTGDVGYLDEDGYLFLVDRIKDVILCGGYNVYPRVIEEALYLHPAVAEAVAIGVPDPYRGQAPKAFVTLRADSEATPGELMDFLTAQISKIEMPKAVEIRDSLPKSVVGKLSKKELVEEERQREQG

SEQ ID NO: 2971 - protein, 448 aa, Echium gentianoides
MANAIKKYITAEELKKHDKEGDLWISIQGKVYDVSDWLKDHPGGKFPLLSLAGQEVTDAFVAFHSGSTWKFLDSFFTGYYLKDYSVSEVSKDYRKLVFEFNKMGLFDKKGHIVLVTVLFIAMMFAMSVYGVLFCEGVLVHLLAGGLMGFVWIQSGWIGHDAGHYIVMPNPRLNKLMGIVAGNCLSGISIGWWKWNHNAHHIACNSLDYDPDLQYIPFLVVSSKLFSSLTSHFYEKKLTFDSLSRFFVSHQHWTFYPVMCSARVNMFVQSLIMLLTKRNVFYRSQELLGLVVFWIWYPLLVSCLPNWGERIMFVVASLSVTGMQQVQFSLNHFSASVYVGQPKGNDWFEKQTCGTLDISCPSWMDWFHGGLQFQVEHHLFPKLPRCHLRKISPFVMELCKKHNLSYNCASFSEANEMTLRTLRDTALQARDLTKPLPKNLVWEALNTHG

SEQ ID NO: 2972 - protein, 326 aa, Streptococcus pyogenes
KFHPDINKEAGAEQKYKDVQEAYETLSDSQKRAAYDQYGAAGAQGGFGGGAGGFGGFDGGGFGGFEDIFSSFFGGGGSRNPNAPRQGDDLQYRVNLSFEEAVFGVEKEVSYNREATCGTCLGSGAKPGTAPVTCRKCHGSGVMTIDTQTPLGMMRRQVTCDICHGSGKEIKEPCQTCHGTSHEKQAHKVSVKIPAGVETGQQIRLQGQGEAGFNGGPYGDLFVILNVLPSKQFERNGSTIYYSLDISFTQAALGDTVEIPTVHGDVEMAIPAGTQTGKTFRLKGKGAPKLRGGGQGDQHVTVNIVTPTKLNDAQREACKHCRSEGK

SEQ ID NO: 2973 - protein, 116 aa, Glycine max
  misc_feature (10)..(10): Xaa can be any naturally occurring amino acid
  misc_feature (27)..(27): Xaa can be any naturally occurring amino acid
  misc_feature (47)..(47): Xaa can be any naturally occurring amino acid
  misc_feature (60)..(60): Xaa can be any naturally occurring amino acid
  unsure (1)..(116): unsure at all Xaa locations
HIPHRAPDLXAKLTFLLVLGLIQALLXTGNWRIYELRDYSKTVRTDXNISRGEPDDDTNXPETELLTIAQFKLRLCTGTDGIPWRDLNSIAMLQRPMVVHMRDTGHTHHFTAYKHD

SEQ ID NO: 2974 - protein, 694 aa, Burkholderia xenovorans LB400
MQNDPALDQLCINTIRTLSMDAVQKANSGHPGTPMALAPVAYHLWQNHLRYDPDEPLWPDRDRFVLSVGHASMLLYSLLHLANVKAVDDDGNPTDGPAVSLDDIEHFRQMGSKTPGHPEYRMTTGVETTTGPLGQGLGNSVGMAMAARWYESHFNKPDAPLFDYRVYALCGDGDMMEGISHEAASLAGHLKLSNLIWIYDSNRVTIEGHTDLAYSDDVETRFRGYNWHTLHVSDANDAAALEAAFVEAKSITDRPTLIVVHSIIGWGAPHKQDTSAAHGEPLGVEEVALAKKAYGWPEDKFFYVPDGVHERFAAGIGARGKAAREEWQAKYDAYSRKYPELAREFAQIEAHELPAGWDSDIPTFDADPKGVASRESSGKVLNAIAARVPWMIGGAADLSPSTKTNLKFEGAGSFEYDNYGGCNLHFGIREHAMGAAVNGLALSNLRPFGSTFLIFSDYMKPPIRLSAIMEVPAIYVFTHDSIGVGEDGPTHQPIEQLASLRGVPGLTVLRPGDANEVAEAWRVALADPRRPSCIVVSRQPLPTLDRSRYAAAKGTQKGAYVLADAADGQKPQVILIATGSELSVCVDVYEKLTSEGIAARVVSMPSWDIFERQDEAYQDSVLPPDVDARVAVEQAASLGWDRYVGRLGAQVVMHTFGASAPLAELKKKFGFTPEHVYEAAKQQIARVQGKRSQE

SEQ ID NO: 2975 - protein, 375 aa, Dechloromonas aromatica RCB
MQPLSPAVIHHGSAGLFLAALAAAFLRLPATEAPAFVPPPVVASPLPADMTRSNLPSAGATAGPASLTLLADGKVAAAWLAGPGNDNSAATIWLSILGRSGWSQPLPAATRESTAAGTFAHMSSLGRPLLLAEGSWLHLWYESLPLGSGAGAAIVHSLSTDGGKTWSKAERLQTSPLGTLGNGLGGPPLMLADGGLGLPLDQRFPKQGSEWLRLSATGRIVDKRRLAHAAPTLQPAVVALDDHRGLAVLRDNRAGTSRATLSTTNGGQTWETASELALPAPDAPVALLRLASGRLLLAGNPQQGKEALQLWLSADDGQTWAMKRIVEAASDGGAEFADPALLQGRDGRIHLTYTWRQQQIRYVAFTEAWLAGGAP

SEQ ID NO: 2976 - protein, 448 aa, Echium pitardii var. pitardii
MANAIKKYITAEELKKHDKEGDLWISIQGKVYDVSDWLKDHPGGKFPLLSLAGQEVTDAFVAFHSGSTWKLLDSFFTGYYLKDYSVSEVSKDYRKLVFEFNKMGLFDKKGHIVLVTVFFIAMMFAMSVYGVLFCEGVLVHLLAGGLMGFVWIQSGWIGHDAGHYIVMPNPKLNKLMGIVASNCLSGISIGWWKWNHNAHHIACNSLDYDPDLQYIPFLVVSSKLFSSLTSHFYEKKLTFDSLSRFFVSHQHWTFYPVMCSARVNMFVQSLIMLLTKRNVFYRSQELLGLVVFWIWYPLLVSCLPNWGERIMFVVASLSVTGLQQVQFSLNHFAASVYVGQPKGIDWFEKQTCGTLDISCPSWMDWFHGGLQFQVEHHLFPKLPRCHLRKISPFVMELCKKHNLSYNCASFSQANEMTLRTLRDTALQARDLTKPLPKNLVWEALNTHG

SEQ ID NO: 2977 - protein, 403 aa, Oryza sativa (japonica cultivar-group)
MFGTPASSPLFGTPSTTPAFGAPSSTPAFGTPSTNPAFGTPSSTPAFGAPSSTPSFGTPSTAPAFGTPSSTPAFGAPSSTPAFGAPFSTPAFGVAPSPSPSPFGFQQQMTPSPSPFGFAGGGGGQITTQMAPVAPLPLSPSDRDIQAIVDAYKEDPGNPRYAFRHLLFSVTEPSQRVKPVAASDIMWAEAMGKLEGMDSSDRERLWPQLVQGFKDLSYRLKLQDGVLVSDSDRLSMTRDNVKKLQRHFQADTYPWIQRLKQQELVIERRLLRIMRIVEALENRGYRIPLTKEEADLYERLAVIAKQLKGPTGDLHRRVYNLLSTSRLLASAGGTAGPIYIPSSAKVDEQSVAELLEALQQQTEAVAKLGNVMKRDTRDLEIILSEDTDMAEDSVGRRALKMYN

SEQ ID NO: 2978 - protein, 298 aa, Streptococcus ratti
  misc_feature (269)..(269): Xaa can be any naturally occurring amino acid
  unsure (1)..(298): unsure at all Xaa locations
AAYDQYGSAGTDGGFGGFDSSGFGGFEDIFSSFFGGGASRNPNAPRQGDDLQYRVNLQFEEAVFGTEKEVHYNREATCHTCKGSGAKPGTSPITCGKCHGSGVINVDTQTPLGMMRRQVTCDVCHGSGKEIKEPCQTCHGTGHEKQSHKVSVKIPAGVETGQQIRLAGQGEAGFNGGPYGDLFVIINVLKSDKFERDGSTIYYSLNINFVQAALGDTVEVPTVHGNVELAIPAGTQTGKTFRLKGKGAPRLRGNGQGDQHVTVKVVTRXKLNDAQKEALQAFAKASGIDPVHPKKKGF

SEQ ID NO: 2979 - protein, 317 aa, Streptococcus sanguinis
HPDINKEAGAEDKYKEVQEAYETLSDEQKRAAYDQYGAAGANGGFGGGAGGFGGFDGSGFGGFEDIFSSFFGGGASRNPNAPRQGDDLQYRVNLRFEEAIFGAEKEIKYNREATCRTCDGSGAKPGTSPVTCGRCHGSGVINVDTQTPLGMMRRQVTCDVCHGRGKEIKSPCETCHGTGHEKQAHSVKVKIPAGVETGQQVRLSGQGEAGFNGGPYGDLYVVVQVEPSDKFERDGSTIYYKLNLNFVQAALGDSVDIPTVHGDVELNIPEGTQTGKRFRLRGKGAPSLRGGSMGDQYVTVNVVTPTGLNDRQKAALK

SEQ ID NO: 2980 - protein, 294 aa, Streptococcus thoraltensis
HPDINKEPGAEEKYKEIKEAYDTLGDEQKRANYDQFGPEGAANGGFGGGAGGFSGFDSAGFGGFEDIFSSFFGGGGASRNPNAPRQGDDLQYRVNLKFEEAIFGTEKEVHYNREVTCHTCDGSGAKPGTSPVTCSKCHGSGVINVDTQTPLGMMRRQMTCDVCHGSGKEIKEPCPTCHGSGREKQRHKMAVTIPAGVETGHQVRVVGQGEAGFNGGPYGDLYVIINVLASDKFERDGSTIYYNLDINFVQAALGDTVEVPTVHGAVDLKIPAGTQAGKVIRIKGKGAPRLNGNG

SEQ ID NO: 2981 - protein, 456 aa, Orobanche pinorum
SGKPFYAIIHRVTGSLIIDFEPVNPHEVPMTAAGALQSYKLAAKAITRLQALPSGSVKRLCDTMVQEVFELTGYDRVMVYKFHDDDHGEVFSEITKPVLEPYVGLHYPATDIPQAARFLFMKNKVRMICDCLANHVKVVQDDNLRFDLTLCGSTLRAPHSCHLQYMENMNSIASLVMSVVVNEGDEDGPDSSSGPNKRERLWGLVVCHNTSPRFVPFPLRYACEFLAQVFAVHVTKELEWENQLLEKNILRTQTLLCDLLLRNTPLGIVSGSPNVMDLVRCDGAVLLHKNTKYRLGLTPTDLQIRDIVSWLDEYHRDSTGLGTDSLYDAGFPGALALGNAVCGMTAARVTDKDWLFWFRSHTAGEVRWSGAKHEPVEKDDGRKMHPRSSFKAFLEVVKTRSLPWRDYEMDAIHSLQLILRNASRENDEKDLEGREIQARLNVLQIDGVKEIEAVTS

SEQ ID NO: 2982 - protein, 303 aa, Streptococcus uberis
YDQYGAAGAQGGFGGGGFGGFDGGGFGGFEDIFSSFFGGGGGMRNPNAPRQGDDLQYRVNLTFEEAIFGVEKDVSYHREATCHTCAGSGAKPGTSPVTCGRCHGSGVINVDTQTPLGMMRRQVTCDVCHGSGKEIKEPCQTCHGTGHEKETHKVSVKIPAGVETGQQIRLQGQGEAGFNGGPYGDLFVVLNVLPSQKFERNGSTIYYNLNISFVQAALGDTVDIPTVHGDVEMAIPAGTQTGKVFRLKGKGAPKLRGAGQGDQHVTVNIVTPTKLNEKQKEALRAFAEASGQEISNPKKKRLL

SEQ ID NO: 2983 - protein, 422 aa, Xanthobacter autotrophicus Py2
MHHFDYRNGRLFAEDVDITPLAAEVRTPFYCYSSATLERHYQVFMEAFSGRDVLLCYALKANSNQSVIATLARLGAGADIVSAGELARARAAGVPAERIVFSGVGKTREEMAAALDGGILCFNVESEPELAALSEVATAMGVSAPVSIRVNPDVDAKTHKKISTGKSATKFGIPISRAREVYDYAARLPGLAITGVDMHIGSQITDMAPFDNAVTLLAELARDLLAAGHRLHHMDLGGGLGVPYAASDPVPPPPSAYAEVVSRALGDLKLPLVFEMGRMLVANAGILVTRVIYVKEGEGKTFVVVDAAMNDLIRPTLYEAHHDIIPVVEPAADAPLVVADVVGPVCETGDFLALDRPLPRLKAGDLLAVMTAGAYGAVQASTYNTRPLVPEVLVRGAAAAVVRPRLEVADLIALDRPAPWLA

SEQ ID NO: 2984 - protein, 609 aa, Orthocarpus bracteosus
SGKPFYAIIHRVTGSMIIDFEPVKPHEVPMTAAGALQSYKLAAKAITRLQALSSGSMEQLCGMMVQEVFELTGYDRVMIYKFHDDDHGEVLSEITKPGLDPYVGLHYPATDIPQAARFLFIKNKVRMICDCRANHVKVIQDDNLPFDLTLCGSTLRAPHSCHLQYMENMNSIASLVMSVVVNEGNEDGPDSSSHPDEKKRLWGLVVCHNTSPRFVPFPLRYACEFLAQVFAIHVNKEIELKNQMLEKNILRTQTLLCDMLLRDAPLGIVSQSPNVMDLVKCDGAVLIYKTKKYRLGKTPSDFQIRDIVSWLDEYHRDSTGLSTDSLYDAGFPGALALGDAVCGMAAVRITNTDWLFWFRSHTAAEIRWGGAKHELGEKDDGRKMHPRLSFKAFLEVVKTRSLPWKDFEMDAIHSLQLILRNASNKKAEERDVEGKEIHARLNDLQLDGVQELEAVTSEMVRLIETASVSIFAVDVDGLVNGWNTKIADLTGLPVDKAIGKHFLALVEDSSAEVVNKMLELALQGNEEQNVLFEIKTHDLRSESGPISLIVNACASWDVKGNVVGVCFVAQDITIQKSMMGKFTRIEGDYRAIVQNPNQLIPPIFGTDEF

SEQ ID NO: 2985 - protein, 171 aa, Glycine max
  misc_feature (115)..(115): Xaa can be any naturally occurring amino acid
  misc_feature (119)..(119): Xaa can be any naturally occurring amino acid
  misc_feature (121)..(122): Xaa can be any naturally occurring amino acid
  misc_feature (124)..(125): Xaa can be any naturally occurring amino acid
  misc_feature (127)..(127): Xaa can be any naturally occurring amino acid
  misc_feature (129)..(129): Xaa can be any naturally occurring amino acid
  misc_feature (136)..(136): Xaa can be any naturally occurring amino acid
  misc_feature (139)..(142): Xaa can be any naturally occurring amino acid
  misc_feature (144)..(144): Xaa can be any naturally occurring amino acid
  misc_feature (146)..(146): Xaa can be any naturally occurring amino acid
  misc_feature (148)..(149): Xaa can be any naturally occurring amino acid
  misc_feature (152)..(152): Xaa can be any naturally occurring amino acid
  misc_feature (154)..(157): Xaa can be any naturally occurring amino acid
  misc_feature (159)..(160): Xaa can be any naturally occurring amino acid
  unsure (1)..(171): unsure at all Xaa locations
APPPPDELLNNISTINTDLDIEASGGYYDDLIARLLKLGCCKNKEIAVKTVKTIKFLGLHEETQIPKGCSSPLDVICQRMEQRMAYGHNEHDMVLFHHEVDVEYPDGQPAEMHLXTLLXFXXLXXAXPXCMALTVXIPXXXXAXFXKXXGPXDXXXXAXXPEFRCVKKPTK

SEQ ID NO: 2986 - protein, 570 aa, Candida glabrata CBS 138
MAGEKVELSSMDSAIEIRHVNQHAKEISSENKSESYDDNKEFEGSNRVVIKPVNDEDDVSVMINFNQGVSHFIIMLTFVASLSGFLFGYDTGYISSALISIGTDLDNKELTYGEKEITTAATSLGALIFALVAGFSVDIFGRKPCLMFSNIMFLIGAILQVTAHKFWQMTAGRFIMGFGVGIGSLIAPLYISEIAPKMIRGRLTVINSLWLTGGQLIAYGCGAGLNHVHNGWRILVGLSLIPTVLQFVFFIFLPDTPRYYVMKGDYEKAKSVLKRSYNGVSDELIDRKIEELLALNQSIPGKNHVERTWNAVKELHTKPANFRALIIACGLQGIQQFTGWNSLVYFSGTIFESVGFKNSSAVSIIVSGTNFIFTLVAFFCIDKIGRRNILIIGIPGMTVAHVMSAIAFHFIGIKFVGNTAIVEHSGFSSWGIVIIVFIIMFAAFYALGIGTVPWQQSELFPQNVRGVGTAFATATNWAGSLVIASTFLTMLQNITPTGTFGFFAGLCVVSFFFCYFCYPELSGLELEEVQTILQDGFNVQASKELAKKRKRQIAVLKKAKHQPTEEIIEE

SEQ ID NO: 2987 - protein, 344 aa, Gloeobacter violaceus PCC 7421
MHSAMLYGVEDVRLEEVPCPEPGPGEVLVRVAVAPTCGTDLKVWLRGGHARMLVPPTPFGHEFAGEIAALGEGVSGWRSGERVVANNSAPCFDCFYCRRERFSLCENLLFNNGTFAEYLRIPAAIVRHNLLAVPPGLPLELAAMSEPLACVLHGVEEAGVRAGDTVVVMGDGAIGLMLVAVCAVRGAAVILAGGQSARLAVAEQLGAQVTLNYRQAGDPVGRLRALTEGGRGADIVIEATGKPAAWEAAIATARPGATVLLFGGCPRGTAVSVDTENLHYNELTLKGVFHNTPRHVREALALIACRRIAFELLVSDSLPLGKLDEALARMRDRTAIKVAMLPGS

SEQ ID NO: 2988 - protein, 174 aa, Populus tremula
MSRDRDPLSVGRVIGDVLDPFTKSIPLRVTYNSREVNNGCELKPSQVANQPRVDIGGEDLRTFYTLVMVDPDAPSPSDPSLREYLHWLVTDIPATTGASFGHETVCYESPRPTMGIHRFVFVLFRQLGRQTVYAPGWRQNFNTRDFAEVYNLGSPVAAVYFNCQRESGSGGRRR

SEQ ID NO: 2989 - protein, 307 aa, Brassica napus
ASFTFGVSAGYTADTMSSIMTDLDLSLAQFSLFGSLMTFGGMIGAIFSAKAASALGNKMTLWLVDLFCITGWVAIALAKEIVLLDLGRFFVGIGVGLISYVVPVYVAEITPKHIRGAFTFSNQLLQNCGVAIAYYFGNFLSWRSLALIGIIPCGIQVIGLFFIPESPRWLAKEGRDEEVEVVLQKLRGKGHDIMLEARAIKISVEVSKQNSNTSIRSLFRKRYAHQLTIGIGLMLLQQLCGMSGIGSYGSTLFELGGFPARIGMTVLSLIVVPKSLLGLILVDRWGRRPLLMASAFGLCLSCITLAV

SEQ ID NO: 2990 - protein, 699 aa, Arabidopsis thaliana
MGCVSSKQTVSVTPAIDHSGVFKDNENECSGSGRIVVEDPPRPTLKKLVSWRSRSGKRRSQKSGSELGSESGRASDSLSFRLGNVSRYLEAEQVAAGWPAWLSNVAGEAIHGWVPLRSDAFEKLEKIGQGTYSNVFRAVETETGRIVALKKVRFDNFEPESVKFMAREILILRRLNHPNIIKLEGLITSKLSCNIQLVFEYMEHDLTGLLSSPDIKFTTPQIKCYMKQLLSGLDHCHSRGVMHRDIKGSNLLLSNEGILKVADFGLANFSNSSGHKKKPLTSRVVTLWYRPPELLLGATDYGASVDLWSVGCVFAELLLGKPILRGRTEVEQLHKIFKLCGSPPEDYWKKSKLPHAMLFKPQQTYDSCLRETLKDLSETEINLIETLLSIDPHKRGTASSALVSQYFTTKPFACDPSSLPIYPPSKEIDTKHRDEAARKKISGNGRRGIDPRKPSRKAHSFNRLAPDVRHQTETFQKRIGHLVHSSIESDARLCGKLQNPLDHKKDEASHVKHASQGDVPFSGPLQVSKSNSFAWAKREKDDVCVRVHNRSLSRGYIPSLSGHSPAFNGKSDVESKINKDEKEDKTDSRGEESYEMVKRSMLKQWRQLERPDSFGASDEYHSQELSLGLYQRDEMAKKMGNNLGDGDKIEFSGPLLSQSYGVDELLERHERNIRKLIRKPWFQKVQDKQKKILLFSSEL

SEQ ID NO: 2991 - protein, 509 aa, Arabidopsis thaliana
MLLHLLLLLCLSSSLKVQASVHEYRSERFVSKGNAFVFHGGSEGIYSSSPSDNFTSDSDSVSFIRFEKIKFQRPEEVSNRSSLSIHAVVFEVEDRENIGGSAYGGQRAVCCTSDLAKLGVCSHGDVIYRPSAKDSGWPQVFGVSLAENEFSVILPTRSIQVTRTGMYNLYFIHCDSDLKDLVVEGKTIWKNPTGYLPGRMAPLMYFYGFMSLAFVLLGIFWFSQCARFWREVLPLQNCLTLVITLGMCEMALWYFDYAEFNETGIRPTVITIWAVTFGSIKRTSARIIILMVSMGYGVVRPTLGGFTSKVIMLGVTFFIASEILELMENVGAVSDLSGKARLFFVLPVAILDAFFIIWIFKSLSATFKKLQTRRLLVKLDIYRKFTNALAVDILVSLGWICYELYFKSKDVYNEHWQNAWIIPAFWQLLSFSLLIVICSLWAPSQNSTRYAFSGSSGDTSAEFEKDDYTLTLIKPSPIPSHEVKNLSETRLLPADEGEPEKDLEEDKRE

SEQ ID NO: 2992 - protein, 284 aa, Roseovarius nubinhibens ISM
MPDDSFTPLQSPQRQPGLEHEMDPAPEYMPRHLGSDRLKGKVALITGGDSGIGRATAVLFAREGARVAIIYRDEERDAEKTRDLIEAEGSEALLIRGDVGDKDFCRAATDRTVETFGGLHILVNDAGEQHAQDDPTKIEEAQIERTFRTNIFGTIFMTQAALPHLERGARIICVTSITAYKGQDLLIDYASTKGAILSFIRAMSSKLASEGILVNGVAPGPIWTPLIPASFPKDAVEDFGKDAPLGRPGQPNEVAPALLFLACDDSSYMTGQVLHPNGGTLIGG

SEQ ID NO: 2993 - protein, 341 aa, Gossypium hirsutum
NSTQESHLRSDNAVTYESPYPLYAMALSSTPAVTHLNHQRIALGSFIEDYANRVHIISFDPESLTLTTHPSLSFDHPYPPTKLMFQPHRKSPFSSSSDLLASSGDYLRLWEVGHSSIELISILDNSKTSEFSAPLTSFDWNDVEPNRIGTSSIDTTCTIWDIEKGVVETQLIAHDKEVYDIAWGEARVFGSVSADGSVRIFDLRDKEHSTIIYESPQPDTPLLRLAWNKQDLRYMATTLMDSNKVVILDIRSPTMPVAELDRHGASVNAIAWAPQSYKHICSAGDDTHALIWELPTVAGPNGIGPLSMYSASSEINQLQWSATQPDWIAIAFSNKMQLLKV

SEQ ID NO: 2994 - protein, 346 aa, Gossypium hirsutum
MAASSDPNPEGSDEQQKRSEIYTYEAPWHIYAMNWSVRRDKKYRLAIASLLEHYNNRLEIVQLDDSNGEIRSDPNLSFDHPYPPTKTIFIPDKECQKPDLLATSSDFLRIWRISDDHSRVDLKSLLNGNKNSEFCGPLTSFDWNEAEPKRIGTSSIDTTCTIWDIERETVDTQLIAHDKEVYDIAWGGVGVFASVSADGSVRVFDLRDKEHSTIIYESSEPDTPLVRLGWNKQDPRYMATIIMDSAKVVVLDIRFPTLPVVELQRHQASVNAIAWAPHSSCHICTAGDDSQALIWDLSSMSQPVEGGLDPILAYTAGAEIEQLQWSSSQPDWVAIAFSTKLQILRV

SEQ ID NO: 2995 - protein, 246 aa, Myxococcus xanthus DK 1622
MRKLIRGLLDFQLNARSSYREKFALLAQEQKPDCLFIACADSRVVPNLLVSMDPGDLFVVRNVGNMVAPSDSKGQSTGDQSEAAALEFSLRSLPVEDIVVCGHSNCGAMKAVLAGGVGPENPNLKSWLEHGKAALQRMDANPTLGEGRSDYDRLSQNNVLLQLEHISTYPLVKERLDAGTLRLHGWWFDIATAQVHAWRPLLGRFIPMDELVGEALLRELGTDTHAPGALANGNGAQRMSVVARAQ

SEQ ID NO: 2996 - protein, 345 aa, Gossypium hirsutum
MENSTQESHLRSDNSVTYESAYTVYAMALSSTPSSTNINHQRIALGSFLEDYTNRVDIISFDPETLSFKTHPKLAFDHPYPPTKLMFQPNRKSASSSSSCSDLLASTGDFLRLWEVRESSIEPVTVLNNSKTSEFCAPLTSFDWNDVEPKRIGTSSIDTTCTIWDIEKCVVETQLIAHDKEVYDIAWGEARVFASVSADGSVRIFDLRDKEHSTIIYESPQPDTPLLRLAWNKQDLKYMATIQMDSNKVVILDIRSPTTPVAELERHHASVNAIAWAPQSCKHICSAGDDTQALIWELPTVAGPNGIDPLCVYSAGYEINQLQWSAAQPDWIAIAFSNKLQLLKV

SEQ ID NO: 2997 - protein, 321 aa, Streptococcus constellatus
PDINKEPGAEEKYKEVQEAYETLSDEQKRAAYDQYGTAGANAGFGGGTGGFGGFDGSSFGGFEDIFSSFFGGGGASRNPNAPRQGDDLQYRVNLKFEEAIFGTDKEIKYHREATCHTCHGSGAKPGTSPVTCSRCHGAGVINVDTQTPLGMMRRQVTCDVCHGRGQEIKEPCQTCHGTGHEKQAHSVHVKIPAGVETGQQVRLSGQGEAGFNGGPYGDLYVVVQVEPSDKFERDGSTIYYKLNLNFVQAALGDSVDIPTVHGDVELNIPEGTQTGKRFRLRGKGAPSLRGGSMGDQYVTVNVVTPTGLNDKQKAALKEFAE

(The sequence listing continues in the following parts.)

What is claimed is:

1. A plant cell nucleus comprising a stably integrated recombinant DNA construct wherein said recombinant DNA comprises a heterologous promoter that is functional in said plant cell and that is operably linked to a protein coding DNA encoding at least one protein having an amino acid sequence comprising at least 95% amino acid sequence identity to SEQ ID NO:936 and having the function of SEQ ID NO:936 and wherein said recombinant DNA construct is stably integrated into a chromosome in a plant cell nucleus which is selected by screening a population of transgenic plants that have said recombinant DNA and an enhanced trait as compared to control plants that do not have said recombinant DNA in their nuclei; and wherein said enhanced trait is selected from group of enhanced traits consisting of increased yield and enhanced nitrogen use efficiency.

2. The plant cell nucleus comprising a recombinant DNA construct of claim 1 wherein said protein coding DNA comprises a nucleotide sequence having at least 99% nucleic acid sequence identity to SEQ ID NO:177.

3. The plant cell nucleus comprising a recombinant DNA construct of claim 1 further comprising DNA expressing a protein that provides tolerance from exposure to an herbicide applied at levels that are lethal to a wild type of said plant cell.

4. The plant cell nucleus of claim 3 wherein the agent of said herbicide is a glyphosate, dicamba, or glufosinate compound.

5. A transgenic plant cell or plant comprising a plurality of plant cells with the plant cell nucleus of claim 1.

6. The transgenic plant cell or plant of claim 5 which is homozygous for said recombinant DNA.

7. A transgenic plant cell or plant comprising a plurality of plant cells with the plant cell nucleus of claim 1.

8. The transgenic seed of claim 7 from a corn, soybean, cotton, canola, alfalfa, wheat or rice plant.

9. A transgenic pollen grain comprising a haploid gamete of a plant cell nucleus comprising a recombinant DNA construct of claim 1.

10. A method for manufacturing non-natural, transgenic seed that can be used to produce a crop of transgenic plants with an enhanced trait resulting from expression of recombinant DNA in the plant cell nucleus of claim 1, wherein said method for manufacturing said transgenic seed comprising:

(a) screening a population of plants for said enhanced trait and said recombinant DNA, wherein individual plants in said population can exhibit said trait at a level less than, essentially the same as or greater than the level that said trait is exhibited in control plants which do not contain the recombinant DNA, wherein said enhanced trait is selected from the group of enhanced traits consisting of increased yield and enhanced nitrogen use efficiency, (b) selecting from said population one or more plants that exhibit said trait at a level greater than the level that said trait is exhibited in control plants, and (c) collecting seeds from selected plant selected from step b.

11. The method of claim 10 wherein said method for manufacturing said transgenic seed further comprising (a) verifying that said recombinant DNA is stably integrated in said selected plants, and (b) analyzing tissue of said selected plant to determine the expression or suppression of a protein having the function of a protein having SEQ ID NO:936.

12. The method of claim 10 herein said seed is corn, soybean, cotton, alafalfa, canola wheat or rice seed.

13. A method of producing hybrid corn seed comprising:

(a) acquiring hybrid corn seed from a herbicide tolerant corn plant which also has the plant cell nucleus of claim 1;

(b) producing corn plants from said hybrid corn seed, wherein a fraction of the plants produced from said hybrid corn seed is homozygous for said recombinant DNA, a fraction of the plants produced from said hybrid corn seed is hemizygous for said recombinant DNA, and a fraction of the plants produced from said hybrid corn seed has none of said recombinant DNA, (c) selecting corn plants which are homozygous and hemizygous for said recombinant DNA by treating with an herbicide;

(d) collecting seed from herbicide-treated-surviving corn plants and planting said seed to produce further progeny corn plants;

(e) repeating steps (c) and (d) at least once to produce an inbred corn line; and (f) crossing said inbred corn line with a second corn line to produce hybrid seed.

* * * * *